US008765931B2

(12) United States Patent
Feinstein et al.

(10) Patent No.: US 8,765,931 B2
(45) Date of Patent: Jul. 1, 2014

(54) DOUBLE-STRANDED OLIGONUCLEOTIDE COMPOUND FOR DOWN-REGULATING THE EXPRESSION OF CASP2 GENE

(75) Inventors: Elena Feinstein, Rehovot (IL); Evgenia Alpert, Jerusalem (IL); Igor Mett, Rehovot (IL); Amir Bar-Ilan, Haifa (IL); Igor Spivak, Haifa (IL); Hagar Kalinski, Rishon-le-Zion (IL); Netanja Slager, Tel Aviv (IL); James D. Thompson, Longmont, CO (US)

(73) Assignee: Quark Pharmaceuticals, Inc., Fremont, CA (US)

( * ) Notice: Subject to any disclaimer, the term of this patent is extended or adjusted under 35 U.S.C. 154(b) by 176 days.

(21) Appl. No.: 13/062,161

(22) PCT Filed: Oct. 22, 2009

(86) PCT No.: PCT/US2009/061570
§ 371 (c)(1),
(2), (4) Date: May 17, 2011

(87) PCT Pub. No.: WO2010/048352
PCT Pub. Date: Apr. 29, 2010

(65) Prior Publication Data
US 2011/0229557 A1 Sep. 22, 2011

Related U.S. Application Data

(60) Provisional application No. 61/198,931, filed on Nov. 11, 2008, provisional application No. 61/196,995, filed on Oct. 22, 2008.

(30) Foreign Application Priority Data

Feb. 15, 2009 (WO) .................. PCT/IL2009/000179

(51) Int. Cl.
C07H 21/04 (2006.01)
C12N 15/11 (2006.01)
(52) U.S. Cl.
USPC ........................................ 536/24.5; 514/44 A
(58) Field of Classification Search
CPC ........... C12Q 2600/178; A61K 31/713; C12N 2310/14; C12N 15/113
USPC ........................................ 536/24.5; 514/44 A
See application file for complete search history.

(56) References Cited

U.S. PATENT DOCUMENTS

| 6,602,858 | B2 * | 8/2003 | Beigelman ............... 514/44 R |
| 2003/0157030 | A1 * | 8/2003 | Davis et al. .................. 424/46 |
| 2005/0282188 | A1 | 12/2005 | Haeberli et al. |
| 2006/0172965 | A1 | 8/2006 | Shepard et al. |
| 2006/0217331 | A1 * | 9/2006 | Vargeese et al. ............... 514/44 |
| 2011/0112168 | A1 | 5/2011 | Feinstein et al. |

FOREIGN PATENT DOCUMENTS

| WO | WO 0224720 A1 * | 3/2002 |
| WO | WO 2004015107 A2 * | 2/2004 |
| WO | WO 2004/078940 A2 | 9/2004 |
| WO | WO 2004/103389 A2 | 12/2004 |
| WO | WO2006/023544 | 3/2006 |
| WO | WO 2006/023544 A2 | 3/2006 |
| WO | WO2008/050329 | 5/2008 |
| WO | WO 2008050329 A2 * | 5/2008 |
| WO | WO2008/104978 | 9/2008 |
| WO | WO 2009/044392 A2 | 4/2009 |

OTHER PUBLICATIONS

Vickers et al. (The Journal of Biological Chemistry, 2003, 278:7108-7118).*
Mucke, Hermann AM. (2007). "New ocular therapeutics: A view from the patenting perspective," IDrugs, 10(1) :1369-7056.
International Preliminary Report on Patentability, including Written Opinion of the International Searching Authority, issued Apr. 26, 2011 in connection with International application No. PCT/US2009/061570.
International Search Report, mailed Apr. 14, 2010 in connection with PCT International Application No. PCT/US2009/061570.
Second Office Action issued on Jul. 12, 2012, in connection with Chinese Application No. 200880110087.0, filed on Sep. 4, 2008.
Nov. 27, 2012 English translation of Response and claims, as filed in Response to 2nd Office Action, issued on Jul. 12, 2012, in connection with Chinese Application No. 200880110087.0, filed on Sep. 4, 2008.
Extended European Search Report, issued on Dec. 6, 2011, in connection with European Patent Application No. EP08808012.2, filed on Sep. 4, 2008.
Office Action issued on Nov. 20, 2012, in connection with European Patent Application No. EP08808012.2, filed on Sep. 4, 2008.
Jul. 2, 2012 Response to Extended European Search Report, issued on Dec. 6, 2011, in connection with European Patent Application No. EP08808012.2, filed on Sep. 4, 2008.
Office Action issued on Mar. 27, 2012, in connection with European Patent Application No. EP09748890.2, filed on Oct. 22, 2009.
Sep. 25, 2012 Response to Office Action issued on Mar. 27, 2012, in connection with European Patent Application No. EP09748890.2, filed on Oct. 22, 2009.
European Search Report and Opinion issued on Aug. 26, 2011, in connection with European Patent Application No. EP11170912.7, filed on Oct. 25, 2007.

(Continued)

*Primary Examiner* — Jon E Angell
(74) *Attorney, Agent, or Firm* — John P. White; Cooper & Dunham LLP

(57) ABSTRACT

The present invention relates to compositions and methods for inhibiting loss of a retinal ganglion cell in a subject, comprising non-invasively applying to the surface of the eye of the subject an ophthalmic composition comprising a therapeutically effective amount of at 5 least one siRNA which down regulates expression of a target gene associated with loss of the retinal ganglion cell, thereby inhibiting loss of the retinal ganglion cell in the subject. The methods of the invention also relate to the use of chemically modified siRNA compounds possessing structural motifs which down-regulate the expression of human genes expressed in retinal tissue in the mammalian eye.

9 Claims, 21 Drawing Sheets

(56) References Cited

OTHER PUBLICATIONS

Apr. 4, 2012 Amended Claims and Response to European Search Report and Opinion issued on Aug. 26, 2011, in connection with European Patent Application No. EP11170912.7, filed on Oct. 25, 2007.
Office Action issued on Aug. 1, 2012, in connection with European Patent Application No. EP11170912.7, filed on Oct. 25, 2007.
Sep. 25, 2012 Response to Office Action issued on Aug. 1, 2012, in connection with European Patent Application No. EP11170912.7, filed on Oct. 25, 2007.
Notice of Acceptance issued on Oct. 11, 2012, in connection with New Zealand Patent Application No. NZ591391, filed on Oct. 22, 2009.
Oct. 4, 2012 Response to Office Action issued on Jun. 1, 2011, in connection with New Zealand Patent Application No. NZ591391, filed on Oct. 22, 2009.
Office Action issued Mar. 14, 2011, in connection with U.S. Appl. No. 11/978,089, filed Oct. 25, 2007.
Jan. 19, 2012 Response to Office Action issued Mar. 14, 2011, in connection with U.S. Appl. No. 11/978,089, filed Oct. 25, 2007.
Office Action issued Jul. 26, 2010, in connection with U.S. Appl. No. 11/978,089, filed Oct. 25, 2007.
Jan. 26, 2011 Response to Office Action issued Jul. 26, 2010, in connection with U.S. Appl. No. 11/978,089, filed Oct. 25, 2007.
Office Action issued Nov. 8, 2011, in connection with U.S. Appl. No. 12/733,998, filed Jan. 18, 2011.
Dec. 8, 2011 Response to Office Action issued Nov. 8, 2011, in connection with U.S. Appl. No. 12/733,998, filed Jan. 18, 2011.
Office Action issued Feb. 15, 2012, in connection with U.S. Appl. No. 12/733,998, filed Jan. 18, 2011.
May 15, 2012 Response to Office Action issued Feb. 15, 2012, in connection with U.S. Appl. No. 12/733,998, filed Jan. 18, 2011.
Office Action issued Dec. 14, 2012, in connection with U.S. Appl. No. 12/733,998, filed Jan. 18, 2011.
Examination Report issued by the Intellectual Property Office of New Zealand on Jun. 1, 2011, in connection with New Zealand Patent Application No. 591391, filed on Oct. 22, 2009.
Official Communication under Rules 161/162 issued by the European Patent Office on Jun. 1, 2011 in connection with European Patent Application No. 09748890.2, filed on Oct. 22, 2009.
Response to Jun. 1, 2011 Official Communication under Rules 161/162 filed with the European Patent Office on Dec. 9, 2011 in connection with European Patent Application No. 09748890.2, filed on Oct. 22, 2009.
Singh et al., (2001), "Cell specific caspase expression by different neuronal phenotypes in transient retinal eschemia", Journal of Neurochemistry, Wiley Interscience, New York, NY, US, vol. 77, No. 2.
Ahmed (2011): Ocular neuroprotection by siRNA targeting caspase-2; Cell Death and Disease (2011).

\* cited by examiner

US 8,765,931 B2

DOUBLE-STRANDED OLIGONUCLEOTIDE COMPOUND FOR DOWN-REGULATING THE EXPRESSION OF CASP2 GENE

RELATED APPLICATION

This application is a §371 national stage of PCT International Application No. PCT/US2009/061570, filed Oct. 22, 2009, and claims priority of PCT International Application No. PCT/IL2009/000179, filed Feb. 15, 2009 and U.S. Provisional Applications Nos. 61/198,931, filed Nov. 11, 2008 and 61/196,995, filed Oct. 22, 2008, which are all hereby incorporated by reference in their entirety.

REFERENCE TO SEQUENCE LISTING

This application incorporates-by-reference nucleotide and/or amino acid sequences which are present in the file named "110303_2094_79020_B_PCT_US_Substitute_Seq_Listing_DE S.txt," which is 5.81 megabytes in size, and which was created Feb. 28, 2011 in the IBM-PC machine format, having an operating system compatibility with MS-Windows, which is contained in the text file filed Mar. 3, 2011 as part of this application.

FIELD OF THE INVENTION

The present invention relates to a non-invasive method of treating an eye disorder in a subject in need thereof comprising the step of topically administering to the surface of the eye of the subject a pharmaceutical composition comprising a therapeutic oligonucleotide directed to a target gene associated with loss of the retinal ganglion cell in the retina of the subject. Furthermore, the invention relates to non-invasive method of promoting retinal ganglion cell survival in subject suffering from an ocular disease, disorder or injury.

BACKGROUND OF THE INVENTION

Delivery of nucleic acid compounds to retinal tissue and in particular to retinal ganglion cells presents a big drug delivery challenge. Hitherto, eye drops have been considered to be useful primarily in the treatment of anterior segment disorders since it is has been shown that nucleic acids do not pass the cornea and insufficient drug concentrations reach the posterior ocular tissue (reviewed in del Amo and Urtti, 2008. Drug Discov Today 13(3/4):135-143; Fattal and Bochot, 2006. Adv Drug Del Rev 56:1203-1223).

A retinal ganglion cell (RGC) is a type of neuron located near the inner surface of the retina of the eye. Retinal ganglion cells receive visual information from photoreceptors and collectively transmit visual information from the retina to several regions in the brain. Further, there remains need for non-invasive method for inhibiting loss of retinal ganglion cells in a subject in need thereof. Various ocular diseases and disorders are characterized by death of retinal ganglion cells (RGCs). Accordingly, there remains a need for a non-invasive method for inhibiting loss of retinal ganglion cells (RGCs) in subjects that are suffering from an ocular disease, an ocular disorder or an ocular injury or are at risk of developing an ocular disease, an ocular disorder, or an ocular injury characterized and/or mediates by degeneration or death of retinal ganglion cells (RGCs).

SUMMARY OF THE INVENTION

The present invention is directed to non-invasive methods of treating ocular diseases, disorders and injuries that are associated with degeneration or death of retinal ganglion cells (RGCs) and to compositions useful in the methods. The methods of the invention comprise topically administering to the surface of the eye of a subject a therapeutic oligonucleotide composition useful in promoting survival of retinal ganglion cells in a subject. Hitherto, oligonucleotides have been delivered to retinal ocular tissue by systemic delivery or intravitreal injection, methods associated with detrimental side effects and poor patient compliance, respectively. The present invention provides topical ophthalmic compositions comprising an oligonucleotide, and non-invasive methods of use thereof for down regulating expression of a target gene associated with loss of the retinal ganglion cell in the retina of a subject, for rescuing retinal ganglion cells from apoptosis and for treating eye disorders.

Accordingly, in one aspect the present invention provides a method of non-invasive delivery of an oligonucleotide to a retinal tissue in a subject suffering from an eye disorder, disease or injury comprising topically applying an ophthalmic composition comprising the oligonucleotide to the surface of the eye of the subject.

In another aspect the present invention provides a method of non-invasive delivery of an oligonucleotide to a retinal ganglion cell in a subject suffering from an eye disorder comprising topically applying an ophthalmic composition comprising the oligonucleotide to the surface of the eye of the subject.

In yet another aspect, the present invention provides a method of attenuating expression of a target gene associated with loss of a retinal ganglion cell in the retina in a subject suffering from an ocular disease, disorder or injury, which comprises topically (non-invasively) administering to the surface of the eye of the subject a pharmaceutical composition comprising at least one oligonucleotide directed to the target mRNA product of the target gene, in an amount and over a period of time effective to attenuate expression of the gene in the retina of the subject.

In a further aspect, the present invention provides a method of treating a subject suffering from retinal ganglion cell loss or retinal ganglion cell damage and providing ocular neuroprotection to a subject suffering from or at risk of developing an eye disease, disorder or injury. The method comprises topically administering to the surface of the eye of the subject an ophthalmic pharmaceutical composition comprising at least one oligonucleotide directed to a target gene in the retina of the subject, in an amount and over a period of time effective to inhibit retinal ganglion cell loss or retinal ganglion cell damage in the subject.

In various embodiments the ophthalmic pharmaceutical composition is formulated as a cream, a foam, a paste, an ointment, an emulsion, a liquid solution including an eye drop, a gel, spray, a suspension, a microemulsion, microspheres, microcapsules, nanospheres, nanoparticles, lipid vesicles, liposomes, polymeric vesicles, a patch, or a contact lens. In some embodiments the pharmaceutical composition is formulated as an eye drop. In preferred embodiments the ophthalmic composition is administered to the eye, for example, by instillation of an eye drop or by administration of a mist.

In certain embodiments the at least one target ocular mRNA is selected from an mRNA polynucleotide set forth in any one of SEQ ID NOS:1-58. In certain embodiments the at least one target gene is selected from a gene transcribed into an mRNA polynucleotide set forth in any one of SEQ ID NOS:1-58.

In some embodiments the at least one oligonucleotide is selected from chemically modified siRNA, unmodified siRNA, antisense, ribozyme, miRNA and shRNA. In preferred embodiments the at least one oligonucleotide is a chemically modified siRNA. In some embodiments the siRNA sense and antisense oligonucleotides are selected from sense and corresponding antisense oligonucleotide pairs shown in Tables B1-B36, set forth in SEQ ID NOS:59-33,596.

In some embodiments the eye disorder, disease or injury is selected from glaucoma, dry eye, diabetic retinopathy (DR), diabetic macular edema (DME) or age related macular degeneration (AMD). In other embodiments the ocular disorder, disease or injury is optic neuritis, central retinal vein occlusion, brunch retinal vein occlusion (BRVO). In further embodiments the eye disorder, disease or injury is retinitis pigmentosa (RP), ischemic optic neuropathy or optic nerve injury. In further embodiments ocular disorder, disease or injury is retinopathy of prematurity (ROP) retinal ganglion degeneration, macular degeneration, hereditary optic neuropathy, metabolic optic neuropathy, optic neuropathy due to a toxic agent or neuropathy caused by adverse drug reactions or vitamin deficiency. In yet another embodiment the disorder is vision loss associated with a tumor.

In various embodiments the at least one siRNA compound is delivered to the eye of a subject as a liquid solution, including an eye drop. In various embodiments the present invention provides a method for attenuating expression of a target ocular gene associated with loss of a retinal ganglion cell in a subject suffering from an ocular disease, disorder or injury, comprising topically applying to the surface of the eye of the subject an ophthalmic pharmaceutical composition formulated as an eye drop.

In various embodiments expression of a target ocular mRNA is attenuated in an ocular cells in the retina of a subject suffering from an eye disease, disorder, or injury. In various embodiments the ocular cell includes but is not limited to an acinar cell of the lacrimal gland, a ductal cell of the lacrimal gland, a retinal ganglion cell (RGC), a retinal pigment epithelial (RPE) cell, a choroidal cell, a corneal cell, a cell of the ciliary process or a cell of the trabecular meshwork or a combination thereof.

The present invention provides a method for inhibiting loss of a retinal ganglion cell in a subject, comprising non-invasively administering to the surface of the eye of the subject an ophthalmic composition comprising a therapeutically effective amount of at least one siRNA which down regulates expression of a target gene associated with loss of the retinal ganglion cell in the retina of the subject, thereby inhibiting loss of a retinal ganglion cell. In certain embodiments two or more target genes are down regulated by the method according to the invention. In certain embodiments attenuating expression of at least one target gene (ocular mRNA) associated with loss of the retinal ganglion cell in the retina of the subject confers upon the eye neuroprotective properties. In various embodiments the at least one ocular target gene is selected from the list in Tables A1 to A4, set forth in SEQ ID NO:1-58.

In one embodiment the eye disorder is glaucoma. Thus the present invention provides a method of inhibiting loss of a retinal ganglion cell in a subject suffering from glaucoma comprising topically (non-invasively) applying to the surface of the eye of the subject an ophthalmic composition comprising a therapeutically effective amount of at least one siRNA which down regulates a target gene (target ocular mRNA) associated with loss of the retinal ganglion cell in the retina of the subject, thereby inhibiting loss of a retinal ganglion cell in the subject's eye. In preferred embodiments the siRNA is chemically modified. In some embodiments the chemically modified siRNA attenuates expression of gene (target ocular mRNA) in the retina of the subject's eye. In other embodiments the chemically modified siRNA attenuates expression of target ocular mRNA in the optic nerve of the subject's eye. In certain embodiments attenuating expression of at least one target gene (ocular mRNA) associated with loss of the retinal ganglion cell in the retina of the subject is effective to treat glaucoma. In certain embodiments the at least one target gene is selected from the list in Table A1 set forth in SEQ ID NO:1-35. In certain preferred embodiments the target gene is selected from CASP2 (SEQ ID NO:1-2), ASPP1 (SEQ ID NO:4), TP53BP2 (SEQ ID NO:6-7), BNIP3 (SEQ ID NO:12), RTP801L (SEQ ID NO:14), ACHE (SEQ ID NO:19-20), ADRB1 (SEQ ID NO:21) and CAPNS1 (SEQ ID NO:28-29). In various embodiments the gene is set forth in SEQ ID NOS:1-2. In some embodiments the siRNA sense and antisense strands are selected from pairs of oligonucleotide sequences set forth in SEQ ID NOS:8515-9516.

In another embodiment the eye disorder is dry-eye. Thus the present invention provides a method of inhibiting loss of a retinal ganglion cell in a subject suffering from dry-eye. The method comprises topically (non-invasively) administering to the surface of the eye of the subject an ophthalmic composition comprising a therapeutically effective amount of at least one siRNA which down regulates a target gene (target ocular mRNA) associated with loss of the retinal ganglion cell in the retina of the subject, thereby inhibiting loss of a retinal ganglion cell in the subject's eye. In preferred embodiments the siRNA is chemically modified. In certain embodiments attenuating expression of at least one target ocular mRNA is effective to treat dry-eye disorder. In certain embodiments attenuating expression of at least one target gene associated with loss of retinal ganglion cells is effective to reduce the symptoms of dry-eye. In certain embodiments the at least one target gene (ocular target mRNA) is expressed in retinal ganglion cell in the eye of the subject. In certain embodiments the at least one target gene (ocular target mRNA) is expressed in the lacrimal gland in the eye of the subject. In certain embodiments the at least one target gene is selected from Table A2 set forth in any one of SEQ ID NO: 5 (p53), SEQ ID NO:8-10 (LRDD), SEQ ID NO:26-27 (SHC1) and SEQ ID NO:30-44 (FAS and FAS ligand). In some embodiments the target gene is selected from FAS, FAS ligand (FASL), p53, LRDD, PARP1, AIF (apoptosis inducing factor), NOS1, NOS2A, XIAP and SHC1-SHC. In certain preferred embodiments the target gene is set forth in any one of SEQ ID NO:36-SEQ ID NO: 43 or SEQ ID NO:44. In some embodiments the siRNA sense and antisense strands are selected from pairs of oligonucleotide sequences set forth in SEQ ID NOS: 13,225-15,224.

In another embodiment the eye disorder is AMD, DR or DME. Thus, the present invention provides a method of inhibiting loss of a retinal ganglion cell in a subject suffering from AMD, DR or DME. The method comprises topically (non-invasively) administering to the surface of the eye of the subject an ophthalmic composition comprising a therapeutically effective amount of at least one siRNA which down regulates a target gene (target ocular mRNA) associated with loss of the retinal ganglion cell in the retina of the subject, thereby inhibiting loss of a retinal ganglion cell in the subject's eye. In preferred embodiments the siRNA is chemically modified. In certain embodiments attenuating expression of at least one target gene associated with loss of retinal ganglion cells is effective to treat AMD, DR or DME. In certain embodiments attenuating expression of at least one target gene associated with loss of retinal ganglion cells is effective to reduce the symptoms of AMD, DR or DME. In certain embodiments the administration of at least one siRNA attenuates expression of at least one target gene (ocular mRNA) in a retinal ganglion cell in the subject's eye. In certain embodiments the administration of at least one siRNA attenuates expression of at least one target gene (target ocular mRNA) in the choroid in the subject's eye. In certain embodiments the at least one target gene is listed in Table A3 set forth in any one of SEQ ID NOS:1-2, 3, 5, 6-7, 8-10, 12, 13, 24-25, 26-27, 30-35, 45-53. In certain preferred embodiments the siRNA targets CTSD, RTP801 and BNIP3. In certain preferred embodiments the disorder is DR and the siRNA targets mRNA set forth in SEQ ID NOS:48-53. In some embodiments the siRNA sense and antisense strands are selected from any one of sequences set forth in SEQ ID NOS:24575-29594. In certain preferred embodiments the disorder is AMD and the siRNA targets gene set forth in SEQ ID NO:3 and the siRNA sense and antisense strands are selected from any one of sequences set forth in SEQ ID NOS:11285-12224. In some embodiments the siRNA sense and antisense strands are selected from pairs of oligonucleotide sequences set forth in SEQ ID NOS:24575-29594.

In a further embodiment the eye disorder is Retinitis pigmentosa (RP). Thus, the present invention provides a method of inhibiting loss of a retinal ganglion cell in a subject suffering from RP. The method comprises topically (non-invasively) administering to the surface of the eye of the subject an ophthalmic composition comprising a therapeutically effective amount of at least one siRNA which down regulates a target gene (target ocular mRNA) associated with loss of the retinal ganglion cell in the retina of the subject, thereby inhibiting loss of a retinal ganglion cell in the subject's eye. In preferred embodiments the siRNA is chemically modified. In certain embodiments attenuating expression of at least one target gene associated with loss of retinal ganglion cells is effective to RP. In certain embodiments attenuating expression of at least one target gene associated with loss of retinal ganglion cells is effective to reduce the symptoms of RP. In certain embodiments the at least one target ocular mRNA is product of a gene selected from a gene listed in Table A4 which is transcribed into mRNA set forth in any one of SEQ ID NOS: 3, 14, 26-35, 54-57. In some embodiments the target ocular mRNA is product of a gene selected from the group consisting of CASP1, CASP3, CASP12, RTP801, RTP801L, CAPNS1, PARP1, AIF, NOS1, NOS2, XIAP and SHC1-SHC. In certain preferred embodiments the siRNA targets mRNA set forth in SEQ ID NOS:56-57.

In another aspect the invention features a method of rescuing a retinal ganglion cell from apoptosis in a subject, comprising non-invasively applying to the surface of the eye of the subject an ophthalmic composition comprising a therapeutically effective amount of at least one siRNA to a target gene in the retina of the subject, thereby rescuing retinal ganglion cell from apoptosis in the subject. In preferred embodiments the at least one siRNA is a chemically modified. In some embodiments the target gene is set forth in any one of SEQ ID NO:1-58. In various embodiments the siRNA sense and antisense oligonucleotides are selected from sense and corresponding antisense oligonucleotides shown in tables B1-B36 and set forth in SEQ ID NOS:59-33,596.

In another aspect, the invention provides method for promoting survival of a retinal ganglion cell in a subject displaying signs or symptoms of an ocular neuropathy, comprising non-invasively administering to the surface of the eye of the subject an ophthalmic composition comprising a therapeutically effective amount of at least one siRNA to a target gene in the retina of the subject, thereby promoting survival of a retinal ganglion cell in the subject. In preferred embodiments the at least one siRNA is a chemically modified. In certain embodiments the signs or symptoms of an ocular neuropathy are mediated by apoptosis. In some embodiments the target gene is set forth in any one of SEQ ID NO:1-58. In various embodiments the siRNA sense and antisense oligonucleotides are selected from sense and corresponding antisense oligonucleotides set forth in SEQ ID NOS:59-33,596.

In yet another aspect, the invention is directed to a method for preventing, treating or alleviating the effects of an ocular disease associated with death of a retinal ganglion cell in a subject, comprising non-invasively applying to the surface of the eye of the subject an ophthalmic composition comprising a therapeutically effective amount of at least one siRNA to a target gene in the retina of the subject, thereby preventing, treating or alleviating the effects of an ocular disease associated with death of a retinal ganglion cell in the subject. In preferred embodiments the at least one siRNA is a chemically modified. In some embodiments the target gene is set forth in any one of SEQ ID NO:1-58. In various embodiments the siRNA sense and antisense oligonucleotides are selected from sense and corresponding antisense oligonucleotide pairs shown in Tables B1-B36, set forth in SEQ ID NOS:59-33, 596.

Another aspect of the invention provides for a method for treating or preventing retinal ganglion cell death in a subject, comprising non-invasively applying to the surface of the eye of the subject an ophthalmic pharmaceutical composition which comprises: (a) a therapeutically effective amount of at least one siRNA to a target gene in the retina of the subject, and (b) a pharmaceutically acceptable excipient or carrier or mixture thereof, and thereby treating or preventing retinal ganglion cell death in the subject. In preferred embodiments the at least one siRNA is a chemically modified. In some embodiments the target gene is set forth in any one of SEQ ID NO:1-58. In various embodiments the siRNA sense and antisense oligonucleotides are selected from sense and corresponding antisense oligonucleotides set forth in SEQ ID NOS:59-33,596.

In another aspect, the present invention is directed to a method preventing retinal ganglion cell death mediated by elevated intraocular pressure (IOP) in the eye of a subject, comprising non-invasively administering to the surface of the eye of the subject an ophthalmic composition comprising a therapeutically effective amount of at least one siRNA to a target gene in the retina of the subject, thereby preventing retinal ganglion cell death in the subject. In preferred embodiments the at least one siRNA is a chemically modified. In a particular embodiment according to this method the subject is afflicted with glaucoma. In some embodiments the target gene is set forth in any one of SEQ ID NO:1-58. In various embodiments the siRNA sense and antisense oligonucleotides are selected from sense and corresponding antisense oligonucleotides set forth in SEQ ID NOS:59-33,596.

The present invention further provides a method of delaying, preventing or rescuing a retinal cell from death in a subject suffering from elevated IOP comprising non-invasively applying to the surface of the eye of the subject an ophthalmic composition comprising a therapeutically effective amount of at least one siRNA to a target gene associated with death of the RGC in the retina of the subject, thereby delaying, preventing or rescuing the retinal cell from injury or death and wherein intraocular pressure (IOP) remains substantially elevated. In preferred embodiments the at least one siRNA is a chemically modified. In a particular embodiment according to this method the subject is afflicted with glaucoma. In some embodiments the target gene is set forth in any one of SEQ ID NO:1-58. In various embodiments the siRNA sense and antisense oligonucleotides are selected from sense and corresponding antisense oligonucleotides set forth in SEQ ID NOS:59-33,596.

The present invention further provides a method of treating a subject suffering from retinal ganglion cell loss or retinal ganglion cell damage, comprising non-invasively administering to the surface of the eye of the subject an ophthalmic composition comprising a therapeutically effective amount of at least one siRNA to a target gene in the retina of the subject, thereby treating the subject or reducing retinal ganglion cell death in the subject. In preferred embodiments the at least one siRNA is a chemically modified. In some embodiments the target gene is set forth in any one of SEQ ID NO:1-58. In various embodiments the siRNA sense and antisense oligonucleotides are selected from sense and corresponding antisense oligonucleotides set forth in SEQ ID NOS:59-33,596.

The present invention further provides a method for lowering retinal ganglion cell loss and providing ocular neuroprotection to a subject in need thereof, comprising non-invasively applying to the surface of the eye of the subject an ophthalmic composition comprising a therapeutically effective amount of at least one siRNA to a target gene in the retina of the subject, thereby lowering retinal ganglion cell loss and providing ocular neuroprotection to the subject. In preferred embodiments the at least one siRNA is a chemically modified. In some embodiments the target gene is set forth in any one of SEQ ID NO:1-58. In various embodiments the siRNA sense and antisense oligonucleotides are selected from sense and corresponding antisense oligonucleotide pairs shown in Tables B1-B36, set forth in SEQ ID NOS:59-33,596.

The present invention further provides a method for preventing visual field loss associated with loss of retinal ganglion cells in a subject, comprising non-invasively administering to the surface of the eye of the subject an ophthalmic composition comprising a therapeutically effective amount of at least one siRNA to a target gene in the retina of the subject, thereby preventing visual field loss in the subject. In preferred embodiments the at least one siRNA is a chemically modified. In some embodiments the target gene is set forth in any one of SEQ ID NO:1-58. In various embodiments the siRNA sense and antisense oligonucleotides are selected from sense and corresponding antisense oligonucleotide pairs shown in Tables B1-B36, set forth in SEQ ID NOS:59-33,596.

In another aspect, the present invention provides an ophthalmic composition for non-invasive treatment of an ocular disease associated with loss of a retinal ganglion cell in a subject, comprising: (a) a therapeutically effective amount of at least one siRNA to a target gene in the retina of the subject, and (b) a pharmaceutically acceptable excipient or carrier or mixture thereof. In preferred embodiments the at least one siRNA is a chemically modified. In some embodiments the target gene is set forth in any one of SEQ ID NO:1-58. In various embodiments the siRNA sense and antisense oligonucleotides are selected from sense and corresponding antisense oligonucleotide pairs shown in Tables B1-B36, set forth in SEQ ID NOS:59-33,596.

In yet another aspect, the present invention provides a topical ophthalmic pharmaceutical composition for non-invasive treatment of an ocular disease associated with pathological abnormalities/changes in the tissues of the visual system, comprising: (a) a therapeutically effective amount of at least one siRNA to a target gene in the retina of the subject, wherein the target gene is set forth in any one of SEQ ID NO:1-58, and (b) a pharmaceutically acceptable excipient or carrier or mixture thereof. In preferred embodiments the at least one siRNA is a chemically modified. In various embodiments the siRNA sense and antisense oligonucleotides are selected from sense and corresponding antisense oligonucleotide pairs shown in Tables B1-B36, set forth in SEQ ID NOS:59-33,596.

According to another aspect, the present invention is directed to a topical ophthalmic pharmaceutical composition for use in treating a subject afflicted with ocular disease associated with death of retinal ganglion cells, which comprises: (a) a therapeutically effective amount of at least one siRNA to a target gene in the retina of the subject, wherein the target gene is set forth in any one of SEQ ID NO:1-58, and (b) a pharmaceutically acceptable excipient or carrier or mixture thereof. In preferred embodiments the at least one siRNA is a chemically modified. In various embodiments the siRNA sense and antisense oligonucleotides are selected from sense and corresponding antisense oligonucleotide pairs shown in Tables B1-B36, set forth in SEQ ID NOS:59-33,596.

In various embodiments the ocular disease is selected from a group comprising glaucoma, dry eye, diabetic retinopathy (DR), diabetic macular edema (DME), age related macular degeneration (AMD), optic neuritis, central retinal vein occlusion, brunch retinal vein occlusion, ischemic optic neuropathy, optic nerve injury, retinopathy of prematurity (ROP) or retinitis pigmentosa (RP), retinal ganglion degeneration, macular degeneration, hereditary optic neuropathy, metabolic optic neuropathy, neuropathy due to a toxic agent or that caused by adverse drug reactions or vitamin deficiency; and the composition is formulated as a cream, a foam, a paste, an ointment, an emulsion, a liquid solution, an eye drop, a gel, spray, a suspension, a microemulsion, microspheres, microcapsules, nanospheres, nanoparticles, lipid vesicles, liposomes, polymeric vesicles, a patch, a biological insert. In a preferred embodiment the composition is formulated as an eye drop.

In another aspect the invention is directed to a packaged pharmaceutical preparation, comprising: (a) a pharmaceutical composition according to the invention in a container; and (b) instructions for using the composition to treat an ocular disease. In various embodiments the pharmaceutical composition according to present invention comprises a therapeutically effective amount of at least one siRNA to a target gene in the retina of the subject suffering from an ocular disease. In preferred embodiments the at least one siRNA is a chemically modified. In some embodiments the target gene is set forth in any one of SEQ ID NO:1-58. In various embodiments the siRNA sense and antisense oligonucleotides are selected from sense and corresponding antisense oligonucleotides set forth in SEQ ID NOS:59-33,596. In one particular embodiment according to this aspect of the invention, the pharmaceutical composition is for non-invasive treatment of an ocular disease associated with loss of a retinal ganglion cell in a subject. In another particular embodiment according to this aspect the invention, the pharmaceutical composition is for non-invasive treatment of an ocular disease associated with pathological abnormalities/changes in the tissues of the visual system. In yet another particular embodiment according to this aspect the invention, the pharmaceutical composition is for use in treating a subject afflicted with ocular disease associated with death of retinal ganglion cells.

According to another aspect, the invention is directed to use of a pharmaceutical composition according to the invention in the manufacture of a medicament for promoting retinal ganglion cell survival in a subject. In various embodiments the pharmaceutical composition according to present invention comprises a therapeutically effective amount of at least one siRNA to a target gene in the retina of the subject suffering from an ocular disease. In preferred embodiments the at least one siRNA is a chemically modified. In some embodiments the target gene is set forth in any one of SEQ ID NO:1-58. In various embodiments the siRNA sense and antisense oligonucleotides are selected from sense and corresponding antisense oligonucleotide pairs shown in Tables B1-B36, set forth in SEQ ID NOS:59-33,596. In one particular embodiment according to this aspect the invention the pharmaceutical composition is for non-invasive treatment of an ocular disease associated with loss of a retinal ganglion cell in a subject. In another particular embodiment according to this aspect the invention the pharmaceutical composition is for non-invasive treatment of an ocular disease associated with pathological abnormalities/changes in the tissues of the visual system. In yet another particular embodiment according to this aspect the invention the pharmaceutical composition is for use in treating a subject afflicted with ocular disease associated with death of retinal ganglion cells.

In some embodiments the composition includes a viscosity enhancing agent. A viscosity enhancing agent is selected from for example a hydrophilic polymer including cellulose and cellulose derivatives methylcellulose and methylcellulose derivatives. Such agents include methylcellulose, hydroxyethyl cellulose, hydroxypropyl cellulose, hydroxypropylmethyl cellulose, carboxymethyl cellulose, derivatives thereof, combinations thereof and their salts. In some embodiments the viscosity enhancing agent is methylcellulose. In certain embodiments the viscosity enhancing agent is provided at a concentration of about 0.01% to about 4%, in other embodiments the viscosity enhancing agent is provided at a concentration of about 0.1% to about 3%, or at a concentration of about 0.5% to about 2%.

In some embodiments the composition includes an agent providing osmotic balance, or a surfactant. Such agents include glycerol, ethylene glycol, poly(ethylene glycol), propylene glycol, sorbitol, mannitol, monosaccharide, disaccharides and oligosaccharides.

The present invention further provides a method of treating glaucoma in a subject in need of treatment that comprises topically (non-invasively) administering to the surface of the eye of the subject a therapeutically effective amount of at least one siRNA to a target gene in the eye of the subject, in an amount effective to treat glaucoma. In certain preferred embodiments the siRNA chemically modified siRNA. In certain embodiments the at least one siRNA inhibits expression of at least one gene expressed in the retina of the subject's eye. In certain embodiments inhibition of at least one gene confers upon the eye neuroprotective properties. In certain embodiments the at least one gene is selected from a list in Table A1 transcribed into mRNA set forth in SEQ ID NO:1-35. In certain preferred embodiments the gene is selected from CASP2 (SEQ ID NO:1-2), ASPP1 (SEQ ID NO:4), TP53BP2 (SEQ ID NO:6-7), BNIP3 (SEQ ID NO:12), RTP801L (SEQ ID NO:14), ACHE (SEQ ID NO:19-20), ADRB1 (SEQ ID NO:21) and CAPNS1 (SEQ ID NO:28-29). In various embodiments the gene is set forth in SEQ ID NOS:1-2. In some embodiments the siRNA sense and antisense strands are selected from any one of sequences set forth in SEQ ID NOS:8515-9516.

The present invention further provides a method of treating dry-eye in a subject in need thereof, which comprises topically (non-invasively) applying to the surface of the eye of the subject a therapeutically effective amount of at least one siRNA which inhibits expression of at least one gene expressed in the eye of the subject in an amount effective to reduce the symptoms of dry eye. In certain preferred embodiments the siRNA is chemically modified siRNA. In certain embodiments the at least one gene is expressed in the lacrimal gland in the subject. In certain embodiments the at least gene is selected from Table A2 set forth in any one of SEQ ID NO: 5, SEQ ID NO:8-10, SEQ ID NO:26-27 and SEQ ID NO:30-44. In some embodiments the gene is selected from FAS, FAS ligand (FASL), p53, LRDD, PARP1, AIF (apoptosis inducing factor), NOS1, NOS2A, XIAP and SHC1-SHC. In certain preferred embodiments the gene is transcribed into mRNA set forth in any one of SEQ ID NO:36-SEQ ID NO:44. In some embodiments the siRNA sense and antisense strands are selected from any one of sequences in Tables 16-17 set forth in SEQ ID NOS: 13,225-15,224.

The present invention further provides a method of treating AMD, DR or DME in a subject in need thereof, which comprises topically (non-invasively) administering to the surface of the eye of the subject a therapeutically effective amount of at least one siRNA which inhibits expression of at least one gene expressed in the eye in the subject in an amount effective to reduce the symptoms of AMD, DR or DME. In certain preferred embodiments the siRNA is chemically modified siRNA. In certain embodiments the at least one siRNA inhibits expression of at least one gene expressed in the choroid in the subject's eye. In certain embodiments the at least one target ocular mRNA listed in Table A3, set forth in any one of SEQ ID NOS:1-2, 3, 5, 6-7, 8-10, 12, 13, 24-25, 26-27, 30-35, 45-53. In certain preferred embodiments the siRNA targets CTSD, RTP801 and BNIP3. In certain preferred embodiments the disorder is DR and the siRNA targets mRNA set forth in SEQ ID NOS:48-53.

In a further embodiment the eye disorder is Retinitis pigmentosa (RP). Thus, the present invention provides a method of attenuating expression of a target ocular mRNA in the eye of a subject suffering from RP. The method comprises topically (non-invasively) applying to the surface of the eye of the subject a therapeutically effective amount of at least one siRNA to a target gene in the eye of the subject. In certain preferred embodiments the siRNA is chemically modified siRNA. In certain embodiments attenuating expression of at least one target gene (target ocular mRNA) is effective to treat RP. In certain embodiments attenuation of at least one target ocular mRNA is effective to reduce the symptoms of RP. In certain embodiments the at least one target ocular mRNA is product of a gene selected from a gene listed in Table A4 which is transcribed into mRNA set forth in any one of SEQ ID NOS: 3, 14, 26-35, 54-57. In some embodiments the target ocular mRNA is product of a gene selected from the group consisting of CASP1, CASP3, CASP12, RTP801, RTP801L, CAPNS1, PARP1, AIF, NOS1, NOS2, XIAP and SHC1-SHC. In certain preferred embodiments the siRNA targets mRNA set forth in SEQ ID NOS:56-57.

In various embodiments the at least one siRNA is chemically modified. In various embodiments the at least one siRNA comprises a sufficient number of consecutive nucleotides having a sequence of sufficient homology to a nucleic acid sequence present within the target mRNA to hybridize to the mRNA and attenuate expression of the mRNA in the eye of the subject.

In various embodiments the at least one siRNA comprises a sufficient number of consecutive nucleotides having a sequence of sufficient homology to a nucleic acid sequence present within the gene to hybridize to the gene and reduce or inhibit expression of the gene in the eye of the subject.

BRIEF DESCRIPTION OF THE FIGURES

FIG. 6B shows accumulation of DDIT4_1 Cy3-siRNA 1 hour post administration by eye drops. Choroid, outer nuclear layer, RPE and outer segment layer of photoreceptor cells show Cy3 staining.

FIGS. 13A-13B show standard curves for measuring p53 protein levels. FIGS. 13C-13D show retinal p53 knockdown by eye drops.

DETAILED DESCRIPTION OF THE INVENTION

Figure 1A:
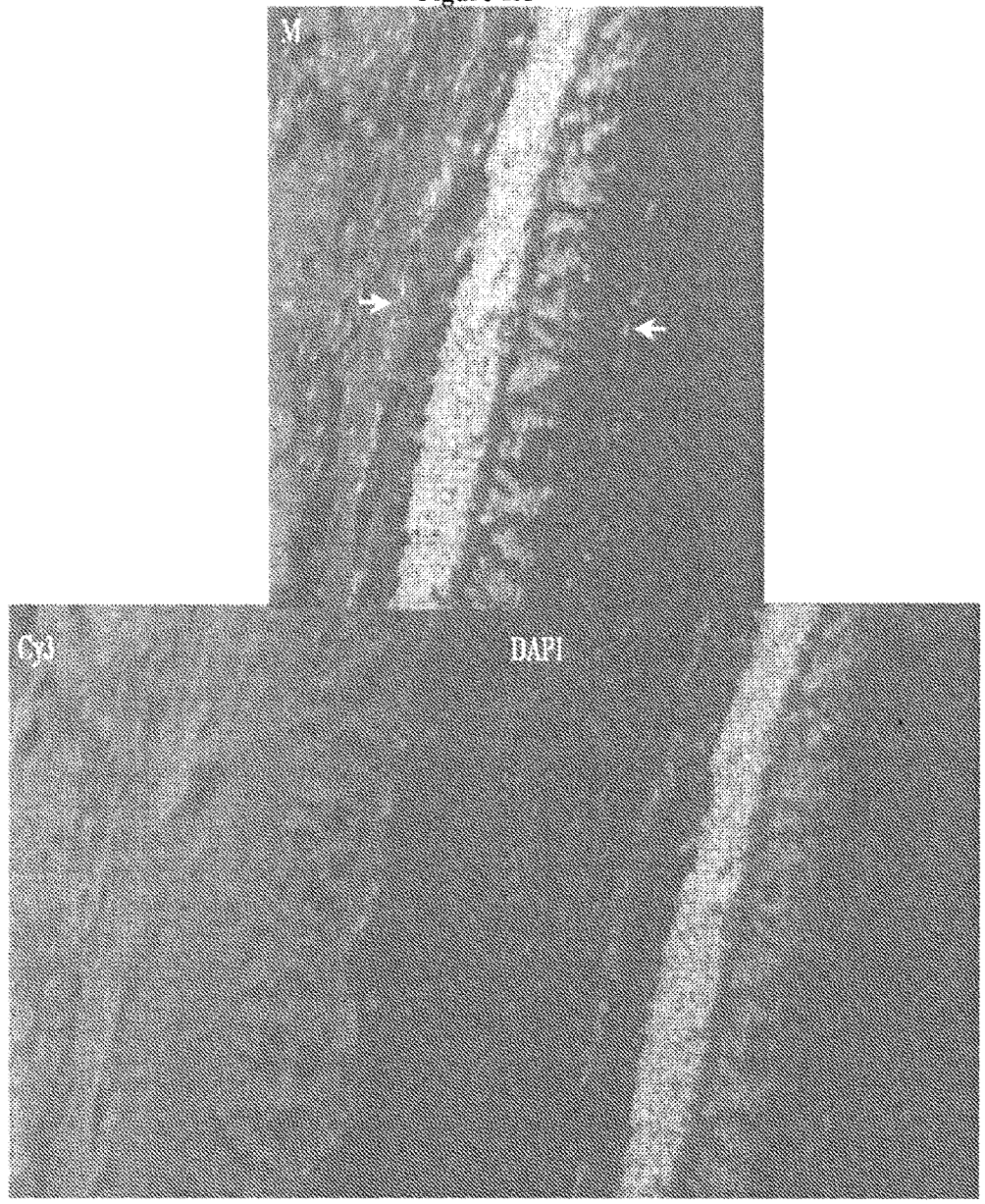
FIGS. 1A-1C: Representative images of Cy3 labeled DDIT4 siRNA incorporated into murine retina following eye drop administration.

The present invention provides topical oligonucleotide compositions and non-invasive methods of use thereof for treating various eye diseases and disorders. In particular, the invention provides methods for treatment of various eye diseases and disorders associated with gene expression in the eye of a subject suffering from the disease or disorder.

The present invention is based in part on the unexpected discovery that topical non-invasive administration of siRNA compositions targets certain ocular tissues and cell types and is active in those tissues and cells when delivered topically to the surface of the eye. The discovery is surprising in view of the known obstacles to siRNA delivery and provides non-invasive methods as a realistic alternative to intravitreal or systemic delivery.

For siRNA molecules to be effective in silencing mRNA of a target gene, the siRNA requires three levels of targeting: to the target tissue, to the target cell type and to the target subcellular compartment. The present invention now discloses non-invasive methods of treating eye diseases and disorders.

The present invention relates in general to compounds which down-regulate expression of genes expressed in ocular cells, particularly to novel small interfering RNAs (siRNAs), and to the use of these novel siRNAs in the treatment of a subject suffering from medical conditions associated with expression of those genes in eye tissues and cells.

Methods for attenuating expression of an ocular target mRNA and methods of treating disorders in the eye are discussed herein at length, and any of said molecules and/or compositions may be beneficially employed in the treatment of a subject suffering from any of said conditions.

The siRNAs of the present invention possess structures and modifications which may increase activity, increase stability, and or minimize toxicity; the novel modifications of the siRNAs of the present invention can be beneficially applied to double stranded RNA sequences useful in preventing or attenuating target gene expression, in particular the target genes discussed herein.

Details of a non-limited example of target genes per indication are presented in Tables A1-A4, hereinbelow.

TABLE A1

| Target genes for treatment of glaucoma | |
|---|---|
| Gene | Full name and Human Gene ID/ SEQ ID NO. for mRNA polynucleotide |
| CASP2 | caspase 2, apoptosis-related cysteine peptidase gi\|39995058\|ref\|NM_032982.2 (SEQ ID NO: 1) gi\|39995060\|ref\|NM_032983.2 (SEQ ID NO: 2) |
| RTP801 | Homo sapiens DNA-damage-inducible transcript 4 (DDIT4), mRNA gi\|56676369\|ref\|NM_019058.2 (SEQ ID NO: 3) |
| ASPP1 | protein phosphatase 1, regulatory (inhibitor) subunit 13B (PPP1R13B) gi\|121114286\|ref\|NM_015316.2 (SEQ ID NO: 4) |
| p53 | tumor protein p53 gi:120407067, NM_000546.2 (SEQ ID NO: 5) |
| TP53BP2 | tumor protein p53 binding protein, 2 gi\|112799848\|ref\|NM_001031685.2 (SEQ ID NO: 6) gi\|112799845\|ref\|NM_005426.2 (SEQ ID NO: 7) |
| LRDD | leucine-rich repeats and death domain containing variant 2 gi\|61742781\|ref\|NM_018494.3 (SEQ ID NO: 8) variant 1 gi\|61742783\|ref\|NM_145886.2 (SEQ ID NO: 9) variant 3 gi\|61742785\|ref\|NM_145887.2 (SEQ ID NO: 10) |
| CYBA | cytochrome b-245, alpha polypeptide gi\|68509913\|ref\|NM_000101.2 (SEQ ID NO: 11) |
| BNIP3 | BCL2/adenovirus E1B 19 kDa interacting protein 3 gi\|7669480\|ref\|NM_004052.2 (SEQ ID NO: 12) |
| RAC1 | ras-related C3 botulinum toxin substrate 1 (rho family, small GTP binding protein) (gi\|38505164\|ref\|NM_198829.1) (SEQ ID NO: 13) |
| RTP801L | Homo sapiens DNA-damage-inducible transcript 4-like (DDIT4L), mRNA gi\|34222182\|ref\|NM_145244.2 (SEQ ID NO: 14) |
| SPP1 | secreted phosphoprotein 1 variant 1 gi\|91206461\|ref\|NM_001040058.1 (SEQ ID NO: 15) variant 2 gi\|38146097\|ref\|NM_000582.2 (SEQ ID NO: 16) variant 3 gi\|91598938\|ref\|NM_001040060.1 (SEQ ID NO: 17) |
| SOX9 | Homo sapiens SRY (sex determining region Y)-box 9 (campomelic dysplasia, autosomal sex-reversal) (SOX9), mRNA gi\|37704387\|ref\|NM_000346.2 (SEQ ID NO: 18) |
| ACHE | Homo sapiens acetylcholinesterase (Yt blood group) (ACHE), variant E4-E6, mRNA gi\|88999567\|ref\|NM_000665.3 (SEQ ID NO: 19) variant E4-E5, mRNA gi\|88999566\|ref\|NM_015831.2 (SEQ ID NO: 20) |
| ADRB1 | Homo sapiens adrenergic, beta-1-, receptor (ADRB1), mRNA gi\|110349783\|ref\|NM_000684.2 (SEQ ID NO: 21) |
| HTRA2 | Htra serine peptidase 2 v 1 gi: 73747817, NM_013247 (SEQ ID NO: 22) v 2 gi: 73747818, NM_145074 (SEQ ID NO: 23) |
| KEAP1 | Kelch-like ECH-associated protein 1 v 1 gi: 45269144 NM_203500 (SEQ ID NO: 24) v 2 gi: 45269143 NM_012289 (SEQ ID NO: 25) |
| SHC1-SHC | Src homology 2 domain containing transforming prot. 1 v 1 gi: 194239661 NM_183001 (SEQ ID NO: 26) v 2 gi: 194239660 NM_003029 (SEQ ID NO: 27) |
| CAPNS1 | Homo sapiens calpain, small subunit 1 (CAPNS1), variant 1, mRNA gi\|51599152\|ref\|NM_001749.2 (SEQ ID NO: 28) variant 2, mRNA gi\|51599150\|ref\|NM_001003962.1 (SEQ ID NO: 29) |

TABLE A1-continued

Target genes for treatment of glaucoma

| Gene | Full name and Human Gene ID/ SEQ ID NO. for mRNA polynucleotide |
|---|---|
| PARP1 | *Homo sapiens* poly (ADP-ribose) polymerase 1 (PARP1), mRNA gi\|156523967\|ref\|NM_001618.3 (SEQ ID NO: 30) |
| AIF (AIFM1) | *Homo sapiens* apoptosis-inducing factor, mitochondrion-associated, 1 variant 4, mRNA gi\|195927003\|ref\|NM_001130846.1 (SEQ ID NO: 31) variant 5, mRNA gi\|195927005\|ref\|NM_001130847.1 (SEQ ID NO: 32) |
| NOS1 | *Homo sapiens* nitric oxide synthase 1 (neuronal) (NOS1), mRNA gi\|194239671\|ref\|NM_000620.2 (SEQ ID NO: 33) |
| NOS2A | *Homo sapiens* nitric oxide synthase 2, inducible (NOS2), mRNA gi\|206597519\|ref\|NM_000625.4 (SEQ ID NO: 34) |
| XIAP | *Homo sapiens* X-linked inhibitor of apoptosis (XIAP), mRNA gi\|32528298\|ref\|NM_001167.2\| (SEQ ID NO: 35) |

TABLE A2

Target genes for treatment of dry eye

| Gene | Full name and Human Gene ID |
|---|---|
| FAS | CD95, TNF receptor superfamily, member 6 v 1. gi\|23510419\|ref\|NM_000043.3\| (SEQ ID NO: 36) v 3. gi\|23510422\|ref\|NM_152872.1\| (SEQ ID NO: 37) v 2. gi\|23510420\|ref\|NM_152871.1\| (SEQ ID NO: 38) v 4. gi\|23510424\|ref\|NM_152873.1\| (SEQ ID NO: 39) v 8. gi\|23510426\|ref\|NM_152874.1\| (SEQ ID NO: 40) v 5. gi\|23510428\|ref\|NM_152875.1\| (SEQ ID NO: 41) v 7. gi\|23510433\|ref\|NM_152877.1\| (SEQ ID NO: 42) v 6. gi\|23510430\|ref\|NM_152876.1\| (SEQ ID NO: 43) |
| FAS ligand | TNF superfamily, member 6 (FASL) gi\|4557328\|ref\|NM_000639.1\| (SEQ ID NO: 44) |
| p53 | tumor protein p53 gi8400737, NM_000546.2 (SEQ ID NO: 5) |
| LRDD | leucine-rich repeats and death domain containing gi\|61742781\|ref\|NM_018494.3 (SEQ ID NO: 8) gi\|61742783\|ref\|NM_145886.2 (SEQ ID NO: 9) gi\|61742785\|ref\|NM_145887.2 (SEQ ID NO: 10) |
| PARP1 | *Homo sapiens* poly (ADP-ribose) polymerase 1 (PARP1), mRNA gi\|156523967\|ref\|NM_001618.3 (SEQ ID NO: 30) |
| AIF (AIFM1) | *Homo sapiens* apoptosis-inducing factor, mitochondrion-associated, 1 variant 4, mRNA gi\|195927003\|ref\|NM_001130846.1 (SEQ ID NO: 31) variant 5, mRNA gi\|195927005\|ref\|NM_001130847.1 (SEQ ID NO: 32) |
| NOS1 | *Homo sapiens* nitric oxide synthase 1 (neuronal) (NOS1), mRNA gi\|194239671\|ref\|NM_000620.2 (SEQ ID NO: 33) |
| NOS2A | *Homo sapiens* nitric oxide synthase 2, inducible (NOS2), mRNA gi\|206597519\|ref\|NM_000625.4 (SEQ ID NO: 34) |
| XIAP | *Homo sapiens* X-linked inhibitor of apoptosis (XIAP), mRNA gi\|32528298\|ref\|NM_001167.2\| (SEQ ID NO: 35) |
| SHC1-SHC | Src homology 2 domain containing transforming prot. 1 v 1 gi: 194239661 NM_183001 (SEQ ID NO: 26) v 2 gi: 194239660 NM_003029 (SEQ ID NO: 27) |

TABLE A3

Target genes for treatment of DR, DME, AMD

| Gene | Full name and Human Gene ID |
|---|---|
| LGALS3 | lectin galactoside-binding soluble 3 v 1 gi: 115430222 NM_002306 (SEQ ID NO: 45) v 2 gi: 115430224 NR_003225 (SEQ ID NO: 46) |
| SLC2A1 | solute carrier family 2 (facilitated glucose transporter), member 1 gi\|166795298\|ref\|NM_006516.1 (SEQ ID NO: 49) |
| SLC2A2 | solute carrier family 2 (facilitated glucose transporter), member 2 gi\|4557850\|ref\|NM_000340.1 (SEQ ID NO: 50) |

TABLE A3-continued

Target genes for treatment of DR, DME, AMD

| Gene | Full name and Human Gene ID |
|---|---|
| SLC2A3 | *Homo sapiens* solute carrier family 2 (facilitated glucose transporter), member 3 (GLUT3) gi\|221136810\|ref\|NM_006931.1 (SEQ ID NO: 51) |
| SLC5A1 | solute carrier family 5 (sodium/glucose cotransporter), member 1 gi\|208973247\|ref\|NM_000343.2 (SEQ ID NO: 52) |
| SORD | sorbitol dehydrogenase mRNA gi\|156627570\|ref\|NM_003104.3 (SEQ ID NO: 53) |
| CTSD | *Homo sapiens* cathepsin D (CTSD) gi\|23110949\|ref\|NM_001909.3 (SEQ ID NO: 47) |
| CASP2 | caspase 2, apoptosis-related cysteine peptidase gi\|39995058\|ref\|NM_032982.2 (SEQ ID NO: 1) gi\|39995060\|ref\|NM_032983.2 (SEQ ID NO: 2) |
| RTP801 | *Homo sapiens* DNA-damage-inducible transcript 4 (DDIT4), mRNA gi\|56676369\|ref\|NM_019058.2 (SEQ ID NO: 3) |
| p53 | tumor protein p53 gi8400737, NM_000546.2 (SEQ ID NO: 5) |
| TP53BP2 | tumor protein p53 binding protein, 2 gi\|112799848\|ref\|NM_001031685.2 (SEQ ID NO: 6) gi\|112799845\|ref\|NM_005426.2 (SEQ ID NO: 7) |
| LRDD | leucine-rich repeats and death domain containing gi\|61742781\|ref\|NM_018494.3 (SEQ ID NO: 8) gi\|61742783\|ref\|NM_145886.2 (SEQ ID NO: 9) gi\|61742785\|ref\|NM_145887.2 (SEQ ID NO: 10) |
| BNIP3 | BCL2/adenovirus E1B 19 kDa interacting protein 3 gi\|7669480\|ref\|NM_004052.2 (SEQ ID NO: 12) |
| RAC1 | ras-related C3 botulinum toxin substrate 1 (rho family, small GTP binding protein) (gi\|38505164\|ref\|NM_198829.1) (SEQ ID NO: 13) |
| AKR1B1 | aldo-keto reductase family 1, member B1 (aldose reductase) gi\|24497579\|ref\|NM_001628.2 (SEQ ID NO: 48) |
| KEAP1 | Kelch-like ECH-associated protein 1 v 1 gi: 45269144 NM_203500 (SEQ ID NO: 24) v 2 gi: 45269143 NM_012289 (SEQ ID NO: 25) |
| PARP1 | *Homo sapiens* poly (ADP-ribose) polymerase 1 (PARP1), mRNA gi\|156523967\|ref\|NM_001618.3 (SEQ ID NO: 30) |
| AIF (AIFM1) | *Homo sapiens* apoptosis-inducing factor, mitochondrion-associated, 1 variant 4, mRNA gi\|195927003\|ref\|NM_001130846.1 (SEQ ID NO: 31) variant 5, mRNA gi\|195927005\|ref\|NM_001130847.1 (SEQ ID NO: 32) |
| NOS1 | *Homo sapiens* nitric oxide synthase 1 (neuronal) (NOS1), mRNA gi\|194239671\|ref\|NM_000620.2 (SEQ ID NO: 33) |
| NOS2A | *Homo sapiens* nitric oxide synthase 2, inducible (NOS2), mRNA gi\|206597519\|ref\|NM_000625.4 (SEQ ID NO: 34) |
| XIAP | *Homo sapiens* X-linked inhibitor of apoptosis (XIAP), mRNA gi\|32528298\|ref\|NM_001167.21 (SEQ ID NO: 35) |
| SHC1-SHC | Src homology 2 domain containing transforming prot. 1 v 1 gi: 194239661 NM_183001 (SEQ ID NO: 26) v 2 gi: 194239660 NM_003029 (SEQ ID NO: 27) |

TABLE A4

Examples of target genes for treatment of retinitis pigmentosa (RP)

| Gene | Full name and Human Gene ID |
|---|---|
| CASP1 | *Homo sapiens* caspase 1, apoptosis-related cysteine peptidase (interleukin 1, beta, convertase) (CASP1), mRNA variant epsilon, gi\|73622117\|ref\|NM_033295.2 (SEQ ID NO: 54) variant alpha, gi\|73622114\|ref\|NM_033292.2 (SEQ ID NO: 55) |
| CASP3 | *Homo sapiens* caspase 3, apoptosis-related cysteine peptidase (CASP3), mRNA variant alpha, gi\|73622121\|ref\|NM_004346.3 (SEQ ID NO: 56) variant beta, gi\|73622122\|ref\|NM_032991.2 (SEQ ID NO: 57) |
| CASP12 | *Homo sapiens* caspase 12 variant zeta (CASP12) mRNA, complete sequence; alternatively spliced gi\|20069120\|gb\|AF486846.1\| (SEQ ID NO: 58) |
| RTP801 | *Homo sapiens* DNA-damage-inducible transcript 4 (DDIT4), mRNA gi\|56676369\|ref\|NM_019058.2 (SEQ ID NO: 3) |
| RTP801L | *Homo sapiens* DNA-damage-inducible transcript 4-like (DDIT4L), mRNA gi\|34222182\|ref\|NM_145244.2 (SEQ ID NO: 14) |

TABLE A4-continued

Examples of target genes for treatment of retinitis pigmentosa (RP)

| Gene | Full name and Human Gene ID |
|---|---|
| CAPNS1 | Homo sapiens calpain, small subunit 1 (CAPNS1), variant 1, mRNA gi\|51599152\|ref\|NM_001749.2 (SEQ ID NO: 28) variant 2, mRNA gi\|51599150\|ref\|NM_001003962.1 (SEQ ID NO: 29) |
| PARP1 | Homo sapiens poly (ADP-ribose) polymerase 1 (PARP1), mRNA gi\|156523967\|ref\|NM_001618.3 (SEQ ID NO: 30) |
| AIF (AIFM1) | Homo sapiens apoptosis-inducing factor, mitochondrion-associated, 1 variant 4, mRNA gi\|195927003\|ref\|NM_001130846.1 (SEQ ID NO: 31) variant 5, mRNA gi\|195927005\|ref\|NM_001130847.1 (SEQ ID NO: 32) |
| NOS1 | Homo sapiens nitric oxide synthase 1 (neuronal) (NOS1), mRNA gi\|194239671\|ref\|NM_000620.2 (SEQ ID NO: 33) |
| NOS2A | Homo sapiens nitric oxide synthase 2, inducible (NOS2), mRNA gi\|206597519\|ref\|NM_000625.4 (SEQ ID NO: 34) |
| XIAP | Homo sapiens X-linked inhibitor of apoptosis (XIAP), mRNA gi\|32528298\|ref\|NM_001167.21 (SEQ ID NO: 35) |
| SHC1-SHC | Src homology 2 domain containing transforming prot. 1 v 1 gi: 194239661 NM_183001 (SEQ ID NO: 26) v 2 gi: 194239660 NM_003029 (SEQ ID NO: 27) |

"Variant" or "v" refer to transcript variant.

Tables A1-A4 provide the gi (GeneInfo identifier) and accession numbers for an example of polynucleotide sequences of human mRNA to which the oligonucleotide inhibitors of the present invention are directed. ("v" refers to transcript variant)

Inhibition of the genes in Tables A1, A2, A3 and A4 is useful in treating, inter alia, glaucoma, dry eye, diabetic retinopathy (DR), diabetic macular edema (DME), age related macular degeneration (AMD) and retinitis pigmentosa (RP), respectively.

DEFINITIONS

For convenience certain terms employed in the specification, examples and claims are described herein.

It is to be noted that, as used herein, the singular forms "a", "an" and "the" include plural forms unless the content clearly dictates otherwise.

Where aspects or embodiments of the invention are described in terms of Markush groups or other grouping of alternatives, those skilled in the art will recognize that the invention is also thereby described in terms of any individual member or subgroup of members of the group.

An "inhibitor" is a compound which is capable of reducing the expression of a gene or the activity of the product of such gene to an extent sufficient to achieve a desired biological or physiological effect. The term "inhibitor" as used herein refers to one or more of an oligonucleotide inhibitor, including siRNA, antisense, shRNA, miRNA and ribozymes. Inhibition may also be referred to as attenuation of expression of mRNA, down-regulation, or for RNA interference (RNAi), silencing. The inhibitors disclosed herein are chemically modified siRNA compounds which incorporate modifications such as changes to the sugar moiety and/or the base moiety and/or the linkages between nucleotides in the oligonucleotide structure.

The term "inhibit" or "attenuate" as used herein refers to reducing the expression of a gene, a variant or product thereof or the activity of the product of such gene to an extent sufficient to achieve a desired biological or physiological effect. Inhibition may be complete or partial. For example "inhibition" of CASP2 gene means inhibition of the gene expression (transcription or translation) or polypeptide activity of one or more of the variants disclosed in any Table A1 or A3 or an SNP (single nucleotide polymorphism) or other variants thereof.

"Ocular tissue" referees to any tissue associated with structure of the eye and is intended to include, in a non-limiting manner, the sclera, the cornea, the choroid, the retina, the lacrimal gland, and the optic nerve.

"Ocular cell" refers to any cell associated with structures of the eye and lacrimal apparatus and is intended to include, in a non-limiting manner, retinal ganglion cell, a retinal pigment epithelial cell, a corneal cell, conjunctiva, anterior chamber, iris, ciliary process, retina, choroid and choroidal cells, trabecular meshwork, and the like. For example the trabecular meshwork includes the inner uveal meshwork, the corneo-scleral meshwork and the juxtacanalicular tissue. The lacrimal gland includes the lacrimal gland per se, the inferior and superior lacrimal puncta, the inferior and superior lacrimal canal, the lacrimal sac and the like.

As used herein, the terms "polynucleotide" and "nucleic acid" may be used interchangeably and refer to nucleotide sequences comprising deoxyribonucleic acid (DNA), and ribonucleic acid (RNA). The terms should also be understood to include, as equivalents, analogs of either RNA or DNA made from nucleotide analogs. Throughout this application mRNA sequences are set forth as representing the corresponding genes. The terms "mRNA polynucleotide sequence" and mRNA are used interchangeably.

"Oligonucleotide", "oligoribonucleotide or "oligomer" refers to a deoxyribonucleotide or ribonucleotide sequence from about 2 to about 50 nucleotides. Each DNA or RNA nucleotide of the sequence may be independently natural or synthetic, and or modified or unmodified. Modifications include changes to the sugar moiety, the base moiety and or the linkages between nucleotides in the oligonucleotide. The compounds of the present invention encompass molecules comprising deoxyribonucleotides, ribonucleotides, modified deoxyribonucleotides, modified ribonucleotides and combinations thereof.

The present invention provides methods and compositions for inhibiting expression of a target gene in vivo. In general, the method includes topically administering oligoribonucleotides, in particular small interfering RNAs (i.e., siRNAs) or a nucleic acid material that can produce siRNA in a cell, to target an mRNA of the genes set forth in Tables A1-A4; in an amount sufficient to down-regulate expression of a target gene by an RNA interference mechanism. In particular, the method can be used to inhibit expression of the gene for treatment of a subject suffering from an eye disorder or disease related to expression of that gene in ocular tissue or cell. In accordance with the present invention, the siRNA molecules or inhibitors of the target gene are used as drugs to treat various ocular pathologies.

"Nucleotide" is meant to encompass deoxyribonucleotides and ribonucleotides, which may be natural or synthetic, and or modified or unmodified. Modifications include changes and substitutions to the sugar moiety, the base moiety and/or the internucleotide linkages.

As used herein, the terms "non-pairing nucleotide analog" means a nucleotide analog which comprises a non-base pairing moiety including but not limited to: 6 des amino adenosine (Nebularine), 4-Me-indole, 3-nitropyrrole, 5-nitroindole, Ds, Pa, N3-Me ribo U, N3-Me riboT, N3-Me dC, N3-Me-dT, N1-Me-dG, N1-Me-dA, N3-ethyl-dC, N3-Me dC. In some embodiments the non-base pairing nucleotide analog is a ribonucleotide. In other embodiments it is a deoxyribonucleotide.

All analogs of, or modifications to, a nucleotide/oligonucleotide may be employed with the present invention, provided that said analog or modification does not substantially adversely affect the stability and function of the nucleotide/oligonucleotide. Acceptable modifications include modifications of the sugar moiety, modifications of the base moiety, modifications in the internucleotide linkages and combinations thereof.

What is sometimes referred to in the present invention as an "abasic nucleotide" or "abasic nucleotide analog" is more properly referred to as a pseudo-nucleotide or an unconventional moiety. A nucleotide is a monomeric unit of nucleic acid, consisting of a ribose or deoxyribose sugar, a phosphate, and a base (adenine, guanine, thymine, or cytosine in DNA; adenine, guanine, uracil, or cytosine in RNA). A modified nucleotide comprises a modification in one or more of the sugar, phosphate and or base. The abasic pseudo-nucleotide lacks a base, and thus is not strictly a nucleotide.

The term "capping moiety" as used herein includes abasic ribose moiety, abasic deoxyribose moiety, modifications abasic ribose and abasic deoxyribose moieties including 2' O alkyl modifications; inverted abasic ribose and abasic deoxyribose moieties and modifications thereof; C6-imino-Pi; a mirror nucleotide including L-DNA and L-RNA; 5'OMe nucleotide; and nucleotide analogs including 4',5'-methylene nucleotide; 1-(β-D-erythrofuranosyl)nucleotide; 4'-thio nucleotide, carbocyclic nucleotide; 5'-amino-alkyl phosphate; 1,3-diamino-2-propyl phosphate, 3-aminopropyl phosphate; 6-aminohexyl phosphate; 12-aminododecyl phosphate; hydroxypropyl phosphate; 1,5-anhydrohexitol nucleotide; alpha-nucleotide; threo-pentofuranosyl nucleotide; acyclic 3',4'-seco nucleotide; 3,4-dihydroxybutyl nucleotide; 3,5-dihydroxypentyl nucleotide, 5'-5'-inverted abasic moiety; 1,4-butanediol phosphate; 5'-amino; and bridging or non bridging methylphosphonate and 5'-mercapto moieties. A 2'-O-methyl sugar modified ribonucleotide is also referred to as 2'-OMe sugar modified or 2'-OMe modified ribonucleotide Certain preferred capping moieties are abasic ribose or abasic deoxyribose moieties; inverted abasic ribose or abasic deoxyribose moieties; C6-amino-Pi; a mirror nucleotide including L-DNA and L-RNA.

The term "unconventional moiety" as used herein refers to abasic ribose moiety, an abasic deoxyribose moiety, a deoxyribonucleotide, a modified deoxyribonucleotide, a mirror nucleotide, a non-base pairing nucleotide analog and a nucleotide joined to an adjacent nucleotide by a 2'-5' internucleotide phosphate bond; bridged nucleic acids including LNA and ethylene bridged nucleic acids.

Abasic deoxyribose moiety includes for example abasic deoxyribose-3'-phosphate; 1,2-dideoxy-D-ribofuranose-3-phosphate; 1,4-anhydro-2-deoxy-D-ribitol-3-phosphate. Inverted abasic deoxyribose moiety includes inverted deoxyriboabasic; 3',5' inverted deoxyabasic 5'-phosphate.

In the context of the present invention, a "mirror" nucleotide (also referred to as a spieglemer), is a nucleotide analog with reverse chirality to the naturally occurring or commonly employed nucleotide, i.e., a mirror image of the naturally occurring or commonly employed nucleotide. The mirror nucleotide is a ribonucleotide (L-RNA) or a deoxyribonucleotide (L-DNA) and may further comprise at least one sugar or base modification and/or a backbone modification, such as a phosphorothioate or phosphonate moiety. U.S. Pat. No. 6,602,858 discloses nucleic acid catalysts comprising at least one L-nucleotide substitution. Mirror nucleotide includes for example L-DNA (L-deoxyriboadenosine-3'-phosphate (mirror dA); L-deoxyribocytidine-3'-phosphate (mirror dC); L-deoxyriboguanosine-3'-phosphate (mirror dG); L-deoxyribothymidine-3'-phosphate (mirror dT) and L-RNA (L-riboadenosine-3'-phosphate (mirror rA); L-ribocytidine-3'-phosphate (mirror rC); L-riboguanosine-3'-phosphate (mirror rG); L-ribouracil-3'-phosphate (mirror dU)

Modified deoxyribonucleotide includes, for example 5'OMe DNA (5-methyl-deoxyriboguanosine-3'-phosphate) which may be useful as a nucleotide in the 5' terminal position (position number 1); PACE (deoxyriboadenine 3' phosphonoacetate, deoxyribocytidine 3' phosphonoacetate, deoxyriboguanosine 3' phosphonoacetate, deoxyribothymidine 3' phosphonoacetate.

Bridged nucleic acids include LNA (2'-O,4'-C-methylene bridged Nucleic Acid adenosine 3' monophosphate, 2'-O,4'-C-methylene bridged Nucleic Acid 5-methyl-cytidine 3' monophosphate, 2'-O,4'-C-methylene bridged Nucleic Acid guanosine 3' monophosphate, 5-methyl-uridine (or thymidine) 3' monophosphate); and ENA (2'-O,4'-C-ethylene bridged Nucleic Acid adenosine 3' monophosphate, 2'-O,4'-C-ethylene bridged Nucleic Acid 5-methyl-cytidine 3' monophosphate, 2'-O,4'-C-ethylene bridged Nucleic Acid guanosine 3' monophosphate, 5-methyl-uridine (or thymidine) 3' monophosphate).

In some embodiments of the present invention a preferred unconventional moiety is an abasic ribose moiety, an abasic deoxyribose moiety, a deoxyribonucleotide, a mirror nucleotide, and a nucleotide joined to an adjacent nucleotide by a 2'-5' internucleotide phosphate bond.

According to one aspect the present invention provides inhibitory oligonucleotide compounds comprising unmodified and modified nucleotides. The compound comprises at least one modified nucleotide selected from the group consisting of a sugar modification, a base modification and an internucleotide linkage modification and may contain DNA, and modified nucleotides such as LNA (locked nucleic acid) including ENA (ethylene-bridged nucleic acid; PNA (peptide nucleic acid); arabinoside; PACE (phosphonoacetate and derivatives thereof), mirror nucleotide, or nucleotides with a 6 carbon sugar.

In one embodiment the compound comprises a 2' modification on the sugar moiety of at least one ribonucleotide ("2' sugar modification"). In certain embodiments the compound comprises 2'O-alkyl or 2'-fluoro or 2'O-allyl or any other 2' sugar modification, optionally on alternate positions.

Other stabilizing modifications are also possible (e.g. modified nucleotides added to a 3' or 5' terminus of an oligomer). In some embodiments the backbone of the oligonucleotides is modified and comprises phosphate-D-ribose entities but may also contain thiophosphate-D-ribose entities, triester, thioate, 2'-5' bridged backbone (also may be referred to as 5'-2'), PACE modified internucleotide linkage or any other type of modification.

Other modifications include additions to the 5' and/or 3' termini of the oligonucleotides. Such terminal modifications may be lipids, peptides, sugars or other molecules.

Possible modifications to the sugar residue are manifold and include 2'-O alkyl, locked nucleic acid (LNA), glycol nucleic acid (GNA), threose nucleic acid (TNA), arabinoside; altritol (ANA) and other 6-membered sugars including morpholinos, and cyclohexinyls.

LNA compounds are disclosed in International Patent Publication Nos. WO 00/47599, WO 99/14226, and WO 98/39352. Examples of siRNA compounds comprising LNA nucleotides are disclosed in Elmen et al., (NAR 2005. 33(1): 439-447) and in International Patent Publication No. WO 2004/083430. Six-membered ring nucleotide analogs are disclosed in Allart, et al (Nucleosides & Nucleotides, 1998, 17:1523-1526; and Perez-Perez, et al., 1996, Bioorg. and Medicinal Chem Letters 6:1457-1460) Oligonucleotides comprising 6-membered ring nucleotide analogs including hexitol and altritol nucleotide monomers are disclosed in International patent application publication No. WO 2006/047842.

Backbone modifications, such as ethyl (resulting in a phospho-ethyl triester); propyl (resulting in a phospho-propyl triester); and butyl (resulting in a phospho-butyl triester) are also possible. Other backbone modifications include polymer backbones, cyclic backbones, acyclic backbones, thiophosphate-D-ribose backbones, amidates, and phosphonoacetate derivatives. Certain structures include siRNA compounds having one or a plurality of 2'-5' internucleotide linkages (bridges or backbone).

The present invention also relates to compounds which down-regulate expression of various genes, particularly to novel small interfering RNA (siRNA) compounds, and to the use of these novel siRNAs in the treatment of various ocular diseases and medical conditions of the eye.

For each gene there is a separate list of 19-mer oligomer sequences, which are prioritized based on their score in the proprietary algorithm as the best sequences for targeting the human gene expression. 21- or 23-mer siRNA sequences can be generated by 5' and/or 3' extension of the 19-mer sequences disclosed herein. Such extension is preferably complementary to the corresponding mRNA sequence. Certain 23-mer oligomers were devised by this method where the order of the prioritization is the order of the corresponding 19-mer. Tables B1-B36 provide human sense and corresponding antisense oligonucleotides useful in preparing siRNA. The abbreviations for cross species are: Ms: Mouse, Rb: Rabbit, Chmp: chimpanzee, Mnk: Monkey, Chn: chinchilla, GP: guinea-pig.

Ocular Diseases

Topical delivery of therapeutic oligonucleotide compounds is useful in the treatment of a broad spectrum of eye diseases and disorders. Certain of the compounds of the invention are useful in treating patients suffering from diseases and disorders in which neuroprotection of the optic nerve would be of benefit, for example in:
1. open angle primary/secondary glaucoma
2. multiple sclerosis (optic neuritis)
3. central or brunch retinal vein occlusion
4. ischemic optic neuropathy (in status epilepticus, HIV-1 infection)
5. optic nerve injury
6. tumors extending into the suprasellar region (above the sella turcica)
7. juxta chiasmal tumors (the visual loss associated with compression of the optic chiasm by pituitary tumors may be transient or permanent, possibly related to the extent of irreversible retrograde degeneration to the retinal ganglion cells.
8. Retinoblastoma Primary Open-Angle Glaucoma The majority of the cases of glaucoma are the form known as primary-open-angle glaucoma POAG, also called chronic open-angle glaucoma). POAG results from a build up of aqueous humor fluid within the anterior chamber of the eye resulting in intraocular pressure (IOP). Elevated IOP, which can be measured by a "tonometry" test, results from fluid entering the eye and not enough fluid exiting the eye. Normally, fluid enters the eye by seeping out of the blood vessels in the ciliary body. This fluid eventually makes its way past the crystalline lens, through the pupil (the central opening in the iris), and into the irido-corneal angle, the anatomical angle formed where the iris and the cornea come together. Then the fluid passes through the trabecular meshwork in the angle and leaves the eye via the canal of Schlemm.

If excess fluid enters the eye, or if the trabecular meshwork "drain" gets clogged up (for instance, with debris or cells) so that not enough fluid is leaving the eye, the pressure builds up in what is known as "open angle glaucoma." Open angle glaucoma also can be caused when the posterior portion of the iris adheres to the anterior surface of the lens creating a "pupillary block", and preventing intraocular fluid from passing through the pupil into the anterior chamber.

If the angle between the iris and the cornea is too narrow or is even closed, then the fluid backs up, causing increased pressure in what is known as "closed angle glaucoma."

Untreated glaucoma eventually leads to optic atrophy and blindness.

Normal Tension Glaucoma

Intraocular eye pressure is normal (between 12-22 mmHg) in about 25-30% glaucoma cases in the US, a condition known as normal-tension glaucoma. (In Japan, the rates may be as high as 70%.) Other factors are present that cause optic nerve damage but do not affect IOP.

Closed-Angle Glaucoma

Closed-angle glaucoma (also called angle-closure glaucoma) is responsible for 15% of all glaucoma cases. It is less common than POAG in the U.S., but it constitutes about half of the world's glaucoma cases because of its higher prevalence among Asians. The iris is pushed against the lens, sometimes sticking to it, closing off the drainage angle. This can occur very suddenly, resulting in an immediate rise in pressure. It often occurs in genetically susceptible people when the pupil shrinks suddenly. Closed-angle glaucoma can also be chronic and gradual, a less common condition.

Congenital Glaucoma

Congenital glaucoma, in which the eye's drainage canals fail to develop correctly, is present from birth. It is very rare, occurring in about 1 in 10,000 newborns. This may be an inherited condition and often can be corrected with microsurgery.

In one aspect the present invention provides a method of attenuating expression of a target ocular mRNA in the eye of a subject suffering from glaucoma, comprising topically (non-invasively) administering to the surface of the eye of the subject an effective amount of at least one chemically modified siRNA and a pharmaceutically acceptable carrier. In certain embodiments the at least one ocular target mRNA is a product of a gene selected from a list in Table A1 set forth in SEQ ID NOS:1-35. In certain preferred embodiments the target ocular mRNA is a product of a gene selected from CASP2, ASPP1, TP53BP2, BNIP3, RTP801L, ACHE, ADRB1 and CAPNS1. In a currently preferred embodiment the siRNA is formulated for delivery as eye drops. In various embodiments the target ocular mRNA set forth in SEQ ID NOS:1-2.

In another aspect the present invention provides a method of treating glaucoma in a subject in need of treatment, comprising topically (non-invasively) administering to the surface of the eye of the subject a therapeutically effective amount of at least one chemically modified siRNA which inhibits expression of a target gene in the eye of the subject. In some embodiments the gene is a human gene selected from a list in Table A1, transcribed into mRNA set forth in any one of SEQ ID NOS:1-35. In certain preferred embodiments the gene is selected from CASP2, ASPP1, TP53BP2, BNIP3, RTP801L, ACHE, ADRB1 and CAPNS1. In a currently preferred embodiment the siRNA is formulated for delivery as eye drops. In various embodiments the target ocular mRNA set forth in SEQ ID NOS:1-2.

Optic Neuritis

Optic neuritis is an inflammation of the optic nerve that may affect the part of the nerve and disc within the eyeball (papillitis) or the portion behind the eyeball (retrobulbar optic neuritis). Optic neuritis may be caused by any of the following: demyelinating diseases such as multiple sclerosis or post infectious encephalomyelitis; systemic viral or bacterial infections including complications of inflammatory diseases (e.g., sinusitis, meningitis, tuberculosis, syphilis, chorioretinitis, orbital inflammation); nutritional and metabolic diseases (e.g., diabetes, pernicious anemia, hyperthyroidism); Leber's Hereditary Optic Neuropathy, a rare form of inherited optic neuropathy which mainly affects young men; toxins (tobacco, methanol, quinine, arsenic, salicylates, lead); and trauma.

Optic Atrophy

Optic atrophy is a hereditary or acquired loss of vision disorder that results from the degeneration of the optic nerve and optic tract nerve fibers. It may be acquired via occlusions of the central retinal vein or artery, arteriosclerotic changes, may be secondary to degenerative retinal disease, may be a result of pressure against the optic nerve, or may be related to metabolic diseases (e.g., diabetes), trauma, glaucoma, or toxicity (to alcohol, tobacco, or other poisons). Degeneration and atrophy of optic nerve fibers is irreversible, although intravenous steroid injections have been seen to slow down the process in some cases.

Papilledema

A swelling of the optic disc (papilla), most commonly due to an increase in intracranial pressure (tumor induced), malignant hypertension, or thrombosis of the central retinal vein. The condition usually is bilateral, the nerve head is very elevated and swollen, and pupil response typically is normal. Vision is not affected initially and there is no pain upon eye movement. Secondary optic nerve atrophy and permanent vision loss can occur if the primary cause of the papilledema is left untreated.

Ischemic Optic Neuropathy (ION)

A severely blinding disease resulting from loss of the arterial blood supply to the optic nerve (usually in one eye), as a result of occlusive disorders of the nutrient arteries. Optic neuropathy can be anterior, which causes a pale edema of the optic disc, or posterior, in which the optic disc is not swollen and the abnormality occurs between the eyeball and the optic chiasm. Ischemic anterior optic neuropathy usually causes a loss of vision that may be sudden or occur over several days. Ischemic posterior optic neuropathy is uncommon, and the diagnosis depends largely upon exclusion of other causes, chiefly stroke and brain tumor.

Other diseases and conditions include dry eye, diabetic retinopathy, diabetic macular edema and retinitis pigmentosa.

Dry Eye

Dry eye, also known as keratoconjunctivitis sicca or keratitis sicca, is a common problem usually resulting from a decrease in the production of tear film that lubricates the eyes. Most patients with dry eye experience discomfort, and no vision loss; although in severe cases, the cornea may become damaged or infected.

Dry eye is a multifactorial disease of the tears and ocular surface that results in symptoms of discomfort, visual disturbance, and tear film instability with potential damage to the ocular surface. It is accompanied by increased osmolarity of the tear film and inflammation of the ocular surface.

The lacrimal gland is a multilobular tissue composed of acinar, ductal, and myoepithelial cells. The acinar cells account for 80% of the cells present in the lacrimal gland and are the site for synthesis, storage, and secretion of proteins. Several of these proteins have antibacterial (lysozyme, lactoferrin) or growth factor (epidermal growth factor, transforming growth factor α, keratocyte growth factor) properties that are crucial to the health of the ocular surface. The primary function of the ductal cells is to modify the primary fluid secreted by the acinar cells and to secrete water and electrolytes. The myoepithelial cells contain multiple processes, which surround the basal area of the acinar and ductal cells, and are believed to contract and force fluid out of the ducts and onto the ocular surface.

Mechanisms of Lacrimal Gland Dysfunction

Apoptosis, hormonal imbalance, production of autoantibodies, alterations in signaling molecules, neural dysfunction, and increased levels of proinflammatory cytokines have been proposed as possible mediators of lacrimal gland insufficiency. One of the primary symptoms of Sjögrens Syndrome is dry eye. Apoptosis of the acinar and ductal epithelial cells of the lacrimal glands has been proposed as a possible mechanism responsible for the impairment of secretory function (Manganelli and Fietta, Semin Arthritis Rheum. 2003. 33(1): 49-65). Without wishing to be bound by theory, apoptotic epithelial cell death may be due to activation of several apoptotic pathways involving Fas (Apo-1/CD95), FasL (FasL/CD95L), Bax, caspases, perforin, and granzyme B. Cytotoxic T cells through the release of proteases, such as perforin and granzyme B, or the interaction of FasL expressed by T cells with Fas on epithelial cells, can lead to apoptosis of the acinar cells.

The current treatment for dry eye is mainly local and symptomatic such as: tear supplementation with lubricants; tear retention with therapies such as punctal occlusion, moisture chamber spectacles or contact lenses; tear stimulation for example by secretagogues; biological tear substitutes; anti-inflammatory therapy (Cyclosporine, Corticosteroids, Tetracyclines); and dietary essential fatty acids.

In one aspect the present invention provides a method of attenuating expression of a target ocular mRNA in the eye of a subject suffering from dry-eye, comprising topically (non-invasively) administering to the surface of the eye of the subject an effective amount of at least one chemically modified siRNA and a pharmaceutically acceptable carrier. In some embodiments the target ocular mRNA is product of a human gene selected Table A2 set forth in SEQ ID NOS: 5, 8-10, 26-27, 30-44. In some embodiments the target ocular mRNA is selected from FAS, FAS ligand (FASL), p53, LRDD, PARP1, AIF (apoptosis inducing factor), NOS1, NOS2A, XIAP and SHC1-SHC. In certain preferred embodiments the target ocular mRNA is set forth in any one of SEQ ID NOS:36-44. In a currently preferred embodiment the siRNA is formulated for delivery as eye drops. In various embodiments the subject is suffering from Sjögrens syndrome. In some embodiments the siRNA sense and antisense strands are selected from sequences in Tables 16-17, set forth in SEQ ID NOS: 13225-15224.

In another aspect the present invention provides a method of treating dry-eye in a subject in need of treatment, comprising topically (non-invasively) administering to the surface of the eye of the subject a therapeutically effective amount of at least one chemically modified siRNA which inhibits expression of a target gene in the eye of the subject. In some embodiments the target gene is a human gene selected from Table A2, whose mRNA is set forth in any one of SEQ ID NOS: 5, 8-10, 26-27, or 30-44. In some embodiments the target gene is selected from FAS, FAS ligand (FASL), p53, LRDD, PARP1, AIF (apoptosis inducing factor), NOS1, NOS2A, XIAP and SHC1-SHC. In certain preferred embodiments the target gene mRNA is set forth in any one of SEQ ID NOS:36-44. In a currently preferred embodiment the siRNA is formulated for delivery as eye drops. In various embodiments the subject is suffering from Sjögrens syndrome. In some embodiments the siRNA sense and antisense strands are selected from sequences in Tables 16-17, set forth in SEQ ID NOS: 13225-15224.

Retinitis Pigmentosa

Retinitis pigmentosa (RP) represents a group of inherited disorders characterized by progressive peripheral vision loss and nyctalopia that can lead to central vision loss. There is currently no cure for retinitis pigmentosa, although the progression of the disease can be attenuated by dietary vitamin A supplementation.

Apoptosis in rod and cone photoreceptor cells is a critical process of retinal degeneration in RP and represent a major cause of adult blindness.

In one aspect the present invention provides a method of attenuating expression of a target ocular mRNA in the eye of a subject suffering from Retinitis pigmentosa (RP), comprising topically (non-invasively) administering to the surface of the eye of the subject an effective amount of at least one chemically modified siRNA and a pharmaceutically acceptable carrier. In some embodiments the target ocular mRNA is product of a gene selected from a gene listed in Table A4, the gene transcribed into mRNA set forth in any one of SEQ ID NOS: 3, 14, 26-35, 54-57. In some embodiments the target ocular mRNA is product of a gene selected from the group consisting of CASP1, CASP3, CASP12, RTP801, RTP801L, Calpain 51, PARP1, AIF, NOS1, NOS2, XIAP and SHC1-SHC. In a currently preferred embodiment the siRNA is formulated for delivery as eye drops. In certain preferred embodiments the siRNA targets mRNA set forth in SEQ ID NOS:56-57. In some embodiments the siRNA sense and antisense strands are selected from sequences in Table 11, set forth in SEQ ID NOS: 9517-10516.

In another aspect the present invention provides a method of treating Retinitis pigmentosa (RP) in a subject in need of treatment, comprising topically (non-invasively) administering to the surface of the eye of the subject a therapeutically effective amount of at least one chemically modified siRNA which inhibits expression of a target gene in the eye of the subject. In some embodiments the target gene is a human gene listed in Table A4, transcribed into mRNA set forth in any one of SEQ ID NOS: 3, 14, 26-35, 54-57. In some embodiments the gene is a human gene selected from selected from the group consisting of CASP1, CASP3, CASP12, RTP801, RTP801L, Calpain 51, PARP1, AIF, NOS1, NOS2, XIAP and SHC1-SHC. In a currently preferred embodiment the siRNA is formulated for delivery as eye drops. In certain preferred embodiments the siRNA targets and inhibits mRNA set forth in SEQ ID NOS:56-57. In some embodiments the siRNA sense and antisense strands are selected from sequences in Table 11, set forth in SEQ ID NOS: 9517-10516.

Diabetic Retinopathy

Diabetic retinopathy is a complication of diabetes and a leading cause of blindness. It occurs when diabetes damages the tiny blood vessels inside the retina. Diabetic retinopathy has four stages:

Mild Nonproliferative Retinopathy: microaneurysms in the retina's blood vessels.

Moderate Nonproliferative Retinopathy. As the disease progresses, some blood vessels that nourish the retina are blocked.

Severe Nonproliferative Retinopathy. Many more blood vessels are blocked, depriving several areas of the retina of a blood supply, which is overcome by the growth of new blood vessels.

Proliferative Retinopathy. The new blood vessels grow along the retina and along the surface of the vitreous gel. When the vessels leak blood, severe vision loss and even blindness can result.

During pregnancy, diabetic retinopathy may be a problem for women with diabetes.

In one aspect the present invention provides a method of attenuating expression of a target ocular mRNA in the eye of a subject suffering from diabetic retinopathy, comprising topically (non-invasively) administering to the surface of the eye of the subject an effective amount of at least one chemically modified siRNA and a pharmaceutically acceptable carrier. In some embodiments the target ocular mRNA is product of a human gene listed in Table A3 having mRNA set forth in any one of SEQ ID NOS:1-2, 3, 5, 6-7, 8-10, 12, 13, 24-25, 26-27, 30-35, 45-53. In a currently preferred embodiment the siRNA is formulated for delivery as eye drops. In certain preferred embodiment the target ocular mRNA set forth in any one of SEQ ID NOS:48-53. In some embodiments the siRNA sense and antisense strands are selected from sequences in Tables 4, 28-32 set forth in SEQ ID NOS: 2669-3648 and 25575-29594.

In another aspect the present invention provides a method of treating diabetic retinopathy in a subject in need of treatment, comprising topically (non-invasively) administering to the surface eye of the subject a therapeutically effective amount of at least one chemically modified siRNA which inhibits expression of a target gene in the eye of the subject. In some embodiments the target gene is a human gene listed in Table A3, having mRNA set forth in any one SEQ ID NOS: 1-2, 3, 5, 6-7, 8-10, 12, 13, 24-25, 26-27, 30-35, 45-53. In a currently preferred embodiment the siRNA is formulated for delivery as eye drops. In certain preferred embodiment the target ocular mRNA set forth in any one of SEQ ID NOS:48-53. In some embodiments the siRNA sense and antisense strands are selected from sequences in Tables 4, 28-32 set forth in SEQ ID NOS: 2669-3648 and 25575-29594.

Without wishing to be bound to theory, blood vessels damaged from diabetic retinopathy can cause vision loss in two ways: Fragile, abnormal blood vessels can develop and leak blood into the center of the eye, blurring vision. This is proliferative retinopathy and is the fourth and most advanced stage of the disease. Fluid can leak into the center of the macula, resulting in blurred vision. This condition is called macular edema. It can occur at any stage of diabetic retinopathy, although it is more likely to occur as the disease progresses and is known as diabetic macular edema (DME).

Age Related Macular Degeneration (AMD)

The most common cause of decreased best-corrected, vision in individuals over 65 years of age in the United States is the retinal disorder known as age-related macular degeneration (AMD). The area of the eye affected by AMD is the macula, a small area in the center of the retina, composed primarily of photoreceptor cells. As AMD progresses, the disease is characterized by loss of sharp, central vision. So-called "dry" AMD accounts for about 85%-90% of AMD patients and involves alterations in eye pigment distribution, loss of photoreceptors and diminished retinal function due to overall atrophy of cells. "Wet" AMD involves proliferation of abnormal choroidal vessels leading to clots or scars in the sub-retinal space. Thus, the onset of "wet" AMD occurs because of the formation of an abnormal choroidal neovascular network (choroidal neovascularization, CNV) beneath the neural retina. The newly formed blood vessels are excessively leaky. This leads to accumulation of subretinal fluid and blood leading to loss of visual acuity. Eventually, there is total loss of functional retina in the involved region, as a large disciform scar involving choroids and retina forms. While dry AMD patients may retain vision of decreased quality, wet AMD often results in blindness. (Hamdi & Kenney, Frontiers in Bioscience, e305-314, May 2003).

In one aspect the present invention provides a method of attenuating expression of a target ocular mRNA in the eye of a subject suffering from AMD or DME, comprising topically (non-invasively) administering to the surface of the eye of the subject an effective amount of at least one chemically modified siRNA and a pharmaceutically acceptable carrier. In some embodiments the target ocular mRNA is product of a human gene listed in Table A3, having mRNA set forth in any one of SEQ ID NOS:1-2, 3, 5, 6-7, 8-10, 12, 13, 24-25, 26-27, 30-35, 45-53. In a currently preferred embodiment the siRNA is formulated for delivery as eye drops. In certain preferred embodiment the target ocular mRNA is product of a human CTSD, RTP801 and BNIP3.

In another aspect the present invention provides a method of treating AMD or DME in a subject in need of treatment, comprising topically (non-invasively) administering to the surface of the eye of the subject a therapeutically effective amount of at least one chemically modified siRNA which inhibits expression of a target gene in the eye of the subject. In some embodiments the target gene is a human gene listed in Table A3, having mRNA set forth in any one of SEQ ID NOS:1-2, 3, 5, 6-7, 8-10, 12, 13, 24-25, 26-27, 30-35, 45-53. In a currently preferred embodiment the siRNA is formulated for delivery as eye drops. In certain preferred embodiment the target human gene is a human CTSD, RTP801 and BNIP3.

Additional Ocular Conditions to be Treated by Compounds of the Present Invention Viral and Bacterial Conditions Viral and bacterial conditions relating to ocular tissues can be treated by the compounds of the present invention. Conjunctivitis and other eyelid diseases or conditions can be treated, in particular by administering according to the methods of the present invention oligonucleotides such as siRNAs which target genes which are essential for replication and/or survival of the organisms which cause such conditions.

Vision Loss Associated with Tumors

In another aspect the present invention provides method of treating vision loss associated with a tumor in a subject in need thereof which comprises topically and non-invasively administering to the surface of the eye of the subject a therapeutically effective amount of at least one chemically modified siRNA which inhibits expression of at least one gene associated with the tumor in the subject in an amount effective to treat the vision loss.

Tumors that cause vision loss, according to the present invention, include both malignant neoplasms (cancers) and benign tumors. Tumors include tumors of any ocular tissue or any type of ocular cell, including, but not limited to, Choroidal tumors, Conjunctival tumors, Eyelid tumors, Infiltrative Intraocular tumors, Iris tumors, Metastatic Ocular tumors, Optic Nerve tumors, Orbital tumors and Retinal tumors. More specifically, a non exhaustive list of tumors and cancers which the present invention aims to treat includes Choroidal Tumors such as Choroidal Hemangioma, Choroidal Melanoma, Choroidal Metastasis, Choroidal Nevus, Choroidal Osteoma, Ciliary Body Melanoma and Nevus of Ota; Conjunctival Tumors such as Conjunctival Kaposi's Sarcoma, Epibulbar Dermoid, Lymphoma of the Conjunctiva, Melanoma and PAM with Atypia, Pigmented Conjunctival Tumors, Pingueculum, Pterygium, Squamous Carcinoma and Intraepithelial Neoplasia of the Conjunctiva; Eyelid Tumors such as Basal Cell Carcinoma, Capillary Hemangioma, Hydrocystoma, Nevus at the Eyelid Margin, Seborrheic Keratosis, Malignant Melanoma of the Eyelid, Sebaceous Carcinoma of the Eyelid and Squamous Carcinoma of the Eyelid; Infiltrative Intraocular Tumors such as Chronic Lymphocytic Leukemia, Infiltrative Choroidopathy and Intraocular Lymphoma; Iris Tumors such as Anterior Uveal Metastasis, Iris Cysts, Iris Melanocytoma, Iris Melanoma and Pearl Cyst of the Iris; Metastatic Ocular Tumors such as Metastatic Choroidal Melanoma; Optic Nerve Tumors such as Choroidal Melanoma Affecting the Optic Nerve, Circumpapillary Metastasis with Optic Neuropathy, Optic Nerve Melanocytoma and Optic Nerve Sheath Meningioma; Orbital Tumors such as Adenoid Cystic Carcinoma of the Lacrimal Gland, Cavernous Hemangioma of the Orbit, Lymphangioma of the Orbit, Orbital Mucocele, Orbital Pseudotumor, Orbital Rhabdomyosarcoma, Periocular Hemangioma of Childhood and Sclerosing Orbital Pseudotumor; Retinal Tumors such as Retinal Pigment Epithelial (RPE) Hypertrophy, Retinal Pigment Epithelium (RPE) Tumors, Retinoblastoma and von Hippel Angioma.

Pharmaceutical Compositions

While it may be possible for the oligonucleotide compounds of the present invention to be administered as the raw chemical, it is preferable to administer them as a pharmaceutical composition. Accordingly the present invention provides a pharmaceutical composition comprising one or more of the compounds of the invention; and a pharmaceutically acceptable carrier. This composition may comprise a mixture of two or more different oligonucleotides/siRNAs.

The invention further provides a pharmaceutical composition comprising at least one compound of the invention covalently or non-covalently bound to one or more compounds of the invention in an amount effective to inhibit one or more genes as disclosed above; and a pharmaceutically acceptable carrier. The compound may be processed intracellularly by endogenous cellular complexes to produce one or more oligoribonucleotides of the invention.

The invention further provides a pharmaceutical composition comprising a pharmaceutically acceptable carrier and one or more of the compounds of the invention in an amount effective to down-regulate expression in of a human gene in an eye of a subject suffering from an eye disease or disorder.

The present invention also provides for a process of preparing a pharmaceutical composition, which comprises:
  providing one or more compounds of the invention; and
  admixing said compound with a pharmaceutically acceptable carrier.

The pharmaceutically acceptable carrier is preferably selected by one with skill in the art for ophthalmological administration.

In various embodiments the pharmaceutical composition of the invention comprises at least one siRNA compound of the invention, or salt thereof, up to 99% by weight, mixed with a physiologically acceptable ophthalmic carrier medium such as water, sodium chloride, buffer, saline (e.g. phosphate buffered saline (PBS)), mannitol, and the like, and combinations thereof, to form an aqueous, sterile ophthalmic suspension or solution.

The pharmaceutical composition further optionally comprises at least one ophthalmologically acceptable preservative, such as for example benzalkonium chloride. Further, the ophthalmic pharmaceutical composition may include an ophthalmologically acceptable surfactant to assist in dissolving the siRNA.

Ophthalmic pharmaceutical composition of the invention may be prepared by dissolving or admixing one or more of the interfering RNA with an ophthalmologically acceptable carrier, such as for example a physiologically acceptable isotonic aqueous buffer.

In a preferred embodiment, the siRNA compound used in the preparation of an ophthalmological composition is admixed with an ophthalmologically acceptable carrier in a pharmaceutically effective dose. In certain preferred embodiments the ophthalmologically acceptable carrier is PBS.

In some embodiments the pharmaceutical ophthalmic compositions of the invention further comprise additional pharmaceutically active agents or a combination of pharmaceutically active agent, such as non-steroidal anti-inflammatory drugs, corticosteroids, antibiotics, and the like.

Additionally, the invention provides a method of inhibiting the expression of a gene of the present invention by at least 20% as compared to a control comprising contacting an mRNA transcript of the gene of the present invention with one or more of the compounds of the invention. In some embodiments an active siRNA compound inhibits gene expression at a level of at least 20%, 30%, 40%, 50%, 60% or 70% as compared to control. In certain preferred embodiments inhibition is at a level of at least 75%, 80% or 90% as compared to control.

In one embodiment the oligoribonucleotide is inhibiting one or more of the genes of the present invention, whereby the inhibition is selected from the group comprising inhibition of gene function, inhibition of polypeptide and inhibition of mRNA expression.

In one embodiment the compound inhibits a polypeptide, whereby the inhibition is selected from the group comprising inhibition of function (which may be examined by an enzymatic assay or a binding assay with a known interactor of the native gene/polypeptide, inter alia), inhibition of protein (which may be examined by Western blotting, ELISA or immuno-precipitation, inter alia) and inhibition of mRNA expression (which may be examined by Northern blotting, quantitative RT-PCR, in-situ hybridization or microarray hybridization, inter alia).

Combination Therapy

The compounds of the present invention can be administered alone or in combination with another therapeutic agent useful in treating an eye disorder or disease.

In some embodiments the pharmaceutical ophthalmic compositions of the invention further comprise additional pharmaceutically active agents or a combination of pharmaceutically active agent, such as oligonucleotide, e.g. siRNA, non-steroidal anti-inflammatory drug, corticosteroid, antibiotic, and the like.

In one embodiment, the co-administration of two or more therapeutic agents achieves a synergistic effect, i.e., a therapeutic affect that is greater than the sum of the therapeutic effects of the individual components of the combination. In another embodiment, the co-administration of two or more therapeutic agents achieves an additive effect.

The active ingredients that comprise a combination therapy may be administered together via a single dosage form or by separate administration of each active agent. In certain embodiments, the first and second therapeutic agents are administered in a single dosage form. The agents may be formulated into a single solution for topical administration. Alternatively, the first therapeutic agent and the second therapeutic agents may be administered as separate compositions. The first active agent may be administered at the same time as the second active agent or the first active agent may be administered intermittently with the second active agent. The length of time between administration of the first and second therapeutic agent may be adjusted to achieve the desired therapeutic effect. For example, the second therapeutic agent may be administered only a few minutes (e.g., 1, 2, 5, 10, 30, or 60 min) or several hours (e.g., 2, 4, 6, 10, 12, 24, or 36 hr) after administration of the first therapeutic agent. In certain embodiments, it may be advantageous to administer more than one dosage of one of the therapeutic agents between administrations of the second therapeutic agent. For example, the second therapeutic agent may be administered at 2 hours and then again at 10 hours following administration of the first therapeutic agent. Alternatively, it may be advantageous to administer more than one dosage of the first therapeutic agent between administrations of the second therapeutic agent. In certain embodiments it is preferred that the therapeutic effects of each active ingredient overlap for at least a portion of the duration of each therapeutic agent so that the overall therapeutic effect of the combination therapy is attributable in part to the combined or synergistic effects of the combination therapy.

Delivery

The siRNA molecules as disclosed herein are delivered to the target tissue of the eye by direct application of the molecules prepared with a carrier or a diluent.

The term "naked siRNA" refers to siRNA molecules that are free from any delivery vehicle or formulation that acts to assist, promote or facilitate entry into the cell, including viral sequences, viral particles, liposome formulations, lipofectin or precipitating agents and the like. For example, siRNA in PBS or an acceptable ophthalmological formulation is "naked siRNA". In certain embodiments of the invention the siRNA is delivered as naked siRNA. For certain applications, a formulation that increases the residence time of the siRNA in the eye or nasal passage may be desired, for example, by addition of a polymer or viscosity enhancing agent.

Delivery systems aimed specifically at the enhanced and improved delivery of siRNA into mammalian cells have been developed, (see, for example, Shen et al FEBS Let. 2003, 539:111-114; Xia et al., Nat. Biotech. 2002, 20:1006-1010; Reich et al., Mol. Vision. 2003, 9: 210-216; Sorensen et al., J. Mol. Biol. 2003. 327: 761-766; Lewis et al., Nat. Gen. 2002, 32: 107-108 and Simeoni et al., NAR 2003, 31, 11: 2717-2724).

The pharmaceutically acceptable carriers, solvents, diluents, excipients, adjuvants and vehicles as well as implant carriers generally refer to inert, non-toxic solid or liquid fillers, diluents or encapsulating material not reacting with the active ingredients of the invention and they include liposomes and microspheres. Examples of delivery systems useful in the present invention include U.S. Pat. Nos. 5,225,182; 5,169,383; 5,167,616; 4,959,217; 4,925,678; 4,487,603; 4,486,194; 4,447,233; 4,447,224; 4,439,196; and 4,475,196. Many other such implants, delivery systems, and modules are well known to those skilled in the art.

A review of the considerations to be taken into account in the preparation of a pharmaceutical composition for topical ocular delivery or intranasal delivery, can be found in Bar-Ilan and Neumann, in Textbook of Ocular Pharmacology, Zimmerman et al eds., Lippencott-Raven 1997.

Topical routes of administration are preferably employed for providing the subject with an effective dosage of the therapeutic siRNA compounds. Dosage forms may include dispersions, suspensions, solutions, ointments and the like. In certain preferred embodiments the pharmaceutical composition of the invention comprising at least one siRNA is delivered as eye drops. In another embodiment the pharmaceutical composition of the invention comprising at least one siRNA is delivered as a spray or mist. For example U.S. Pat. No. 4,052, 985 discloses ophthalmic spray applicators.

In certain embodiments of the present invention the siRNA reaches its target cell locally, for example direct contact or by diffusion through cells, tissue or intracellular fluid. The siR- NAs or pharmaceutical compositions of the present invention are administered and dosed in accordance with good medical practice, taking into account the clinical condition of the individual patient, the disease to be treated, scheduling of administration, patient age, sex, body weight and other factors known to medical practitioners.

The "therapeutically effective dose" for purposes herein is thus determined by such considerations as are known in the art. The dose must be effective to achieve improvement including but not limited to an improved course of disease, more rapid recovery, improvement of symptoms, elimination of symptoms and other indicators as are selected as appropriate measures by those skilled in the art. The siRNA of the invention can be administered in a single dose or in multiple doses.

In general, the active dose of compound for humans is in the range of from 1 ng/kg to about 20-100 mg/kg body weight per day, preferably about 0.01 mg/kg to about 2-10 mg/kg body weight per day, in a regimen of one dose per day or twice or three or more times per day for a single dose or multiple dose regimen. In certain embodiments the siRNA compounds are formulated for topical application to the eye as eye drops and comprise about 5 µg/µl to about 60 µg/µl by volume of the composition, about 6.6 µg/µl by volume of the composition, about 25 µg/µl by volume of the composition, about 33.3 µg/µl by volume of the composition, about 50 µg/µl by volume of the composition.

The pH of the formulation is about pH 5 to about pH 8, or about pH 5 to about pH 7, or from about pH 5 to about pH 6. In certain embodiments the pH is about Ph 5.9, about pH 6.15, about pH 6.25, about pH 6.3, about pH 6.5, about pH 7.25. The compounds of the present invention can be administered topically to the surface of the eye. It should be noted that the compound is preferably applied as the compound or as pharmaceutically acceptable salt active ingredient in combination with pharmaceutically acceptable carriers, solvents, diluents, excipients, adjuvants and or vehicles. As disclosed herein the preferred method of delivery is topical application of an ophthalmic composition to the eye.

Liquid forms may be prepared for drops or spray. The liquid compositions include aqueous solutions, with and without organic co-solvents, aqueous or oil suspensions, emulsions with edible oils, as well as similar pharmaceutical vehicles.

These compounds may be administered to humans and other animals for therapy by any suitable route of administration to the eye, as by, for example, a spray or drops, and topically, as by ointments, or drops.

Methods of Treatment

In one aspect, the present invention relates to a method for the treatment of a subject in need of treatment for an eye disease or disorder associated with expression of a gene listed in Tables A1-A4 in the eye of the subject, comprising topically and non-invasively administering to the subject an amount of a chemically modified siRNA which inhibits expression of at least one of the genes. In certain preferred embodiments more than one siRNA compound to one or more than one gene target is administered.

In preferred embodiments the subject being treated is a warm-blooded animal and, in particular, mammals including human.

The methods of the invention comprise topically and non-invasively administering to the eye of the subject one or more inhibitory compounds which down-regulate expression of the genes of Tables A1-A4; and in particular siRNA in a therapeutically effective dose so as to thereby treat the subject.

The term "treatment" refers to both therapeutic treatment and prophylactic or preventative measures, wherein the object is to prevent or slow down, attenuate the related eye disorder as listed above. Those in need of treatment include those already experiencing the disease or condition, those prone to having the disease or condition, and those in which the disease or condition is to be prevented. The compounds of the invention may be administered before, during or subsequent to the onset of the eye disease or condition or symptoms associated therewith. In cases where treatment is for the purpose of prevention, then the present invention relates to a method for delaying the onset of or averting the development of the disease or disorder.

Ocular disorders include Acute Zonal Occult Outer Retinopathy, Adie Syndrome, Age Related Macular Degeneration, Amblyopia, Aniridia, Anisocoria, Anophthalmos, Aphakia, Blepharitis, Blepharoptosis, Blepharospasm, Blindness, Cataract, Chalazion, Chorioretinitis, Choroideremia, Coloboma, Conjunctival Diseases, Conjunctivitis, Corneal Diseases, Corneal Dystrophies, Corneal Edema, Corneal Ulcer, Diabetic Macular Edema, Diabetic Retinopathy, Diplopia, Distichiasis, Dry Eye Syndromes, Duane Retraction Syndrome, Ectropion, Endophthalmitis, Entropion, Esotropia, Exfoliation Syndrome, Exotropia, Eye Abnormalities, Eye Neoplasms, General Fibrosis Syndrome, Glaucomas, Gyrate Atrophy, Hemianopsia, Hermanski-Pudlak Syndrome, Hordeolum, Horner Syndrome, Hyperopia, Hyphema, Iritis, Kearns-Sayer Syndrome, Keratitis, Keratoconus, Lacrimal Apparatus Diseases, Lacrimal Duct Obstruction, Lens Diseases, Macular Degeneration, Nystagmus, Pathologic, Ocular Motility Disorders, Oculomotor Nerve Diseases, Ophthalmoplegia, Optic Atrophies, Hereditary, Optic Nerve Diseases, Optic Neuritis, Ischemic Optic Neuropathy, Orbital Cellulitis, Papilledema, Presbyopia, Pterygium, Pupil Disorders, Refractive Errors, Retinal Detachment, Retinal Diseases, Retinal Vein Occlusion, Retinal Blastoma, Retinitis Pigmentosa, Retinopathy of Prematurity, Retinoschisis, Scleritis, Scotoma, Strabismus, Sjögrens Syndrome, Thygeson's Superficial Punctate Keratitis, Trachoma, Uveitis.

Oligonucleotides

The oligonucleotides useful in the methods disclosed herein are preferably double stranded oligonucleotides and siRNA compounds and include unmodified and chemically and/or structurally modified compounds.

The selection and synthesis of siRNA corresponding to known genes has been widely reported; see for example Ui-Tei et al., J Biomed Biotechnol. 2006; 65052; Chalk et al., BBRC. 2004, 319(1):264-74; Sioud & Leirdal, Met. Mol. Biol. 2004, 252:457-69; Levenkova et al., Bioinform. 2004, 20(3):430-2; Ui-Tei et al., NAR. 2004, 32(3):936-48. For examples of the use and production of modified siRNA see for example Braasch et al., Biochem. 2003, 42(26):7967-75; Chiu et al., RNA. 2003, 9(9):1034-48; PCT Publication Nos. WO 2004/015107 and WO 02/44321 and U.S. Pat. Nos. 5,898,031 and 6,107,094.

The present invention provides double-stranded oligonucleotides (e.g. siRNAs), which down-regulate the expression of a desired gene. A siRNA of the invention is a duplex oligoribonucleotide in which the sense strand is derived from the mRNA sequence of the desired gene, and the antisense strand is complementary to the sense strand. In general, some deviation from the target mRNA sequence is tolerated without compromising the siRNA activity (see e.g. Czauderna et al., NAR. 2003, 31(11):2705-2716). An siRNA of the invention inhibits gene expression on a post-transcriptional level with or without destroying the mRNA. Without being bound by theory, siRNA may target the mRNA for specific cleavage and degradation and/or may inhibit translation from the targeted message.

In some embodiments the siRNA is blunt ended, i.e. Z and Z' are absent, on one or both ends. More specifically, the siRNA may be blunt ended on the end defined by the 5'-terminus of the first strand and the 3'-terminus of the second strand, and/or the end defined by the 3'-terminus of the first strand and the 5'-terminus of the second strand.

In other embodiments at least one of the two strands may have an overhang of at least one nucleotide at the 5'-terminus; the overhang may consist of at least one deoxyribonucleotide. At least one of the strands may also optionally have an overhang of at least one nucleotide at the 3'-terminus. The overhang may consist of from about 1 to about 5 nucleotides.

The length of RNA duplex is from about 18 to about 40 ribonucleotides, preferably 19, 21 or 23 ribonucleotides. Further, the length of each strand may independently have a length selected from the group consisting of about 15 to about 40 bases, preferably 18 to 23 bases and more preferably 19, 21 or 23 ribonucleotides. In some embodiments a 20 or 22-mer molecule may be contemplated.

In certain embodiments the complementarity between said first strand and the target nucleic acid is perfect (100%). In some embodiments, the strands are substantially complementary, i.e. having one, two or up to three mismatches between said first strand and the target nucleic acid. Substantially complementary refers to complementarity of greater than about 84%, to another sequence. For example in a duplex region consisting of 19 base pairs one mismatch results in 94.7% complementarity, two mismatches results in about 89.5% complementarity and 3 mismatches results in about 84.2% complementarity, rendering the duplex region substantially complementary. Accordingly substantially identical refers to identity of greater than about 84%, to another sequence.

The first strand and the second strand may be linked by a loop structure, which may be comprised of a non-nucleic acid polymer such as, inter alia, polyethylene glycol. Alternatively, the loop structure may be comprised of a nucleic acid, including modified and non-modified ribonucleotides and modified and non-modified deoxyribonucleotides.

Further, the 5'-terminus of the first strand of the siRNA may be linked to the 3'-terminus of the second strand, or the 3'-terminus of the first strand may be linked to the 5'-terminus of the second strand, said linkage being via a nucleic acid linker typically having a length between 2-100 nucleobases, preferably about 2 to about 30 nucleobases.

In preferred embodiments of the compounds of the invention having alternating ribonucleotides modified in at least one of the antisense and the sense strands of the compound, for 19-mer and 23-mer oligomers the ribonucleotides at the 5' and 3' termini of the antisense strand are modified in their sugar residues, and the ribonucleotides at the 5' and 3' termini of the sense strand are unmodified in their sugar residues. For 21-mer oligomers the ribonucleotides at the 5' and 3' termini of the sense strand are modified in their sugar residues, and the ribonucleotides at the 5' and 3' termini of the antisense strand are unmodified in their sugar residues, or may have an optional additional modification at the 3' terminus. As mentioned above, it is preferred that the middle nucleotide of the antisense strand is unmodified.

Additionally, the invention provides siRNA comprising a double stranded nucleic acid molecule wherein 1, 2, or 3 of the nucleotides in one strand or both strands are substituted thereby providing at least one base pair mismatch. The substituted nucleotides in each strand are preferably in the terminal region of one strand or both strands.

According to one preferred embodiment of the invention, the antisense and the sense strands of the oligonucleotide/siRNA are phosphorylated only at the 3'-terminus and not at the 5'-terminus. According to another preferred embodiment of the invention, the antisense and the sense strands are non-phosphorylated. According to yet another preferred embodiment of the invention, the 5' most ribonucleotide in the sense strand is modified to abolish any possibility of in vivo 5'-phosphorylation.

Any siRNA sequence disclosed herein can be prepared having any of the modifications/structures disclosed herein. The combination of sequence plus structure is novel and can be used in the treatment of the conditions disclosed herein.

siRNA Structures

The selection and synthesis of siRNA corresponding to known genes has been widely reported; (see for example Ui-Tei et al., J Biomed Biotech. 2006; 2006: 65052; Chalk et al., BBRC. 2004, 319(1): 264-74; Sioud & Leirdal, Met. Mol. Biol.; 2004, 252:457-69; Levenkova et al., Bioinform. 2004, 20(3):430-2; Ui-Tei et al., NAR. 2004, 32(3):936-48).

For examples of the use of, and production of, modified siRNA see, for example, Braasch et al., Biochem. 2003, 42(26):7967-75; Chiu et al., RNA, 2003, 9(9):1034-48; PCT publications WO 2004/015107 (atugen AG) and WO 02/44321 (Tuschl et al). U.S. Pat. Nos. 5,898,031 and 6,107,094, teach chemically modified oligomers. US Patent Publication Nos. 2005/0080246 and 2005/0042647 relate to oligomeric compounds having an alternating motif and dsRNA compounds having chemically modified internucleoside linkages, respectively.

Other modifications have been disclosed. The inclusion of a 5'-phosphate moiety was shown to enhance activity of siRNAs in *Drosophila* embryos (Boutla, et al., Curr. Biol. 2001, 11:1776-1780) and is required for siRNA function in human HeLa cells (Schwarz et al., Mol. Cell, 2002, 10:537-48). Amarzguioui et al., (NAR, 2003, 31(2):589-95) showed that siRNA activity depended on the positioning of the 2'-O-methyl (2'-OMe) modifications. Holen et al (NAR. 2003, 31(9): 2401-07) report that an siRNA having small numbers of 2'-OMe modified nucleosides gave good activity compared to wild type but that the activity decreased as the numbers of 2'-OMe modified nucleosides was increased. Chiu and Rana (RNA. 2003, 9:1034-48) teach that incorporation of 2'-OMe modified nucleosides in the sense or antisense strand (fully modified strands) severely reduced siRNA activity relative to unmodified siRNA. The placement of a 2'-OMe group at the 5'-terminus on the antisense strand was reported to severely limit activity whereas placement at the 3'-terminus of the antisense and at both termini of the sense strand was tolerated (Czauderna et al., NAR. 2003, 31(11):2705-16; WO 2004/015107). The molecules of the present invention offer an advantage in that they are non-toxic and may be formulated as pharmaceutical compositions for treatment of various diseases.

The nucleotides can be selected from naturally occurring or synthetic modified bases. Naturally occurring bases include adenine, guanine, cytosine, thymine and uracil. Modified bases of nucleotides include inosine, xanthine, hypoxanthine, 2-aminoadenine, 6-methyl, 2-propyl and other alkyl adenines, 5-halo uracil, 5-halo cytosine, 6-aza cytosine and 6-aza thymine, pseudo uracil, 4-thiouracil, 8-halo adenine, 8-aminoadenine, 8-thiol adenine, 8-thiolalkyl adenines, 8-hydroxyl adenine and other 8-substituted adenines, 8-halo guanines, 8-amino guanine, 8-thiol guanine, 8-thioalkyl guanines, 8-hydroxyl guanine and other substituted guanines, other aza and deaza adenines, other aza and deaza guanines, 5-trifluoromethyl uracil and 5-trifluoro cytosine. Molecules comprising one or more abasic moiety (unconventional or pseudonucleotide) are encompassed by the present invention, as well as molecules comprising alternating RNA and DNA nucleotides.

In addition, analogues of polynucleotides can be prepared wherein the structure of one or more nucleotide is fundamentally altered and better suited as therapeutic or experimental reagents. An example of a nucleotide analog is a peptide nucleic acid (PNA) wherein the deoxyribose (or ribose) phosphate backbone in DNA (or RNA) is replaced with a polyamide backbone which is similar to that found in peptides. PNA analogs have been shown to be resistant to enzymatic degradation and to have extended lives in vivo and in vitro.

Possible modifications to the sugar residue are manifold and include 2'-O alkyl, locked nucleic acid (LNA), glycol nucleic acid (GNA), threose nucleic acid (TNA), arabinoside, altritol (ANA) and other, 6-membered sugars including morpholinos, and cyclohexinyls. Further, said molecules may additionally contain modifications on the sugar, such as 2' alkyl, 2' fluoro, 2'O allyl, 2' amine and 2' alkoxy. Additional sugar modifications are discussed herein.

LNA compounds are disclosed in International Patent Publication Nos. WO 00/47599, WO 99/14226, and WO 98/39352. Examples of siRNA compounds comprising LNA nucleotides are disclosed in Elmen et al., (NAR 2005. 33(1): 439-447) and in PCT Patent Publication No. WO 2004/083430.

The compounds of the present invention can be synthesized using one or more inverted nucleotides, for example inverted thymidine or inverted adenine (for example see Takei, et al., 2002. JBC 277(26):23800-06).

Backbone modifications, such as ethyl (resulting in a phospho-ethyl triester); propyl (resulting in a phospho-propyl triester); and butyl (resulting in a phospho-butyl triester) are also possible. Other backbone modifications include polymer backbones, cyclic backbones, acyclic backbones, thiophosphate-D-ribose backbones, amidates, and phosphonoacetate derivatives. Certain structures include siRNA compounds having one or a plurality of 2'-5' internucleotide linkages (bridges or backbone).

Further, the inhibitory nucleic acid molecules of the present invention may comprise one or more gaps and/or one or more nicks and/or one or more mismatches. Without wishing to be bound by theory, gaps, nicks and mismatches have the advantage of partially destabilizing the nucleic acid/siRNA, so that it may be more easily processed by endogenous cellular machinery such as DICER, DROSHA or RISC into its inhibitory components.

The molecules of the present invention may comprise siRNAs, synthetic siRNAs, shRNAs and synthetic shRNAs, in addition to other nucleic acid sequences or molecules which encode such molecules or other inhibitory nucleotide molecules.

The compounds of the present invention may further comprise an end modification. A biotin group may be attached to either the most 5' or the most 3' nucleotide of the first and/or second strand or to both ends. In a more preferred embodiment the biotin group is coupled to a polypeptide or a protein. It is also within the scope of the present invention that the polypeptide or protein is attached through any of the other aforementioned modifications.

The various end modifications as disclosed herein are preferably located at the ribose moiety of a nucleotide of the nucleic acid as disclosed herein. More particularly, the end modification may be attached to or replace any of the OH-groups of the ribose moiety, including but not limited to the 2'OH, 3'OH and 5'OH position, provided that the nucleotide thus modified is a terminal nucleotide. Inverted abasic or abasic are nucleotides, either deoxyribonucleotides or ribonucleotides which do not have a nucleobase moiety. This kind of compound is, inter alia, described in Sternberger, et al., (Antisense Nucleic Acid Drug Dev, 2002.12, 131-43).

In the context of the present invention, a gap in a nucleic acid refers to the absence of one or more internal nucleotides in one strand, while a nick in a nucleic acid refers to the absence of an internucleotide linkage between two adjacent nucleotides in one strand. Any of the molecules of the present invention may contain one or more gaps and/or one or more nicks. Further provided by the present invention is an siRNA encoded by any of the molecules disclosed herein, a vector encoding any of the molecules disclosed herein, and a pharmaceutical composition comprising any of the molecules disclosed herein or the vectors encoding them; and a pharmaceutically acceptable carrier.

Particular molecules to be administered according to the methods of the present invention are disclosed below under the heading "structural motifs". For the sake of clarity, any of these molecules can be administered according to any of the methods of the present invention.

Structural Motifs

As disclosed herein the siRNA compounds that are chemically and or structurally modified according to one of the following modifications set forth in Structures below or as tandem siRNA or RNAstar (see below) are useful in the methods of the present invention. Tables 1-36 provide sense and antisense oligonucleotide pairs, set forth in SEQ ID NOS: 59-33596, useful in preparing corresponding siRNA compounds.

In one aspect the present invention provides a compound set forth as Structure (A):

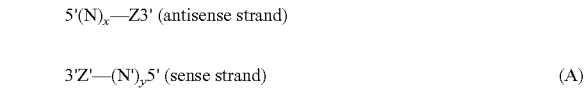

wherein each of N and N' is a nucleotide selected from an unmodified ribonucleotide, a modified ribonucleotide, an unmodified deoxyribonucleotide and a modified deoxyribonucleotide;

wherein each of $(N)_x$ and $(N')_y$ is an oligonucleotide in which each consecutive N or N' is joined to the next N or N' by a covalent bond;

wherein each of x and y is an integer between 18 and 40;

wherein each of Z and Z' may be present or absent, but if present is 1-5 consecutive nucleotides covalently attached at the 3' terminus of the strand in which it is present; and and wherein the sequence of $(N)_x$ comprises an antisense sequence substantially complementary to about 18 to about 40 consecutive ribonucleotides in the mRNA of a gene expressed in the retina and associated with an ocular disease or disorder. In some embodiments the mRNA is set forth in any one of SEQ ID NOS:1-58.

In certain embodiments the present invention provides a compound having structure B

wherein each of $(N)_x$ and $(N')_y$ is an oligomer in which each consecutive N or N' is an unmodified ribonucleotide or a modified ribonucleotide joined to the next N or N' by a covalent bond;

wherein each of x and y=19, 21 or 23 and $(N)_x$ and $(N')_y$ are fully complementary wherein alternating ribonucleotides in each of $(N)_x$ and $(N')_y$ comprise 2'-OMe sugar modified ribonucleotides;

wherein the sequence of $(N')_y$ is a sequence complementary to $(N)x$; and wherein the sequence of $(N)_x$ comprises an antisense sequence substantially complementary to about 18 to about 40 consecutive ribonucleotides in the mRNA set forth in any one of SEQ ID NOS:1-58.

In some embodiments each of $(N)_x$ and $(N')_y$ is independently phosphorylated or non-phosphorylated at the 3' and 5' termini.

In certain embodiments of the invention, alternating ribonucleotides are modified in both the antisense and the sense strands of the compound.

In certain embodiments wherein each of x and y=19 or 23, each N at the 5' and 3' termini of $(N)_x$ is modified; and each N' at the 5' and 3' termini of $(N')_y$ is unmodified.

In certain embodiments wherein each of x and y=21, each N at the 5' and 3' termini of $(N)_x$ is unmodified; and each N' at the 5' and 3' termini of $(N')_y$ is modified.

In particular embodiments, when x and y=19, the siRNA consists of a 2'OMe sugar modified ribonucleotides on the first, third, fifth, seventh, ninth, eleventh, thirteenth, fifteenth, seventeenth and nineteenth nucleotide of the antisense strand $(N)_x$, and 2'-OMe sugar modified ribonucleotides in the second, fourth, sixth, eighth, tenth, twelfth, fourteenth, sixteenth and eighteenth nucleotide of the sense strand $(N')_y$. In various embodiments these particular siRNA compounds are blunt ended at both termini.

In some embodiments, the present invention provides a compound having Structure (C):

5'$(N)x$-Z3' antisense strand

3'Z'—$(N')y$5' sense strand            (C)

wherein each of N and N' is a nucleotide independently selected from an unmodified ribonucleotide, a modified ribonucleotide, an unmodified deoxyribonucleotide and a modified deoxyribonucleotide;

wherein each of (N)x and (N')y is an oligomer in which each consecutive nucleotide is joined to the next nucleotide by a covalent bond and each of x and y is an integer between 18 and 40;

wherein in (N)x the nucleotides are unmodified or (N)x comprises alternating 2' OMe sugar modified ribonucleotides and unmodified ribonucleotides; and wherein the ribonucleotide located at the middle position of (N)x being 2'OMe sugar modified or unmodified, preferably unmodified;

wherein (N')y comprises unmodified ribonucleotides further comprising one modified nucleotide at a terminal or penultimate position, wherein the modified nucleotide is selected from the group consisting of a mirror nucleotide, a bicyclic nucleotide, a 2'-sugar modified nucleotide, an altritol nucleotide, or a nucleotide joined to an adjacent nucleotide by an internucleotide linkage selected from a 2'-5' phosphodiester bond, a P-alkoxy linkage or a PACE linkage;

wherein if more than one nucleotide is modified in (N')y, the modified nucleotides may be consecutive;

wherein each of Z and Z' may be present or absent, but if present is 1-5 deoxyribonucleotides covalently attached at the 3' terminus of any oligomer to which it is attached;

wherein the sequence of $(N')_y$ comprises a sequence substantially complementary to (N)x; and wherein the sequence of $(N)_x$ comprises an antisense sequence substantially complementary to about 18 to about 40 consecutive ribonucleotides in the mRNA set forth in any one of SEQ ID NOS:1-58.

In particular embodiments, x=y=19 and in (N)x each modified ribonucleotide is a 2'-OMe sugar modified and the ribonucleotide located at the middle of (N)x is unmodified. Accordingly, in a compound wherein x=19, (N)x comprises 2'-O-methyl sugar modified ribonucleotides at positions 1, 3, 5, 7, 9, 11, 13, 15, 17 and 19. In other embodiments, (N)x comprises 2'-OMe sugar modified ribonucleotides at positions 2, 4, 6, 8, 11, 13, 15, 17 and 19 and may further comprise at least one abasic or inverted abasic pseudo-nucleotide for example in position 5. In other embodiments, (N)x comprises 2'-OMe modified ribonucleotides at positions 2, 4, 8, 11, 13, 15, 17 and 19 and may further comprise at least one abasic or inverted abasic pseudo-nucleotide for example in position 6. In other embodiments, (N)x comprises 2'-OMe modified ribonucleotides at positions 2, 4, 6, 8, 11, 13, 17 and 19 and may further comprise at least one abasic or inverted abasic pseudo-nucleotide for example in position 15. In other embodiments, (N)x comprises 2'-OMe modified ribonucleotides at positions 2, 4, 6, 8, 11, 13, 15, 17 and 19 and may further comprise at least one abasic or inverted abasic pseudo-nucleotide for example in position 14. In other embodiments, (N)x comprises 2'-OMe modified ribonucleotides at positions 1, 2, 3, 7, 9, 11, 13, 15, 17 and 19 and may further comprise at least one abasic or inverted abasic pseudo-nucleotide for example in position 5. In other embodiments, (N)x comprises 2'-OMe modified ribonucleotides at positions 1, 2, 3, 5, 7, 9, 11, 13, 15, 17 and 19 and may further comprise at least one abasic or inverted abasic pseudo-nucleotide for example in position 6. In other embodiments, (N)x comprises 2'-OMe modified ribonucleotides at positions 1, 2, 3, 5, 7, 9, 11, 13, 17 and 19 and may further comprise at least one abasic or inverted abasic pseudo-nucleotide for example in position 15. In other embodiments, (N)x comprises 2'-OMe modified ribonucleotides at positions 1, 2, 3, 5, 7, 9, 11, 13, 15, 17 and 19 and may further comprise at least one abasic or inverted abasic pseudo-nucleotide for example in position 14. In other embodiments, (N)x comprises 2'-OMe modified ribonucleotides at positions 2, 4, 6, 7, 9, 11, 13, 15, 17 and 19 and may further comprise at least one abasic or inverted abasic pseudo-nucleotide for example in position 5. In other embodiments, (N)x comprises 2'-OMe modified ribonucleotides at positions 1, 2, 4, 6, 7, 9, 11, 13, 15, 17 and 19 and may further comprise at least one abasic or inverted abasic pseudo-nucleotide for example in position 5. In other embodiments, (N)x comprises 2'-OMe modified ribonucleotides at positions 2, 4, 6, 8, 11, 13, 14, 16, 17 and 19 and may further comprise at least one abasic or inverted abasic pseudo-nucleotide for example in position 15. In other embodiments, (N)x comprises 2'-OMe modified ribonucleotides at positions 1, 2, 3, 5, 7, 9, 11, 13, 14, 16, 17 and 19 and may further comprise at least one abasic or inverted abasic pseudo-nucleotide for example in position 15. In other embodiments, (N)x comprises 2'-OMe modified ribonucleotides at positions 2, 4, 6, 8, 11, 13, 15, 17 and 19 and may further comprise at least one abasic or inverted abasic pseudo-nucleotide for example in position 7. In other embodiments, (N)x comprises 2'-OMe sugar modified ribonucleotides at positions 2, 4, 6, 11, 13, 15, 17 and 19 and may further comprise at least one abasic or inverted abasic pseudo-nucleotide for example in position 8. In other embodiments, (N)x comprises 2'-OMe sugar modified ribonucleotides at positions 2, 4, 6, 8, 11, 13, 15, 17 and 19 and may further comprise at least one abasic or inverted abasic pseudo-nucleotide for example in position 9. In other embodiments, (N)x comprises 2'-OMe sugar modified ribonucleotides at positions 2, 4, 6, 8, 11, 13, 15, 17 and 19 and may further comprise at least one abasic or inverted abasic pseudo-nucleotide for example in position 10. In other embodiments, (N)x comprises 2'-OMe sugar modified ribonucleotides at positions 2, 4, 6, 8, 13, 15, 17 and 19 and may further comprise at least one abasic or inverted abasic pseudo-nucleotide for example in position 11. In other embodiments, (N)x comprises 2'-OMe sugar modified ribonucleotides at positions 2, 4, 6, 8, 11, 13, 15, 17 and 19 and may further comprise at least one abasic or inverted abasic pseudo-nucleotide for example in position 12. In other embodiments, (N)x comprises 2'-OMe sugar modified ribonucleotides at positions 2, 4, 6, 8, 11, 15, 17 and 19 and may further comprise at least one abasic or inverted abasic pseudo-nucleotide for example in position 13.

In yet other embodiments (N)x comprises at least one nucleotide mismatch relative to the target gene. In certain preferred embodiments, (N)x comprises a single nucleotide mismatch on position 5, 6, or 14. In one embodiment of Structure (C), at least two nucleotides at either or both the 5' and 3' termini of (N')y are joined by a 2'-5' phosphodiester bond. In certain preferred embodiments x=y=19 or x=y=23; in (N)x the nucleotides alternate between 2'-OMe sugar modified ribonucleotides and unmodified ribonucleotides, and the ribonucleotide located at the middle of (N)x being unmodified; and three nucleotides at the 3' terminus of (N')y are joined by two 2'-5' phosphodiester bonds (set forth herein as Structure I). In other preferred embodiments, x=y=19 or x=y=23; in (N)$_x$ the nucleotides alternate between 2'-OMe sugar modified ribonucleotides and unmodified ribonucleotides, and the ribonucleotide located at the middle of (N)x being unmodified; and four consecutive nucleotides at the 5' terminus of (N')y are joined by three 2'-5' phosphodiester bonds. In a further embodiment, an additional nucleotide located in the middle position of (N)y is 2'-OMe sugar modified. In another preferred embodiment, in (N)x the nucleotides alternate between 2'-OMe sugar modified ribonucleotides and unmodified ribonucleotides, and in (N')y four consecutive nucleotides at the 5' terminus are joined by three 2'-5' phosphodiester bonds and the 5' terminal nucleotide or two or three consecutive nucleotides at the 5' terminus comprise 3'-O-methyl (3'-OMe) modifications.

In certain preferred embodiments of Structure C, x=y=19 and in (N')y, at least one position comprises an abasic or inverted abasic pseudo-nucleotide, preferably five positions comprises an abasic or inverted abasic pseudo-nucleotides. In various embodiments, the following positions comprise an abasic or inverted abasic: positions 1 and 16-19, positions 15-19, positions 1-2 and 17-19, positions 1-3 and 18-19, positions 1-4 and 19 and positions 1-5. (N')y may further comprise at least one LNA nucleotide.

In certain preferred embodiments of Structure C, x=y=19 and in (N')y the nucleotide in at least one position comprises a mirror nucleotide, a deoxyribonucleotide and a nucleotide joined to an adjacent nucleotide by a 2'-5' internucleotide bond.

In certain preferred embodiments of Structure C, x=y=19 and (N')y comprises a mirror nucleotide. In various embodiments the mirror nucleotide is an L-DNA nucleotide. In certain embodiments the L-DNA is L-deoxyribocytidine. In some embodiments (N')y comprises L-DNA at position 18. In other embodiments (N')y comprises L-DNA at positions 17 and 18. In certain embodiments (N')y comprises L-DNA substitutions at positions 2 and at one or both of positions 17 and 18. In certain embodiments (N')y further comprises a 5' terminal cap nucleotide such as 5'-O-methyl DNA or an abasic or inverted abasic pseudo-nucleotide as an overhang.

In yet other embodiments (N')y comprises at least one nucleotide mismatch relative to the target gene. In certain preferred embodiments, (N')y comprises a single nucleotide mismatch on position 6, 14, or 15.

In yet other embodiments (N')y comprises a DNA at position 15 and L-DNA at one or both of positions 17 and 18. In that structure, position 2 may further comprise an L-DNA or an abasic pseudo-nucleotide.

Other embodiments of Structure C are envisaged wherein x=y=21 or wherein x=y=23; in these embodiments the modifications for (N')y discussed above instead of being on positions 15, 16, 17, 18 are on positions 17, 18, 19, 20 for 21 mer and on positions 19, 20, 21, 22 for 23 mer; similarly the modifications at one or both of positions 17 and 18 are on one or both of positions 19 or 20 for a 21 mer and one or both of positions 21 and 22 for a 23 mer. All modifications in the 19 mer are similarly adjusted for the 21 and 23 mers.

According to various embodiments of Structure (C), in (N')y 2, 3, 4, 5, 6, 7, 8, 9, 10, 11, 12, 13 or 14 consecutive ribonucleotides at the 3' terminus are linked by 2'-5' internucleotide linkages In one preferred embodiment, four consecutive nucleotides at the 3' terminus of (N')y are joined by three 2'-5' phosphodiester bonds, wherein one or more of the 2'-5' nucleotides which form the 2'-5' phosphodiester bonds further comprises a 3'-O-methyl sugar modification. Preferably the 3' terminal nucleotide of (N')y comprises a 2'-O-methyl sugar modification. In certain preferred embodiments of Structure C, x=y=19 and in (N')y two or more consecutive nucleotides at positions 15, 16, 17, 18 and 19 comprise a nucleotide joined to an adjacent nucleotide by a 2'-5' internucleotide bond. In various embodiments the nucleotide forming the 2'-5' internucleotide bond comprises a 3' deoxyribose nucleotide or a 3' methoxy nucleotide. In some embodiments the nucleotides at positions 17 and 18 in (N')y are joined by a 2'-5' internucleotide bond. In other embodiments the nucleotides at positions 16, 17, 18, 16-17, 17-18, or 16-18 in (N')$_y$ are joined by a 2'-5' internucleotide bond.

In certain embodiments (N')y comprises an L-DNA at position 2 and 2'-5' internucleotide bonds at positions 16, 17, 18, 16-17, 17-18, or 16-18. In certain embodiments (N')y comprises 2'-5' internucleotide bonds at positions 16, 17, 18, 16-17, 17-18, or 16-18 and a 5' terminal cap nucleotide.

According to various embodiments of Structure (C), in (N')y 2, 3, 4, 5, 6, 7, 8, 9, 10, 11, 12, 13 or 14 consecutive nucleotides at either terminus or 2-8 modified nucleotides at each of the 5' and 3' termini are independently mirror nucleotides. In some embodiments the mirror nucleotide is an L-ribonucleotide. In other embodiments the mirror nucleotide is an L-deoxyribonucleotide. The mirror nucleotide may further be modified at the sugar or base moiety or in an internucleotide linkage.

In one preferred embodiment of Structure (C), the 3' terminal nucleotide or two or three consecutive nucleotides at the 3' terminus of (N')y are L-deoxyribonucleotides.

In other embodiments of Structure (C), in (N')y 2, 3, 4, 5, 6, 7, 8, 9, 10, 11, 12, 13 or 14 consecutive ribonucleotides at either terminus or 2-8 modified nucleotides at each of the 5' and 3' termini are independently 2' sugar modified nucleotides. In some embodiments the 2' sugar modification comprises the presence of an amino, a fluoro, an alkoxy or an alkyl moiety. In certain embodiments the 2' sugar modification comprises a methoxy moiety (2'-OMe).

In one series of preferred embodiments, three, four or five consecutive nucleotides at the 5' terminus of (N')y comprise the 2'-OMe modification. In another preferred embodiment, three consecutive nucleotides at the 3' terminus of (N')y comprise the 2'-O-methyl modification.

In some embodiments of Structure (C), in (N')y 2, 3, 4, 5, 6, 7, 8, 9, 10, 11, 12, 13 or 14 consecutive ribonucleotides at either or 2-8 modified nucleotides at each of the 5' and 3' termini are independently bicyclic nucleotide. In various embodiments the bicyclic nucleotide is a locked nucleic acid (LNA). A 2'-O, 4'-C-ethylene-bridged nucleic acid (ENA) is a species of LNA (see below).

In various embodiments (N')y comprises modified nucleotides at the 5' terminus or at both the 3' and 5' termini.

In some embodiments of Structure (C), at least two nucleotides at either or both the 5' and 3' termini of (N')y are joined by P-ethoxy backbone modifications. In certain preferred embodiments x=y=19 or x=y=23; in (N)x the nucleotides alternate between modified ribonucleotides and unmodified ribonucleotides, each modified ribonucleotide being modified so as to have a 2'-O-methyl on its sugar and the ribonucleotide located at the middle position of (N)x being unmodified; and four consecutive nucleotides at the 3' terminus or at the 5' terminus of (N')y are joined by three P-ethoxy backbone modifications. In another preferred embodiment, three consecutive nucleotides at the 3' terminus or at the 5' terminus of (N')y are joined by two P-ethoxy backbone modifications.

In some embodiments of Structure (C), in (N')y 2, 3, 4, 5, 6, 7 or 8, consecutive ribonucleotides at each of the 5' and 3' termini are independently mirror nucleotides, nucleotides joined by 2'-5' phosphodiester bond, 2' sugar modified nucleotides or bicyclic nucleotide. In one embodiment, the modification at the 5' and 3' termini of (N')y is identical. In one preferred embodiment, four consecutive nucleotides at the 5' terminus of (N')y are joined by three 2'-5' phosphodiester bonds and three consecutive nucleotides at the 3' terminus of (N')y are joined by two 2'-5' phosphodiester bonds. In another embodiment, the modification at the 5' terminus of (N')y is different from the modification at the 3' terminus of (N')y. In one specific embodiment, the modified nucleotides at the 5' terminus of (N')y are mirror nucleotides and the modified nucleotides at the 3' terminus of (N')y are joined by 2'-5' phosphodiester bond. In another specific embodiment, three consecutive nucleotides at the 5' terminus of (N')y are LNA nucleotides and three consecutive nucleotides at the 3' terminus of (N')y are joined by two 2'-5' phosphodiester bonds. In (N)x the nucleotides alternate between modified ribonucleotides and unmodified ribonucleotides, each modified ribonucleotide being modified so as to have a 2'-O-methyl on its sugar and the ribonucleotide located at the middle of (N)x being unmodified, or the ribonucleotides in (N)x being unmodified In another embodiment of Structure (C), the present invention provides a compound wherein x=y=19 or x=y=23; in (N)x the nucleotides alternate between modified ribonucleotides and unmodified ribonucleotides, each modified ribonucleotide being modified so as to have a 2'-O-methyl on its sugar and the ribonucleotide located at the middle of (N)x being unmodified; three nucleotides at the 3' terminus of (N')y are joined by two 2'-5' phosphodiester bonds and three nucleotides at the 5' terminus of (N')y are LNA such as ENA.

In another embodiment of Structure (C), five consecutive nucleotides at the 5' terminus of (N')y comprise the 2'-O-methyl sugar modification and two consecutive nucleotides at the 3' terminus of (N')y are L-DNA.

In yet another embodiment, the present invention provides a compound wherein x=y=19 or x=y=23; (N)x consists of unmodified ribonucleotides; three consecutive nucleotides at the 3' terminus of (N')y are joined by two 2'-5' phosphodiester bonds and three consecutive nucleotides at the 5' terminus of (N')y are LNA such as ENA.

According to other embodiments of Structure (C), in (N')y the 5' or 3' terminal nucleotide, or 2, 3, 4, 5 or 6 consecutive nucleotides at either termini or 1-4 modified nucleotides at each of the 5' and 3' termini are independently phosphonocarboxylate or phosphinocarboxylate nucleotides (PACE nucleotides). In some embodiments the PACE nucleotides are deoxyribonucleotides. In some preferred embodiments in (N')y, 1 or 2 consecutive nucleotides at each of the 5' and 3' termini are PACE nucleotides. Examples of PACE nucleotides and analogs are disclosed in U.S. Pat. Nos. 6,693,187 and 7,067,641 both incorporated by reference.

In additional embodiments, the present invention provides a compound having Structure (D):

5'(N)x-Z3' antisense strand

3'Z'—(N')y5' sense strand      (D)

wherein each of N and N' is a nucleotide selected from an unmodified ribonucleotide, a modified ribonucleotide, an unmodified deoxyribonucleotide or a modified deoxyribonucleotide;

wherein each of (N)x and (N')y is an oligomer in which each consecutive nucleotide is joined to the next nucleotide by a covalent bond and each of x and y is an integer between 18 and 40;

wherein (N)x comprises unmodified ribonucleotides further comprising one modified nucleotide at the 3' terminal or penultimate position, wherein the modified nucleotide is selected from the group consisting of a bicyclic nucleotide, a 2' sugar modified nucleotide, a mirror nucleotide, an altritol nucleotide, or a nucleotide joined to an adjacent nucleotide by an internucleotide linkage selected from a 2'-5' phosphodiester bond, a P-alkoxy linkage or a PACE linkage;

wherein (N')y comprises unmodified ribonucleotides further comprising one modified nucleotide at the 5' terminal or penultimate position, wherein the modified nucleotide is selected from the group consisting of a bicyclic nucleotide, a 2' sugar modified nucleotide, a mirror nucleotide, an altritol nucleotide, or a nucleotide joined to an adjacent nucleotide by an internucleotide linkage selected from a 2'-5' phosphodiester bond, a P-alkoxy linkage or a PACE linkage;

wherein in each of (N)x and (N')y modified and unmodified nucleotides are not alternating;

wherein each of Z and Z' may be present or absent, but if present is 1-5 deoxyribonucleotides covalently attached at the 3' terminus of any oligomer to which it is attached;

wherein the sequence of (N')y is a sequence substantially complementary to (N)x; and wherein the sequence of (N)x comprises an antisense sequence having substantial complementarity to about 18 to about 40 consecutive ribonucleotides in the mRNA set forth in any one of SEQ ID NOS:1-58.

In one embodiment of Structure (D), x=y=19 or x=y=23; (N)x comprises unmodified ribonucleotides in which two consecutive nucleotides linked by one 2'-5' internucleotide linkage at the 3' terminus; and (N')y comprises unmodified ribonucleotides in which two consecutive nucleotides linked by one 2'-5' internucleotide linkage at the 5' terminus.

In some embodiments, x=y=19 or x=y=23; (N)x comprises unmodified ribonucleotides in which three consecutive nucleotides at the 3' terminus are joined together by two 2'-5' phosphodiester bonds; and (N')y comprises unmodified ribonucleotides in which four consecutive nucleotides at the 5' terminus are joined together by three 2'-5' phosphodiester bonds (set forth herein as Structure II).

According to various embodiments of Structure (D) 2, 3, 4, 5, 6, 7, 8, 9, 10, 11, 12, 13 or 14 consecutive ribonucleotides starting at the ultimate or penultimate position of the 3' terminus of (N)x and 2, 3, 4, 5, 6, 7, 8, 9, 10, 11, 12, 13 or 14 consecutive ribonucleotides starting at the ultimate or penultimate position of the 5' terminus of (N')y are linked by 2'-5' internucleotide linkages.

According to one preferred embodiment of Structure (D), four consecutive nucleotides at the 5' terminus of (N')y are joined by three 2'-5' phosphodiester bonds and three consecutive nucleotides at the 3' terminus of (N')x are joined by two 2'-5' phosphodiester bonds. Three nucleotides at the 5' terminus of (N')y and two nucleotides at the 3' terminus of (N')x may also comprise 3'-O-methyl modifications.

According to various embodiments of Structure (D), 2, 3, 4, 5, 6, 7, 8, 9, 10, 11, 12, 13 or 14 consecutive nucleotides starting at the ultimate or penultimate position of the 3' terminus of (N)x and 2, 3, 4, 5, 6, 7, 8, 9, 10, 11, 12, 13 or 14 consecutive ribonucleotides starting at the ultimate or penultimate position of the 5' terminus of (N')y are independently mirror nucleotides. In some embodiments the mirror is an L-ribonucleotide. In other embodiments the mirror nucleotide is L-deoxyribonucleotide.

In other embodiments of Structure (D), 2, 3, 4, 5, 6, 7, 8, 9, 10, 11, 12, 13 or 14 consecutive ribonucleotides starting at the ultimate or penultimate position of the 3' terminus of (N)x and 2, 3, 4, 5, 6, 7, 8, 9, 10, 11, 12, 13 or 14 consecutive ribonucleotides starting at the ultimate or penultimate position of the 5' terminus of (N')y are independently 2' sugar modified nucleotides. In some embodiments the 2' sugar modification comprises the presence of an amino, a fluoro, an alkoxy or an alkyl moiety. In certain embodiments the 2' sugar modification comprises a methoxy moiety (2'-OMe).

In one preferred embodiment of Structure (D), five consecutive nucleotides at the 5' terminus of (N')y comprise the 2'-O-methyl modification and five consecutive nucleotides at the 3' terminus of (N')x comprise the 2'-O-methyl modification. In another preferred embodiment of Structure (D), ten consecutive nucleotides at the 5' terminus of (N')y comprise the 2'-O-methyl modification and five consecutive nucleotides at the 3' terminus of (N')x comprise the 2'-O-methyl modification. In another preferred embodiment of Structure (D), thirteen consecutive nucleotides at the 5' terminus of (N')y comprise the 2'-O-methyl modification and five consecutive nucleotides at the 3' terminus of (N')x comprise the 2'-O-methyl modification.

In some embodiments of Structure (D), in (N')y 2, 3, 4, 5, 6, 7, 8, 9, 10, 11, 12, 13 or 14 consecutive ribonucleotides starting at the ultimate or penultimate position of the 3' terminus of (N)x and 2, 3, 4, 5, 6, 7, 8, 9, 10, 11, 12, 13 or 14 consecutive ribonucleotides starting at the ultimate or penultimate position of the 5' terminus of (N')y are independently a bicyclic nucleotide. In various embodiments the bicyclic nucleotide is a locked nucleic acid (LNA) such as a 2'-O,4'-C-ethylene-bridged nucleic acid (ENA).

In various embodiments of Structure (D), (N')y comprises a modified nucleotide selected from a bicyclic nucleotide, a 2' sugar modified nucleotide, a mirror nucleotide, an altritol nucleotide or a nucleotide joined to an adjacent nucleotide by an internucleotide linkage selected from a 2'-5' phosphodiester bond, a P-alkoxy linkage or a PACE linkage;

In various embodiments of Structure (D), (N)x comprises a modified nucleotide selected from a bicyclic nucleotide, a 2' sugar modified nucleotide, a mirror nucleotide, an altritol nucleotide or a nucleotide joined to an adjacent nucleotide by an internucleotide linkage selected from a 2'-5' phosphodiester bond, a P-alkoxy linkage or a PACE linkage;

In embodiments wherein each of the 3' and 5' termini of the same strand comprises a modified nucleotide, the modification at the 5' and 3' termini is identical. In another embodiment, the modification at the 5' terminus is different from the modification at the 3' terminus of the same strand. In one specific embodiment, the modified nucleotides at the 5' terminus are mirror nucleotides and the modified nucleotides at the 3' terminus of the same strand are joined by 2'-5' phosphodiester bond.

In one specific embodiment of Structure (D), five consecutive nucleotides at the 5' terminus of (N')y comprise the 2'-O-methyl modification and two consecutive nucleotides at the 3' terminus of (N')y are L-DNA. In addition, the compound may further comprise five consecutive 2'-O-methyl modified nucleotides at the 3' terminus of (N')x.

In various embodiments of Structure (D), the modified nucleotides in (N)x are different from the modified nucleotides in (N')y. For example, the modified nucleotides in (N)x are 2' sugar modified nucleotides and the modified nucleotides in (N')y are nucleotides linked by 2'-5' internucleotide linkages. In another example, the modified nucleotides in (N)x are mirror nucleotides and the modified nucleotides in (N')y are nucleotides linked by 2'-5' internucleotide linkages. In another example, the modified nucleotides in (N)x are nucleotides linked by 2'-5' internucleotide linkages and the modified nucleotides in (N')y are mirror nucleotides.

In additional embodiments, the present invention provides a compound having Structure (E):

5'(N)x-Z3' antisense strand

3'Z'—(N')y5' sense strand (E)

wherein each of N and N' is a nucleotide selected from an unmodified ribonucleotide, a modified ribonucleotide, an unmodified deoxyribonucleotide or a modified deoxyribonucleotide;

wherein each of (N)x and (N')y is an oligomer in which each consecutive nucleotide is joined to the next nucleotide by a covalent bond and each of x and y is an integer between 18 and 40;

wherein (N)x comprises unmodified ribonucleotides further comprising one modified nucleotide at the 5' terminal or penultimate position, wherein the modified nucleotide is selected from the group consisting of a bicyclic nucleotide, a 2' sugar modified nucleotide, a mirror nucleotide, an altritol nucleotide, or a nucleotide joined to an adjacent nucleotide by an internucleotide linkage selected from a 2'-5' phosphodiester bond, a P-alkoxy linkage or a PACE linkage;

wherein (N')y comprises unmodified ribonucleotides further comprising one modified nucleotide at the 3' terminal or penultimate position, wherein the modified nucleotide is selected from the group consisting of a bicyclic nucleotide, a 2' sugar modified nucleotide, a mirror nucleotide, an altritol nucleotide, or a nucleotide joined to an adjacent nucleotide by an internucleotide linkage selected from a 2'-5' phosphodiester bond, a P-alkoxy linkage or a PACE linkage;

wherein in each of (N)x and (N')y modified and unmodified nucleotides are not alternating;

wherein each of Z and Z' may be present or absent, but if present is 1-5 deoxyribonucleotides covalently attached at the 3' terminus of any oligomer to which it is attached;

wherein the sequence of $(N')_y$ is a sequence substantially complementary to (N)x; and wherein the sequence of $(N)_x$ comprises an antisense sequence having substantial complementarity to about 18 to about 40 consecutive ribonucleotides in the mRNA set forth in any one of SEQ ID NOS:1-58.

In certain preferred embodiments the ultimate nucleotide at the 5' terminus of (N)x is unmodified.

According to various embodiments of Structure (E) 2, 3, 4, 5, 6, 7, 8, 9, 10, 11, 12, 13 or 14 consecutive ribonucleotides starting at the ultimate or penultimate position of the 5' terminus of (N)x, preferably starting at the 5' penultimate position, and 2, 3, 4, 5, 6, 7, 8, 9, 10, 11, 12, 13 or 14 consecutive ribonucleotides starting at the ultimate or penultimate position of the 3' terminus of (N')y are linked by 2'-5' internucleotide linkages.

According to various embodiments of Structure (E), 2, 3, 4, 5, 6, 7, 8, 9, 10, 11, 12, 13 or 14 consecutive nucleotides starting at the ultimate or penultimate position of the 5' terminus of (N)x, preferably starting at the 5' penultimate position, and 2, 3, 4, 5, 6, 7, 8, 9, 10, 11, 12, 13 or 14 consecutive nucleotides starting at the ultimate or penultimate position of the 3' terminus of (N')y are independently mirror nucleotides. In some embodiments the mirror is an L-ribonucleotide. In other embodiments the mirror nucleotide is L-deoxyribonucleotide.

In other embodiments of Structure (E), 2, 3, 4, 5, 6, 7, 8, 9, 10, 11, 12, 13 or 14 consecutive ribonucleotides starting at the ultimate or penultimate position of the 5' terminus of (N)x, preferably starting at the 5' penultimate position, and 2, 3, 4, 5, 6, 7, 8, 9, 10, 11, 12, 13 or 14 consecutive ribonucleotides starting at the ultimate or penultimate position of the 3' terminus of (N')y are independently 2' sugar modified nucleotides. In some embodiments the 2' sugar modification comprises the presence of an amino, a fluoro, an alkoxy or an alkyl moiety. In certain embodiments the 2' sugar modification comprises a methoxy moiety (2'-OMe).

In some embodiments of Structure (E), in (N')y 2, 3, 4, 5, 6, 7, 8, 9, 10, 11, 12, 13 or 14 consecutive ribonucleotides starting at the ultimate or penultimate position of the 5' terminus of (N)x, preferably starting at the 5' penultimate position, and 2, 3, 4, 5, 6, 7, 8, 9, 10, 11, 12, 13 or 14 consecutive ribonucleotides starting at the ultimate or penultimate position of the 3' terminus of (N')y are independently a bicyclic nucleotide. In various embodiments the bicyclic nucleotide is a locked nucleic acid (LNA) such as a 2'-O, 4'-C-ethylene-bridged nucleic acid (ENA).

In various embodiments of Structure (E), (N')y comprises modified nucleotides selected from a bicyclic nucleotide, a 2' sugar modified nucleotide, a mirror nucleotide, an altritol nucleotide, a nucleotide joined to an adjacent nucleotide by a P-alkoxy backbone modification or a nucleotide joined to an adjacent nucleotide by an internucleotide linkage selected from a 2'-5' phosphodiester bond, a P-alkoxy linkage or a PACE linkage at the 3' terminus or at each of the 3' and 5' termini.

In various embodiments of Structure (E), (N)x comprises a modified nucleotide selected from a bicyclic nucleotide, a 2' sugar modified nucleotide, a mirror nucleotide, an altritol nucleotide, or a nucleotide joined to an adjacent nucleotide by an internucleotide linkage selected from a 2'-5' phosphodiester bond, a P-alkoxy linkage or a PACE linkage at the 5' terminus or at each of the 3' and 5' termini.

In one embodiment where both 3' and 5' termini of the same strand comprise a modified nucleotide, the modification at the 5' and 3' termini is identical. In another embodiment, the modification at the 5' terminus is different from the modification at the 3' terminus of the same strand. In one specific embodiment, the modified nucleotides at the 5' terminus are mirror nucleotides and the modified nucleotides at the 3' terminus of the same strand are joined by 2'-5' phosphodiester bond.

In various embodiments of Structure (E), the modified nucleotides in (N)x are different from the modified nucleotides in (N')y. For example, the modified nucleotides in (N)x are 2' sugar modified nucleotides and the modified nucleotides in (N')y are nucleotides linked by 2'-5' internucleotide linkages. In another example, the modified nucleotides in (N)x are mirror nucleotides and the modified nucleotides in (N')y are nucleotides linked by 2'-5' internucleotide linkages.

In another example, the modified nucleotides in (N)x are nucleotides linked by 2'-5' internucleotide linkages and the modified nucleotides in (N')y are mirror nucleotides.

In additional embodiments, the present invention provides a compound having Structure (F):

5'(N)x-Z3' antisense strand

3'Z'—(N')y5' sense strand                (F)

wherein each of N and N' is a nucleotide selected from an unmodified ribonucleotide, a modified ribonucleotide, an unmodified deoxyribonucleotide or a modified deoxyribonucleotide;

wherein each of (N)x and (N')y is an oligomer in which each consecutive nucleotide is joined to the next nucleotide by a covalent bond and each of x and y is an integer between 18 and 40;

wherein each of (N)x and (N')y comprise unmodified ribonucleotides in which each of (N)x and (N')y independently comprise one modified nucleotide at the 3' terminal or penultimate position wherein the modified nucleotide is selected from the group consisting of a bicyclic nucleotide, a 2' sugar modified nucleotide, a mirror nucleotide, a nucleotide joined to an adjacent nucleotide by a P-alkoxy backbone modification or a nucleotide joined to an adjacent nucleotide by a 2'-5' phosphodiester bond;

wherein in each of (N)x and (N')y modified and unmodified nucleotides are not alternating;

wherein each of Z and Z' may be present or absent, but if present is 1-5 deoxyribonucleotides covalently attached at the 3' terminus of any oligomer to which it is attached;

wherein the sequence of $(N')_y$ is a sequence substantially complementary to (N)x; and wherein the sequence of $(N)_x$ comprises an antisense sequence having substantial complementarity to about 18 to about 40 consecutive ribonucleotides in mRNA set forth in any one of SEQ ID NOS:1-58.

In some embodiments of Structure (F), x=y=19 or x=y=23; (N')y comprises unmodified ribonucleotides in which two consecutive nucleotides at the 3' terminus comprises two consecutive mirror deoxyribonucleotides; and (N)x comprises unmodified ribonucleotides in which one nucleotide at the 3' terminus comprises a mirror deoxyribonucleotide (set forth as Structure III).

According to various embodiments of Structure (F) 2, 3, 4, 5, 6, 7, 8, 9, 10, 11, 12, 13 or 14 consecutive ribonucleotides independently beginning at the ultimate or penultimate position of the 3' termini of (N)x and (N')y are linked by 2'-5' internucleotide linkages.

According to one preferred embodiment of Structure (F), three consecutive nucleotides at the 3' terminus of (N')y are joined by two 2'-5' phosphodiester bonds and three consecutive nucleotides at the 3' terminus of (N')x are joined by two 2'-5' phosphodiester bonds.

According to various embodiments of Structure (F), 2, 3, 4, 5, 6, 7, 8, 9, 10, 11, 12, 13 or consecutive nucleotides independently beginning at the ultimate or penultimate position of the 3' termini of (N)x and (N')y are independently mirror nucleotides. In some embodiments the mirror nucleotide is an L-ribonucleotide. In other embodiments the mirror nucleotide is an L-deoxyribonucleotide.

In other embodiments of Structure (F), 2, 3, 4, 5, 6, 7, 8, 9, 10, 11, 12, 13 or 14 consecutive ribonucleotides independently beginning at the ultimate or penultimate position of the 3' termini of (N)x and (N')y are independently 2' sugar modified nucleotides. In some embodiments the 2' sugar modification comprises the presence of an amino, a fluoro, an alkoxy or an alkyl moiety. In certain embodiments the 2' sugar modification comprises a methoxy moiety (2'-OMe).

In some embodiments of Structure (F), 2, 3, 4, 5, 6, 7, 8, 9, 10, 11, 12, 13 or 14 consecutive ribonucleotides independently beginning at the ultimate or penultimate position of the 3' termini of (N)x and (N')y are independently a bicyclic nucleotide. In various embodiments the bicyclic nucleotide is a locked nucleic acid (LNA) such as a 2'-O,4'-C-ethylene-bridged nucleic acid (ENA).

In various embodiments of Structure (F), (N')y comprises a modified nucleotide selected from a bicyclic nucleotide, a 2' sugar modified nucleotide, a mirror nucleotide, an altritol nucleotide, or a nucleotide joined to an adjacent nucleotide by an internucleotide linkage selected from a 2'-5' phosphodiester bond, a P-alkoxy linkage or a PACE linkage at the 3' terminus or at both the 3' and 5' termini.

In various embodiments of Structure (F), (N)x comprises a modified nucleotide selected from a bicyclic nucleotide, a 2' sugar modified nucleotide, a mirror nucleotide, an altritol nucleotide, or a nucleotide joined to an adjacent nucleotide by an internucleotide linkage selected from a 2'-5' phosphodiester bond, a P-alkoxy linkage or a PACE linkage at the 3' terminus or at each of the 3' and 5' termini.

In one embodiment where each of 3' and 5' termini of the same strand comprise a modified nucleotide, the modification at the 5' and 3' termini is identical. In another embodiment, the modification at the 5' terminus is different from the modification at the 3' terminus of the same strand. In one specific embodiment, the modified nucleotides at the 5' terminus are mirror nucleotides and the modified nucleotides at the 3' terminus of the same strand are joined by 2'-5' phosphodiester bond.

In various embodiments of Structure (F), the modified nucleotides in (N)x are different from the modified nucleotides in (N')y. For example, the modified nucleotides in (N)x are 2' sugar modified nucleotides and the modified nucleotides in (N')y are nucleotides linked by 2'-5' internucleotide linkages. In another example, the modified nucleotides in (N)x are mirror nucleotides and the modified nucleotides in (N')y are nucleotides linked by 2'-5' internucleotide linkages. In another example, the modified nucleotides in (N)x are nucleotides linked by 2'-5' internucleotide linkages and the modified nucleotides in (N')y are mirror nucleotides.

In additional embodiments, the present invention provides a compound having Structure (G):

5'(N)x-Z3' antisense strand

3'Z'—(N')y5' sense strand  (G)

wherein each of N and N' is a nucleotide selected from an unmodified ribonucleotide, a modified ribonucleotide, an unmodified deoxyribonucleotide or a modified deoxyribonucleotide;
wherein each of (N)x and (N')y is an oligomer in which each consecutive nucleotide is joined to the next nucleotide by a covalent bond and each of x and y is an integer between 18 and 40;
wherein each of (N)x and (N')y comprise unmodified ribonucleotides in which each of (N)x and (N')y independently comprise one modified nucleotide at the 5' terminal or penultimate position wherein the modified nucleotide is selected from the group consisting of a bicyclic nucleotide, a 2' sugar modified nucleotide, a mirror nucleotide, a nucleotide joined to an adjacent nucleotide by a P-alkoxy backbone modification or a nucleotide joined to an adjacent nucleotide by a 2'-5' phosphodiester bond;
wherein for (N)x the modified nucleotide is preferably at penultimate position of the 5' terminal;
wherein in each of (N)x and (N')y modified and unmodified nucleotides are not alternating;
wherein each of Z and Z' may be present or absent, but if present is 1-5 deoxyribonucleotides covalently attached at the 3' terminus of any oligomer to which it is attached;
wherein the sequence of (N')y is a sequence substantially complementary to (N)x; and
wherein the sequence of (N)x comprises an antisense sequence having substantial complementarity to about 18 to about 40 consecutive ribonucleotides in the mRNA set forth in any one of SEQ ID NOS:1-58.

In some embodiments of Structure (G), x=y=19.

According to various embodiments of Structure (G) 2, 3, 4, 5, 6, 7, 8, 9, 10, 11, 12, 13 or 14 consecutive ribonucleotides independently beginning at the ultimate or penultimate position of the 5' termini of (N)x and (N')y are linked by 2'-5' internucleotide linkages. For (N)x the modified nucleotides preferably starting at the penultimate position of the 5' terminal.

According to various embodiments of Structure (G), 2, 3, 4, 5, 6, 7, 8, 9, 10, 11, 12, 13 or 14 consecutive nucleotides independently beginning at the ultimate or penultimate position of the 5' termini of (N)x and (N')y are independently mirror nucleotides. In some embodiments the mirror nucleotide is an L-ribonucleotide. In other embodiments the mirror nucleotide is an L-deoxyribonucleotide. For (N)x the modified nucleotides preferably starting at the penultimate position of the 5' terminal.

In other embodiments of Structure (G), 2, 3, 4, 5, 6, 7, 8, 9, 10, 11, 12, 13 or 14 consecutive ribonucleotides independently beginning at the ultimate or penultimate position of the 5' termini of (N)x and (N')y are independently 2' sugar modified nucleotides. In some embodiments the 2' sugar modification comprises the presence of an amino, a fluoro, an alkoxy or an alkyl moiety. In certain embodiments the 2' sugar modification comprises a methoxy moiety (2'-OMe). In some preferred embodiments the consecutive modified nucleotides preferably begin at the penultimate position of the 5' terminus of (N)x.

In one preferred embodiment of Structure (G), five consecutive ribonucleotides at the 5' terminus of (N')y comprise a 2'-O-methyl modification and one ribonucleotide at the 5' penultimate position of (N')x comprises a 2'-O-methyl modification. In another preferred embodiment of Structure (G), five consecutive ribonucleotides at the 5' terminus of (N')y comprise a 2'-O-methyl modification and two consecutive ribonucleotides at the 5' terminal position of (N')x comprise a 2'-O-methyl modification.

In some embodiments of Structure (G), 2, 3, 4, 5, 6, 7, 8, 9, 10, 11, 12, 13 or 14 consecutive ribonucleotides independently beginning at the ultimate or penultimate position of the 5' termini of (N)x and (N')y are bicyclic nucleotides. In various embodiments the bicyclic nucleotide is a locked nucleic acid (LNA) such as a 2'-O, 4'-C-ethylene-bridged nucleic acid (ENA). In some preferred embodiments the consecutive modified nucleotides preferably begin at the penultimate position of the 5' terminus of (N)x.

In various embodiments of Structure (G), (N')y comprises a modified nucleotide selected from a bicyclic nucleotide, a 2' sugar modified nucleotide, a mirror nucleotide, an altritol nucleotide, or a nucleotide joined to an adjacent nucleotide by an internucleotide linkage selected from a 2'-5' phosphodiester bond, a P-alkoxy linkage or a PACE linkage at the 5' terminus or at each of the 3' and 5' termini.

In various embodiments of Structure (G), (N)x comprises a modified nucleotide selected from a bicyclic nucleotide, a 2' sugar modified nucleotide, a mirror nucleotide, an altritol nucleotide, or a nucleotide joined to an adjacent nucleotide by an internucleotide linkage selected from a 2'-5' phosphodiester bond, a P-alkoxy linkage or a PACE linkage at the 5' terminus or at each of the 3' and 5' termini.

In one embodiment where each of 3' and 5' termini of the same strand comprise a modified nucleotide, the modification at the 5' and 3' termini is identical. In another embodiment, the modification at the 5' terminus is different from the modification at the 3' terminus of the same strand. In one specific embodiment, the modified nucleotides at the 5' terminus are mirror nucleotides and the modified nucleotides at the 3' terminus of the same strand are joined by 2'-5' phosphodiester bond. In various embodiments of Structure (G), the modified nucleotides in (N)x are different from the modified nucleotides in (N')y. For example, the modified nucleotides in (N)x are 2' sugar modified nucleotides and the modified nucleotides in (N')y are nucleotides linked by 2'-5' internucleotide linkages. In another example, the modified nucleotides in (N)x are mirror nucleotides and the modified nucleotides in (N')y are nucleotides linked by 2'-5' internucleotide linkages. In another example, the modified nucleotides in (N)x are nucleotides linked by 2'-5' internucleotide linkages and the modified nucleotides in (N')y are mirror nucleotides.

In additional embodiments, the present invention provides a compound having Structure (H):

5'(N)x-Z3' antisense strand

3'Z'—(N')y5' sense strand                                    (H)

wherein each of N and N' is a nucleotide selected from an unmodified ribonucleotide, a modified ribonucleotide, an unmodified deoxyribonucleotide or a modified deoxyribonucleotide;
wherein each of (N)x and (N')y is an oligomer in which each consecutive nucleotide is joined to the next nucleotide by a covalent bond and each of x and y is an integer between 18 and 40;
wherein (N)x comprises unmodified ribonucleotides further comprising one modified nucleotide at the 3' terminal or penultimate position or the 5' terminal or penultimate position, wherein the modified nucleotide is selected from the group consisting of a bicyclic nucleotide, a 2' sugar modified nucleotide, a mirror nucleotide, an altritol nucleotide, or a nucleotide joined to an adjacent nucleotide by an internucleotide linkage selected from a 2'-5' phosphodiester bond, a P-alkoxy linkage or a PACE linkage;
wherein (N')y comprises unmodified ribonucleotides further comprising one modified nucleotide at an internal position, wherein the modified nucleotide is selected from the group consisting of a bicyclic nucleotide, a 2' sugar modified nucleotide, a mirror nucleotide, an altritol nucleotide, or a nucleotide joined to an adjacent nucleotide by an internucleotide linkage selected from a 2'-5' phosphodiester bond, a P-alkoxy linkage or a PACE linkage;
wherein in each of (N)x and (N')y modified and unmodified nucleotides are not alternating;
wherein each of Z and Z' may be present or absent, but if present is 1-5 deoxyribonucleotides covalently attached at the 3' terminus of any oligomer to which it is attached;
wherein the sequence of $(N')_y$ is a sequence substantially complementary to (N)x; and
wherein the sequence of $(N)_x$ comprises an antisense sequence having substantial complementarity to about 18 to about 40 consecutive ribonucleotides in mRNA set forth in any one of SEQ ID NOS:1-58.

In one embodiment of Structure (H), 2, 3, 4, 5, 6, 7, 8, 9, 10, 11, 12, 13 or 14 consecutive ribonucleotides independently beginning at the ultimate or penultimate position of the 3' terminus or the 5' terminus or both termini of (N)x are independently 2' sugar modified nucleotides, bicyclic nucleotides, mirror nucleotides, altritol nucleotides or nucleotides joined to an adjacent nucleotide by a 2'-5' phosphodiester bond and 2, 3, 4, 5, 6, 7, 8, 9, 10, 11, 12, 13 or 14 consecutive internal ribonucleotides in (N')y are independently 2' sugar modified nucleotides, bicyclic nucleotides, mirror nucleotides, altritol nucleotides or nucleotides joined to an adjacent nucleotide by a 2'-5' phosphodiester bond. In some embodiments the 2' sugar modification comprises the presence of an amino, a fluoro, an alkoxy or an alkyl moiety. In certain embodiments the 2' sugar modified ribonucleotide comprises a methoxy moiety (2'-OMe).

In another embodiment of Structure (H), 2, 3, 4, 5, 6, 7, 8, 9, 10, 11, 12, 13 or 14 consecutive ribonucleotides independently beginning at the ultimate or penultimate position of the 3' terminus or the 5' terminus or 2-8 consecutive nucleotides at each of 5' and 3' termini of (N')y are independently 2' sugar modified nucleotides, bicyclic nucleotides, mirror nucleotides, altritol nucleotides or nucleotides joined to an adjacent nucleotide by a 2'-5' phosphodiester bond, and 2, 3, 4, 5, 6, 7, 8, 9, 10, 11, 12, 13 or 14 consecutive internal ribonucleotides in (N)x are independently 2' sugar modified nucleotides, bicyclic nucleotides, mirror nucleotides, altritol nucleotides or nucleotides joined to an adjacent nucleotide by a 2'-5' phosphodiester bond.

In one embodiment wherein each of 3' and 5' termini of the same strand comprises a modified nucleotide, the modification at the 5' and 3' termini is identical. In another embodiment, the modification at the 5' terminus is different from the modification at the 3' terminus of the same strand. In one specific embodiment, the modified nucleotides at the 5' terminus are mirror nucleotides and the modified nucleotides at the 3' terminus of the same strand are joined by 2'-5' phosphodiester bond.

In various embodiments of Structure (H), the modified nucleotides in (N)x are different from the modified nucleotides in (N')y. For example, the modified nucleotides in (N)x are 2' sugar modified nucleotides and the modified nucleotides in (N')y are nucleotides linked by 2'-5' internucleotide linkages. In another example, the modified nucleotides in (N)x are mirror nucleotides and the modified nucleotides in (N')y are nucleotides linked by 2'-5' internucleotide linkages. In another example, the modified nucleotides in (N)x are nucleotides linked by 2'-5' internucleotide linkages and the modified nucleotides in (N')y are mirror nucleotides.

In one preferred embodiment of Structure (H), x=y=19; three consecutive ribonucleotides at the 9-11 nucleotide positions 9-11 of (N')y comprise 2'-O-methyl modification and five consecutive ribonucleotides at the 3' terminal position of (N')x comprise 2'-O-methyl modification.

In one aspect the present invention provides a compound having Structure (I) set forth below:

5'(N)x-Z3' (antisense strand)

3'Z'—(N')y-z"5' (sense strand)                               (I)

wherein each of N and N' is a ribonucleotide which may be unmodified or modified, or an unconventional moiety;
wherein each of (N)x and (N')y is an oligonucleotide in which each consecutive N or N' is joined to the next N or N' by a covalent bond;

wherein Z and Z' may be present or absent, but if present is independently 1-5 consecutive nucleotides covalently attached at the 3' terminus of the strand in which it is present; wherein z" may be present or absent, but if present is a capping moiety covalently attached at the 5' terminus of (N') y;

wherein x=18 to 27;

wherein y=18 to 27;

wherein (N)x comprises modified and unmodified ribonucleotides, each modified ribonucleotide having a 2'-O-methyl on its sugar, wherein N at the 3' terminus of (N)x is a modified ribonucleotide, (N)x comprises at least five alternating modified ribonucleotides beginning at the 3' end and at least nine modified ribonucleotides in total and each remaining N is an unmodified ribonucleotide;

wherein in (N')y at least one unconventional moiety is present, which unconventional moiety may be an abasic ribose moiety, an abasic deoxyribose moiety, a modified or unmodified deoxyribonucleotide, a mirror nucleotide, and a nucleotide joined to an adjacent nucleotide by a 2'-5' internucleotide phosphate bond; and wherein the sequence of (N)x is substantially complementary to the sequence of (N')y; and wherein the sequence of (N)$_x$ comprises an antisense sequence having substantial complementarity to about 18 to about 40 consecutive ribonucleotides in mRNA set forth in any one of SEQ ID NOS:1-58.

In some embodiments x=y=19. In other embodiments x=y=23. In some embodiments the at least one unconventional moiety is present at positions 15, 16, 17, or 18 in (N')y. In some embodiments the unconventional moiety is selected from a mirror nucleotide, an abasic ribose moiety and an abasic deoxyribose moiety. In some preferred embodiments the unconventional moiety is a mirror nucleotide, preferably an L-DNA moiety. In some embodiments an L-DNA moiety is present at position 17, position 18 or positions 17 and 18.

In other embodiments the unconventional moiety is an abasic moiety. In various embodiments (N')y comprises at least five abasic ribose moieties or abasic deoxyribose moieties.

In yet other embodiments (N')y comprises at least five abasic ribose moieties or abasic deoxyribose moieties and at least one of N' is an LNA.

In some embodiments of Structure (IX) (N)x comprises nine alternating modified ribonucleotides. In other embodiments of Structure (I) (N)x comprises nine alternating modified ribonucleotides further comprising a 2'O modified nucleotide at position 2. In some embodiments (N)x comprises 2'-OMe sugar modified ribonucleotides at the odd numbered positions 1, 3, 5, 7, 9, 11, 13, 15, 17, 19. In other embodiments (N)x further comprises a 2'-OMe sugar modified ribonucleotide at one or both of positions 2 and 18. In yet other embodiments (N)x comprises 2'-OMe sugar modified ribonucleotides at positions 2, 4, 6, 8, 11, 13, 15, 17, 19.

In various embodiments z" is present and is selected from an abasic ribose moiety, a deoxyribose moiety; an inverted abasic ribose moiety, a deoxyribose moiety; C6-amino-Pi; a mirror nucleotide.

In another aspect the present invention provides a compound having Structure (J) set forth below:

5'(N)x-Z3' (antisense strand)

3'Z'—(N')y-z"5' (sense strand)     (J)

wherein each of N and N' is a ribonucleotide which may be unmodified or modified, or an unconventional moiety;

wherein each of (N)x and (N')y is an oligonucleotide in which each consecutive N or N' is joined to the next N or N' by a covalent bond;

wherein Z and Z' may be present or absent, but if present is independently 1-5 consecutive nucleotides covalently attached at the 3' terminus of the strand in which it is present; wherein z" may be present or absent but if present is a capping moiety covalently attached at the 5' terminus of (N')y;

wherein x=18 to 27;

wherein y=18 to 27;

wherein (N)x comprises modified or unmodified ribonucleotides, and optionally at least one unconventional moiety;

wherein in (N')y at least one unconventional moiety is present, which unconventional moiety may be an abasic ribose moiety, an abasic deoxyribose moiety, a modified or unmodified deoxyribonucleotide, a mirror nucleotide, a non-base pairing nucleotide analog or a nucleotide joined to an adjacent nucleotide by a 2'-5' internucleotide phosphate bond; and wherein the sequence of (N)x is substantially complementary to the sequence of (N')y; and wherein the sequence of (N)$_x$ comprises an antisense sequence having substantial complementarity to about 18 to about 40 consecutive ribonucleotides in mRNA set forth in any one of SEQ ID NOS:1-58.

In some embodiments x=y=19. In other embodiments x=y=23. In some preferred embodiments (N)x comprises modified and unmodified ribonucleotides, and at least one unconventional moiety.

In some embodiments in (N)x the N at the 3' terminus is a modified ribonucleotide and (N)x comprises at least 8 modified ribonucleotides. In other embodiments at least 5 of the at least 8 modified ribonucleotides are alternating beginning at the 3' end. In some embodiments (N)x comprises an abasic moiety in one of positions 5, 6, 7, 8, 9, 10, 11, 12, 13, 14 or 15.

In some embodiments the at least one unconventional moiety in (N')y is present at positions 15, 16, 17, or 18. In some embodiments the unconventional moiety is selected from a mirror nucleotide, an abasic ribose moiety and an abasic deoxyribose moiety. In some preferred embodiments the unconventional moiety is a mirror nucleotide, preferably an L-DNA moiety. In some embodiments an L-DNA moiety is present at position 17, position 18 or positions 17 and 18. In other embodiments the at least one unconventional moiety in (N')y is an abasic ribose moiety or an abasic deoxyribose moiety.

In various embodiments of Structure (X) z" is present and is selected from an abasic ribose moiety, a deoxyribose moiety; an inverted abasic ribose moiety, a deoxyribose moiety; C6-amino-Pi; a mirror nucleotide.

In yet another aspect the present invention provides a compound having Structure (K) set forth below:

5'(N)$_x$—Z3' (antisense strand)

3'Z'—(N')$_y$-z"5' (sense strand)     (K)

wherein each of N and N' is a ribonucleotide which may be unmodified or modified, or an unconventional moiety;

wherein each of (N)x and (N')y is an oligonucleotide in which each consecutive N or N' is joined to the next N or N' by a covalent bond;

wherein Z and Z' may be present or absent, but if present is independently 1-5 consecutive nucleotides covalently attached at the 3' terminus of the strand in which it is present; wherein z" may be present or absent but if present is a capping moiety covalently attached at the 5' terminus of (N')y;

wherein x=18 to 27;

wherein y=18 to 27;

wherein (N)x comprises a combination of modified or unmodified ribonucleotides and unconventional moieties, any modified ribonucleotide having a 2'-O-methyl on its sugar;

wherein (N')y comprises modified or unmodified ribonucleotides and optionally an unconventional moiety, any modified ribonucleotide having a 2'OMe on its sugar;

wherein the sequence of (N)x is substantially complementary to the sequence of (N')y; and wherein the sequence of (N)$_x$ comprises an antisense sequence having substantial complementarity to about 18 to about 40 consecutive ribonucleotides in mRNA set forth in any one of SEQ ID NOS:1-58; and wherein there are less than 15 consecutive nucleotides complementary to the mRNA.

In some embodiments x=y=19. In other embodiments x=y=23. In some preferred embodiments the at least one preferred one unconventional moiety is present in (N)x and is an abasic ribose moiety or an abasic deoxyribose moiety. In other embodiments the at least one unconventional moiety is present in (N)x and is a non-base pairing nucleotide analog. In various embodiments (N')y comprises unmodified ribonucleotides. In some embodiments (N)x comprises at least five abasic ribose moieties or abasic deoxyribose moieties or a combination thereof. In certain embodiments (N)x and/or (N')y comprise modified ribonucleotides which do not base pair with corresponding modified or unmodified ribonucleotides in (N')y and/or (N)x.

In various embodiments the present invention provides an siRNA set forth in Structure (L):

5'(N)$_x$—Z3' (antisense strand)

3'Z'—(N')$_y$5' (sense strand)   (L)

wherein each of N and N' is a nucleotide selected from an unmodified ribonucleotide, a modified ribonucleotide, an unmodified deoxyribonucleotide and a modified deoxyribonucleotide;

wherein each of (N)$_x$ and (N')$_y$ is an oligonucleotide in which each consecutive N or N' is joined to the next N or N' by a covalent bond;

wherein Z and Z' are absent;

wherein x=y=19;

wherein in (N')y the nucleotide in at least one of positions 15, 16, 17, 18 and 19 comprises a nucleotide selected from an abasic pseudo-nucleotide, a mirror nucleotide, a deoxyribonucleotide and a nucleotide joined to an adjacent nucleotide by a 2'-5' internucleotide bond;

wherein (N)x comprises alternating modified ribonucleotides and unmodified ribonucleotides each modified ribonucleotide being modified so as to have a 2'-O-methyl on its sugar and the ribonucleotide located at the middle position of (N)x being modified or unmodified, preferably unmodified; and wherein the sequence of (N)x is substantially complementary to the sequence of (N')y; and wherein the sequence of (N)$_x$ comprises an antisense sequence having substantial complementarity to about 18 to about 40 consecutive ribonucleotides in mRNA set forth in any one of SEQ ID NOS:1-58.

In some embodiments of Structure (L), in (N')y the nucleotide in one or both of positions 17 and 18 comprises a modified nucleotide selected from an abasic pseudo-nucleotide, a mirror nucleotide and a nucleotide joined to an adjacent nucleotide by a 2'-5' internucleotide bond. In some embodiments the mirror nucleotide is selected from L-DNA and L-RNA. In various embodiments the mirror nucleotide is L-DNA.

In various embodiments (N')y comprises a modified nucleotide at position 15 wherein the modified nucleotide is selected from a mirror nucleotide and a deoxyribonucleotide.

In certain embodiments (N')y further comprises a modified nucleotide or pseudo nucleotide at position 2 wherein the pseudo nucleotide may be an abasic pseudo-nucleotide analog and the modified nucleotide is optionally a mirror nucleotide.

In various embodiments the antisense strand (N)x comprises 2'O-Me modified ribonucleotides at the odd numbered positions (5' to 3'; positions 1, 3, 5, 7, 9, 11, 13, 15, 17, 19). In some embodiments (N)x further comprises 2'O-Me modified ribonucleotides at one or both positions 2 and 18. In other embodiments (N)x comprises 2'-OMe sugar modified ribonucleotides at positions 2, 4, 6, 8, 11, 13, 15, 17, 19.

Other embodiments of Structures (L), (I) and (J) are envisaged wherein x=y=21 or wherein x=y=23; in these embodiments the modifications for (N')y discussed above instead of being in positions 17 and 18 are in positions 19 and 20 for 21-mer oligonucleotide and 21 and 22 for 23 mer oligonucleotide; similarly the modifications in positions 15, 16, 17, 18 or 19 are in positions 17, 18, 19, 20 or 21 for the 21-mer oligonucleotide and positions 19, 20, 21, 22, or 23 for the 23-mer oligonucleotide. The 2'-OMe modifications on the antisense strand are similarly adjusted. In some embodiments (N)x comprises 2'-OMe sugar modified ribonucleotides at the odd numbered positions (5' to 3'; positions 1, 3, 5, 7, 9, 12, 14, 16, 18, 20 for the 21 mer oligonucleotide [nucleotide at position 11 unmodified] and 1, 3, 5, 7, 9, 11, 13, 15, 17, 19, 21, 23 for the 23 mer oligonucleotide [nucleotide at position 12 unmodified]. In other embodiments (N)$_x$ comprises 2'-OMe sugar modified ribonucleotides at positions 2, 4, 6, 8, 10, 12, 14, 16, 18, 20 [nucleotide at position 11 unmodified for the 21 mer oligonucleotide and at positions 2, 4, 6, 8, 10, 13, 15, 17, 19, 21, 23 for the 23 mer oligonucleotide [nucleotide at position 12 unmodified].

In some embodiments (N')y further comprises a 5' terminal cap nucleotide. In various embodiments the terminal cap moiety is selected from an abasic pseudo-nucleotide analog, an inverted abasic pseudo-nucleotide analog, an L-DNA nucleotide, and a C6-imine phosphate (C6 amino linker with phosphate at terminus).

In other embodiments the present invention provides a compound having Structure (M) set forth below:

5'(N)$_x$—Z3' (antisense strand)

3'Z'—(N')$_y$5' (sense strand)

wherein each of N and N' is selected from a pseudo-nucleotide and a nucleotide;

wherein each nucleotide is selected from an unmodified ribonucleotide, a modified ribonucleotide, an unmodified deoxyribonucleotide and a modified deoxyribonucleotide;

wherein each of (N)$_x$ and (N')$_y$ is an oligonucleotide in which each consecutive N or N' is joined to the next N or N' by a covalent bond;

wherein Z and Z' are absent;

wherein x=18 to 27;

wherein y=18 to 27;

wherein the sequence of (N)x is substantially complementary to the sequence of (N')y;

and wherein the sequence of (N)$_x$ comprises an antisense sequence having substantial complementarity to about 18 to about 40 consecutive ribonucleotides in mRNA set forth in any one of SEQ ID NOS:1-58;

wherein at least one of N is selected from an abasic pseudo nucleotide, a non-pairing nucleotide analog and a nucleotide mismatch to the mRNA of a target gene in a position of (N)x such that (N)x comprises less than 15 consecutive nucleotides complementary to the mRNA of a target gene.

In other embodiments the present invention provides a double stranded compound having Structure (N) set forth below:

5'(N)$_x$—Z3' (antisense strand)

3'Z'—(N')$_y$5' (sense strand)     (N)

wherein each of N and N' is a nucleotide selected from an unmodified ribonucleotide, a modified ribonucleotide, an unmodified deoxyribonucleotide and a modified deoxyribonucleotide;
wherein each of (N)$_x$ and (N')$_y$ is an oligonucleotide in which each consecutive N or N' is joined to the next N or N' by a covalent bond;
wherein Z and Z' are absent;
wherein each of x and y is an integer between 18 and 40;
wherein the sequence of (N)x is substantially complementary to the sequence of (N')y;
and wherein the sequence of (N)$_x$ comprises an antisense sequence having substantial complementarity to about 18 to about 40 consecutive ribonucleotides in mRNA set forth in any one of SEQ ID NOS:1-58;
wherein (N)x, (N')y or (N)x and (N')y comprise non base-pairing modified nucleotides such that (N)x and (N')y form less than 15 base pairs in the double stranded compound.

In other embodiments the present invention provides a compound having Structure (O) set forth below:

5'(N)$_x$—Z3' (antisense strand)

3'Z'—(N')$_y$5' (sense strand)     (O)

wherein each of N is a nucleotide selected from an unmodified ribonucleotide, a modified ribonucleotide, an unmodified deoxyribonucleotide and a modified deoxyribonucleotide;
wherein each of N' is a nucleotide analog selected from a six membered sugar nucleotide, seven membered sugar nucleotide, morpholino moiety, peptide nucleic acid and combinations thereof;
wherein each of (N)$_x$ and (N')$_y$ is an oligonucleotide in which each consecutive N or N' is joined to the next N or N' by a covalent bond;
wherein Z and Z' are absent;
wherein each of x and y is an integer between 18 and 40;
wherein the sequence of (N)x is substantially complementary to the sequence of (N')y; and wherein the sequence of (N)$_x$ comprises an antisense sequence having substantial complementarity to about 18 to about 40 consecutive ribonucleotides in mRNA set forth in any one of SEQ ID NOS:1-58.

In other embodiments the present invention provides a compound having Structure (P) set forth below:

5'(N)$_x$—Z3' (antisense strand)

3'Z'—(N')$_y$5' (sense strand)     (P)

wherein each of N and N' is a nucleotide selected from an unmodified ribonucleotide, a modified ribonucleotide, an unmodified deoxyribonucleotide and a modified deoxyribonucleotide;
wherein each of (N)$_x$ and (N')$_y$ is an oligonucleotide in which each consecutive N or N' is joined to the next N or N' by a covalent bond;
wherein Z and Z' are absent;
wherein each of x and y is an integer between 18 and 40;
wherein one of N or N' in an internal position of (N)x or (N')y or one or more of N or N' at a terminal position of (N)x or (N')y comprises an abasic moiety or a 2' modified nucleotide; wherein the sequence of (N)x is substantially complementary to the sequence of (N')y; and wherein the sequence of (N)$_x$ comprises an antisense sequence having substantial complementarity to about 18 to about 40 consecutive ribonucleotides in mRNA set forth in any one of SEQ ID NOS:1-58.

In various embodiments (N')y comprises a modified nucleotide at position 15 wherein the modified nucleotide is selected from a mirror nucleotide and a deoxyribonucleotide.

In certain embodiments (N')y further comprises a modified nucleotide at position 2 wherein the modified nucleotide is selected from a mirror nucleotide and an abasic pseudo-nucleotide analog.

In various embodiments the antisense strand (N)x comprises 2'O-Me modified ribonucleotides at the odd numbered positions (5' to 3'; positions 1, 3, 5, 7, 9, 11, 13, 15, 17, 19). In some embodiments (N)$_x$ further comprises 2'O-Me modified ribonucleotides at one or both positions 2 and 18. In other embodiments (N)x comprises 2'-OMe sugar modified ribonucleotides at positions 2, 4, 6, 8, 11, 13, 15, 17, 19.

The Structural motifs (A)-(P) described above are useful with any oligonucleotide pair (sense and antisense strands) to a mammalian or non-mammalian gene. In some embodiments the mammalian gene is a human gene preferably selected from the genes provided in Tables A1-A4, with mRNA set forth in SEQ ID NOS:1-58. In certain preferred embodiments the sense and antisense oligonucleotides of the siRNA are selected from any one of siRNA pairs set forth in SEQ ID NOS:59-33,596. Table A5 below shows certain preferred sense and antisense oligonucleotide pairs.

TABLE A5

| TARGET GENE | SENSE (N')y 5'-3' | ANTISENSE (N)x 5'-3' |
|---|---|---|
| P53 | GAGAAUAUUUCACCCUUCA | UGAAGGGUGAAAUAUUCUC |
| CASP2 | GCCAGAAUGUGGAACUCCU | AGGAGUUCCACAUUCUGGC |
| RTP801 | GUGCCAACCUGAUGCAGCU | AGCAGCAUCAGGUUGGCAC |
| RTP801 | UACUGUAGCAUGAAACAAA | UUUGUUUCAUGCUACAGUA |
| RTP801 | CAGUACUGUAGCAUGAAAC | GUUUCAUGCUACAGUACUG |
| TP53BP2 | CACCCAGAGAACAUUUAUU | AAUAAAUGUUCUCUGGGUG |
| CYBA | UGGGGACAGAAGUACAUGA | UCAUGUACUUCUGUCCCCA |
| RAC1 | GAGUCCUGCAUCAUUUGAA | UUCAAAUGAUGCAGGACUC |
| SPP1 | GUGCCAUACCAGUUAAACA | UGUUUAACUGGUAUGGCAC |
| SPP1 | GCAAAAUGAAAGAACAU | AUGUUCUCUUUCAUUUUGC |
| ASPP1 | CGAACUCAGAGAAAUGUAA | UUACAUUUCUCUGAGUUCG |
| ASPP1 | GGAGAAAAACGUACUGAAA | UUUCAGUACGUUUUUCUCC |
| SOX9 | CCUUCAUGAAGAUGACCGA | UCGGUCAUCUUCAUGAAGG |

For all the above Structures (A)-(P), in various embodiments x=y and each of x and y is 19, 20, 21, 22 or 23. In preferred embodiments, x=y=19. In additional embodiments the compound comprises modified ribonucleotides in alternating positions wherein each N at the 5' and 3' termini of (N)x are modified in their sugar residues and the middle ribonucleotide is not modified, e.g. ribonucleotide in position 10 in a 19-mer strand, position 11 in a 21 mer and position 12 in a 23-mer strand.

In some embodiments where x=y=21 or x=y=23 the position of modifications in the 19 mer are adjusted for the 21 and 23 mers with the proviso that the middle nucleotide of the antisense strand is preferably not modified.

For all the above Structures (A)-(P), in some embodiments, neither (N)x nor (N')y are phosphorylated at the 3' and 5' termini. In other embodiments either or both (N)x and (N')y are phosphorylated at the 3' termini. In yet another embodiment, either or both (N)x and (N')y are phosphorylated at the 3' termini using non-cleavable phosphate groups. In yet another embodiment, either or both (N)x and (N')y are phosphorylated at the terminal 2' termini position using cleavable or non-cleavable phosphate groups. These particular siRNA compounds are also blunt ended and are non-phosphorylated at the termini; however, comparative experiments have shown that siRNA compounds phosphorylated at one or both of the 3'-termini have similar activity in vivo compared to the non-phosphorylated compounds.

For all the above Structures (A)-(P), in some embodiments, the compound is blunt ended, for example wherein both Z and Z' are absent. In an alternative embodiment, the compound comprises at least one 3' overhang, wherein at least one of Z or Z' is present. Z and Z' independently comprises one or more covalently linked modified or non-modified nucleotides, for example inverted dT or dA; dT, LNA, mirror nucleotide and the like. In some embodiments each of Z and Z' are independently selected from dT and dTdT. siRNA in which Z and/or Z' is present have similar activity and stability as siRNA in which Z and Z' are absent.

In certain embodiments for all the above-mentioned Structures, the compound comprises one or more locked nucleic acids (LNA) also defined as bridged nucleic acids or bicyclic nucleotides. Preferred locked nucleic acids are 2'-O, 4'-C-ethylene nucleosides (ENA) or 2'-O, 4'-C-methylene nucleosides. Other examples of LNA and ENA nucleotides are disclosed in WO 98/39352, WO 00/47599 and WO 99/14226, all incorporated herein by reference.

In certain embodiments for all the above-mentioned Structures, the compound comprises one or more altritol monomers (nucleotides), also defined as 1,5 anhydro-2-deoxy-D-altrito-hexitol (see for example, Allart, et al., 1998. Nucleosides & Nucleotides 17:1523-1526; Herdewijn et al., 1999. Nucleosides & Nucleotides 18:1371-1376; Fisher et al., 2007, NAR 35(4):1064-1074; all incorporated herein by reference).

The present invention explicitly excludes compounds in which each of N and/or N' is a deoxyribonucleotide (D-A, D-C, D-G, D-T). In certain embodiments (N)x and (N')y may comprise independently 1, 2, 3, 4, 5, 6, 7, 8, or 9 deoxyribonucleotides. In certain embodiments the present invention provides a compound wherein each of N is an unmodified ribonucleotide and the 3' terminal nucleotide or 2, 3, 4, 5, 6, 7, 8, 9, 10, 11, 12, 13 or 14 consecutive nucleotides at the 3' terminus of (N')y are deoxyribonucleotides. In yet other embodiments each of N is an unmodified ribonucleotide and the 5' terminal nucleotide or 2, 3, 4, 5, 6, 7, 8, 9, 10, 11, 12, 13 or 14 consecutive nucleotides at the 5' terminus of (N')y are deoxyribonucleotides. In further embodiments the 5' terminal nucleotide or 2, 3, 4, 5, 6, 7, 8, or 9 consecutive nucleotides at the 5' terminus and 1, 2, 3, 4, 5, or 6 consecutive nucleotides at the 3' termini of (N)x are deoxyribonucleotides and each of N' is an unmodified ribonucleotide. In yet further embodiments (N)x comprises unmodified ribonucleotides and 1 or 2, 3 or 4 consecutive deoxyribonucleotides independently at each of the 5' and 3' termini and 1 or 2, 3, 4, 5 or 6 consecutive deoxyribonucleotides in internal positions; and each of N' is an unmodified ribonucleotide. In certain embodiments the 3' terminal nucleotide or 2, 3, 4, 5, 6, 7, 8, 9, 10, 11, 12 13 or 14 consecutive nucleotides at the 3' terminus of (N')y and the terminal 5' nucleotide or 2, 3, 4, 5, 6, 7, 8, 9, 10, 11, 12 13 or 14 consecutive nucleotides at the 5' terminus of (N)x are deoxyribonucleotides. The present invention excludes compounds in which each of N and/or N' is a deoxyribonucleotide. In some embodiments the 5' terminal nucleotide of N or 2 or 3 consecutive of N and 1, 2, or 3 of N' is a deoxyribonucleotide. Certain examples of active DNA/RNA siRNA chimeras are disclosed in US patent publication 2005/0004064, and Ui-Tei, 2008 (NAR 36(7):2136-2151) incorporated herein by reference in their entirety.

Unless otherwise indicated, in preferred embodiments of the structures discussed herein the covalent bond between each consecutive N and N' is a phosphodiester bond.

An additional novel molecule provided by the present invention is an oligonucleotide comprising consecutive nucleotides wherein a first segment of such nucleotides encode a first inhibitory RNA molecule, a second segment of such nucleotides encode a second inhibitory RNA molecule, and a third segment of such nucleotides encode a third inhibitory RNA molecule. Each of the first, the second and the third segment may comprise one strand of a double stranded RNA and the first, second and third segments may be joined together by a linker. Further, the oligonucleotide may comprise three double stranded segments joined together by one or more linker.

Thus, one molecule provided by the present invention is an oligonucleotide comprising consecutive nucleotides which encode three inhibitory RNA molecules; said oligonucleotide may possess a triple stranded structure, such that three double stranded arms are linked together by one or more linker, such as any of the linkers presented hereinabove. This molecule forms a "star"-like structure, and may also be referred to herein as RNAstar. Such structures are disclosed in PCT patent publication WO 2007/091269, assigned to the assignee of the present invention and incorporated herein in its entirety by reference.

A covalent bond refers to an internucleotide linkage linking one nucleotide monomer to an adjacent nucleotide monomer. A covalent bond includes for example, a phosphodiester bond, a phosphorothioate bond, a P-alkoxy bond, a P-carboxy bond and the like. The normal internucleoside linkage of RNA and DNA is a 3' to 5' phosphodiester linkage. In certain preferred embodiments a covalent bond is a phosphodiester bond. Covalent bond encompasses non-phosphorous-containing internucleoside linkages, such as those disclosed in WO 2004/041924 inter alia. Unless otherwise indicated, in preferred embodiments of the structures discussed herein the covalent bond between each consecutive N and N' is a phosphodiester bond.

For all of the structures above, in some embodiments the oligonucleotide sequence of (N)x is fully complementary to the oligonucleotide sequence of (N')y. In other embodiments (N)x and (N')y are substantially complementary. In certain embodiments (N)x is fully complementary to a target sequence. In other embodiments (N)x is substantially complementary to a target sequence.

In some embodiments, neither (N)x nor (N')y are phosphorylated at the 3' and 5' termini. In other embodiments either or both (N)x and (N')y are phosphorylated at the 3' termini (3' Pi). In yet another embodiment, either or both (N)x and (N')y are phosphorylated at the 3' termini with non-cleavable phosphate groups. In yet another embodiment, either or both (N)x and (N')y are phosphorylated at the terminal 2' termini position using cleavable or non-cleavable phosphate groups. Further, the inhibitory nucleic acid molecules of the present invention may comprise one or more gaps and/or one or more nicks and/or one or more mismatches. Without wishing to be bound by theory, gaps, nicks and mismatches have the advantage of partially destabilizing the nucleic acid/siRNA, so that it may be more easily processed by endogenous cellular machinery such as DICER, DROSHA or RISC into its inhibitory components.

In the context of the present invention, a gap in a nucleic acid refers to the absence of one or more internal nucleotides in one strand, while a nick in a nucleic acid refers to the absence of an internucleotide linkage between two adjacent nucleotides in one strand. Any of the molecules of the present invention may contain one or more gaps and/or one or more nicks.

The structures disclosed herein, when integrated into antisense and corresponding sense nucleic acid sequences to any target gene, provides siRNA compound useful in reducing expression of that target gene. The target gene is a mammalian or non-mammalian gene. The methods of the invention comprise topically and non-invasively administering to the eye of the subject one or more siRNA compounds which inhibit expression of a target gene in the eye of the subject.

siRNA Synthesis

The compounds of the present invention can be synthesized by any of the methods that are well-known in the art for synthesis of ribonucleic (or deoxyribonucleic) oligonucleotides. Such synthesis is, among others, described in Beaucage and Iyer, Tetrahedron 1992; 48:2223-2311; Beaucage and Iyer, Tetrahedron 1993; 49: 6123-6194 and Caruthers, et. al., Methods Enzymol. 1987; 154: 287-313; the synthesis of thioates is, among others, described in Eckstein, Annu Rev. Biochem. 1985; 54: 367-402, the synthesis of RNA molecules is described in Sproat, in Humana Press 2005 edited by Herdewijn P.; Kap. 2: 17-31 and respective downstream processes are, among others, described in Pingoud et. al., in IRL Press 1989 edited by Oliver; Kap. 7: 183-208.

Other synthetic procedures are known in the art e.g. the procedures as described in Usman et al., J. Am. Chem. Soc., 1987, 109:7845; Scaringe et al., NAR, 1990, 18:5433; Wincott et al., NAR 1995, 23:2677-2684; and Wincott et al., Methods Mol. Bio., 1997, 74:59, and these procedures may make use of common nucleic acid protecting and coupling groups, such as dimethoxytrityl at the 5'-end, and phosphoramidites at the 3'-end. The modified (e.g. 2'-O-methylated) nucleotides and unmodified nucleotides are incorporated as desired.

The oligonucleotides of the present invention can be synthesized separately and joined together post-synthetically, for example, by ligation (Moore et al., Science 1992, 256:9923; International Patent Publication No. WO 93/23569; Shabarova et al., NAR 1991, 19:4247; Bellon et al., Nucleosides & Nucleotides, 1997, 16:951; Bellon et al., Bioconjugate Chem 1997, 8:204), or by hybridization following synthesis and/or deprotection.

It is noted that a commercially available machine (available, inter alia, from Applied Biosystems) can be used; the oligonucleotides are prepared according to the sequences disclosed herein. Overlapping pairs of chemically synthesized fragments can be ligated using methods well known in the art (e.g., see U.S. Pat. No. 6,121,426). The strands are synthesized separately and then are annealed to each other in the tube. Then, the double-stranded siRNAs are separated from the single-stranded oligonucleotides that were not annealed (e.g. because of the excess of one of them) by HPLC. In relation to the siRNAs or siRNA fragments of the present invention, two or more such sequences can be synthesized and linked together for use in the present invention.

The compounds of the invention can also be synthesized via tandem synthesis methodology, as described for example in US Patent Publication No. 2004/0019001 (McSwiggen), and in PCT Patent Publication No. WO 2007/091269 (assigned to the assignee of the present invention and incorporated herein in its entirety by reference) wherein both siRNA strands are synthesized as a single contiguous oligonucleotide fragment or strand separated by a cleavable linker which is subsequently cleaved to provide separate siRNA fragments or strands that hybridize and permit purification of the siRNA duplex. The linker can be a polynucleotide linker or a non-nucleotide linker.

The present invention further provides for a pharmaceutical composition comprising two or more siRNA molecules for the treatment of any of the diseases and conditions mentioned herein, whereby said two molecules may be physically mixed together in the pharmaceutical composition in amounts which generate equal or otherwise beneficial activity, or may be covalently or non-covalently bound, or joined together by a nucleic acid linker of a length ranging from 2-100, preferably 2-50 or 2-30 nucleotides.

Thus, the siRNA molecules may be covalently or non-covalently bound or joined by a linker to form a tandem siRNA compound. Such tandem siRNA compounds comprising two siRNA sequences are typically about 38-150 nucleotides in length, more preferably 38 or 40-60 nucleotides in length, and longer accordingly if more than two siRNA sequences are included in the tandem molecule. A longer tandem compound comprised of two or more longer sequences which encode siRNA produced via internal cellular processing, e.g., long dsRNAs, is also envisaged, as is a tandem molecule encoding two or more shRNAs. Such tandem molecules are also considered to be a part of the present invention. A tandem compound comprising two or more siRNAs sequences of the invention is envisaged.

Additionally, the siRNA disclosed herein or any nucleic acid molecule comprising or encoding such siRNA can be linked or bound (covalently or non-covalently) to antibodies (including aptamer molecules) against cell surface internalizable molecules expressed on the target cells, in order to achieve enhanced targeting for treatment of the diseases disclosed herein. For example, anti-Fas antibody (preferably a neutralizing antibody) may be combined (covalently or non-covalently) with any of the siRNA compounds.

The compounds of the present invention can be delivered either directly or with viral or non-viral vectors. When delivered directly the sequences are generally rendered nuclease resistant. Alternatively the sequences can be incorporated into expression cassettes or constructs such that the sequence is expressed in the cell as discussed herein below. Generally the construct contains the proper regulatory sequence or promoter to allow the sequence to be expressed in the targeted cell. Vectors optionally used for delivery of the compounds of the present invention are commercially available, and may be modified for the purpose of delivery of the compounds of the present invention by methods known to one of skill in the art.

It is also envisaged that a long oligonucleotide (typically 25-500 nucleotides in length) comprising one or more stem and loop structures, where stem regions comprise the sequences of the oligonucleotides of the invention, may be delivered in a carrier, preferably a pharmaceutically acceptable carrier, and may be processed intracellularly by endogenous cellular complexes (e.g. by DROSHA and DICER as described above) to produce one or more smaller double stranded oligonucleotides (siRNAs) which are oligonucleotides of the invention. This oligonucleotide can be termed a tandem shRNA construct. It is envisaged that this long oligonucleotide is a single stranded oligonucleotide comprising one or more stem and loop structures, wherein each stem region comprises a sense and corresponding antisense siRNA sequence of the genes of the invention.

RNA Interference

A number of PCT applications have recently been published that relate to the RNAi phenomenon. These include: PCT publication WO 00/44895; PCT publication WO 00/49035; PCT publication WO 00/63364; PCT publication WO 01/36641; PCT publication WO 01/36646; PCT publication WO 99/32619; PCT publication WO 00/44914; PCT publication WO 01/29058; and PCT publication WO 01/75164.

RNA interference (RNAi) is based on the ability of dsRNA species to enter a cytoplasmic protein complex, where it is then targeted to the complementary cellular RNA and specifically degrade it. The RNA interference response features an endonuclease complex containing an siRNA, commonly referred to as an RNA-induced silencing complex (RISC), which mediates cleavage of single-stranded RNA having a sequence complementary to the antisense strand of the siRNA duplex. Cleavage of the target RNA may take place in the middle of the region complementary to the antisense strand of the siRNA duplex (Elbashir et al., Genes Dev., 2001, 15(2): 188-200). In more detail, longer dsRNAs are digested into short (17-29 bp) dsRNA fragments (also referred to as short inhibitory RNAs, "siRNAs") by type III RNAses (DICER, DROSHA, etc.; Bernstein et al., Nature, 2001, 409(6818): 363-6; Lee et al., Nature, 2003, 425(6956):415-9). The RISC protein complex recognizes these fragments and complementary mRNA. The whole process is culminated by endonuclease cleavage of target mRNA (McManus & Sharp, Nature Rev Genet, 2002, 3(10):737-47; Paddison & Hannon, Curr Opin Mol. Ther. 2003, 5(3):217-24). (For additional information on these terms and proposed mechanisms, see for example Bernstein et al., RNA 2001, 7(11):1509-21; Nishikura, Cell 2001, 107(4):415-8 and PCT publication WO 01/36646).

Several groups have described the development of DNA-based vectors capable of generating siRNA within cells. The method generally involves transcription of short hairpin RNAs that are efficiently processed to form siRNAs within cells (Paddison et al. PNAS USA 2002, 99:1443-1448; Paddison et al. Genes & Dev 2002, 16:948-958; Sui et al. PNAS USA 2002, 8:5515-5520; and Brummelkamp et al. Science 2002, 296:550-553). These reports describe methods to generate siRNAs capable of specifically targeting numerous endogenously and exogenously expressed genes.

The invention has been described in an illustrative manner, and it is to be understood that the terminology used is intended to be in the nature of words of description rather than of limitation.

Obviously, many modifications and variations of the present invention are possible in light of the above teachings. It is, therefore, to be understood that within the scope of the appended claims, the invention can be practiced otherwise than as specifically described.

Throughout this application, various publications, including United States patents, are referenced by author and year and patents by number. The disclosures of these publications and patents and patent applications in their entireties are hereby incorporated by reference into this application in order to more fully describe the state of the art to which this invention pertains.

The present invention is illustrated in detail below with reference to examples, but is not to be construed as being limited thereto.

Citation of any document herein is not intended as an admission that such document is pertinent prior art, or considered material to the patentability of any claim of the present application. Any statement as to content or a date of any document is based on the information available to applicant at the time of filing and does not constitute an admission as to the correctness of such a statement.

EXAMPLES

Without further elaboration, it is believed that one skilled in the art can, using the preceding description, utilize the present invention to its fullest extent. The following preferred specific embodiments are, therefore, to be construed as merely illustrative, and not limitative of the claimed invention in any way.

Standard molecular biology protocols known in the art not specifically described herein are generally followed essentially as in Sambrook et al., Molecular cloning: A laboratory manual, Cold Springs Harbor Laboratory, New-York (1989, 1992), and in Ausubel et al., Current Protocols in Molecular Biology, John Wiley and Sons, Baltimore, Md. (1988), and as in Ausubel et al., Current Protocols in Molecular Biology, John Wiley and Sons, Baltimore, Md. (1989) and as in Perbal, A Practical Guide to Molecular Cloning, John Wiley & Sons, New York (1988), and as in Watson et al., Recombinant DNA, Scientific American Books, New York and in Birren et al (eds) Genome Analysis: A Laboratory Manual Series, Vols. 1-4 Cold Spring Harbor Laboratory Press, New York (1998) and methodology as set forth in U.S. Pat. Nos. 4,666,828; 4,683,202; 4,801,531; 5,192,659 and 5,272,057 and incorporated herein by reference. Polymerase chain reaction (PCR) was carried out as in standard PCR Protocols: A Guide To Methods And Applications, Academic Press, San Diego, Calif. (1990). In situ PCR in combination with Flow Cytometry (FACS) can be used for detection of cells containing specific DNA and mRNA sequences (Testoni et al., Blood 1996, 87:3822.) Methods of performing RT-PCR are well known in the art.

Cell Culture

HeLa cells (American Type Culture Collection) were cultured as described in Czauderna, et al. (NAR, 2003. 31:670-82). Human keratinocytes were cultured at 37° C. in Dulbecco's modified Eagle medium (DMEM) containing 10% FCS. The mouse cell line, B16V (American Type Culture Collection), was cultured at 37° C. in Dulbecco's modified Eagle medium (DMEM) containing 10% FCS. Culture conditions were as described in (Methods Find Exp Clin Pharmacol. 1997, 19(4):231-9).

In each case, the cells were subject to the experiments as described herein at a density of about 50,000 cells per well and the double-stranded nucleic acid according to the present invention was added at a concentration of 20 nM, whereby the double-stranded nucleic acid was complexed using 1 μg/ml of a proprietary lipid as described below.

In the histochemical/microscopic figures, arrows were added to draw attention to staining of the tissue.

Animal Models

Model Systems of Glaucoma and of Retinal Ganglion Cells (RGC) Death

ONC Model in Rats

Various animal models are useful for studying the effect of siRNA therapeutics in treating glaucoma. In the optic nerve crush model in rats the orbital optic nerve (ON) of anesthetized rats is exposed through a supraorbital approach, the meninges severed and all axons in the ON transected by crushing with forceps for 10 seconds, 2 mm from the lamina cribrosa. Testing active inhibitors of the invention (such as siRNA) for treating or preventing glaucoma is performed, for example, in the animal models described by Pease et al. (J. Glaucoma, 2006, 15(6):512-9. Manometric calibration and comparison of TonoLab and TonoPen tonometers in rats with experimental glaucoma and in normal mice).

Optic nerve crush (ONC) model in adult Wistar rats is also an accepted model for studying Retinal Ganglion Cells (RGC) death. The onset and kinetics of RGC death in this model are very reproducible; RGC apoptosis begins on day 4-5 after the ONC; massive RGC loss (about 50-60%) is observed on days 7-10 after the ONC; and 95% of the RGC loss is occurs by week 3-4 after the ONC. This model allows for establishment of the neuroprotective efficacy of test drugs in vivo.

In some non-limiting examples, siRNA compounds directed to genes shown in Tables A1-A4 are tested in this animal model which show that these siRNA compounds treat and/or prevent glaucoma and/or RGC death when topically and non-invasively delivered to the eye.

IOP Model in Rats

Intraocular pressure (IOP) is a measurement of the fluid pressure inside the eye. This fluid, called aqueous humor, is circulated and then drained out via specialized outflow pathways. If the drainage system does not function properly, as in prevalent forms of glaucoma, pressure inside the eye builds up. A model of ocular hypertension in Brown Norway rats developed by Dr. J. Morrison and collaborators at the Casey Eye Institute (Portland, Oreg.) is used in this study. The Morrison model involves injection of hypertonic saline into an episcleral vein, leading to blockade of the aqueous humor outflow pathways. This procedure leads to gradual increase of eye pressure and progressive death of RGCs. Importantly, inner retinal atrophy, optic nerve degeneration, and optic nerve head remodeling observed in this model are similar to that seen in human glaucoma. Thus, the Morrison model is considered the best pre-clinical rodent model of glaucoma.

In Vivo Axotomy Model in Rats

In this model RGC apoptosis is induced by axotomy of the optic nerve (ON) in adult Sprague-Dawley rats. The onset and kinetics of RGC death in this model system are very reproducible and allow for the establishment of the neuroprotective efficacy of non-invasively administered siRNA compound in vivo. Using this method, the time course of RGC death follows a predictable course: cell death begins on day 5 and proceeds to the rapid loss of more than 90% of these neurons by 2 weeks.

Vehicle Formulations and Exemplary Eye Drop Formulations

The aqueous eye drop formulation optionally contain various additives incorporated ordinarily, such as buffering agents (e.g., phosphate buffers, borate buffers, citrate buffers, tartarate buffers, acetate buffers, amino acids, sodium acetate, sodium citrate and the like), isotonicities (e.g., saccharides such as sorbitol, glucose and mannitol, polyhydric alcohols such as glycerin, concentrated glycerin, polyethylene glycol and propylene glycol, salts such as sodium chloride), preservatives or antiseptics (e.g., benzalkonium chloride, benzethonium chloride, p-oxybenzoates such as methyl p-oxybenzoate or ethyl p-oxybenzoate, benzyl alcohol, phenethyl alcohol, sorbic acid or its salts, thimerosal, chlorobutanol and the like), solubilizing aids or stabilizing agents (e.g., cyclodextrins and their derivative, water-soluble polymers such as polyvinyl pyrrolidone) surfactants such as polysorbate 80 (Tween 80)), pH modifiers (e.g., hydrochloric acid, acetic acid, phosphoric acid, sodium hydroxide, potassium hydroxide, ammonium hydroxide and the like), chelating agents (e.g., sodium edetate, sodium citrate, condensed sodium phosphate) and the like.

The eye drop formulation in the form of an aqueous suspension may also contain suspending agents (e.g., polyvinyl pyrrolidone, glycerin monostearate) and dispersing agents (e.g., surfactants such as tyloxapol and polysorbate 80, ionic polymers such as sodium alginate), in addition to the additives listed above, thereby ensuring that the eye drop formulation is a further uniform microparticulate and satisfactorily dispersed aqueous suspension.

The ophthalmic ointment may comprise a known ointment base, such as purified lanolin, petrolatum, plastibase, liquid paraffin, polyethylene glycol and the like.

Exemplary Eye Drop Formulation 1:

Formulation of siRNA compounds in PBS ("naked siRNA formulation") is typically prepared by dissolving dry siRNA in PBS. The formulation comprises at least one siRNA compound typically present in an amount ranging from about 5 µg/µl to about 60 µg/µl by volume of the composition.

In a non-limiting example formulation of an siRNA compound in PBS was prepared as follows: Under sterile conditions, 500 mg of dry siRNA were dissolved in 25 ml of sterile double distilled water (DDW), to achieve a clear 20 mg/ml solution. The solution was stored at $-80°$ C. until use. The 20 mg/ml stock solution in DDW was then brought to a working concentration of 100 µg/3 µl, in PBS, as follows: 325 µl of 20 mg/ml stock of siRNA solution (6.5 mg) were precipitates by 0.15M NaCl and EtOH, and dried under a tissue culture laminar (sterile conditions). 6.5 mg of dry siRNA were dissolved in 130 µl PBS to form eye drop formulation 1.

Exemplary Eye Drop Formulation 2:

In some embodiments at least one siRNA compound is formulated in tris(hydroxymethyl)aminomethane (TRIS) 1M, pH 8.0 (available e.g. from Sigma (catalog #T-1503)).

In a non-limiting example 121.1 g of TRIS base (Sigma #T1503) were dissolved in 700 ml of ddH$_2$O. Desired pH 8 was achieved with addition of concentrated HCl. DDW was added to have final 1 L solution. Under sterile conditions, 42.426 mg of siRNA compound powder were dissolved in 2.1 ml of sterile double distilled water, to achieve a clear 20 mg/ml (1.5 mM) stock solution. The stock solution was stored at $-80°$ C. until use. Under sterile conditions, corresponding amounts of siRNA stock were lyophilized and re-suspended in corresponding amount of 1M TRIS pH 8.

Exemplary Eye Drop Formulation 3:

The concentration of the viscosity-enhancing agents to be used is typically within the range of about 0.05 to about 5.0% (w/v), and more desirably, from about 0.1 to about 3.0% (w/v). One preferred ophthalmic composition comprises from about 0.01 to about 0.075% (w/v) of an active ingredient; from about 0.15 to about 2.5% (w/v) of polyoxyl 40 stearate; from about 0.1 to about 3.0% (w/v) of a cellulose thickening agent selected from 25 hydroxypropyl methylcellulose or hydroxyethylcellulose; and from about 0.0001% to about 0.01% (w/v) of an anti-oxidant selected from butylated hydroxytoluene or sodium thiosulfate.

The combination of the surfactants such as polyoxyl 40 stearate or polyoxyethylene cetyl ether or polyoxyethylene octylphenyl ether with siRNA yields an eye-drop preparation causing less irritation to the eyes, providing better distribution in the eyes and having higher stability. The inclusion of an anti-oxidant and a cellulose-thickening agent further improves the distribution of the active therapeutic agent (i.e. siRNA) in the eyes and the stability.

Other excipients may also be added, such as for example an isotonic agent, buffer, preservative, and or pH-controlling agent. Sterile purified water in appropriate amounts is present to obtain the desired eye-drop preparation.

The pH of the ophthalmic composition is within the range, which is normally used for ophthalmic preparations, as known in the art, but is desirably within the range of 5 to 8. The formulation further comprises at least one siRNA compound typically present in an amount ranging from about 6.6 µg/µl to about 50 µg/µl by volume of the composition.

Exemplary Eye Drop Formulation 4:

In the topical delivery of drugs to the lens, drug retention on the eye surface is considered to be important. Without wishing to be bound to theory, increased retention on the ocular surface leads to increased ocular absorption of a drug through the cornea into the aqueous humor and subsequently the lens.

In some embodiments a topical suspension is preferred. Non-limiting examples of topical suspensions include:

(1) hydroxypropyl methylcellulose (HPMC, 0.5% w/v), (2) xanthan gum (0.5% w/v), (3) gellan gum (0.5% w/v), (4) carbopol (0.25% w/v), and (5) carbopol (0.25% w/v)-hydroxypropyl methylcellulose (HPMC) (0.25% w/v). Viscosity measurements are conducted with a viscometer.

The formulation further comprises at least one siRNA compound typically present in an amount ranging from about 5 µg/µl to about 60 µg/µl by volume of the composition.

Exemplary Eye Drop Formulation 5:

In ophthalmic compositions, a chelating agent is optionally used to enhance preservative effectiveness. Suitable chelating agents are those known in the art, and, while not intending to be limiting, edetate (EDTA) salts like edetate disodium, edetate calcium disodium, edetate sodium, edetate trisodium, and edetate dipotassium are examples of useful chelating agents. It is understood that EDTA refers to a species having four carboxylic acid functional groups, and that these carboxylic acid groups may be protonated or deprotonated (i.e. in the salt form) depending upon the pH of the composition it is in.

Buffers are commonly used to adjust the pH to a desirable range for ophthalmic use. Generally, a pH of around 5-8 is desired, however, this may need to be adjusted due to considerations such as the stability or solubility of the therapeutically active agent or other excipients.

Another commonly used excipient in ophthalmic compositions is a viscosity-enhancing, or a thickening agent. Thickening agents are used for a variety of reasons, ranging from improving the form of the formulation for convenient administration to improving the contact with the eye to improve bioavailability. The viscosity-enhancing agent comprises a polymer containing hydrophilic groups such as monosaccharides, polysaccharides, ethylene oxide groups, hydroxyl groups, carboxylic acids or other charged functional groups. While not intending to limit some examples useful viscosity-enhancing agents are sodium carboxymethylcellulose, hydroxypropylmethylcellulose, povidone, polyvinyl alcohol, and polyethylene glycol.

The formulation further comprises at least one siRNA compound typically present in an amount ranging from about 5 µg/µl to about 60 µg/µl by volume of the composition.

Exemplary Eye Drop Formulation 6 ("Formulation A"):

Formulation "A": Prepare 2 solutions, A and B.

Preparation of Solution A: 4% solution of methylcellulose in water. 0.4 g of methylcellulose 25 (ScienceLab.com, Cat#SLM2050) dissolved in the final volume of 10 ml of apyrogenic water for injections (WFI) in 50 mL sterile tube (Norbook, Cat#7082-51). Put small sterile stirrer inside and close the cap. Keep in boiling water bath while stirring for at least 5 minutes until methylcellulose forms an opalescent solution.

Preparation of Solution B: 2% Glycerol; 0.02% (v/v) EDTA solution. Add 333.3 uL of 60% glycerol (Sigma, Cat#G6279) & 2 µA 0.5M EDTA, pH=8 (Sigma, Cat#E9884) (final—100 uM) to 9.665 ml WFI (Norbook, Cat#7082-51). Final volume—10 mL.

Prepare 2× (in regard to working concentration) solution of siRNA in Solution B. Note: if stock siRNA volume is substantially high, the final volume of Solution B is better kept lower than 10 mL to allow volume adjustment later in 2× siRNA solution.

Preparation of Working siRNA Solution:

Cool solution A in hand ~till 40-50° C. (still liquid) and mix the desired volume with an equal volume of 2× solution of siRNA in Solution B.

Final siRNA formulation contains 2% methylcellulose, 1% glycerol and 0.01% (v/v) (50 uM) EDTA in WFI. Final pH should be ~7.4 and osmomolarity—similar to human tear film. Concentration of siRNA in final formulation is 33.3 mg/ml.

Must be prepared fresh once a week and aliquoted into the portions for daily usage. The aliquots are kept at 4° C. Before application, the dose is warmed for 20-30 min at room temperature.

The final concentration of the methylcellulose is about 0.1% to about 3% w/v about 0.1% to about 2% w/v, about 0.1%-1.5% w/v methylcellulose, preferably about 2% w/v. The final concentration of glycerol is about 0.1% to about 5% v/v, about 0.5% to about 2%, preferably about 1% v/v. The final concentration of EDTA is about 0.001% to about 0.05%, about 0.005% to about 0.01%, preferably about 0.01% w/v.

Exemplary Eye Drop Formulation 7:

In some embodiments siRNA is formulated in a commercially available lubricant eye drop formulation. Non-limiting example of commercially available lubricant eye drop formulation is Systane® available from Alcon Inc. Such commercially available lubricant eye drop formulations typically comprise polyethylene glycol and/or propylene glycol, an antiseptic and/or antiviral agent such as boric acid, a gelling agent such as hydroxypropyl guar, potassium chloride and/or sodium chloride and/or magnesium chloride and/or calcium chloride and/or zinc chloride, preservatives such as Polyquad® and purified water. Under sterile conditions, 300 mg of siRNA powder is dissolved in 15 ml of sterile double distilled water, to achieve a clear 20 mg/ml solution. The solution is stored at (−)80° C. until use. The 20 mg/ml stock solution in double distilled water is then brought to a working concentration of 100 µg/3 µl, in formulation, as follows:

To obtain a final formulated quantity of 1.7 mg siRNA: 85 µl of 20 mg/ml stock of siRNA (1.7 mg), is precipitated by 0.15M NaCl and EtOH, dried under the tissue culture laminar (sterile conditions).

To achieve a siRNA solution of 33.3 mg/ml 1.7 mg dry siRNA is dissolved in 51 µL Systane®.

siRNA Compounds Induce Knockdown (KD) of Target Genes

Example 1

In Vitro Testing of siRNA Compounds

About $1.5-2 \times 10^5$ tested cells (HeLa cells and/or 293T cells for siRNA targeting human genes and NRK52 (normal rat kidney proximal tubule cells) cells and/or NMuMG cells (mouse mammary epithelial cell line) for siRNA targeting the rat/mouse gene) were seeded per well in 6 wells plate (70-80% confluent).

About 24 hours later, cells were transfected with siRNA compounds using the Lipofectamine™ 2000 reagent (Invitrogen) at final concentrations of 5 nM or 20 nM. The cells were incubated at 37° C. in a $CO_2$ incubator for 72 h.

As positive control for transfection phosphatase and tensin homolog (PTEN)-Cy3 labeled siRNA compounds were used.

Various chemically modified blunt ended siRNA compounds having alternating modified and unmodified ribonucleotides (modified at the 2' position of the sugar residue in both the antisense and the sense strands, wherein the moiety at the 2' position is methoxy) and wherein the ribonucleotides at the 5' and 3' termini of the antisense strand are modified in their sugar residues, and the ribonucleotides at the 5' and 3' termini of the sense strand are unmodified in their sugar residues were tested. Another siRNA compound comprised a blunt ended structure having an antisense with an alternating pattern of methoxy moieties and a sense strand with three ribonucleotides linked by two 2'5' bridges at the 3' terminus; and another siRNA compound comprising antisense and sense strands having three ribonucleotides linked by 2'5' bridges at the 3' terminus was used. Some of the tested compounds comprised a blunt ended structure having an antisense with an alternating pattern of methoxy moieties and a sense strand with one or two L-nucleotides at the 3' terminal or 3' penultimate positions.

GFP siRNA compounds were used as negative control for siRNA activity. At 72 h after transfection cells were harvested and RNA was extracted from cells. Transfection efficiency was tested by fluorescent microscopy. The percent of inhibition of gene expression using specific preferred siRNA structures was determined using qPCR analysis of a target gene in cells expressing the endogenous gene.

In general, the siRNAs having specific sequences that were selected for in vitro testing were specific for human and a second species such as non-human primate, rat or rabbit genes. Similar results are obtained using siRNAs having these RNA sequences and modified as described herein.

siRNAs targeted at genes related to apoptosis and neuroprotection were tested by a similar procedure and found active and able to induce knock down of their corresponding target genes.

siRNA Prepared for Non-Invasive Administration and Administered by Eye Drops is Delivered to the Target Retinal Tissue in-vivo Example 2

Distribution of CY3-Labeled siRNA in Murine Optic Tissue (siRNA Formulated in PBS) as Monitored by Fluorescence Microscopy and Confocal Microscopy The current study showed siRNA delivery in-vivo to the lacrimal gland and ocular structures via a topical ocular route. Abbreviations: E.D.=Eye Drops; ISH=In-situ Hybridization The objective of this study was to test the delivery of DDIT4-Cy3 labeled siRNA (siRNA compound targeting the RTP801 gene) to the lacrimal gland via non-invasive topical ocular route. The topical ocular route has been evaluated for the delivery of siRNA into the lacrimal gland, anterior chamber of the eye, the retina and the optic nerve.

Materials and Methods

TABLE C1

| Animals | |
|---|---|
| Species/strain: | Mice/ICR, males |
| Age: | 6-10 weeks |
| Body Weight Range: | 27-32 gr |
| Group Size: | 2 |
| Total number of animals: | 26 |

DDIT4-Cy3 siRNA (siRNA against mouse RTP801) formulated as 20 m-/ml stock solution in PBS and stored at −80° C. until use.

Experimental Procedure

The study included 6 experimental groups as described in Table C2 hereinbelow: Mice were treated with a single siRNA DDIT4-Cy3 as follows:

Group V (A and B): dose regime: 50 µg/mouse/3 µl/eye, administration route: Right Eye drops (E.D.);

Group Am-V-A, Ami-VIII, Ami-IX: dose regime: 50 µg/mouse/3 µl/eye, administration route: both eyes, Eye drops (E.D.);

Group VI-A: dose regime: 20 µg/mouse/3 µl/eye, administration route: Right eye, Eye drops (E.D.);

Group VII, Am-VII: non-treated control.

TABLE C2

| Study Design | | | | | | |
|---|---|---|---|---|---|---|
| Group | SiRNA Type | Dose µg/mouse | Injected Volume (µl) | Route | Time point (hrs) | Group Size |
| V-A | DDIT4-Cy3 | 50.00 Right Eye | 3.00 | E.D. | 1 | 2 |
| Am-V-A | DDIT4-Cy3 | 50.00 per eye/ Both Eyes | 3.00 | E.D. | 1 | 2 |
| V-B | DDIT4-Cy3 | 50.00 Right Eye | 3.00 | E.D. | 4 | 2 |
| VI-A | DDIT4-Cy3 | 20.00 Right Eye | 3.00 | E.D. | 1 | 2 |
| VII | None | none | None | none | | 5 |
| Am-VII | None | none | None | none | | 1 |
| Am3-VIII | DDIT4-Cy3 | 50.00 per eye/ Both Eyes | 3.00 | E.D. | 4 | 2 |
| Am3-IX | DDIT4-Cy3 | 50.00 per eye/ Both Eyes | 3.00 | E.D. | 24 | 2 |

The siRNA doses were prepared under sterile conditions. siRNA aliquots were thawed for at least 30 min at room temperature prior to administration. Total amount per aliquot (per each mouse) included an additional 20% of the calculated volume. The designated siRNA dose was delivered in 3 µl (Experimental groups V-VI) volume per eye.

Anesthesia: Mice were anesthetized with Ketamine/Xylazine mix as follows: 0.85 ml Ketamine+0.15 ml Xylazine+0.9 ml Saline, 0.1 ml mix solution/20 gr body weight (BW).

Eye drop (E.D.) delivery: A 3 µl sample volume was slowly dropped in the treated eye (corneal surface) using a blunt pipette tip; the animals were placed in a warm environment to prevent anesthesia-induced hypothermia, and were returned to cages after regaining consciousness.

Scheduled euthanasia: Following treatment, mice from all groups were euthanized according to the study design (Table C2, Time point termination).

Termination step was accomplished by cardiac puncture and blood collection; collected serum/plasma was stored (−20° C.) for further siRNA blood detection analysis.

Tissue Collection: Left and right eyes including optic nerve, lacrimal glands (left and right) from all animals were excised, brain (front and middle parts of the brain, frontal oriented sections) from animals of groups, V-A one from group VII, Am3-VIII, Am3-IX were excised, embedded in optimal cutting temperature (OCT) compound and sectioned with a cryostat into 8 µm slices that were placed on microscope slides (Superfrost/Plus™). Sections were fixed in 95% EtOH for 7 minutes then counter stained with DAPI (1 μg/ml), incubated for 1 minute in absolute EtOH, incubated for 5 minutes in xylene, air dried and mounted.

Tissue Evaluation: Delivery of siRNA was evaluated using light microscopy and digital imaging. A tissue fragment was considered positive (i.e., successful Cy3 DDIT4 siRNA intracellular incorporation) only where histological (microscopic) examination showed a clear fluorescence signal within specific cells or structures such as acinar alone or in combination with ductal cells of the lacrimal gland. Background DAPI staining assisted in identification of tissue structure: in the case of anterior eye chamber structures such as cornea, angle, ciliary body or posterior eye chamber such as retina (retinal pigmentum epithelium cells (RPE), retinal ganglion cells (RGC)). Delivery was considered positive if histological examination would show that all animals within one experimental group showed the same fluorescence signal within the investigated cell type/tissue. (i.e. time points or route administration).

Results & Discussion

Figure 1B:
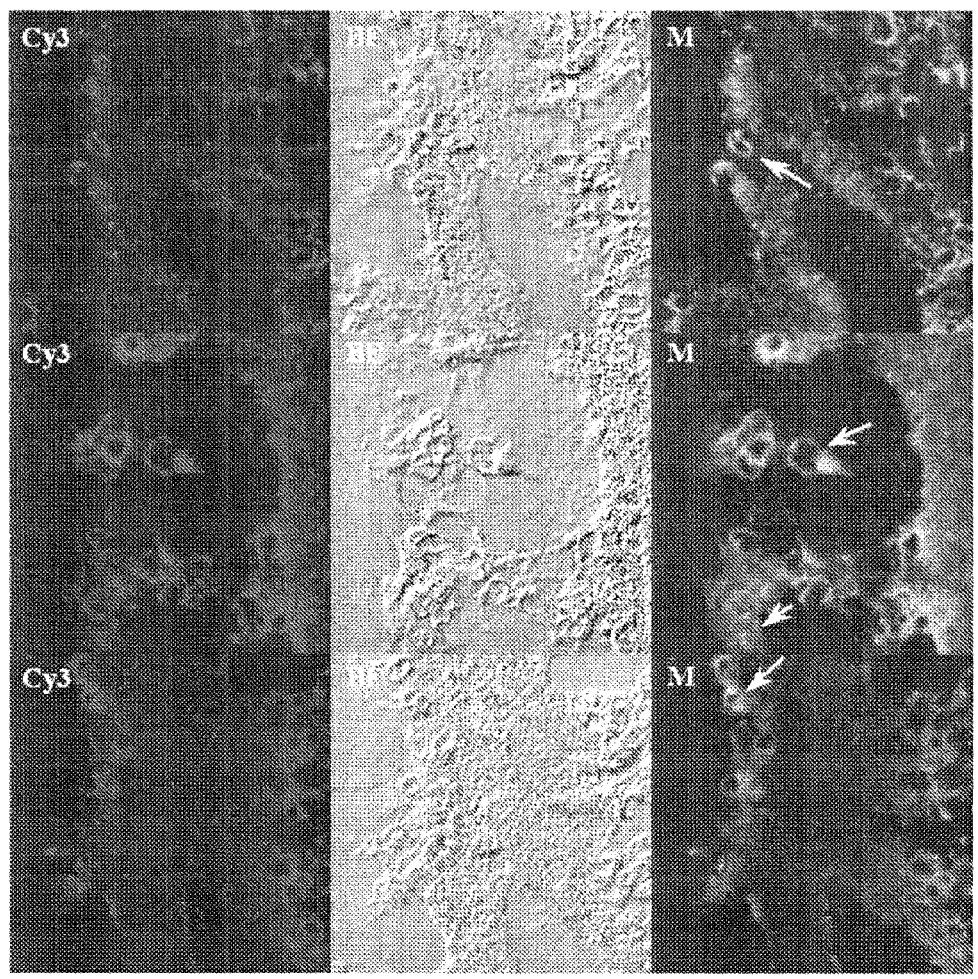
Figure 1C:
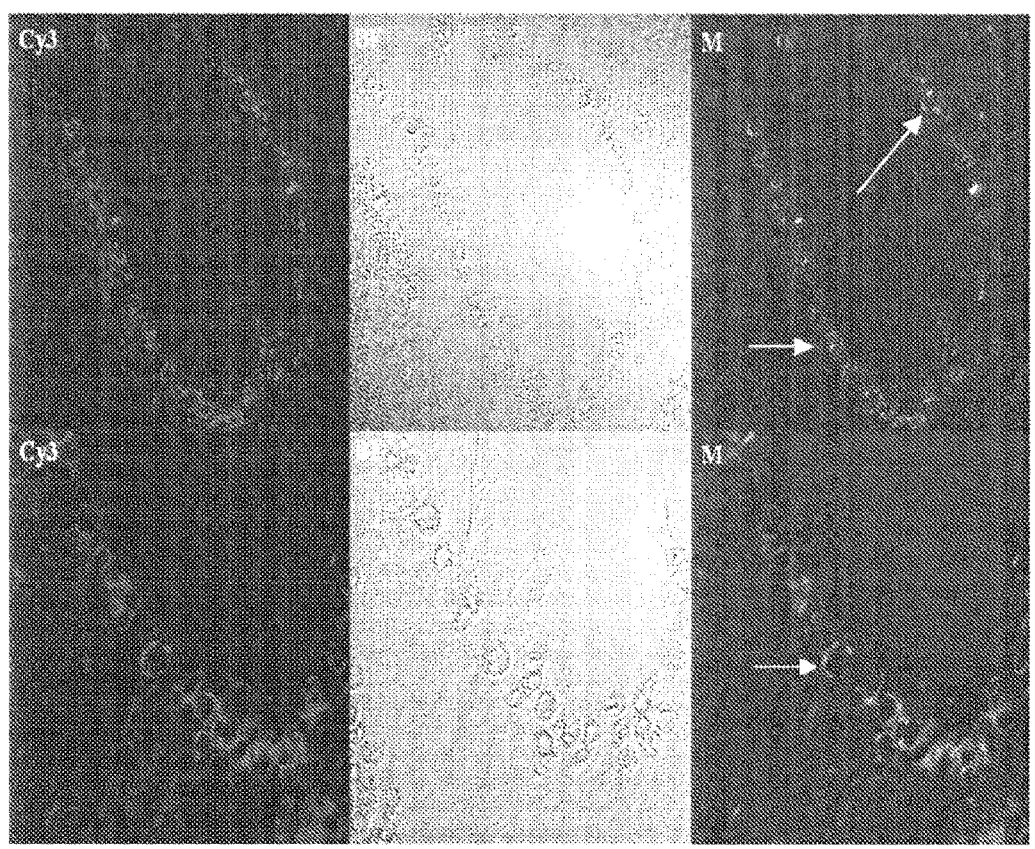

All cryosections were analyzed under light microscopy (bright field, BF) and fluorescence confocal microscopy. The fluorescent signal was visualized in the following tissues:

Retina by E.D. delivery (retinal pigment epithelial cells, retinal ganglion cells) FIGS. 1A-1B: Representative images of Cy3 labeled DDIT4 siRNA incorporated into mice retina.

FIG. 1A: Fluorescent microscopy (upper panel, magnification ×40) of the retina 1 hour after E.D. administration. Right arrow identifies Cy3 stained retinal ganglion cells (RGC), left arrow identifies Cy3 stained retinal pigmentum epithelium cells (RPE). Confocal microscopy (lower panel, magnification ×60) of the retinal ganglion cells layer. The lower set of 9 views show Cy3 labeled tissue (Left), bright filed (BF, center) and a merge of the two (M, right). Arrows point to the labeled RGCs.

Figures in 1B: Confocal microscopy of the retina 4 hours after E.D. administration (upper ×40, lower ×60). Cy3 staining of the RGC is prominent.

Figure 2A:
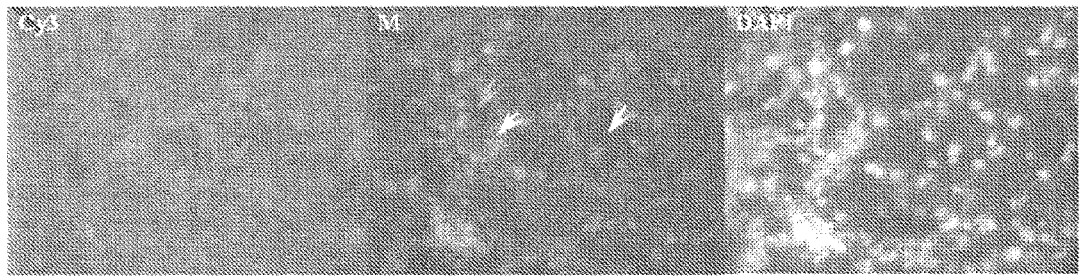
FIGS. 2A-2D: Representative images of Cy3 labeled DDIT4 siRNA incorporated into ductal and acinar cells of the murine lacrimal gland following eye drop administration.

FIG. 2A: Fluorescent microscopy of the lacrimal gland 1 hour after E.D. administration (M=merged DAPI-Cy3 staining). Center arrow points to acinar cells, right arrow indicates ductal epithelial cells, the gray left arrow points to the lacrimal duct (magnification ×60)

Figure 2B:
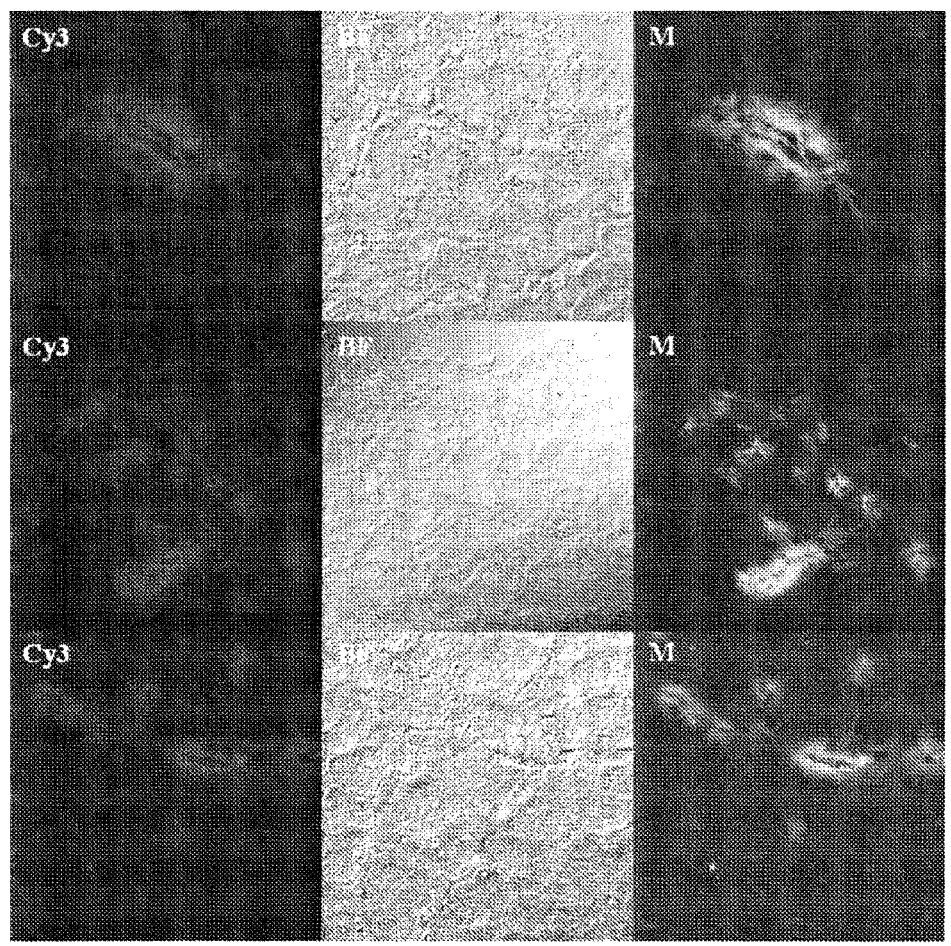

FIG. 2B: Confocal microscopy of the lacrimal gland 1 hour after E.D administration (upper ×40 and lower panel ×60). Arrow in merged image M is pointing to lacrimal duct.

Figure 2C:
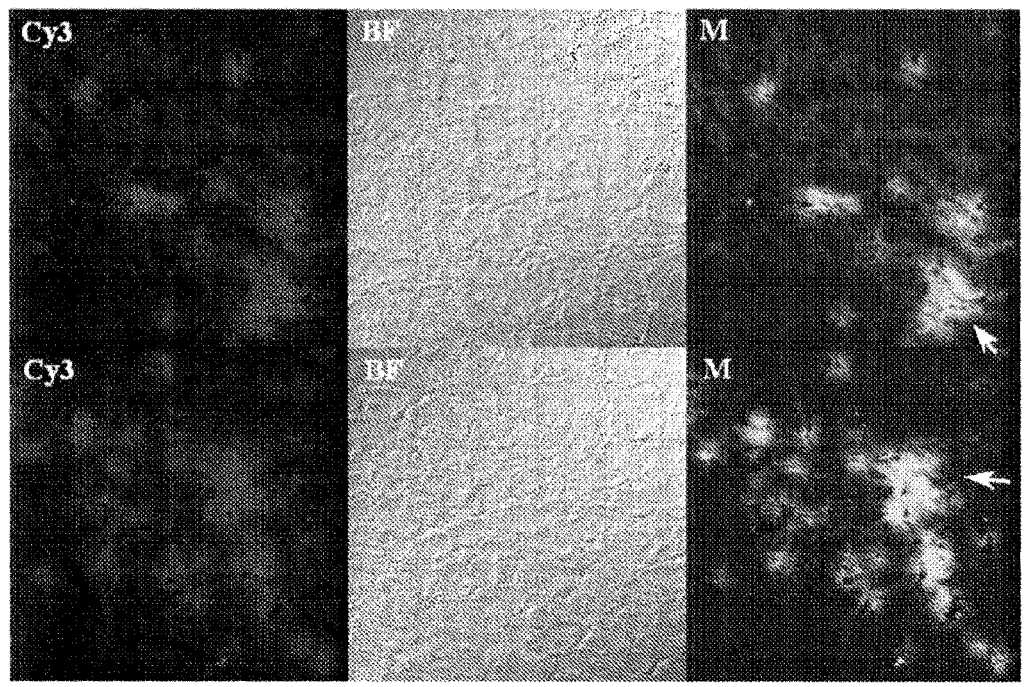
Figure 2D:
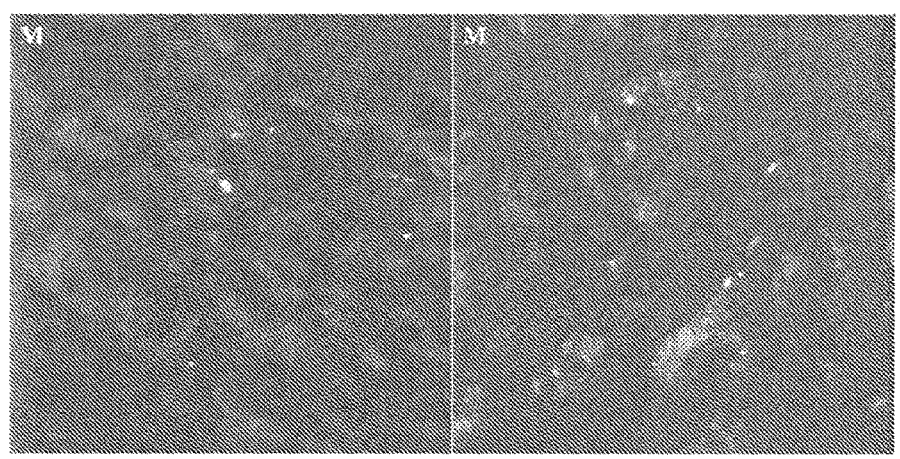

FIG. 2C: Confocal microscopy of the lacrimal gland 1 hour E.D administration (×40). Arrows are pointing to acinar cells FIG. 2D: Confocal microscopy of the lacrimal gland 4 hours after E.D. (×60).

Figures 3A, 3B, 3C:
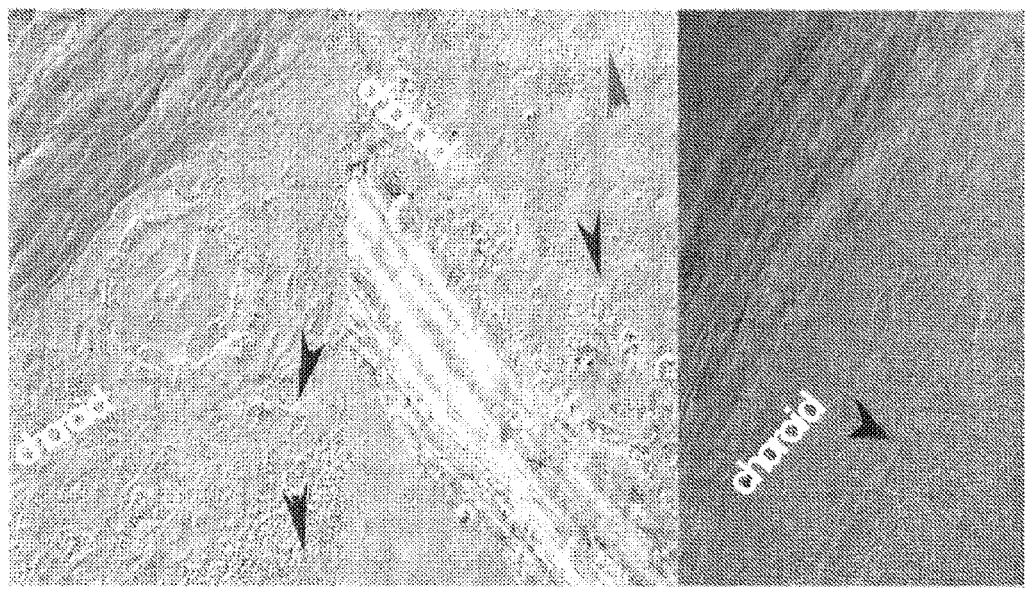
FIGS. 3A-3C: Time course of accumulation of Cy3-siRNA in rat choroid after administration of eye drops, following 1 and 4 hours post administration.
Figure 4:
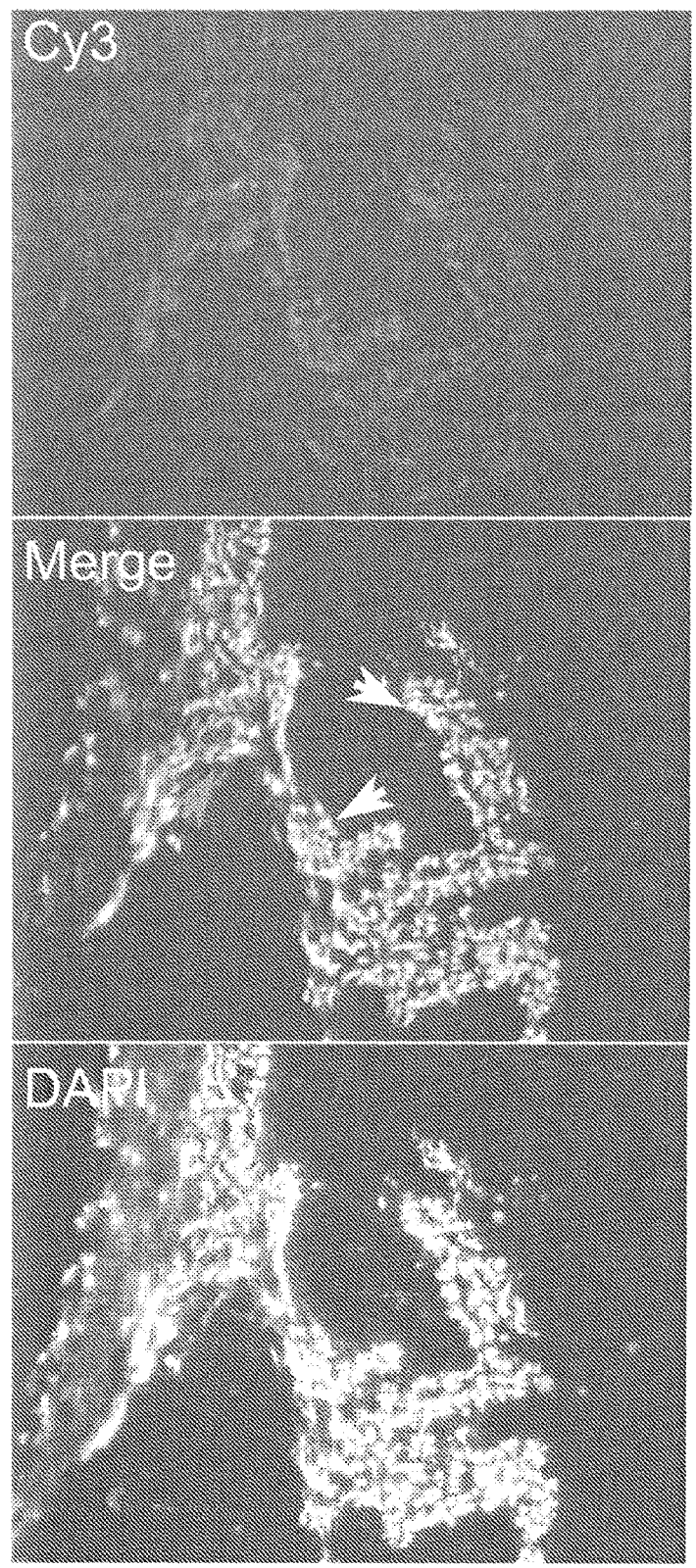
FIG. 4: Cy3-siRNA delivery to the trabecular meshwork and ciliary body one hour after eye drop administration to the eye.

FIGS. 3A-3C show time course of accumulation of Cy3-siRNA in rat choroid after administration by eye drops, following 1 and 4 hours post administration. Choroid, outer nuclear layer, RPE and outer segment layer of photoreceptor cells show Cy3 staining FIG. 4 shows Cy3-siRNA delivery to the trabecular meshwork end ciliary body one hour after administration by eye drops.

Different chemically modified siRNA (structural motives) were tested with mouse Cy3-labeled siRNA. Similar tissue distribution to that shown above was observed for all structures tested: Structure B having alternating natural ribonucleotides and 2'O-Me sugar modified ribonucleotides on both strands; Structure I having alternating natural ribonucleotides and 2'O-Me sugar modified ribonucleotides on the antisense strand and three ribonucleotides linked by 2'5' internucleotide linkages at the 3' end of the sense strand; and a structure having three ribonucleotides linked by 2'5' internucleotide linkages at the 3' end of each of the antisense and sense strands.

Example 3

Examination of Topical Ocular Route Delivery of Formulated siRNA in Rats (siRNA Formulated in PBS or in Methyl Cellulose 2% ("Formulation A"))

In the current study the ocular delivery of DDIT4-Cy3 siRNA formulated either in PBS or in Formulation A and applied by Eye Drops was studied in rats.

TABLE C3

Study Design

| Group | siRNA | Dose μg/eye | Route of Adm. (Bilateral) | Adm. Volume (μl) | Formulation | Termination time | Group Size |
|---|---|---|---|---|---|---|---|
| I | DDIT4_1-Cy3 | 100.00 | E.D. | 3.00 | Formulated | 30 min. | 1 |
| Ia | DDIT4_1-Cy3 | 100.00 | E.D. | 3.00 | PBS | 30 min. | 1 |
| II | DDIT4_1-Cy3 | 100.00 | E.D. | 3.00 | Formulated | 1 hour | 1 |
| IIa | DDIT4_1-Cy3 | 100.00 | E.D. | 3.00 | PBS | 1 hour | 1 |
| III | DDIT4_1-Cy3 | 100.00 | E.D. | 3.00 | Formulated | 3 hours | 1 |
| IIIa | DDIT4_1-Cy3 | 100.00 | E.D. | 3.00 | PBS | 3 hours | 1 |
| IV | DDIT4_1-Cy3 | 100.00 | E.D. | 3.00 | Formulated | 6 hours | 1 |
| Iva | DDIT4_1-Cy3 | 100.00 | E.D. | 3.00 | PBS | 6 hours | 1 |
| V | DDIT4_1-Cy3 | 100.00 | E.D. | 3.00 | Formulated | 24 hours | 1 |
| Va | DDIT4_1-Cy3 | 100.00 | E.D. | 3.00 | PBS | 24 hours | 1 |
| VI | N/A | N/A | E.D. | 3.00 | vehicle | 1 hours | 1 |
| VII | N/A Intact control | N/A | N/A | N/A | N/A | N/A | 1 |

Eye Drop Delivery of siRNA to the Lacrimal Glands (Acinar Cells, Ductal Cells)

FIGS. 2A-2D: Representative images of Cy3 labeled DDIT4 siRNA incorporated into ductal and acinar cells of the murine lacrimal gland.

Experimental Design:

1) Group I, II, III, IV, V: dose regime: siRNA formulated in Formulation A; 100 μg/rat/3 μl/eye, administration route: Bilateral Eye drops (E.D.);

2) Group Ia, IIa, IIIa, IVa, Va: dose regime: siRNA formulated in PBS; 100 μg/rat/3 μl/eye, administration route: Bilateral Eye drops (E.D.);
3) Group VI: control group treated with the formulation vehicle of Formulation A (no siRNA); 100 μg/rat/3 μl/eye, administration route: Bilateral Eye drops (E.D.);
4) Group VII: intact control The siRNA doses were prepared under sterile conditions. siRNA aliquots were thawed for at least 30 minutes at room temperature prior to administration. Total amount per aliquot (per each mouse) included an additional 20% of the calculated volume. The designated siRNA dose was delivered in 3 μl volume per eye.

Anesthesia: Rats from groups I-VII were anesthetized with Equithesine (4 ml/kg)

Termination step: At study termination, animals were deeply anesthetized by Equithesine (4 ml/kg). Thereafter, rats were intracortically perfused with fresh 10% neutral buffered formalin using peristaltic pump standard regime.

Tissue Collection: Left and right eyes including optic nerve from all animals were enucleated, perforated and post fixed in 10% neutral buffered formalin for an additional 1 hour in room temperature with slow rotation, cryoprotected stepwise by sucrose gradient at 4° C. overnight, following cryoprotection in optimal cutting temperature (OCT) compound at 4° C. overnight with rotation, embedded in OCT compound and sectioned with a cryostat into 12 μm slices that were placed on microscope slides (Superfrost/Plus). Sections were counter stained with DAPI (1 μg/ml) and mounted.

Delivery of siRNA was evaluated using light microscopy and digital imaging. A tissue fragment was considered positive (i.e., a successful Cy3 DDIT4_1 siRNA transfer in anterior eye chamber, retina and optic nerve delivery was considered positive) if histological examination would show that all animals within one experimental group showed the same fluorescent signal within the specific tissue/cell type.

Results: All cryosections were analyzed under light microscopy (bright field, BF) and fluorescence confocal microscopy. The fluorescent signal was visualized in retinal pigment epithelial cells and retinal ganglion cells. Notably, compounds formulated in PBS reached maximum distribution in ocular tissues 3 hours after administration, and were cleared from said tissues at the 6 hour time point. However, compounds formulated in Formulation A were maximally distributed in ocular tissues at 24 hours after administration.

Example 4

Ocular Distribution of siRNA (Formulated in PBS) in the Cynomolgus Monkey

TABLE C4

Experimental Design

| Group | Animal number | Compound | Dose Volume | Termination after administration | Processing at termination Eyes |
|---|---|---|---|---|---|
| 1 | 101 | Cy3-DDIT4_1 | 500 ug/20 ul/eye | 1 hour | 4% PFA |
| 2 | 251 | DDIT4_1 | 500 ug/20 ul/eye | 1 hour | Snap frozen in liquid nitrogen |
| 3 | 351 | Cy3-DDIT4_1 | 500 ug/20 ul/eye | 5 hours | 4% PFA |
| 4 | 401 | DDIT4_1 | 500 ug/20 ul/eye | 5 hours | Snap frozen in liquid nitrogen |

ED = Eye Drops, topically

The aim of this study was to investigate the tissue distribution of siRNA formulated in PBS following single topical ocular administration to the surface of the eye of the Cynomolgus *Macaca fascicularis* monkey. All tissues were snap frozen in triplicate ~1 to ~2 g samples or as a whole, as appropriate.

RNA Purification

Frozen samples were grinded to a fine powder under liquid nitrogen. A small amount of the powdered tissue was used for RNA extraction. The rest of the tissues were stored at −80° C. for further usage. PolyA RNA was extracted from each sample with MicroPoly(A)Purist mRNA purification Kit (#1919) and processed according to manufacturer's protocol for poly(A)RNA isolation from tissues or cells. The final yields and spectral characteristics of the RNA are summarized below in Table C5.

TABLE C5 polyA RNA from monkey

| Tissue | 260/280 | 260/230 | Concentration μg/μl | Yield μg |
|---|---|---|---|---|
| Lymph Node | 1.58 | 0.92 | 0.104 | 1.55 |
| Spleen | 1.74 | 1.27 | 0.175 | 2.62 |

One μg from the spleen and 0.7 μg from the lymph node polyA RNA preparations were used for cDNA synthesis using random primer. Casp2 gene was successfully amplified from both cDNA preparations.

Results are summarized below in Table C6.

TABLE C6

Results

| Treatment | Tissue analysed | Termination | Av | SD | Group size |
|---|---|---|---|---|---|
| ED(REDD14) | Neuronal Retina | 1 h | 0.2 | [+/−0] | 1 (2 eyes) |
| ED(REDD14) | Neuronal Retina | 5 h | 0.05 | [+/−0.03] | 1 (2 eyes) |
| ED(REDD14) | RPE | 1 h | 0.62 | [+/−0.05] | 1 (2 eyes) |
| ED(REDD14) | RPE | 5 h | 0.1 | [+/−0.07] | 1 (2 eyes) |
| ED(REDD14) | optic nerve | 1 h | 8.9 | [+/−2.6] | 1 (2 eyes) |
| ED(REDD14): | optic nerve | 5 h | 3 | [+/−1.9] | 1 (2 eyes) |

Conclusion: SiRNA formulated in PBS following single topical ocular administration to the surface of the eye of the Cynomolgus *Macaca fascicularis* monkey reaches the neuronal retina and can be measured by the qPCR S&L method.

Example 5

Delivery of siRNA (Formulated in TRIS) to Target Retinal Tissue in Mice

Examination of topical delivery of siRNA molecules labeled with different fluorophores.

Topical delivery to Mice of 20 ug of different fluorescently-labeled siRNAs formulated in tris(hydroxymethyl) aminomethane (TRIS) 1M, pH 8, 1 hr post-administration.

LdC, LdT refer to L-DNA nucleotides, mA, mC, Mg, Mu refer to 2'O-methoxy ribonucleotides.

Formulated (formulated compound): siRNA in 1M Tris pH 8.0 Of the following siRNA's: QM5-Cy3#1, QM5-Cy3#10, DDIT4_1-Cy3, DDIT4_1Cy3.5, Redd14(DDIT4_1) Dy-649/C6, FITC-CNL_1RD/CNL_1FD, scarmbled3'Cy3CNL_1, Cy3-AS-CASP2_4-Struc-L-DNA-s(2 residues at 3' of sense)-plus-alt AS, Cy3AS-CASP2_4-Struc2-5-s(2 residues at 3' of sense)-plus-alt AS, TGASEII-FAM, HNOEL-FAM.

TABLE C7

Formulations

| siRNA | IDO | Final | siRNA Stock | Preparation |
|---|---|---|---|---|
| QM5-Cy3#1 | 116937 | 40 μg | 20 mg/ml | 2 μl stock were lyophilized and resuspended in 7 μl 1M Tris pH8 |
| QM5-Cy3#10 | 116938 | 40 μg | 20 mg/ml | 2 μl stock were lyophilized and resuspended in 7 μl 1M Tris pH8 |
| DDIT4_1-Cy3 | 117821 | 40 μg | 20 mg/ml | 2 μl stock were lyophilized and resuspended in 7 μl 1M Tris pH8 |
| DDIT4_1-Cy3.5 | 112206 | 40 μg | 20 mg/ml | 2 μl stock were lyophilized and resuspended in 7 μl 1M Tris pH8 |
| Redd14(DDIT4_1) Dy-649/C6 | 114029 | 40 μg | 20 mg/ml | 2 μl stock were lyophilized and resuspended in 7 μl 1M Tris pH8 |
| FITC-CNL_1RD/CNL_1FD | 110357 | 40 μg | 20 mg/ml | 2 μl stock were lyophilized and resuspended in 7 μl 1M Tris pH8 |
| scarmbled3'Cy3-CNL_1 | 110910 | 40 μg | 20 mg/ml | 2 μl stock were lyophilized and resuspended in 7 μl 1M Tris pH8 |
| Cy3-AS-CASP2_4-Struc-L-DNA-s(2 residues at 3' of sense)-plus-alt AS | 122994 | 40 μg | 20 mg/ml | 2 μl stock were lyophilized and resuspended in 7 μl 1M Tris pH8 |
| Cy3-AS-CASP2_4-Struc2-5-s (2 residues at 3' of sense)-plus-alt AS | 122979 | 40 μg | 20 mg/ml | 2 μl stock were lyophilized and resuspended in 7 μl 1M Tris pH8 |
| TGASEII-FAM | 75755 | 11.62 μg | 0.75 μg/μl | 15.5 μl stock were lyophilized and resuspended in 2 μl 1M Tris pH8 |
| HNOEL-FAM | 75757 | 4.48 μg | 1.4 μg/μl | 3.2 μl stock were lyophilized and resuspended in 0.784 μl 1M Tris pH8 |
| DDIT4_1-Cy3 | 117821 | 40 μg | 20 mg/ml | 2 μl stock + 0.7 μl PBSx10 + 4.3 μl DDW | siRNAs tested:

Cy3-QM5; Cy3-DDIT4; Cy3.5-DDIT4; DDIT4_1 Dy-649/C6; FITC-CNL_1; 3'Cy3-CNL_1; Cy3-Casp2_4 L-DNA; Cy3-AS-Casp2_4; TGASEII-FAM; HNOEL-FAM. (QM5 is a rat/mouse siRNA that targets p53; CNL is control scrambled siRNA)

Exemplary chemically modified Casp2 siRNA compounds were as follows:

```
1. Sense: GCCAGAAUGUGGAACUC2pC2pU, 17 and 18 are
   2'-5'-bridge
   Antisense: mAGmGAmGUmUCmCAmCAmUUmCUmGGmC-cy3
2. Sense: GCCAGAAUGUGGAACUC; LdC; LdT 18 and 19
   are L-DNA
   Antisense: mAGmGAmGUmUCmCAmCAmUUmCUmGGmC-cy3
3. Sense: GCCAGAAUGUGGAACUC; LdC; U18 is an
   L-DNA moiety
   Antisense: mAGmGAmGUmUCmCAmCAmUUmCUmGGmC-cy3
```

Description of the test material: Under sterile conditions, corresponding amount of siRNA stock were lyophilized and re-suspended in corresponding amount of 1M Tris pH8 (see Table C7).

Quantity supplied: One vile for each tested siRNA (Synthesized by Biospring, AG)

Storage Conditions: frozen until use. Prior to use, samples were thawed and kept at room temperature for 30 minutes.

Control Article(s)

Positive Control—DDIT4_1-Cy3 in PBS, Batch #: 117821

Description of the test material: Under sterile conditions, 42.426 mg of DDIT4_1-Cy3 powder (BioSpring) were dissolved in 2.1 ml of sterile double distilled water, to achieve a clear 20 mg/ml (1.5 mM) solution. The solution was stored at −80° C. until use.

Vehicle—1M Tris pH 8.0—Outsourcing from Sigma (catalog #T-1503). 121.1 g of TRIS base (Sigma #T1503) were dissolved in 700 ml of ddH$_2$O. Desire pH 8 was achieved with concentrated HCl. DDW was added to have final 1 L solution.

Vehicle—PBSX10—Outsourcing from Biological Industries (catalog #02-023-5A; (For 10×PBS) Batch #:619113)

Test System
Animals:
Species: Mice; Strain: RTP-801WT; CMF-608WT
Source: Harlan Laboratories, Jerusalem, Israel.
Age: 8-12 weeks; Body Weight Range: 17-28 gr
Sex: males; Group Size: 1; Total number of animals: 14
Animal Husbandry: Diet: Animals were provided an ad libitum commercial rodent diet and free access to drinking water. Environment: (i) Acclimatization of at least 5 days. (ii) All the animals were confined in a limited access facility with environmentally-controlled housing conditions throughout the entire study period, and maintained in accordance with approved standard operating procedures (SOPs).
Experimental Design
General: The study included 14 experimental groups as described in Table C8:

Experimental groups 1-12 siRNA delivered by eye drops, group 13 the vehicle [TRIS 1M pH8 treated control delivered by eye drops and group 14 (non-treated control). Mice were treated with a single siRNA as follows:

Groups 1-9 and 12: dose regime: 20 µg/eye/3 µl/SiRNA, group 10: dose regime 5.81 µg/eye/3 µl/siRNA, group 11: dose regime 2.24 µg/eye/3 µl/siRNA administration route: Eye Drop (E.D.);
Group 13: vehicle (TRIS 1M pH8) 3 µl/eye control
Group 14: none treated control Scheduled euthanasia: Mice from all groups were terminated according to the study design (Table C8, Time points termination).

Termination step was accomplished by cervical dislocation.

Tissue Collection: Left and right eyes including optic nerve, from all animals were enucleated, the retina was transversal dissected with the blade, the lens/vitreous were gently removed. The remaining eye cup was fixed with 4% PFA (in PBS pH 7.4) for 30 minutes, then infiltrated with 30% sucrose for 3 hours at 4° C. Washed 3×5 minutes with ice cold PBS pH7.4. It was then embedded in optimal cutting temperature (OCT) compound and sectioned longitudinal with a cryostat into 4 µm slices that were placed on microscope slides (Superfrost/Plus). Sections were counter stained with DAPI (1 µg/ml) and mounted.

A whole blood drop from all animals, was smeared on the slide with the cover slip, and covered. It was then glued with nail polish Evaluation Delivery of siRNA was evaluated using light microscopy and digital imaging. A tissue fragment was considered positive (i.e., a successful siRNA transfer\intracellular incorporation occurred) only if histological (microscopic) examination showed clear fluorescence signal within specific cells or structures of the anterior or posterior chamber, and retina.

TABLE C8

Study Design

| Group | SiRNA type/bilateral | Dose µg/eye | Volume (µl) | Route | Time point (hrs) | Group Size |
|---|---|---|---|---|---|---|
| 1 | QM5-Cy3#1 | 20 | 3.00 | E.D. | 1 | 1 |
| 2 | QM5-Cy3#10 | 20 | 3.00 | E.D. | 1 | 1 |
| 3 | DDIT4_1-Cy3 | 20 | 3.00 | E.D. | 1 | 1 |
| 4 | DDIT4_1-Cy3.5 | 20 | 3.00 | E.D. | 1 | 1 |
| 5 | DDIT4_1 Dy-649/C6 | 20 | 3.00 | E.D. | 1 | 1 |
| 6 | FITC-CNL_1RD/CNL_1FD | 20 | 3.00 | E.D. | 1 | 1 |
| 7 | scarmbled3'cy3-CNL_1 | 20 | 3.00 | E.D. | 1 | 1 |
| 8 | Cy3-AS-CASP2_4-Struc-L-DNA-s(2 residues at 3' of sense)-plus-alt AS | 20 | 3.00 | E.D. | 1 | 1 |
| 9 | CY3-AS-CASP2_4-Struc2-5-s(2 residues at 3' of sense)-plus-alt AS | 20 | 3.00 | E.D. | 1 | 1 |
| 10 | TGASEII-FAM | 5.81 | 3.00 | E.D. | 1 | 1 |
| 11 | HNOEL-FAM | 2.24 | 3.00 | E.D. | 1 | 1 |
| 12 | DDIT4_1-Cy3 in PBS vehicle (positive control) | 20 | 3.00 | E.D. | 1 | 1 |
| 13 | Vehicle (TRIS 1M pH8) (negative control) | N/A | 3.00 | E.D. | 1 | 1 |
| 14 | Non treated (negative control) | N/A | 3.00 | E.D. | 1 | 1 |

The siRNA doses for delivery were prepared under sterile conditions and stored at −20° C. siRNA aliquots were thawed for at least 30 minutes at room temperature prior to administration. Total amount per aliquot (per each eye) included an additional 20% of the calculated volume. The designated siRNA dose was delivered in 3.5 .µl (Experimental groups 1 to 9 and 12) volume per eye. The designated siRNA dose was delivered in 3.2. µl (Experimental groups 10 and 11) volume per eye.

Anesthesia: Mice were anesthetized with Ketamine/Xylazine mixture as follows (0.85 ml Ketamine+0.15 ml Xylazine+0.9 ml Saline, 0.1 ml mix solution/20 gr BW).

Eye drop delivery: A 3 µl volume sample was slowly dropped in each eye (corneal surface) by blunt pipette tip; the animals were placed in a warm environment to prevent anesthesia-induced hypothermia, and were returned to its cage after it regaining consciousness.

Background DAPI staining was assisted in identification of tissue structure. Delivery was considered positive if histological examination was consistent within the group (bilateral identical cell type or structural staining), i.e. the histological examination would show the same fluorescent signal in all cell types/tissues (anterior eye chamber, retina and optic nerve) of the same experimental group.

Results

Figure 5A:
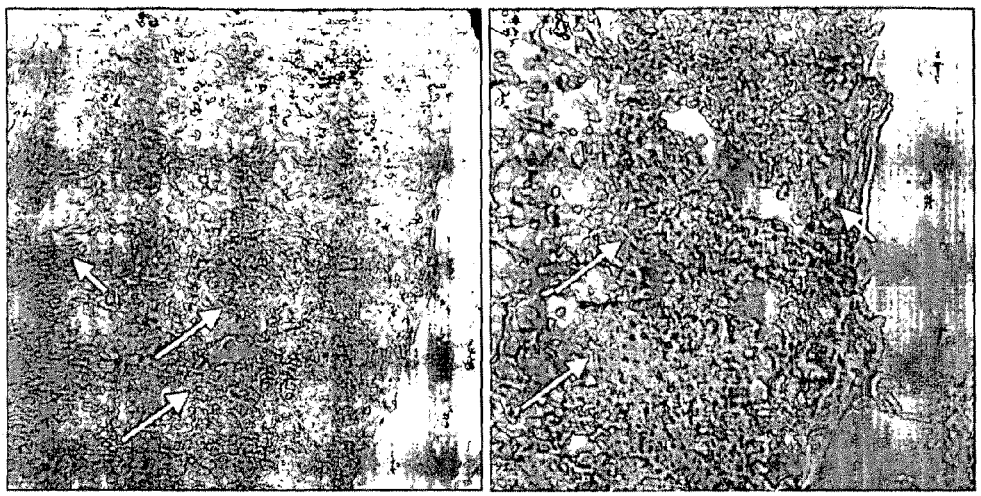
FIGS. 5A-5B: Confocal microscopy (magnification ×60) of the retina 1 hour after eye drop administration of QM5—siRNA targeted at the p53 gene. SiRNA in retina (retinal pigment epithelial cells, retinal ganglion cells) is shown by Cy3 fluorescence.
Figure 5B:
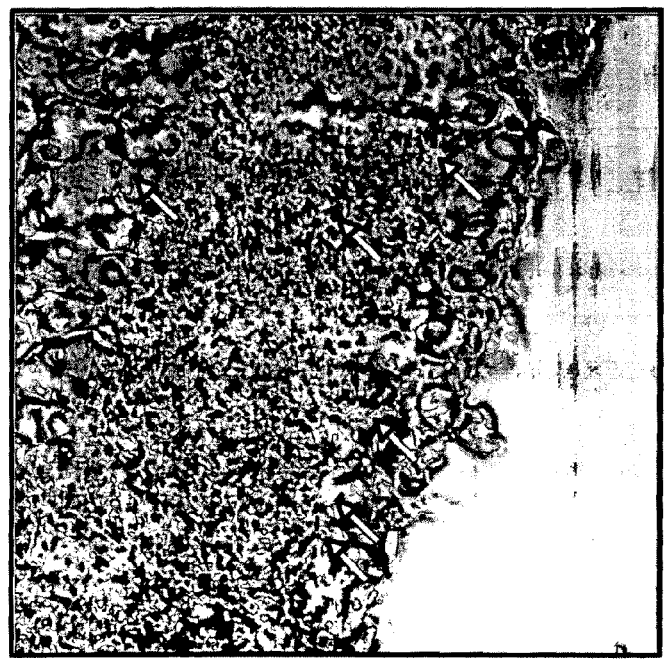

FIGS. 5A-5B: Confocal microscopy (magnification ×60) of the retina 1 hour after eye drop administration of QM5—siRNA targeted at the p53 gene. SiRNA in retina (retinal pigment epithelial cells, retinal ganglion cells) is shown by Cy3 fluorescence.

Figure 6A:
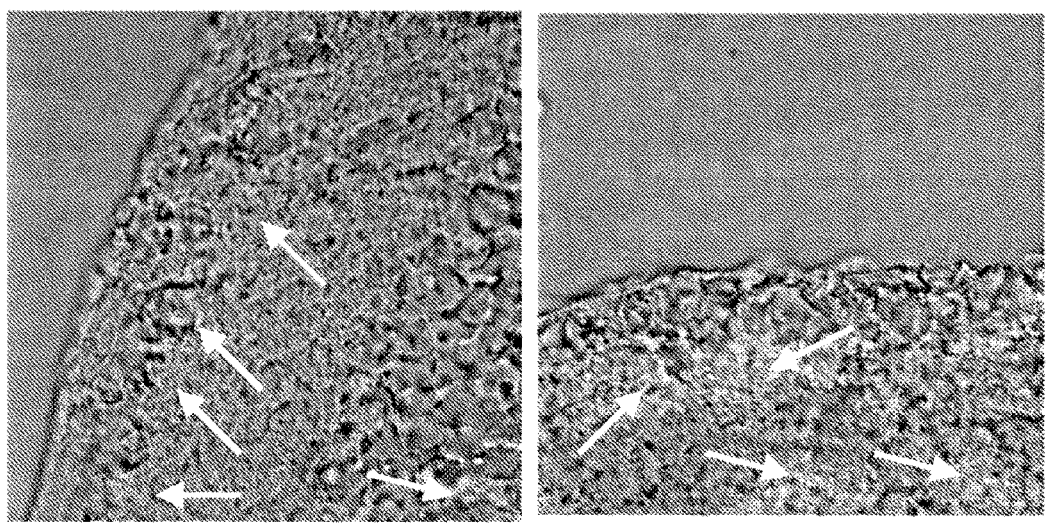
FIGS. 6A-6B are representative images of Cy3 labeled DDIT4 siRNA incorporated into mice retina.
Figure 6B:
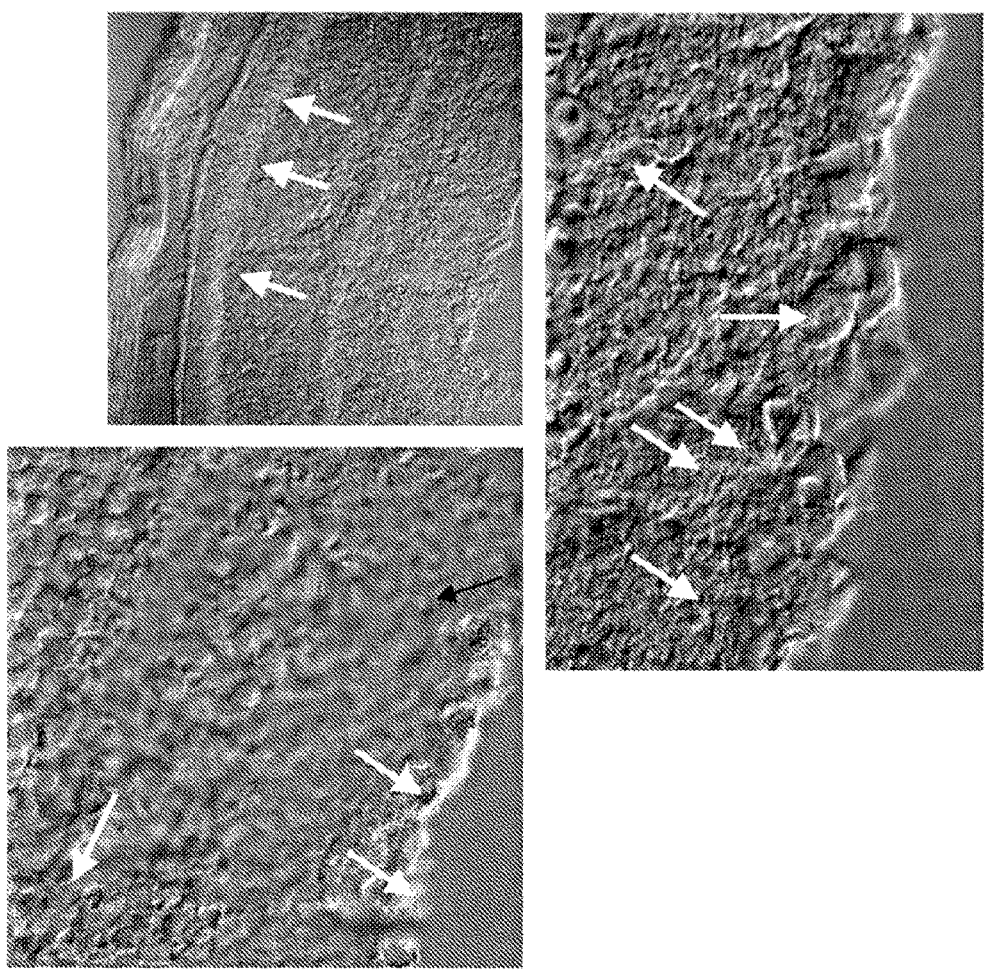

FIGS. 6A-6B are representative images of Cy3 labeled DDIT4 siRNA incorporated into mice retina.

Figure 7:
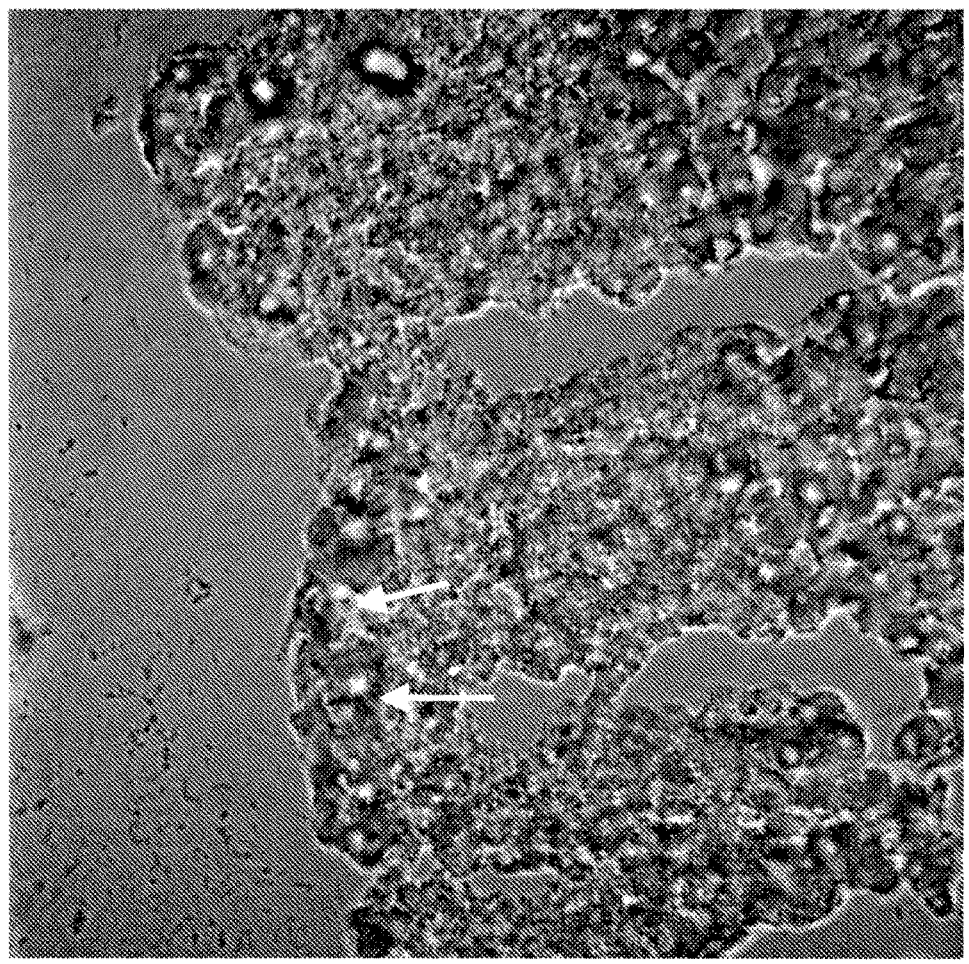
FIG. 7 shows accumulation of DDIT4_1 Dy-649/C6-siRNA 1 hour post administration by eye drops in RGC cells by use of Dy-649/C6 staining.
Figure 8A:
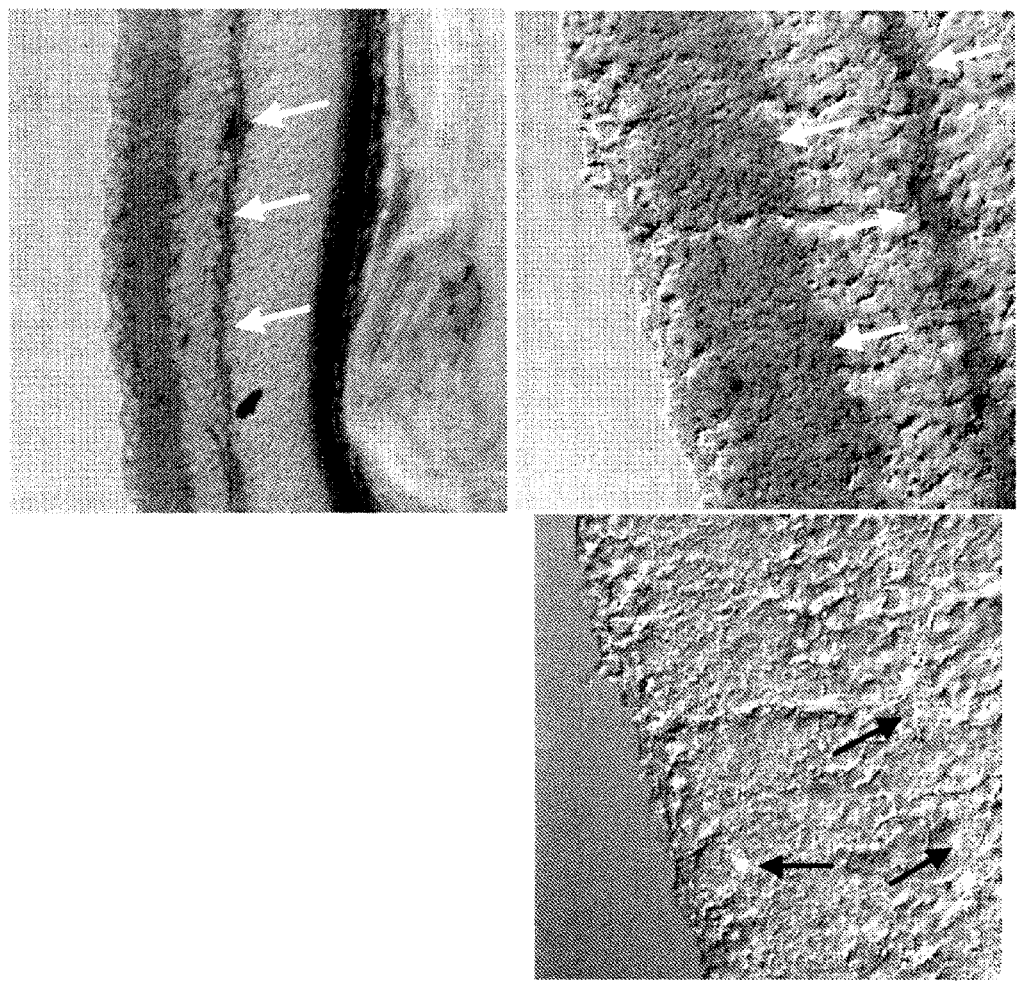
FIG. 8A-8C represent control siRNA FITC-CNL_1RD/CNL_1FD and scarmbled3'cy3-CNL_1 delivery to retinal tissues by different staining methods.
Figure 8B:
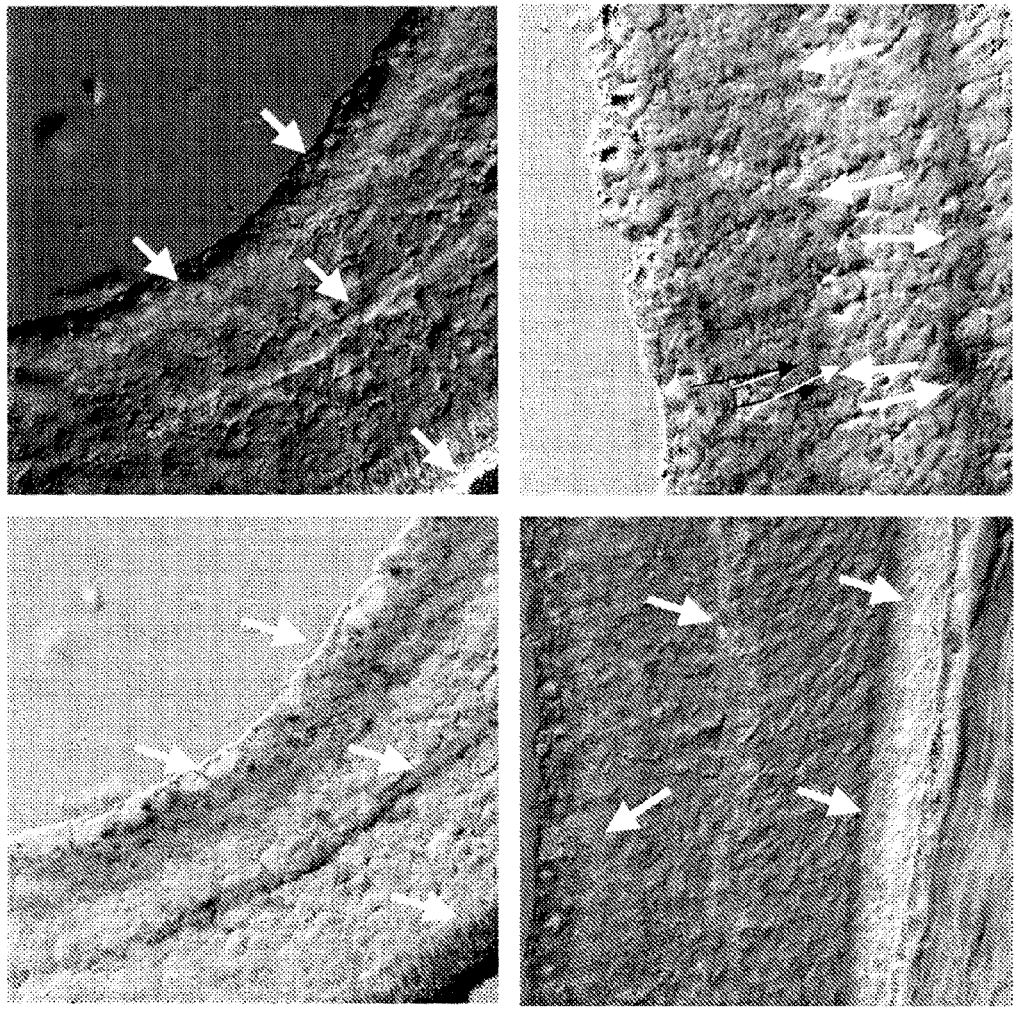
Figure 8C:
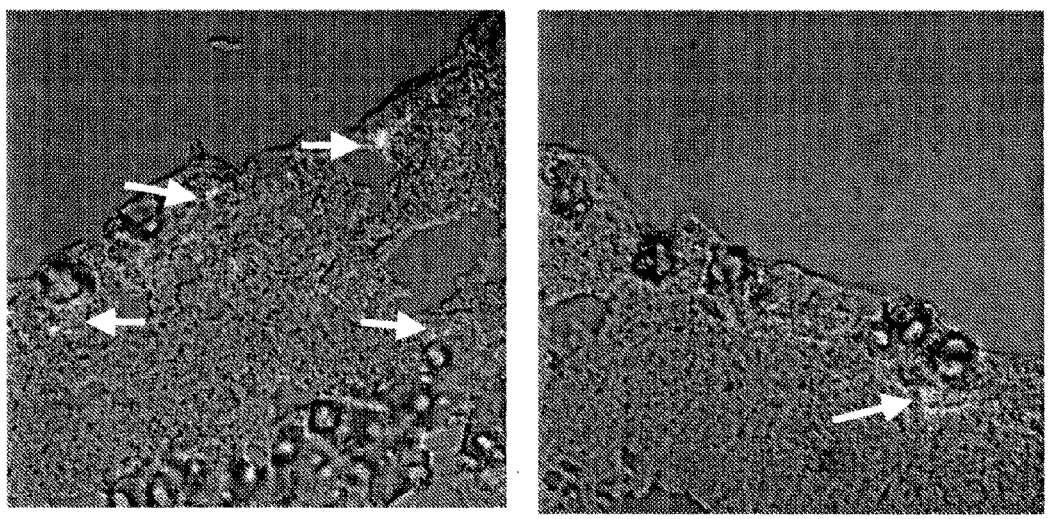
Figure 9A:
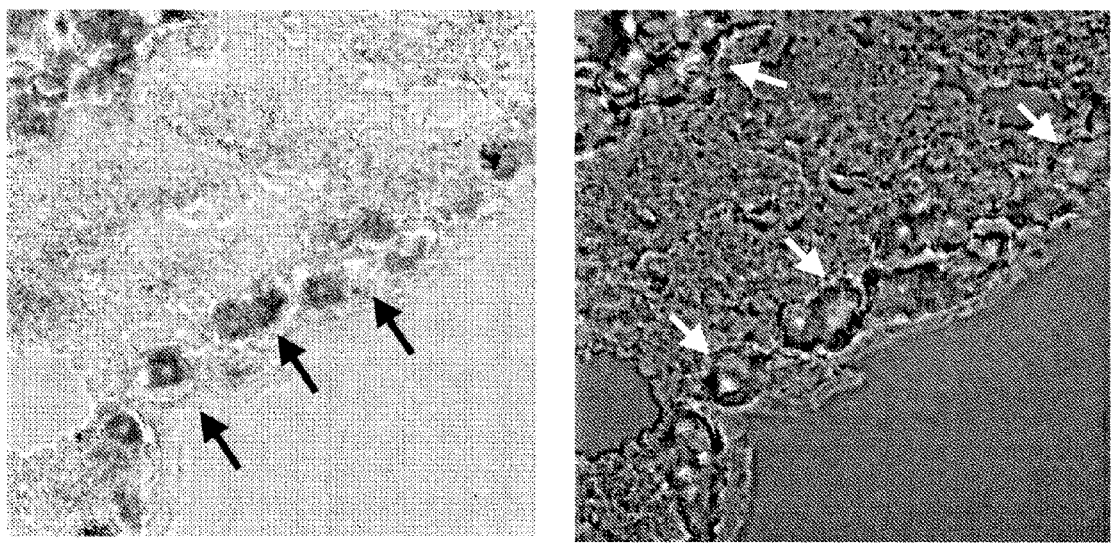
FIGS. 9A-9B show delivery of different structures of Casp2 to the mouse retinal tissues.
Figure 9B:
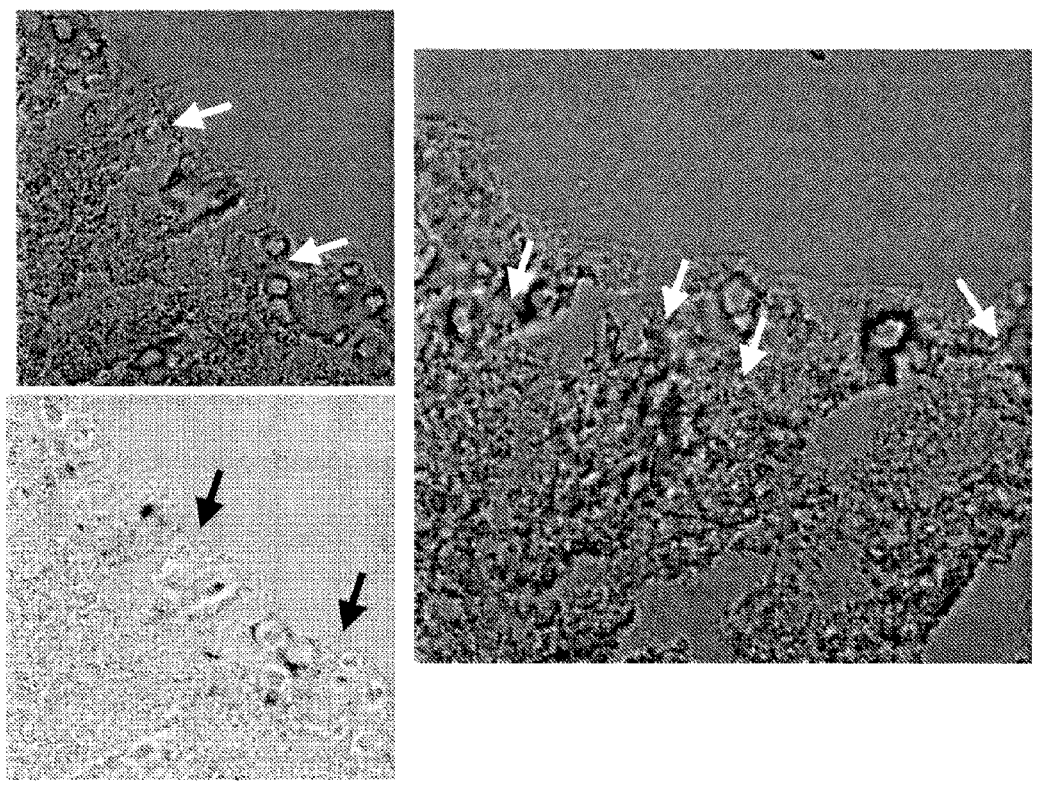

FIG. 6B shows accumulation of DDIT4_1 Cy3-siRNA 1 hour post administration by eye drops. Choroid, outer nuclear layer, RPE and outer segment layer of photoreceptor cells show Cy3 staining FIG. 7 shows accumulation of DDIT4_1 Dy-649/C6-siRNA 1 hour post administration by eye drops in RGC cells by use of Dy-649/C6 staining FIG. 8A-8C represent control siRNA FITC-CNL_1RD/CNL_1FD and scarmbled3'cy3-CNL_1 delivery to retinal tissues by different staining methods. FIGS. 9A and 9B show delivery of different structures of Casp2 to the mouse retinal tissues.

Figure 10A:
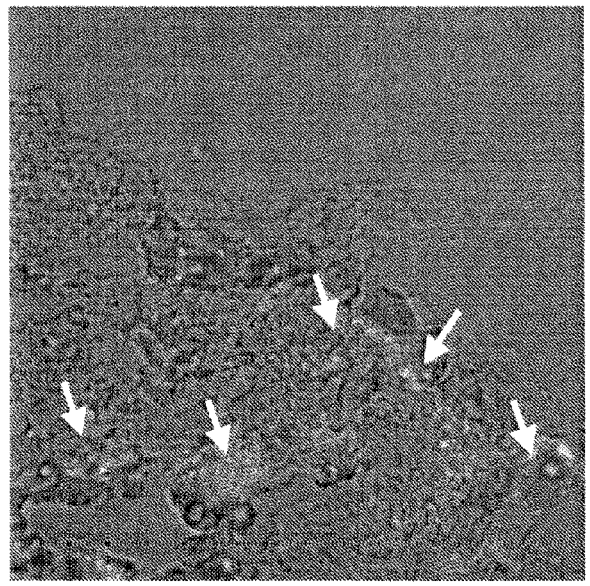
FIGS. 10A-10B show TGASEII-FAM and HNOEL-FAM delivery.
Figure 10B:
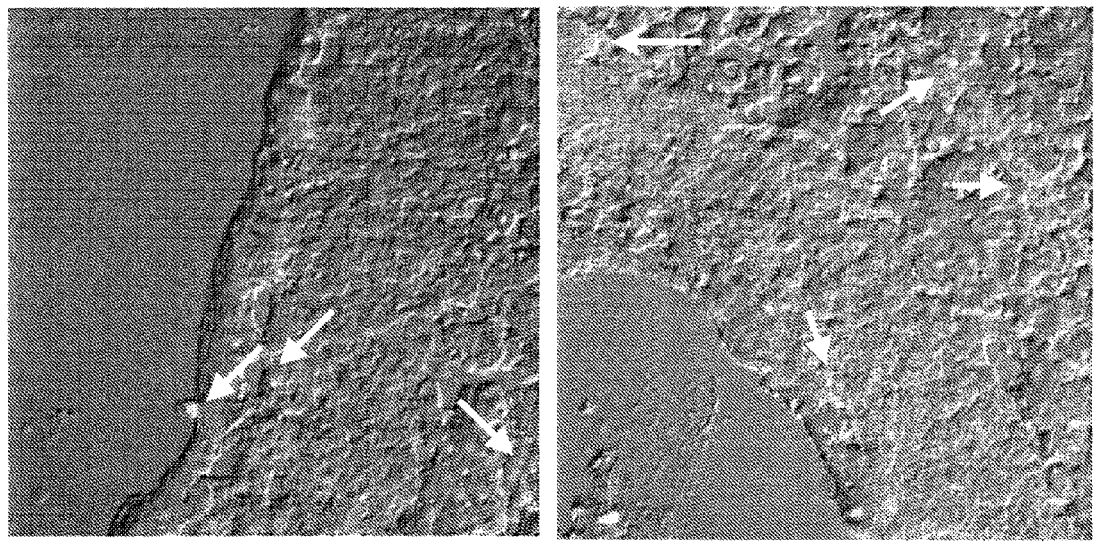

FIGS. 10A and 10B show TGASEII-FAM and HNOEL-FAM delivery.

Figure 11:
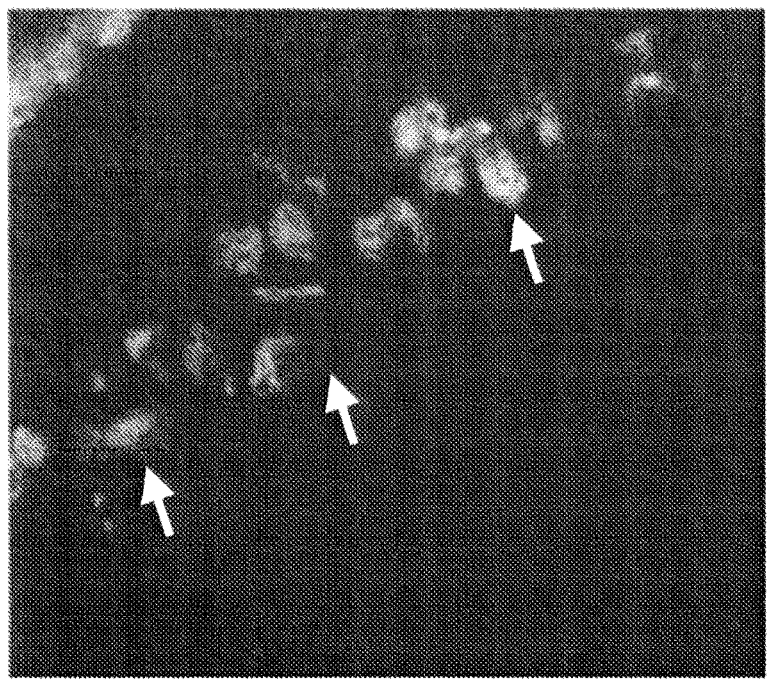
FIG. 11 shows retinal delivery of siRNA against p53 in PBS as positive control group.
Figure 11:
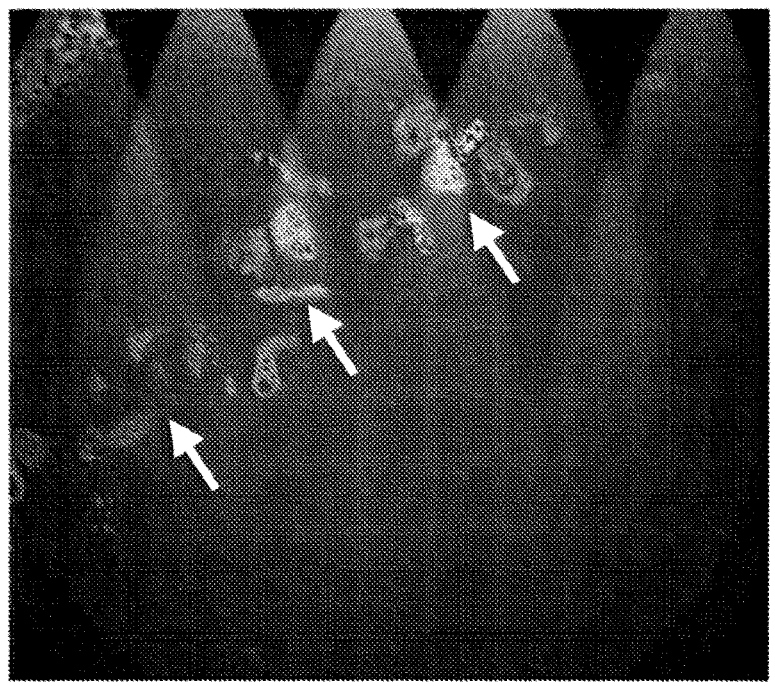
Figure 12A:
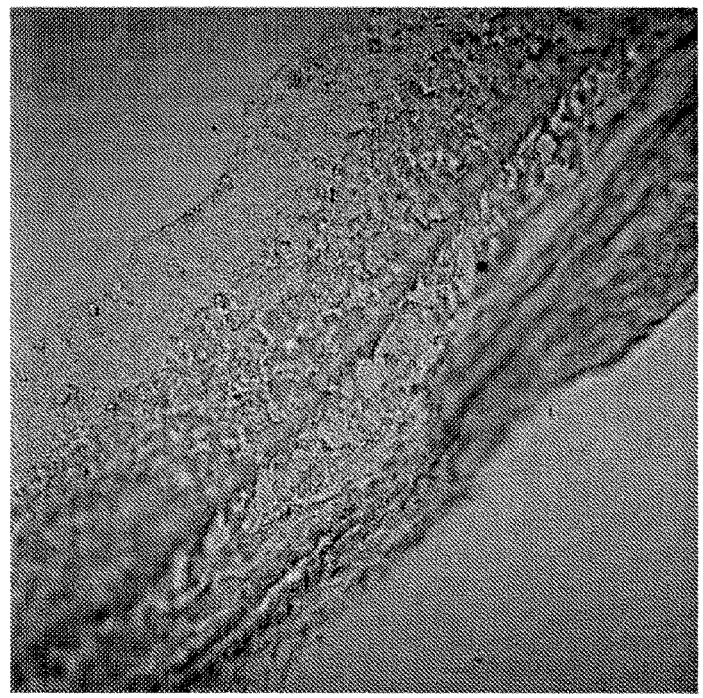
FIGS. 12A-12B show that in intact animals or when administering ED without siRNA no fluorescent signal is obtained in the retina.
Figure 12B:
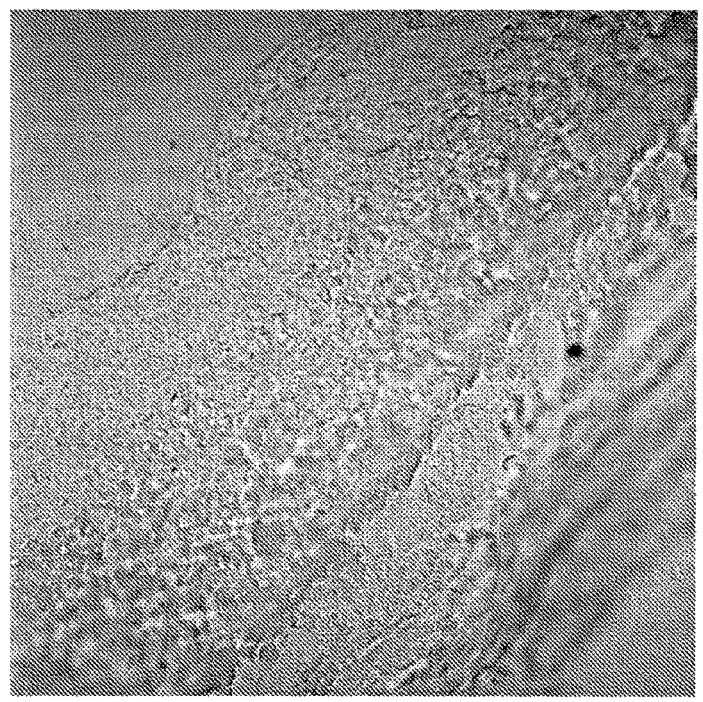
Figure 13A:
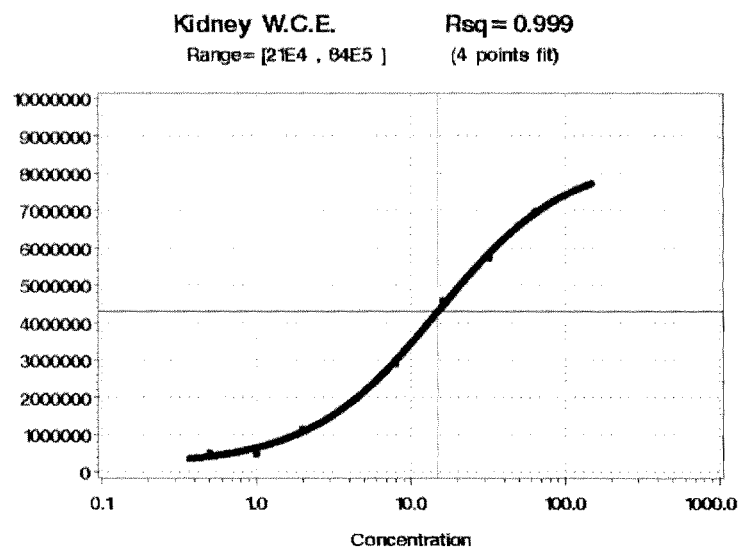
FIGS. 13A-13D provide the results of an experiment showing knockdown of p53 in the retina.
Figure 13B:
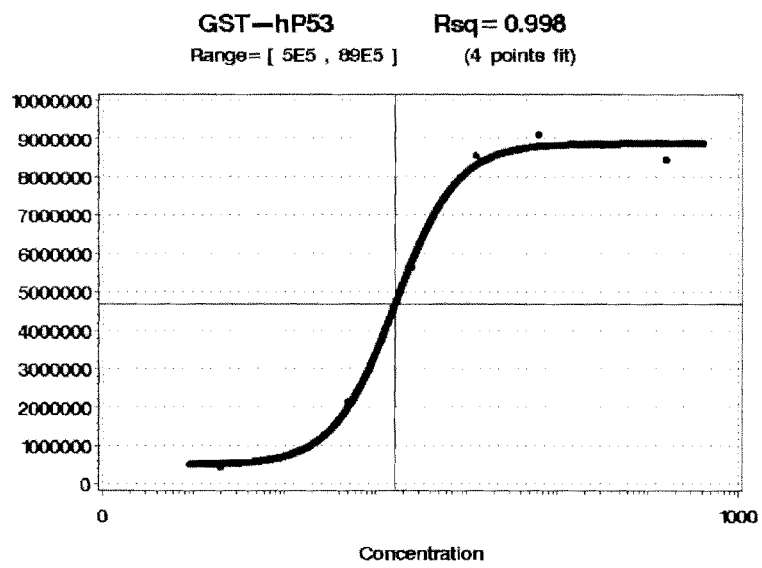
Figure 13C:
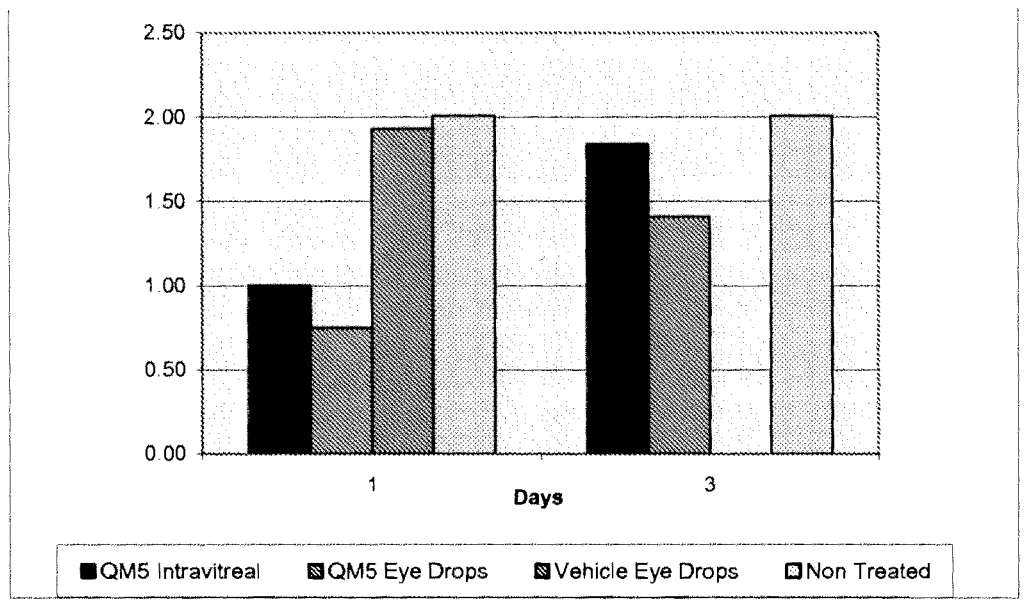
Figure 13D:
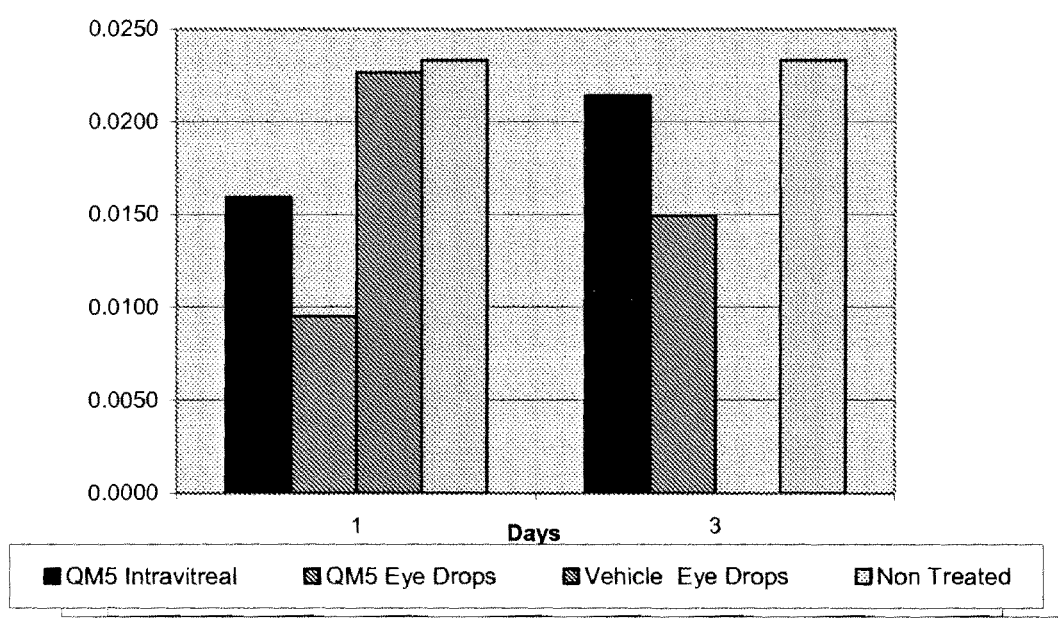

FIG. 11 shows retinal delivery of siRNA against p53 in PBS as positive control group and FIGS. 12A and 12B show that in intact animals or when administering ED without siRNA no fluorescent signal is obtained in the retina.

Conclusion: No sequence dependent differences, neither fluorophore nor gene dependent differences in the delivery to the retina were found. The study showed efficient delivery of Cy3 conjugated siRNA compounds directed to CASP2, RTP801, TIGASEII and p53 target genes, to ocular structures: RGC, RPE, photoreceptors, choroid.

Example 6

Quantification of Delivery of Casp2 siRNA (Formulated in PBS or in MC 2% (Formulation "A")) to Target Retinal Tissue in Rats In-Vivo Examination of different eye Drop formulations for the delivery of siRNA to the retina. The objective of the study was the determination of CASP2_4_S510 siRNA quantity in rat retina at time points 1, 3, 6 & 24 hours following single topical administration in different eye drops (ED) formulations.

Test Article
Substance (unformulated compound): CASP2_4_S510 (siRNA Against CASP2)
Supplied by Agilent (Manufacturer's catalog #QPI-1007, Batch #: Q02F08002N)

Description of the test material: CASP2_4_S510: S-inverted-Abasic 5'-cap, L-DNA 18/AS-AL. A 19-mer chemically modified blunt-ended duplex having two separate strands, with a sense strand (SEN) comprising unmodified ribonucleotides (upper case letters), an L-deoxyribonucleotide at position 18 (bold, underlined) and inverted deoxyabasic moiety (iB) present at the 5' terminus of the SEN strand; and with an antisense strand (AS) comprising unmodified ribonucleotides (upper case letters), and 2'OMe sugar modified ribonucleotides (lower case letters) at positions 2, 4, 6, 8, 11, 13, 15, 17 and 19 as shown in Formula I:

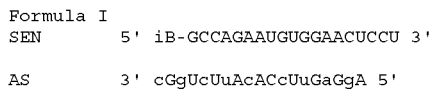

```
Formula I
SEN     5' iB-GCCAGAAUGUGGAACUCCU 3'

AS      3' cGgUcUuAcACcUuGaGgA 5'
```

Storage Conditions: −80° C.
siRNA formulated in PBS: 33.3 mg/ml CASP2_4_S510 in PBS (solution for eye drops)
Description of the test material: Under sterile conditions, 300 mg dry CASP2_4_S510 siRNA were dissolved in 15 ml of sterile double distilled water, to achieve a clear 20 mg/ml solution. The solution was stored at −80° C. until use. The 20 mg/ml stock solution in DDW was then brought to a working concentration of 100 μg/3 μl, in PBS, as follows:
6.5 mg CASP2_4_S510 siRNA: 325 μl of 20 mg/ml stock of CASP2_4 (6.5 mg), were precipitated by 0.15M NaCl and EtOH, and dried under the tissue culture laminar (sterile conditions). siRNA solution 33.3 mg/ml: 6.5 mg dry siRNA were dissolved in 195 μl PBS×1 Quantity prepared: 6.5 mg/195 μl aliquoted into 4 tubes.

Storage Conditions: Freshly Prepared
siRNA formulated in Formulation A: 33.3 mg/ml solution of CASP2_4_S510 siRNA in 2% (w/v) methylcellulose & 1% (v/v) sterile glycerol & 0.01% (w/v) EDTA solution in pyrogen free water (solution for eye drops)
Description of the test material: Under sterile conditions, 300 mg dry CASP2_4_S510 siRNA were dissolved in 15 ml of sterile double distilled water, to achieve a clear 20 mg/ml solution. The solution was stored at −80° C. until use. The 20 mg/ml stock solution in DDW was brought to a working concentration of 100 μg/3 μl, in formulation, as follows:
6.5 mg CASP2_4_S510 siRNA: 325 μl of 20 mg/ml stock of CASP2_4 (6.5 mg), were precipitated by 0.15M NaCl and EtOH, and dried under the tissue culture laminar (sterile conditions).
siRNA solution 33.3 mg/ml: 6.5 mg dry siRNA were dissolved in 195 μl Formulation A solution
Quantity prepared: 6.5 mg/195 μl aliquoted into 4 tubes
Storage Conditions: Freshly Prepared
Control Article(s)
Methyl cellulose formulation (no siRNA)—2% methylcellulose & 1% v/v sterile glycerol & 0.01% w/v EDTA solution in pyrogen free water, was prepared as follows:
Solution A: 0.4 g of methylcellulose 25 (ScienceLab.com, Cat#SLM2050) dissolved in final volume of 10 ml of hot boiled water (80-90° C.), (Norbrook), cooled down to room temperature and added in a proportion of 1:1 (final concentration 2%) to solution B.
Solution B: 332 μl of 60% glycerol (Sigma, Cat#G6279) & 2 μl EDTA solution pH8 (prepared from Sigma, Cat#E9884) in 9.66 ml WFI (Norbrook).
500 μL, of Solution A mixed with 500 μL, of Solution B to obtain: 2% methylcellulose & 1% v/v sterile Glycerol & 0.01% w/v EDTA solution in pyrogen free water (final pH was approximately 7.4 and osmolarity similar to human tear film).
PBS was supplied by Biological industries (Manufacturer catalog #02-023-5A (For 10×PBS); Batch #619113)
Test System
Animals used: Species: Rats; Strain: Adult, Sprague-Dawley (SD)
Source: Harlan, Jerusalem Israel
Age: 8-10 weeks; Body Weight Range: 180-250 gr
Sex: Male; Group Size: n=6/3; Total number of animals: 54
Animal Husbandry: Diet: Animals were provided an ad libitum commercial rodent diet and free access to drinking water.
Environment:
(i) Acclimatization of at least 5 days.
(ii) All animals were confined in a limited access facility with environmentally-controlled housing conditions throughout the entire study period, and maintained in accordance with approved standard operating procedures (SOPs). Animals were provided ad libitum a commercial rodent diet (Harlan Teklad 2018S Global 18% Protein Rodent Diet) and filtered, chlorinated and acidified water.
Rats were kept in microisolator cages with filter top, 1-6 Rats/cage. The cages were maintained under controlled environmental-conditions of temperature (20-24° C.), relative humidity (30-70%), a 12-hr light/12-hr dark cycle, monitored by the control computer, throughout the study period.

Experimental Design

Study design: Retinal concentration of CASP2_4 siRNA following ED application of ocular formulation was determined by qPCR in study groups terminated at different time points after siRNA administration. Each experimental siRNA-treated group included 6 rats. ED was applied bilaterally as detailed in Study Design Table C9.

Termination time points post siRNA administration: Termination setup was performed according to the study design Table C9. Dosing and termination of experimental groups were performed on separate days.

TABLE C9

Study Design

| Group Number | Group Size | Test Article | Dose of Bilateral ED [100 μg/eye/3 ul] | Termination [hrs] | Method of Analysis |
|---|---|---|---|---|---|
| 1 | 6 | CASP2_4_S510 | PBS formulated siRNA | 1 | qPCR |
| 2 | 6 | CASP2_4_S510 | MC formulated | 1 | qPCR |
| 3 | 6 | CASP2_4_S510 | PBS formulated siRNA | 3 | qPCR |
| 4 | 6 | CASP2_4_S510 | MC formulated | 3 | qPCR |
| 5 | 6 | CASP2_4_S510 | PBS formulated siRNA | 6 | qPCR |
| 6 | 6 | CASP2_4_S510 | MC formulated | 6 | qPCR |
| 7 | 6 | CASP2_4_S510 | PBS formulated siRNA | 24 | qPCR |
| 8 | 6 | CASP2_4_S510 | MC formulated | 24 | qPCR |
| 9 | 3 | N/A | Vehicle MC | 1 | qPCR |
| 10 | 3 | N/A | intact | N/A | qPCR |

Anesthesia: In the course of the experiment, the animals were anesthetized with Equithesine (I.P. 4 ml/kg) for ED application and/or before terminations.

Eye Drop Delivery: A 3 μl sample volume of the test article or vehicle was applied to the corneal surface bilaterally to the anesthetized animals, by a blunt pipette tip (filter tips 10 μl sterile (short)). The animals were placed in a warm environment to prevent anesthesia-induced hypothermia, and were returned to their cage after regaining consciousness (experimental Groups 7 and 8). Termination of animals from all study groups was according to study design. Tissues were collected according to study design.

Scheduled euthanasia: All animals were deeply anaesthetized and euthanized according to the study design (Table C9, Termination).

Perfusion setup: Rats were perfused transcardially with PBS (20-50 ml/min following 2-3 min).

Tissue Collection: After perfusion, both eyes (left and right) were enucleated and stored on ice. The eyes were dissected using a microscope, and optionally gross pathology was graded according to the sample grading scale. The cornea was dissected by a cut along the limbus, lens was gently removed, and the retina and vitreous were carefully separated from the sclera. Whole retinas and vitreous bodies (humor) were collected (Retina including: "neural retina"+Retinal Pigment Epithelium+Choroid) into two separate appropriate and properly marked test tubes. Dissected retinas were washed in a large volume of PBS (each retina in a separate tube with fresh PBS), extra liquid was removed with Kim-wipe® and retinas were snap-frozen in liquid nitrogen. Retina and Vitreous body samples were s subjected to RNA extraction.

Evaluation

RNA Extraction:

Retina: RNA was extracted from each retina sample individually (left and right) by double extraction. The RNA was transferred for cDNA preparation and qPCR analyses.

Vitreous: Material for Casp2_4 siRNA detection from vitreous was obtained using the following protocol:

Each rat vitreous was around 10 μl. 500 μl of reagent A EZ-RNA II (Biological Industries Cat no. 20-410-100) were added to each vitreous. The sample was homogenized, and 10 μg tRNA (1 μl from 10 mg/ml stock) were added. The sample was stored for 5 minutes at room temperature. Subsequently: EZ-RNA II B: 400 μl and EZ-RNA II C: 90 μl were added and Mixed well. The sample was stored for 10 min at room temperature then centrifuged 12000 g for 15 min at 4° C.

The upper phase was transferred to a fresh tube to which isopropanol: 500 μl and Linear Acrylamide: 5 μl were added. The sample was stored overnight at −20° C., centrifuged at 12000 g for 20 min at 4° C., washed twice with 75% ethanol. The pellet was dissolved in 15 μl $H_2O$.

siRNA Quantification: The quantity of the siRNA in retinas and vitreous humor (siRNA quantification was performed per vitreous) was examined by qPCR siRNA quantification. qPCR was performed according to Quark's standard operating procedures. CASP2_4 siRNA and reference gene expression were tested. Results are summarized in Table C10.

TABLE C10

Results

| Termination | Formulation | Eye | Group size | fmol siRNA/μg retinal RNA |
|---|---|---|---|---|
| 1 hrs | Methyl Cellulose | Right | 5 | 12.50 |
| | | Left | 6 | 10.19 |
| | PBS | Right | 6 | 8.08 |
| | | Left | 6 | 4.77 |
| 3 hrs | Methyl Cellulose | Right | 5 | 1.76 |
| | | Left | 5 | 2.47 |
| | PBS | Right | 6 | 6.48 |
| | | Left | 6 | 7.80 |
| 6 hrs | Methyl Cellulose | Right | 4 | 1.37 |
| | | Left | 6 | 3.80 |
| | PBS | Right | 6 | 3.61 |
| | | Left | 6 | 1.04 |
| 24 hrs | Methyl Cellulose | Right | 6 | 0.11 |
| | | Left | 6 | 0.21 |
| | PBS | Right | 6 | 0.03 |
| | | Left | 6 | 0.04 |

Conclusion: The study showed efficient delivery of siRNA into retina 1 and 3 hours post administration. qPCR analysis showed that after application of 100 μg siRNA in Formulation A, in average 11 fMol/ug of total RNA was obtained in the retina after 1 hour and 2 fMol/ug siRNA after 3 hours. When administering the same concentration in PBS, an amount of 6 fmol/μg of siRNA was obtained after 1 hour and 8 fmol/μg of tot RNA was obtained after 3 hours.

Example 7

Quantification of Non-Invasively Administered siRNA Compound (Formulated in Various Formulations) in Target Retinal Tissue in Rats Examination of different eye drop formulations for non-invasive delivery of siRNA to the retina in vivo.

The objective of this study was the assessment of CASP2_4_S510 siRNA quantity in normal rat retina at 3 hours following single topical application of different siRNA formulations prepared for administration as eye drops (ED).

Test Article

Substance (unformulated compound) CASP2_4_S510 (siRNA Against CASP2) Supplied by Agilent (Manufacturer's catalog #QPI-1007; Batch #: Q02F08002N).

Description of the test material: CASP2_4_S510: S-inverted-Abasic 5'-cap, L-DNA 18/AS-AL. A 19-mer stabilized double strand RNA with inverted Abasic as 5'-cap, L-DNA at the 18 position of the sense strand and alternating 2'-OMe at positions 2, 4, 6, 8, 11, 13, 15, 17 & 19 on the antisense strand.

Storage Conditions: −80° C.

siRNA formulated in PBS 33.3 mg/ml CASP2_4_S510 in PBS (solution for eye drops)—

Description of the test material: Under sterile conditions, 300 mg dry CASP2_4_S510 siRNA were dissolved in 15 ml of sterile double distilled water, to achieve a clear 20 mg/ml solution. The solution was stored at −80° C. until use. The 20 mg/ml stock solution in double distilled water was then brought to a working concentration of 100 µg/3 µl, in PBS, as follows:

1.7 mg CASP2_4_S510 siRNA: 85 µl of 20 mg/ml stock of CASP2_4 (1.7 mg), were precipitated by 0.15M NaCl and EtOH, and dried under the tissue culture laminar (sterile conditions).

siRNA solution 33.3 mg/ml: 1.7 mg dry siRNA were dissolved in PBS ×1 to achieve 51 µl Quantity prepared: 1 tube of 1.7 mg in 51 µl of PBS Storage Conditions: freshly prepared siRNA formulated in commercial lubricant solution Systane®: 33.3 mg/ml CASP2_4_S510 in Systane (solution for eye drops)—Group II. Purchased from Alcone Inc.; Batch #: Lot 165228F.

Description of the test material: Under sterile conditions, 300 mg of CASP2_4_S510 powder (Aligent, batch #Q02F08002N) were dissolved in 15 ml of sterile double distilled water, to achieve a clear 20 mg/ml solution. The solution was stored at −80° C. until use. The 20 mg/ml stock solution in double distilled water was then brought to a working concentration of 100 µg/3 µl, in formulation, as follows:

1.7 mg CASP2_4_S510 siRNA: 85 µl of 20 mg/ml stock of CASP2_4_S510 (1.7 mg), was precipitated by 0.15M NaCl and EtOH, and dried under the tissue culture laminar (sterile conditions).

siRNA solution 33.3 mg/ml: 1.7 mg dry siRNA was dissolved in 51 µL commercial lubricant solution (i.e. Systane®).

Quantity prepared: 1 vial of 1.7 mg siRNA in 51 µL Systane® solution.

SiRNA formulated in glycerol+EDTA solution and in methyl cellulose (MC) Solutions: 33.3 mg/ml solution of CASP2_4_S510 siRNA in Glycerol+EDTA formulation, and in 0.5%, 2% or 3% (w/v) methylcellulose & 1% (v/v) sterile glycerol & 0.01% (w/v) EDTA solution in pyrogen free water—Groups III-VI Description of the test material: Under sterile conditions, 300 mg of CASP2_4_S510 powder (Aligent, batch #Q02F08002N) were dissolved in 15 ml of sterile double distilled water, to achieve a clear 20 mg/ml solution. The solution was stored at −80° C. until use. The 20 mg/ml stock solution in double distilled water was then brought to a working concentration of 100 µg/3 µl, in formulation, as follows:

Seven vials of 1.7 mg CASP2_4_S510 siRNA: 85 µl of 20 mg/ml stock of CASP2_4_S510 (1.7 mg), was precipitated by 0.15M NaCl and EtOH, and dried under the tissue culture laminar (sterile conditions).

Group III: 0.5% MC formulation: 1:7 mixture of solution A and solution B [12.5 µL of Solution A were mixed with 50 µL of Solution B and 37.5 µl WFI to obtain: 0.5% methylcellulose & 1% v/v sterile Glycerol & 0.01% w/v EDTA solution in pyrogen free water (final pH was approximately 7.4 and osmolarity similar to human tear film)]

siRNA formulated in 0.5% MC formulation 33.3 mg/ml: 1.7 mg dry siRNA were dissolved in 0.5% MC formulation that was prepared as described to achieve a 51 µL formulated solution of siRNA in 0.5% MC formulation.

Group IV: 1% MC formulation: 1:3 mixture of solution A and solution B [25 µL of Solution A were mixed with 50 µL of Solution B and 25 µl of WFI to obtain: 1% methylcellulose & 1% v/v sterile Glycerol & 0.01% w/v EDTA solution in pyrogen free water (final pH was approximately 7.4 and osmolarity similar to human tear film)]

siRNA solution formulated in 1% MC formulation 33.3 mg/ml: 1.7 mg dry siRNA were dissolved in 1% MC formulation that was prepared as described to achieve a 51 µL formulated solution of siRNA in 1% MC formulation.

Group V: 2% MC formulation: 1:1 mixture of solution A and solution B [50 µL of Solution A were mixed with 50 µL, of Solution B to obtain: 2% methylcellulose & 1% v/v sterile Glycerol & 0.01% w/v EDTA solution in pyrogen free water (final pH was approximately 7.4 and osmolarity similar to human tear film)]

siRNA solution formulated in 2% MC formulation 33.3 mg/ml: 1.7 mg dry siRNA were dissolved in 2% MC formulation that was prepared as described to achieve a 51 µL formulated solution of siRNA in 2% MC formulation.

Group VI: 3% MC formulation: 1:1 mixture of solution A and solution C [50 µL of Solution A were mixed with 50 µL, of Solution C to obtain: 3% methylcellulose & 1% v/v sterile Glycerol & 0.01% w/v EDTA solution in pyrogen free water (final pH was approximately 7.4 and osmolarity similar to human tear film)]

siRNA solution formulated in 3% MC formulation 33.3 mg/ml: 1.7 mg dry siRNA were dissolved in 3% MC formulation that was prepared as described to achieve a 51 µL formulated solution of siRNA in 4% MC formulation.

Group VII: Glycerol+EDTA formulation: 50 µL, WFI (Norbrook) were mixed with 50 µL of Solution B to get: 1% v/v sterile Glycerol & 0.01% w/v EDTA solution in pyrogen free water.

siRNA solution formulated in Glycerol+EDTA formulation 33.3 mg/ml: 1.7 mg dry siRNA were dissolved in Glycerol+EDTA formulation that was prepared as described to achieve a 51 µL formulated solution of siRNA in Glycerol+EDTA formulation.

Quantity prepared: 7 vials, as follows:
1 vial of 1.7 mg siRNA in 51 µL PBS formulation
1 vial of 1.7 mg siRNA in 51 µL Systane® formulation
1 vial of 1.7 mg siRNA in 51 µL 0.5% MC formulation
1 vial of 1.7 mg siRNA in 51 µL 1% MC formulation
1 vial of 1.7 mg siRNA in 51 µL 2% MC formulation
1 vial of 1.7 mg siRNA in 51 µL 3% MC formulation
1 vial of 1.7 mg siRNA in 51 µL Glycerol+EDTA formulation
Storage Conditions: Freshly Prepared Control Article(s)

1. PBS—Supplied by Biological industries (Manufacturer catalog #02-023-5A (For 10×PBS); Batch #619113).

2. Systane®—commercially available eye drop solution; Supplied by Alcon; Batch #: Lot 165228F; Quantity supplied: 15 ml; Storage Conditions: RT; Expiration Date: 02/2011.

Formulation Solution A—methylcellulose solution in pyrogen free water Solution A) 0.4 g of methylcellulose 25 (ScienceLab.com, Cat#SLM2050) dissolved in final volume of 10 ml of hot boiled water (80-90° C.), (Norbrook), cooled down to room temperature.

Formulation Solution B—Sterile Glycerol & EDTA solution in pyrogen free water Solution B) 332 µl of 60% glycerol (Sigma, Cat#G6279) & 2 µl EDTA solution pH8 (prepared from Sigma, Cat#E9884) in 9.666 ml WFI (Norbrook).

Formulation Solution C—Concentrated methylcellulose solution in pyrogen free water Solution C) 0.6 g of methylcellulose 25 (ScienceLab.com, Cat#SLM2050) dissolved in final volume of 10 ml of hot boiled water (80-90° C.), (Norbrook), cooled down to room temperature.

Stability Tests of siRNA Compounds in the Above Methyl Cellulose Formulations:

The stability of Casp2_4 Q02F08002N siRNA was tested in Methyl cellulose formulations according to the following protocol:

siRNA was diluted in the different formulations containing Methyl cellulose, to a final concentration of 7 µM siRNA. The 0%, 0.5%, 1%, 2% and 3% MC formulations were incubated at Room Temperature. In addition, the 3% MC formulation was also incubated at 37° C. with and without nuclease inhibitor.

A 5-µL aliquot of each solution was transferred to 15 µL of 10×TBE-loading buffer after incubation at the following time points: 0, 10', 0.5, 1, 1.5, 3, 6 h. The solution was then frozen in liquid nitrogen, and stored at −20° C.

4 µL of each sample was loaded onto a non-denaturing 20% polyacrylamide gel and electrophoresis was performed at 80V for 2.5 h.

For siRNA visualization the gel was stained with Ethidium bromide solution (1.0 µg/µL).

As a positive control for gel migration of a non-degraded siRNA, 5 µL of a 7 µM tested siRNA solution in PBS was transferred to 15 µL of 10×TBE-loading buffer and loaded onto the gel. Then, the sample was frozen in liquid nitrogen and stored at −20° C.

As a reference to the migration pattern of a degraded single strand (ss) siRNA, a non-relevant single strand siRNA was prepared.

Results: The Casp 2_4 siRNA compound was stable in all formulations.

The In Vivo Study:
Test System:
Animals used: Rats; Strain: Adult, Sprague-Dawley; Modification: SD
Source: Harlan, Jerusalem Israel
Age: 8-10 weeks; Body Weight Range: 220-270 gr
Sex: Male; Group Size: n=6; Total number of animals: 54
Animal Husbandry Diet: Animals were provided an ad libitum commercial rodent diet and free access to drinking water.
Environment:
(i) Acclimatization of at least 5 days.
(ii) All the animals were confined in a limited access facility with environmentally-controlled housing conditions throughout the entire study period, and maintained in accordance with approved standard operating procedures (SOPs). Animals were provided ad libitum a commercial rodent diet (Harlan Teklad 2018S Global 18% Protein Rodent Diet) and filtered, chlorinated and acidified water.

Rats were kept in microisolator cages with filter top, 1-6 Rats/cage. The cages were maintained under controlled environmental conditions of temperature (20-24° C.), relative humidity (30-70%), a 12-hr light/12-hr dark cycle, monitored by the control computer, throughout the study period.

Experimental Design

Experimental setup included 9 experimental groups (6 rats per group). ED were applied bilaterally. Different formulations were used (Study Design Table C11). Termination time point (3 hrs) post siRNA administration: Termination setup was performed according to the study design Table C11. Retinal concentration of CASP2_4 siRNA was determined by qPCR.

TABLE C11

Study Design

| Group | Delivery Route | Formulation | siRNA Compound | Bilateral Application (dose/volume/eye) | Term. Time Point (hrs) | Group Size |
|---|---|---|---|---|---|---|
| I | ED | PBS | Casp2_4_S510 | 100 µg/3 µl | 3 | 6 |
| II | ED | Systane | Casp2_4_S510 | 100 µg/3 µl | 3 | 6 |
| III | ED | MC0.5% | Casp2_4_S510 | 100 µg/3 µl | 3 | 6 |
| IV | ED | MC1% | Casp2_4_S510 | 100 µg/3 µl | 3 | 6 |
| V | ED | MC2% | Casp2_4_S510 | 100 µg/3 µl | 3 | 6 |
| VI | ED | MC3% | Casp2_4_S510 | 100 µg/3 µl | 3 | 6 |
| VII | ED | Glycerol + EDTA * | Casp2_4_S510 | 100 µg/3 µl | 3 | 6 |
| VIII | ED | PBS | — | — | 3 | 6 |
| IX | Intact | — | — | — | — | 6 |

* Glycerol + EDTA formulation (MC free formulation) = 1% v/v sterile glycerol & 0.01% w/v EDTA solution in pyrogen free water
Anesthesia: In the course of the experiment, All ED treated animals were anesthetized with Equithesine (I.P. 4 ml/kg).

Eye Drop Delivery A 3 µl sample volume of the test article or vehicle were applied to the corneal surface bilaterally to the anesthetized animals, by a blunt pipette tip (filter tips 10 µl sterile (short)). The animals were placed in a warm environment to prevent anesthesia-induced hypothermia. Termination of animals from all study groups was according to study design (time point 3 hrs). Tissues were collected according to study design.

Scheduled euthanasia: All animals were deeply anaesthetized and euthanized according to the study design (Table C11, Termination).

Perfusion setup: Rats were perfused transcardially with PBS (20-50 rpm/min following 2-3 min).

Tissue Collection: After perfusion, both eyes (left and right) were washed with PBS, were enucleated and stored on ice. The eyes were dissected using a binocular microscope, and optionally gross pathology was graded according to the sample grading scale. The cornea was dissected by a cut along the limbus, lens was gently removed, and the retina and vitreous were carefully separated from the sclera. Whole retinas and vitreous bodies (humor) were collected into two separate appropriate and properly marked test tubes. Dissected retinas were washed in a large volume of PBS (each retina in a separate tube with fresh PBS), extra liquid was removed with Kimwipes and retinas were snap-frozen in liquid nitrogen. Retina and Vitreous body samples were subjected to RNA extraction.

Evaluation:

RNA Extraction: Retina: RNA was extracted from each retina sample individually (left and right) by double extraction. The RNA was transferred for cDNA preparation and qPCR analyses.

Vitreous: Material for Casp2_4_S510 siRNA detection from vitreous was obtained using the following protocol: Each rat vitreous was around 10 µl. 500 µl of reagent A EZ-RNA II (Biological Industries Cat no. 20-410-100) were added to each vitreous. The sample was homogenized, and 10 µg tRNA (1 µl from 10 mg/ml stock) were added. The sample was stored for 5 minutes at room temperature. Subsequently EZ-RNA II B: 400 µl and EZ-RNA II C: 90 µl were added and mixed well. The sample thus obtained was stored for 10 min at room temperature then centrifuged 12000 g for 15 min at 4° C.

The upper phase was transferred to a fresh tube to which isopropanol: 500 µl and Linear Acrylamide: 5 µl were added. The sample was stored overnight at −20° C., centrifuged at 12000 g for 20 min at 4° C., washed twice with 75% ethanol. The pellet was dissolved in 15 µl DDW.

siRNA Quantification: The quantity of the siRNA in retinas and vitreous humor (siRNA quantification was performed per vitreous) was examined by qPCR siRNA according to Quark's standard operating procedures.

Results

The study showed that the following quantities of siRNA were detected in the rat retina three hours post application of siRNA non-invasively administered in vivo with the different formulations:

TABLE C12

CASP2 siRNA Normalized (miRNA) quantity in fmle/1 µg RNA

| Group | Abbreviation | N | Mean | Std |
|---|---|---|---|---|
| IX | I-N/A | 6 | 0.005 | 0.005 |
| VIII | P-PBS | 6 | 0.056 | 0.124 |
| VII | C-MC(0) | 6 | 6.303 | 3.921 |
| XA | C-MC(1/2) | 4 | 17.831 | 16.628 |
| XIA | C-MC(1) | 6 | 5.677 | 4.235 |
| V | C-MC(2) | 6 | 6.963 | 8.042 |
| VI | C-MC(3) | 5 | 7.653 | 6.674 |
| II | C-Systane | 5 | 5.109 | 2.492 |
| I | C-PBS | 6 | 4.228 | 6.758 |

MC(0)-MC(3)-formulations including increasing concentrations from 0 to 3% of Methyl Cellulose.

Conclusion: All groups that were treated by CASP2 siRNA show positive quantities of the siRNA (>4 fmole) in target retinal tissue. No significant difference (P-value=0.8425) were found between the formulation groups.

Non-Invasively Administered siRNA Induces in-vivo Knockdown (KD) of Target Gene Associated with Apoptosis in Target Ocular Tissue Example 8

Determination of In-Vivo Knockdown Activity of siRNA Against p53 Prepared for Non-invasive Administration by Eye Drops in Rat Retina (siRNA Compound Formulated in MC 2% (Formulation "A")

Objective

The objective of the study was to determine knockdown activity of non-invasively delivered siRNA compound targeting p53 mRNA in the rat neural retina. The siRNA compound was formulated for non-invasive administration by eye drops. Knockdown activity was assessed by protein level determination using ELISA method.

Test Article
a. Substance (unformulated siRNA compound): QM5 (siRNA Against Mouse/Rat p53)
b. Formulated siRNA compound for non-invasive (eye drop) delivery (groups 2 & 5 in Table C13): 100 µg/3 µl solution of QM5 siRNA in 2% (w/v) methylcellulose & 1% (v/v) sterile glycerol & 0.01% (w/v) EDTA solution in pyrogen free water.
c. Formulated siRNA compound for intravitreal injection (groups 1 & 4 in Table C13): 280 µg of QM5 siRNA in 140 µl of PBS
d. Formulated vehicle solution for non-invasive (eye drop) delivery (groups 3 & 6 in Table C13): 2% methylcellulose & 1% v/v sterile glycerol & 0.01% w/v EDTA solution in pyrogen free water.

Test System:

Adult Male, Sprague-Dawley (SD) Rats Harlan, Jerusalem Israel, 6-8 weeks old, 160-180 gr each.

Experimental Design

Study design: Unilateral axotomy (left eye, OS) was performed in each animal from groups 1-6.

Groups 2, 3, 5& 6: Test compound (100 µg test article in 3 µl of formulated vehicle—groups 2&5) or formulated vehicle alone (groups 3&6) were applied as eye drops every day starting on day 0 (immediately after axotomy). Experimental groups were terminated according to Table C13. Left and Right eye samples from group 7 served as an intact normal controls.

Groups 1 & 4: Three minutes following axotomy (at day 0), 20 µg of siRNA compound in 10 µl of PBS vehicle were applied by microinjection into the vitreous. The microinjection into the vitreous was performed perpendicular to the sclera, using an Insulin micro-injector (0.3 ml). Animals were terminated according to Table C13.

TABLE C13

Study Design:

| Group | Group Size | Axotomy (unilat. OS) | Intravitreal injection (OS) (dose/volume/eye) | ED (OS) (dose/volume/eye) | Termination (days) |
|---|---|---|---|---|---|
| 1 | 6 | Yes | QM5 20 µg/10 µl | N/A | 1 |
| 2 | 6 | Yes | N/A | QM5 100 µg/3 µl | 1 |
| 3 | 4 | Yes | N/A | Formulated vehicle | 1 |
| 4 | 6 | Yes | QM5 20 µg/10 µl | N/A | 3 |
| 5 | 6 | Yes | N/A | 3× QM5 100 µg/3 µl | 3 |
| 6 | 4 | Yes | N/A | 3× Formulated vehicle | 3 |
| 7 | 4 | N/A | N/A | N/A | N/A |

(see Tables C14-C17 hereinbelow and FIGS. 11A and 11B)

p53 Signal According to Kidney W.C.E Standard Curve

TABLE C14 p53 signals values according to Kidney W.C.E standard curve

| | P53 Signal | retina | |
|---|---|---|---|
| Operation | Treatment | 1 days | 3 days |
| Axotomy | QM5 Intravitreal | 1.00 | 1.84 |
| Axotomy | QM5 Eye Drops | 0.75 | 1.41 |
| Axotomy | Vehicle Eye Drops | 1.93 | Missing |
| None | Non Treated | 2.01 | 2.01 |

TABLE C15

% p53 signals ratio from non-treated animals

| | % signal ratio from non-treated | retina | |
|---|---|---|---|
| Axotomy | QM5 Intravitreal | 50% | 92% |
| Axotomy | QM5 Eye Drops | 37% | 70% |
| Axotomy | Vehicle Eye Drops | 96% | 0% | p53 signal according to GST-hp53

TABLE C16 p53 signal values according to GST-p53 standard curve

| | P53 Signal | retina | |
|---|---|---|---|
| Operation | Treatment | 1 day | 3 days |
| Axotomy | QM5 Intravitreal | 0.0159 | 0.0214 |
| Axotomy | QM5 Eye Drops | 0.0095 | 0.0149 |
| Axotomy | Vehicle Eye Drops | 0.0227 | Missing |
| None | Non Treated | 0.0233 | 0.0233 |

TABLE C17

% P53 signals ratio from non-treated animals

| | % Signal ratio from non-treated | retina | |
|---|---|---|---|
| Axotomy | QM5 Intravitreal | 68% | 92% |
| Axotomy | QM5 Eye Drops | 41% | 64% |
| Axotomy | Vehicle Eye Drops | 97% | Missing |

Conclusion: These studies showed that non-invasively delivered siRNA compound targeting p53 mRNA in the rat neural retina induces knock down of the p53 protein.

siRNA Compounds Induce Ocular Neuroprotection In-Vivo in Animal Models of Ocular Neuronal Injury Example 9

Evaluation of Ocular Neuroprotective Induction by siRNA Compound Targeting Caspase 2 in the ONC Model after ITV Injection Study objectives: To evaluate ocular neuroprotective efficacy of siRNA targeting Caspase 2 in the ONC model following intravitreal injection(s)

Methods

Retrograde Labelling of RGCs.

The Fluorogold tracer is transported retrogradely (from brain to eye) along RGC axons resulting in complete and specific labeling of all RGCs. For the purpose of this study, RGCs were labeled by application of the retrograde tracer FluoroGold (2%, Fluorochrome, Englewood, Colo.) in the superior colliculus. Briefly, a window was drilled in the scalp above the coordinates 6 mm rostral to the bregma and 1.2 mm lateral to the midline in both hemispheres. Using a Hamilton syringe, 3 µl of the FluoroGold was injected into superior colliculus 3.8 mm, 4 mm, and 4.2 mm below the bony surface at a rate 1 µl/min at each of the three depths. The needle was then slowly withdrawn and the skin was sutured. In adult rats, the time required to obtain full labeling of all RGCs following this procedure was ~1 week. For this reason, ONC was performed one week after retrograde labeling of RGCs.

Optic nerve crush. The orbital optic nerve (ON) of anaesthetized adults Wistar rats was exposed through a supraorbital approach, the meninges severed and all axons in the optic nerve (ON) transected by crushing with calibrated forceps for 10 seconds, 2 mm from the lamina cribrosa.

Intravitreal (IVT) injection. One or two 20 µg doses (in 10 µl of PBS) of test or control siRNAs or 10 µl of PBS vehicle were microinjected into the vitreous body 2 mm anterior to the nerve head, perpendicular to the sclera, using a glass micropipette. IVT administration is shown as a control and or for initial validation of a target gene.

Quantification of RGC survival. At termination, experimental animals were perfused transcardially with 4% paraformaldehyde. The eyes with the optic nerve were enucleated, the cornea was dissected with the blade and lens/vitreous were gently removed. Both retinas were dissected out, fixed for an additional 30 min and flat-mounted vitreal side up on a glass slide for examination of the ganglion cell layer. RGCs were examined under the fluorescence microscope with an UV filter (365/420 nm). The number of retrogradely fluorescent RGCs were determined by two different, independent and "blinded" investigators counting them in 16 distinct areas (four areas per retinal quadrant at three different eccentricities of one-sixth, one-half, and five-sixths of the retinal radius). Microglia that may have incorporated FluoroGold after phagocytosis of dying RGCs was distinguished by their characteristic morphology and excluded from quantitative analyses.

Part 1

Test article: CASP2_4 siRNA—a double-stranded 19-mer oligonucleotide chemically modified by 2'O-methylation on both strands. Other compounds included siRNA chemically modified with L-DNA at the 3' terminus of the sense strand or 2'5' bridges at the 3' terminus. Targets the caspase2 gene in multiple species.

Control Article: PBS

Design: Retinal ganglion cells (RGC) were selectively labeled first by application of the retrograde tracer FluoroGold to the superior colliculus. One week later, animals were subjected to optic nerve crush injury (ONC). The quantifications of surviving RGCs were carried out at 7 and 30 days after ONC by counting FluoroGold-labelled RGCs on flat-mounted retinas. Table C18 shows the groups treatments.

TABLE C18

Group Treatments

| Groups | Right eye (n = 4) | Left eye (n = 4) | Termination |
|---|---|---|---|
| 1 and 2 | 20 µg siCasp2_4 on day 0 | 20 µl PBS on day 0 | Day 7 |
| 3 and 4 | 20 µg siCasp2_4 on days 0 and 10 | 20 µl PBS on days 0 and 10 | Day 30 |

Results: The mean number of surviving RGCs in eyes treated with 20 µg Casp2_4 siRNA and subjected to optic nerve crush was 2040±35 cells/mm2 at 7 days and 298±25 cells/mm2 at 30 days post injury. These counts were significantly greater than the mean RGC counts in eyes treated with PBS and subjected to nerve crush, which was 941±27 cells/mm2 at 7 days and 41±7 cells/mm2 at 30 days. In the non-surgical control eyes, the mean number of RGCs was 2253±104 cells/mm2, which is comparable to the average number of RGCs reported in literature. Table C19 provides the results of this study.

TABLE C19

Mean numbers of survived RGC at the different time points post injury

| Time post ONC | 7 days | | 30 days | |
|---|---|---|---|---|
| Treatment | PBS | Casp2_4 | PBS | Casp2_4 |
| Mean survival RGC (cells/mm2) | 941.347 | 2039.672 | 41.040 | 298.051 |
| SD | 27.038 | 34.766 | 7.219 | 25.401 |
| % of RGC survival from total RGC | 26.659 | 57.764 | 1.162 | 8.441 |
| SD | 0.766 | 0.985 | 0.204 | 0.719 |

All data are given as mean±standard deviation. Values were compared using one-way analysis of variance (ANOVA) and considered as significantly different at P<0.02.

Conclusions: The increased survival of the RGCs was not due to the neuroprotective effects of anesthesia (ketamine is an antagonist of the N-methyl-D-aspartate receptor, and xylazine is an α2-adrenergic receptor agonist), since identically anesthetized animals in the control group had significantly lower RGC counts than did animals in the Casp2_4 siRNA treated group, but due to neuroprotective effect of silencing pro-apoptotic Caspase 2 activation and up regulation following ONC injury, by treatment with siRNA compound targeting the Caspase 2 gene.

Part 2

Test article: CASP2_4L siRNA—a double-stranded 19-mer oligonucleotide chemically modified by 2'-O-methylation on the antisense strand and L-DNA on the sense strand. Targets the caspase 2 gene of multiple species.

Control Articles:

PBS siRNA targeting GFP—a double-stranded 21-mer oligonucleotide stabilized by 2'-O-methylation on both strands.

CNL—siRNA with no match to any known mammalian transcript; a double-stranded 19-mer oligonucleotide chemically modified by 2'-O-methylation on both strands.

Design. Retinal ganglion cells (RGC) were selectively labeled first by application of the retrograde tracer FluoroGold to the superior colliculus. One week later, animals were subjected to optic nerve crush injury (ONC). The quantifications of surviving RGCs were carried out at day 7 after ONC by counting FluoroGold-labelled RGCs on flat-mounted retinas. Test or control articles were injected at the time of ONC. Similar experiments were performed in order to test activity and efficacy of siRNA administered via eye drops (see next example). Table C20 shows groups treatments.

TABLE C20

Groups Treatments

| Groups | Right eye (n = 4) | Left eye (n = 4) | Termination |
|---|---|---|---|
| 1 and 2 | 20 µg siCasp2_4 on day 0 | 20 µl PBS on day 0 | Day 7 |
| 3 and 4 | 20 µg siGFP on day 0 | 20 µl siCNL_1 on day 0 | Day 7 |

Results: The mean number of surviving RGCs in eyes treated with 20 µg Casp2_4 siRNA and subjected to optic nerve crush was 2085±40 cells/mm2 at 7 days post injury. These counts were significantly greater than the mean RGC counts in eyes treated with either PBS or GFP siRNA or CNL_1 siRNA and subjected to nerve crush, which was 901±50 cells/mm2, 922±38 cells/mm2, 898±42 cells/mm2 respectively, at 7 days. In the nonsurgical control eyes, the mean number of RGCs was 2196±110 cells/mm2, which is comparable to the average number of RGCs reported in literature. Table C21 shows results. All data are given as mean±standard deviation. Values were compared using one-way analysis of variance (ANOVA) and considered as significantly different at P<0.01.

TABLE C21

Mean numbers of survival RGC 7 days post injury (n = 4 retinas/group).

| Treatment | PBS | siGFP | siCNL_1 | siCasp2 |
|---|---|---|---|---|
| Mean survival RGC (cells/mm2) | 901.3338 | 922.3666 | 898.4268 | 2084.815 |
| SD | 49.74134 | 38.04059 | 42.12429 | 40.03638 |
| % of RGC survival from total RGC | 25.52577 | 26.12142 | 25.44345 | 59.04197 |
| SD | 1.408675 | 1.07731 | 1.19296 | 1.13383 |

Conclusions: The increased survival of the RGCs was due to neuroprotective effect of silencing pro-apoptotic Caspase 2 activation and up-regulation following ONC injury, by treatment with siRNA targeting Caspase 2 gene. The Casp2_4 siRNA molecules having different structural modifications/motifs show similar neuroprotective effect on RGC survival range.

Example 10

Evaluation of Ocular Neuroprotective Efficacy of siRNA Compound Targeting Caspase 2 in the IOP Model The objective of the current study was to establish the neuroprotective effect of a single injection of 20 µg of CASP2_4 compound or negative control GFP siRNAs in the pre-clinical rat glaucoma IOP model.

Study Outline

In animals from all study groups, RGCs were retrograde labeled using the fluorescent tracer DiI (1,1'-dioctadecyl-3,3,3',3'-tetramethylindocarbocyanine) applied to both superior colliculi. A week later, IOP was unilaterally increased in the left eyes of animals from groups 2 to 5. IOP was monitored every other day in the operated (left) and contralateral (right) eyes during 2 weeks. Two weeks following hypertonic saline injection, vehicle (PBS) or siRNA (20 µg in PBS, either siRNA targeting Casp2 or a negative control siRNA targeting the non-mammalian gene, Green Fluorescent Protein), was administered by intravitreal (IVT) injection to the left (operated) eyes. The contralateral non-operated eyes received no IVT injection. In addition, two weeks after hypertonic saline injection, the animals from group 2 were sacrificed and DiI-labeled RGCs were counted in flat mounts of left retinas under fluorescence microscopy, in order to assess the extent of RGC loss at the time of siRNA injection. For all groups receiving IVT injection, IOP was measured once during the 3rd week of the experiment to confirm its increased state in the operated eyes. At 3 weeks of increased IOP, or at 1 week after the test and control article injections, the animals were sacrificed and DiI-labeled RGCs were counted in flat mounts of left retinas under fluorescence microscopy. Right retinas served as internal controls for labeling quality. A separate group of naïve rats in which RGC's were retrogradely labeled at the experiment commence was used as an intact control to provide a reference for normal RGC densities. 4 rats from this group were sacrificed at 2 weeks of ocular hypertension (together with group 2) and the remaining 9 rats—at 3 weeks (together with groups 3 to 5). The experimental design is shown in Table C22 below.

Animals

| | |
|---|---|
| Species: | Rats |
| Strain: | Brown Norway Rats |
| Modification: | N/A |
| Source: | Charles River (Canada) |
| Age: | Adult, retired breeders, 10-12 months of age |
| Body Weight Range: | 300-400 g |
| Sex: | Males |
| Animal Husbandry: | Diet: |
| | Environment: All animal procedures were performed in accordance with the guidelines of the Canadian Council on Animal Care for the use of experimental animals (http://www.ccac.ca/). |
| | Environment: (i) Acclimatization of at least 5 days. (ii) All the animals were confined in a limited-access facility with environmentally controlled housing conditions throughout the entire study period, and maintained in accordance with University of Montreal approved standard operating procedures (SOPs). |

Materials and Equipment

Substance (Unformulated Compound) CASP2_4_S510 (CASP2_4; CASP2 SIRNA; siRNA Against Caspase2 mRNA)

Supplied by Agilent

Description of the test material: A 19-mer chemically modified blunt-ended duplex having two separate strands, with a sense strand (SEN) comprising unmodified ribonucleotides (upper case letters), an L-deoxyribonucleotide at position 18 (bold, underlined) and inverted deoxyabasic moiety (iB) present at the 5' terminus of the SEN strand; and with an antisense strand (AS) comprising unmodified ribonucleotides (upper case letters), and 2'OMe sugar modified ribonucleotides (lower case letters) at positions 2, 4, 6, 8, 11, 13, 15, 17 and 19 as shown in Formula I.

Quantity supplied: 300 mg

Storage Conditions: −80° C.

Control Substance (unformulated compound) GFP_5_S763 (siRNA Against GFP mRNA)

Outsourcing (manufacturer's name): Agilent

Manufacturer's catalog #N/A

Quantity supplied: 220.8150 mg

Storage Conditions: −80° C.; Expiration Date: ND

Test/Control Article (formulated) CASP2_4/GFP_5 20 μg/5 μL of PBS 0.5 mg was diluted into 125 μl to achieve a stock solution of 4 μg/μl. These were subsequently aliquoted to 5 μl per tube and stored at −80° C.

Vehicle—PBS.

Multicell Phosphate buffered saline, solution 1×, without calcium, without magnesium (CAT. No: 311-010-EL).

Fluorescence microscopy was performed using a Zeiss Axioskop 2 Plus microscope (Carl Zeiss Canada, Kirkland, QC), images were captured with a CCD camera (Retiga, Qimaging) and processed with Northern Eclipse image analysis software (Empix Imaging, Mississauga, ON). Microphotographs were taken at 25× magnification.

Experimental Procedure

Surgery was be performed in adult male Brown Norway rats, retired breeders, between 10-12 months of age (300-400 g), under general anesthesia by intraperitoneal injection of 1 mL/Kg standard rat cocktail consisting of Ketamine (100 mg/mL), xylazine (20 mg/mL) and acepromazine (10 mg/mL).

Ocular hypertension surgery: Unilateral and chronic elevation of IOP was induced by using the Morrison model, involving an injection of hypertonic saline into a episcleral vein, leading to a blockade of the aqueous humor outflow pathways. This procedure lead to gradual increase of eye pressure and progressive death of RGS. All the animals in this study received only a single saline vein injection. The eye selected for the procedure was adapted with a plastic ring applied to the ocular equator to confine the saline injection to the limbal plexus. A micro needle (30-50 μm in diameter) was used to inject 50 μL of sterile 1.85 M NaCl solution through one episcleral vein. The plastic ring temporarily blocked off other episcleral veins forcing the saline solution into the Schlemm's canal to create isolated scarring. Animals were kept in a room with constant low fluorescent light (40-100 lux) to stabilize circadian IOP variation (8).

Measurement of intraocular pressure (IOP): IOP from glaucomatous and normal (contralateral) eyes was measured in awake animals using a calibrated tonometer (TonoPen XL, Medotronic Solan, Jacksonville, Fla.). IOP was measured every other day for the first two weeks after ocular hypertension surgery; and at least once between week 2 and week 3 after ocular hypertension surgery. Eyes become fragile after intraocular injections in conditions of high IOP, for this reason the number of IOP measurements was limited as this involves putting additional pressure on the cornea to get a reliable reading. The mean IOP (mmHg±S.E.M) per eye was considered as the average of all IOP readings since the onset of pressure elevation. The maximum IOP measurements in each individual eye, glaucomatous or normal contralateral eye was defined as the peak IOP and this value was used to estimate the mean peak IOP for each group Calculation of intraocular pressure (IOP): The mean IOP (mmHg±S.E.M) per eye was considered as the average of all IOP readings since the onset of pressure elevation. The maximum IOP measurements in each individual eye, glaucomatous or normal contra lateral eye was defined as the peak IOP and this value was used to estimate the mean peak IOP for each group. The positive integral IOP was calculated as the area under the IOP curve in the glaucomatous eye minus that of the fellow normal eye from ocular hypertension surgery to euthanasia. Integral IOP represents the total, cumulative IOP exposure throughout the entire experiment.

Study Design:

One week prior to induction of glaucoma, RGCs were retrogradely labeled using the fluorescent tracer DiI applied to both superior colliculi.

One week later, unilateral elevation of IOP was induced by injection of a hypertonic saline solution into an episcleral vein. This procedure was referred to as ocular hypertension surgery.

In a first experiment, prior to efficacy studies, the status of RGC loss in "no injection" groups at 2 and 3 weeks after ocular hypertension surgery (4 rats/group, total=8 rats) was assessed.

Exactly 2 weeks after ocular hypertension surgery, a single intravitreal injection of each siRNA was performed.

Animals were euthanized and retinas prepared for analysis of RGC survival at exactly 3 weeks after ocular hypertension surgery.

The density of surviving RGCs was quantified in 12 standard retinal areas.

TABLE C22

Study Design

| Group | n | Increased IOP | IVT Injection (μL/eye) 2 weeks post IOP induction | Dose Volume | Termination (Weeks Post IOP) |
|---|---|---|---|---|---|
| 1 (Intact) | 13 (4 + 9) | No | No | N/A | N/A |
| 2 | 4 | Yes | No | N/A | 2 |
| 3 | 6 | Yes | PBS Vehicle | 5 μL | 3 |
| 4 | 6 | Yes | Negative Control siRNA, 20 μg | 5 μL | 3 |
| 5 | 6 | Yes | CASP2 SIRNA, 20 μg | 5 μL | 3 |

*NA—non-applicable,
Group size: n = 5

Quantification of surviving RGC soma: Quantification of RGC bodies was performed in duplicate and in a masked fashion. For RGC density counts, rats were deeply anesthetized and then perfused transcardially with 4% paraformaldehyde (PFA) in 0.1 M phosphate buffer and both eyes were immediately enucleated. Retinas were dissected and flat-mounted on a glass slide with the ganglion cell layer side up. Under fluorescence microscopy, DiI-labeled neurons were counted in 12 standard retinal areas as described.

Results & Discussion

TABLE C23

Percent RGC from intact inference table

| Treat | N | Mean | Std | CV | Dunnett P-value |
|---|---|---|---|---|---|
| PBS | 6 | 62.37 | 5.86 | 9.40 | |
| CASP2_4 | 6 | 81.71 | 14.28 | 17.48 | 0.05 |
| 2wIOP | 4 | 71.25 | 6.75 | 9.47 | 0.19 |
| GFPsiRNA | 6 | 65.75 | 4.97 | 7.57 | 0.68 |
| intact | 13 | 100.00 | 2.84 | 2.84 | 0.00 |

Comparisons to PBS Treated Group

Preservation of RGC in CASP2_4 siRNA-treated eyes with increased IOP was significantly better than in the PBS treated group (1.31 fold higher from the PBS result; p-value=0.05). In GFP siRNA treated group no significant difference was found (p-value=0.68) with respect to PBS treated group.

No significant difference between IOP (2 weeks) to IOP (3 weeks) treated by PBS (p-value=0.19).

Comparisons to IOP (2 Weeks) Group

The intact group has significantly higher RGC density per mm2 than IOP (2 w) group (p-value=0.00). No significant differences in RGC density per mm2 were found between IOP (2 w) group and other IOP groups that were sacrificed after 3 weeks (p-value range from 0.16 to 0.44).

Comparisons to Intact Group

The intact group has significantly higher RGC density per mm2 than IOP groups that were treated by PBS, GFP siRNA and IOP(2 w) without treatment (p-value<0.01). No significant differences in RGC density per mm2 were found between IOP group treated by CASP2_4 siRNA compared to intact group (p-value=0.06).

These data demonstrate that a siRNA targeting Caspase2 provides protection of RGCs from damage induced by increased intraocular pressure and its administration at 2 weeks of increased IOP leads to cessation of further RGC loss.

IOP measurements were carried out as described above.

IOP: The Dunnett approach was used for comparison of the results to PBS treated group. Additional parameters were calculated and analyzed such as: AUC (area under the curve), Mean IOP and Max(IOP) along the duration of measurements.

Most animals show significant increase in IOP at 1-2 weeks after ocular hypertension surgery.

No significant differences in IOP levels were found among operated eyes in treated groups (0.7746). Likewise, no differences in IOP levels were found among contra lateral eyes in treated groups and intact eyes.

The results show that Casp2 siRNA induced neuroprotection even as IOP remained elevated in all treatment groups.

Results: No significant differences between groups were found in all three calculated IOP parameters

Example 11

Evaluation of Ocular Neuroprotective Efficacy of siRNA Compound Targeting Caspase 2 in the Axotomy Model The purpose of the present efficacy studies was to use a model of RGC apoptosis induced by axotomy of the optic nerve (ON) in adult Sprague-Dawley rats. The onset and kinetics of RGC death in this model system are very reproducible and allow for the establishment of the neuroprotective efficacy of Casp2_4 siRNA in vivo. Using this method, the time course of RGC death follows a predictable course: cell death begins on day 5 and proceeds to the rapid loss of more than 90% of these neurons by 2 weeks.

Methods

Retrograde labeling of RGCs: For the purpose of this study, RGCs were labeled by application of the retrograde tracer FluoroGold (2%, Fluorochrome, Englewood, Colo.) in the superior colliculus. Briefly, both superior colliculi were exposed and a small piece of gelfoam soaked in FluoroGold was applied to their surface. In adult rats, the time required to obtain full labeling of all RGCs following this procedure is ~1 week. For this reason, optic nerve axotomy and intraocular injection of siRNA molecules were performed one week after retrograde labeling of RGCs.

Optic nerve axotomy: The entire population of RGCs were axotomized by transecting the optic nerve close to the eye (0.5 to 1 mm). Retinal fundus examination was routinely performed after each axotomy to check the integrity of the retinal circulation after surgery. Animals showing signs of compromised blood supply were excluded from the study.

For intravitreal injection 10 μg in 5 μl of PBS each of the reagents, either Casp2_4 siRNA or GFP siRNA were microinjected into the vitreous body 2 mm anterior to the nerve head, perpendicular to the sclera, using a glass micropipette at the time of surgery, day 0, and then repeated at day 7.

Quantification of RGC survival: Experimental and control animals were perfused transcardially with 4% paraformaldehyde at 14 days after optic nerve axotomy. The left retinas (treated) and the right retinas (untreated controls) were dissected out, fixed for an additional 30 min and flat-mounted vitreal side up on a glass slide for examination of the ganglion cell layer. RGCs backfilled with FluoroGold were counted in 12 standard retinal areas. Microglia that may have incorporated FluoroGold after phagocytosis of dying RGCs were distinguished by their characteristic morphology and excluded from our quantitative analyses.

Experimental Design

Test article: CASP2_4L siRNA: a double-stranded 19-mer oligonucleotide chemically modified by 2'-O-methylation of sugar residues on the antisense strand and L-DNA on the sense strand. Targets caspase2 gene in multiple species.

Control Articles

PBS siRNA targeting GFP—a double-stranded 21-mer oligonucleotide chemically modified by 2'-O-methylation on both strands.

CNL—siRNA with no match to any known mammalian transcript; a double-stranded 19-mer oligonucleotide chemically modified by 2'-O-methylation on both strands. Table C24 shows groups treatments.

TABLE C24

Groups Treatments

| SiRNA | SiRNA Dose | Time of administration (post axotomy) | Time of analysis (post axotomy) | No. of animals per group | Sample preparation |
|---|---|---|---|---|---|
| SiGFP, axotomy (OS) | 10 ug × 2 | Time 0 1 week | 2 weeks | 8 | Flat mount |
| SiCasp2_4, Axotomy (OS) | 10 ug × 2 | Time 0 1 week | 2 weeks | 8 | Flat mount |

Results: The mean number of surviving RGCs in eyes treated with two intravitreal injections of 10 μg Casp2_4 siRNA and subjected to axotomy was 533±24 cells/mm2 at 14 days post injury. These counts were significantly greater than the mean RGC counts in eyes treated with GFP siRNA at the similar regiment and subjected to axotomy, which was 130±7 cells/mm2 at 14 days. In the nonsurgical control eyes, the mean number of RGCs was 2138±91 cells/mm2, which is comparable to the average number of RGCs reported in literature.

TABLE C25

Mean numbers of survival RGC 14 days post injury (n = 6 retinas/group)

| Treatment | GFP | Casp2_4 |
|---|---|---|
| Mean survival RGC (cells/mm2) | 130 | 533 |
| SE | 7 | 24 |
| % of RGC survival from total RGC | 6 | 25 |
| SE | 0.32 | 1.12 |

Data analyses and statistics were performed using the GraphPad Instat software by one-way analysis of variance (ANOVA). All data are given as mean±SE, significantly different at P<0.02.

Conclusions: The increased survival of the RGCs was due to neuroprotective effect by silencing pro-apoptotic Caspase 2 activation and up regulation following axotomy by treatment with siRNA targeting Caspase 2 gene.

Discussion: In the present studies, the Casp2_4 siRNA was neuroprotective for at least 30 days in an optic nerve crush model and for 14 days in axotomy model of RGC loss. Optic nerve crush and axotomy experiments provide a realistic model of acute optic neuropathies.

Non-Invasive Administration of siRNA Compounds Induces Ocular Neuroprotection In-Vivo in Animal Models of Ocular Neuronal Injury Example 12

Evaluation of Ocular Neuroprotective Efficacy of Non-Invasively Administered siRNA Compound Targeting Caspase 2 in the ONC Model Test article: CASP2_4 siRNA (compound of Formula I)

Control Articles:
  Methyl Cellulose
  CNL—siRNA with no match to any known mammalian transcript; a double-stranded 19-mer oligonucleotide stabilized by 2'-O-methylation on both strands.

Design: Retinal ganglion cells (RGC) were selectively labeled first by application of the retrograde tracer FluoroGold to the superior colliculus. One week later, animals were subjected to optic nerve crush injury (ONC). Eye drops were applied every other day during one week (3 times over all). 100 μg/3 μl CNL_1, or Casp2_4 siRNA or 3 μl of MC vehicle were applied, the first dose was applied 10 minutes after ONC. The quantifications of surviving RGCs were carried out at day 7 after ONC by counting FluoroGold-labelled RGCs on flat-mounted retinas.

Results: The mean number of surviving RGCs in eyes treated with 20 μg Casp2_4 siRNA and subjected to optic nerve crush was 445±17 cells/mm2 at 7 days post injury. These counts were significantly greater than the mean RGC counts in eyes treated with either PBS or CNL_1 siRNA and subjected to nerve crush, which were 337±11 cells/mm$^2$, 341.6±13 cells/mm$^2$, respectively, at 7 days. Table C26 shows results. All data are given as mean±standard deviation. Values were compared using one-way analysis of variance (ANOVA) and considered as significantly different at P<0.01.

TABLE C26

Mean numbers of survival RGCs 7 days post injury.

| | CNL_1 | Casp2_4 | MC vehicle |
|---|---|---|---|
| Average | 341.625 | 445.4375 | 337.5 |
| SD | 13.03265 | 17.222331 | 11.3389342 |
| cells/mm2 | 934.6785 | 1218.7073 | 923.392613 |
| Sd | 35.65705 | 47.119921 | 31.0230758 |
| RGC/retina | 26470.1 | 34513.789 | 26150.4788 |
| SD | 1009.808 | 1334.4362 | 878.573505 |
| % total | 26.4701 | 34.513789 | 26.1504788 |
| SD | 1.009808 | 1.3344362 | 0.87857351 |
| Average | 341.625 | 445.4375 | 337.5 |
| SD | 13.03265 | 17.222331 | 11.3389342 |

Conclusions: The increased survival of the RGCs was due to neuroprotective effect of silencing pro-apoptotic Caspase 2 following ONC injury by treatment with eye drops containing siRNA targeting Caspase 2 gene in a methyl cellulose formulation.

Example 13

Evaluation of Ocular Neuroprotective Efficacy of Non-Invasively Administered siRNA Compound Targeting Caspase 2 in the IOP Model Experimental Setup:
  Experimental animals: All animal procedures are performed in accordance with the guidelines of the Canadian Council on Animal Care for the use of experimental animals (http://www.ccac.ca/). Surgeries are performed in adult male Brown Norway rats, retired breeders, between 10-12 months of age (300-400 g), under general anesthesia by intraperitoneal injection of 1 ml/kg standard rat cocktail consisting of ketamine (100 mg/ml), xylazine (20 mg/ml) and acepromazine (10 mg/ml).

Retrograde labeling of RGCs: For neuronal survival experiments, RGCs are retrogradely labeled with 3% DiI (1,1'-dioctadecyl-3,3,3',3'-tetramethyl-indocarbocyanine perchlorate; Molecular Probes, Junction City, Oreg.), a fluorescent carbocyanine marker that persists for several months without fading or leakage and does not interfere with the function of labeled cells. For retrograde labeling, both superior colliculi, the main targets of RGCs in the brain, are exposed and a small piece of gelfoam (Pharmacia and Upjohn Inc., Mississauga, ON) soaked in DiI will be applied to their surface. Seven days after DiI application, the time required for labeling the entire RGC population, animals are subjected to ocular hypertension surgery as described below.

Ocular hypertension surgery: Unilateral and chronic elevation of IOP are induced using a method that involves injection of a hypertonic saline solution into an episcleral vein. All the animals involved in this study receive only a single saline vein injection. The eye selected for the procedure is adapted with a plastic ring applied to the ocular equator to confine the saline injection to the limbal plexus. A microneedle (30-50 µm in diameter) is be used to inject 50 µl of sterile 1.85 M NaCl solution through one episcleral vein. The plastic ring temporarily blocks off other episcleral veins forcing the saline solution into the Schlemm's canal to create isolated scarring. Animals are kept in a room with constant low fluorescent light (40-100 lux) to stabilize circadian IOP variation.

Measurement of intraocular pressure (IOP): IOP from glaucomatous and normal (contralateral) eyes is measured in awake animals using a calibrated tonometer (TonoPen XL, Medtronic Solan, Jacksonville, Fla.). IOP is measured every other day for the first two weeks after ocular hypertension surgery; and at least once between week 2 and week 3 after ocular hypertension surgery. Eyes become fragile after intraocular injections in conditions of high IOP (see below), so it is advisable to limit the number of IOP measurements as this involves putting additional pressure on the cornea to get a reliable reading. The mean IOP (mm Hg±S.E.M.) per eye is considered as the average of all IOP readings since the onset of pressure elevation. The maximum IOP measured in each individual eye, glaucomatous or normal contralateral eye is defined as the peak IOP and this value is used to estimate the mean peak IOP for each group. The positive integral IOP is calculated as the area under the IOP curve in the glaucomatous eye minus that of the fellow normal eye from ocular hypertension surgery to euthanasia. Integral IOP represents the total, cumulative IOP exposure throughout the entire experiment.

Intraocular injection of siRNA molecules: Intraocular injections are performed by infusing each siRNA compound at a concentration of 20 µg into the vitreous chamber of the left eye (total injection volume: 5 µl). The right eye serves as contralateral control. In addition, non-operated eyes from naïve rats are used as intact controls. Intravitreal injections are performed using a 10-µl Hamilton syringe adapted with a ~32-gauge glass needle. The needle tip is inserted into the superior hemisphere of the eye, at the level of the pars plana, at a 45° angle through the sclera into the vitreous body. This route of administration avoids retinal detachment or injury to eye structures, including the lens and the iris, which can release factors that induce RGC regeneration and survival. The injection is performed over a period of 2 min and the needle is kept in place for an additional 2 min, after which it is gently removed. Surgical glue (Indermill, Tyco Health Care, Mansfield, Mass., USA) will be used to seal the site of injection.

Topical Eye Drop Instillation of siRNA Molecules:

Daily during week 3 after IOP induction a 3 µl sample volume of 100 µg of siRNA are applied to the corneal surface bilaterally to the anesthetized animals, by a blunt pipette tip (filter tips 10 µl sterile (short)). The animals are placed in a warm environment to prevent anesthesia-induced hypothermia Quantification of surviving RGC soma: Quantification of RGC bodies is performed in duplicate and in a masked fashion. For RGC density counts, rats are deeply anesthetized and then perfused transcardially with 4% paraformaldehyde (PFA) in 0.1 M phosphate buffer and both eyes are immediately enucleated. Retinas are dissected and flat-mounted on a glass slide with the ganglion cell layer side up. Under fluorescence microscopy, DiI-labeled neurons is counted in 12 standard retinal areas as described.

IOP (intra ocular pressure) is induced and followed for 2 weeks. Then, CASP2_4 or control siRNA are administered by either Eye Drop (siRNA in a 2% methyl cellulose formulation) or IVT (siRNA in PBS) as detailed in the study design in Table C27.

TABLE C27

Study Design

| Group | Treatment | Intravitreal injection (5 uL) | | Eye drops (3 uL/eye) | | Termination |
|---|---|---|---|---|---|---|
| | | Dose | Frequency | Dose | Frequency | |
| 1 | CASP2_4 | 20 ug | Once a week starting at 2 weeks after IOP induction (total 3 times during weeks 3, 4, 5) | NA* | NA | 5 weeks after IOP induction |
| 2 | SiGFP | 20 ug | Once a week starting at 2 weeks after IOP induction (total 3 times during weeks 3, 4, 5) | NA* | NA | 5 weeks after IOP induction |
| 3 | CASP2_4 | 20 ug | Once after 2 weeks of IOP induction at the beginning of week 3 | 100 ug | Daily during weeks 4 and 5 after IOP induction | 5 weeks after IOP induction |
| 4 | siGFP | 20 ug | Once after 2 weeks of IOP induction at the beginning of week 3 | 100 ug | Daily during weeks 4 and 5 after IOP induction | 5 weeks after IOP induction |
| 5 | CASP2_4 | | | 100 ug | Daily during week 3 after IOP induction | 3 weeks after IOP induction |
| 6 | siGFP | | | 100 ug | Daily during week 3 after IOP induction | 3 weeks after IOP induction |

*NA—non-applicable, Group size: n = 5

The results show that non-invasive delivery of siRNA formulated in a 2% methyl cellulose formulation provides neuroprotection and increases neuronal survival.

Example 14

Rat Optic Nerve Crush (ONC) Model: Comparison of Intravitreal siRNA Delivery to Topical Eye Drop Delivery For optic nerve transsection the orbital optic nerve (ON) of anesthetized rats is exposed through a supraorbital approach, the meninges severed and all axons in the ON transected by crushing with forceps for 10 seconds, 2 mm from the lamina cribrosa.

The siRNA compounds are delivered alone or in combination in 5 uL volume (20 ug/uL) as eye drops. Immediately after optic nerve crush (ONC), 20 ug/10 ul test siRNA or 10 ul PBS is administered by IVT to one or both eyes of adult Wistar rats. After that, siRNA is applied to the eye by ED every other day and the levels of siRNA taken up into the dissected and snap frozen whole retinas at 5 hours and 1 day, and later at 2 days, 4 days, 7 days, 14 days and 21 days post injection is determined. Similar experiments are performed in order to test activity and efficacy of siRNA administered via eye drops.

Table C28 below shows an experimental procedure to determine efficacy of test siRNAs (siTEST1; siTEST2) alone or in combination, in the ONC model. Additional dosing parameters, concentrations, termination schedules, formulations and the like are contemplated.

TABLE C28

Study Design

| Group (n = 8) | Right eye (n = 8) | Left eye (n = 8) | termination |
|---|---|---|---|
| 1 and 2 | 20 μg siTEST1 on days 0 and 7 (intravitreal) | 20 μg siGFP on days 0 and 7 (intravitreal) | Day 21 |
| 3 and 4 | 20 μg siTEST1 on days 10 and 20 (intravitreal) | 20 μg siGFP on days 10 and 20 (intravitreal) | Day 30 |
| 5 and 6 | PBS (eye drops) every other day starting from day 0, 3 times/week | PBS on days 0 and 7 (intravitreal) | Day 21 |
| 7 and 8 | 50 μg siTEST1 (eye drops) every other day starting from day 0, 3 times/week | 50 μg siGFP (eye drops) every other day starting from day 0, 3 times/week | Day 10 |
| 9 and 10 | 50 μg siTEST1 (eye drops) every other day starting from day 0, 3 times/week | 50 μg siGFP (eye drops) every other day starting from day 0, 3 times/week | Day 21 |
| 11 and 12 | 50 μg siTEST2 (eye drops) every other day starting from day 0, 3 times/week | 50 μg siGFP (eye drops) every other day starting from day 0, 3 times/week | Day 21 |
| 13 and 14 | 20 μg siTEST1 + 20 μg siTEST2 (eye drops) every other day starting from day 0, 3 times/week | 40 μg siGFP on days 0, 7 and 20 (eye drops) every other day starting from day 0, 3 times/week | Day 21 |
| 15 and 16 | 20 μg siTEST1 + 20 μg siTEST2 on days 0, and 10 (intravitreal) n = 4 | 40 μg siGFP on days 0 and 10 (intravitreal) n = 4 | Day 21 |

Results: According to the results that are obtained in this study non-invasive delivery of siRNA compound designed for down regulation of a target gene provides neuroprotection and increases neuronal survival in the retina.

Tables B1-B26 disclose oligonucleotide pairs of sense and antisense nucleic acids useful in synthesizing unmodified or chemically modified siRNA compounds. The tables disclose the position of the sense strand along the mRNA for at least one variant.

Lengthy table referenced here

US08765931-20140701-T00001

Please refer to the end of the specification for access instructions.

Lengthy table referenced here

US08765931-20140701-T00002

Please refer to the end of the specification for access instructions.

Lengthy table referenced here

US08765931-20140701-T00003

Please refer to the end of the specification for access instructions.

Lengthy table referenced here

US08765931-20140701-T00004

Please refer to the end of the specification for access instructions.

Lengthy table referenced here

US08765931-20140701-T00005

Please refer to the end of the specification for access instructions.

Lengthy table referenced here
US08765931-20140701-T00006

Please refer to the end of the specification for access instructions.

Lengthy table referenced here
US08765931-20140701-T00007

Please refer to the end of the specification for access instructions.

Lengthy table referenced here
US08765931-20140701-T00008

Please refer to the end of the specification for access instructions.

Lengthy table referenced here
US08765931-20140701-T00009

Please refer to the end of the specification for access instructions.

Lengthy table referenced here
US08765931-20140701-T00010

Please refer to the end of the specification for access instructions.

Lengthy table referenced here
US08765931-20140701-T00011

Please refer to the end of the specification for access instructions.

Lengthy table referenced here
US08765931-20140701-T00012

Please refer to the end of the specification for access instructions.

Lengthy table referenced here
US08765931-20140701-T00013

Please refer to the end of the specification for access instructions.

Lengthy table referenced here
US08765931-20140701-T00014

Please refer to the end of the specification for access instructions.

Lengthy table referenced here
US08765931-20140701-T00015

Please refer to the end of the specification for access instructions.

Lengthy table referenced here
US08765931-20140701-T00016

Please refer to the end of the specification for access instructions.

Lengthy table referenced here
US08765931-20140701-T00017

Please refer to the end of the specification for access instructions.

Lengthy table referenced here
US08765931-20140701-T00018

Please refer to the end of the specification for access instructions.

Lengthy table referenced here
US08765931-20140701-T00019

Please refer to the end of the specification for access instructions.

Lengthy table referenced here
US08765931-20140701-T00020

Please refer to the end of the specification for access instructions.

Lengthy table referenced here
US08765931-20140701-T00021

Please refer to the end of the specification for access instructions.

| | |
|---|---|
| 101 | 102 |
| Lengthy table referenced here US08765931-20140701-T00022 Please refer to the end of the specification for access instructions. | Lengthy table referenced here US08765931-20140701-T00029 Please refer to the end of the specification for access instructions. |
| Lengthy table referenced here US08765931-20140701-T00023 Please refer to the end of the specification for access instructions. | Lengthy table referenced here US08765931-20140701-T00030 Please refer to the end of the specification for access instructions. |
| Lengthy table referenced here US08765931-20140701-T00024 Please refer to the end of the specification for access instructions. | Lengthy table referenced here US08765931-20140701-T00031 Please refer to the end of the specification for access instructions. |
| Lengthy table referenced here US08765931-20140701-T00025 Please refer to the end of the specification for access instructions. | Lengthy table referenced here US08765931-20140701-T00032 Please refer to the end of the specification for access instructions. |
| Lengthy table referenced here US08765931-20140701-T00026 Please refer to the end of the specification for access instructions. | Lengthy table referenced here US08765931-20140701-T00033 Please refer to the end of the specification for access instructions. |
| Lengthy table referenced here US08765931-20140701-T00027 Please refer to the end of the specification for access instructions. | Lengthy table referenced here US08765931-20140701-T00034 Please refer to the end of the specification for access instructions. |
| Lengthy table referenced here US08765931-20140701-T00028 Please refer to the end of the specification for access instructions. | Lengthy table referenced here US08765931-20140701-T00035 Please refer to the end of the specification for access instructions. |
| | Lengthy table referenced here US08765931-20140701-T00036 Please refer to the end of the specification for access instructions. |

LENGTHY TABLES

The patent contains a lengthy table section. A copy of the table is available in electronic form from the USPTO web site (http://seqdata.uspto.gov/?pageRequest=docDetail&DocID=US08765931B2). An electronic copy of the table will also be available from the USPTO upon request and payment of the fee set forth in 37 CFR 1.19(b)(3).

SEQUENCE LISTING (33596 sequences)

SEQ ID NO: 1 - RNA, 4145 nt, Homo sapiens
ggguggccuggugugugggcgcggcagggcgcaggcgcaggcgcagugugcguccgcgucugaggggagggaugugggggaagcgacggcccccgguuuguuugggcugugggcggugcgcagcggagagcccgggaaaagcgggaaauggcggcgccgagcgcggggucuugguccaccuuccagcacaaggagcugauggccgcugacaggggacgcaggauauugggaguguguggcaugcauccucaucaucaggaaacucuaaaaaagaaccgaguggugcuagccaaacagcuguuguugagcgaauuguuagaacaucuucuggagaaggacaucaucaccuuggaaaugagggagcucauccaggccaaagugggcaguuucagccagaauguggaacuccucaacuugcugccuaagagggguccccaagcuuuugaugccuucugugaagcacugagggagaccaagcaaggccaccuggaggauauguugcucaccacccuuucugggcuucagcauguacucccaccguugagcugugacuacgacuugagucucccuuuuccggugugugaguccuguccccuuuacaagaagcuccgccugucgacagauacuguggaacacucccuagacaauaaagaugguccugucugccuucaggugaagccuugcacuccugaauuuuaucaaacacacuuccagcuggcauauagguugcagucucggccucguggccuagcacugguguugagcaaugugcacuucacuggagagaaagaacuggaauuucgcucuggaggggauguggaccacaguacucuagucacccucuucaagcuuuugggcuaugacguccauguucuaugugaccagacugcacaggaaaugcaagagaaacugcagaauuuugcacaguuaccugcacaccgagucacggacuccugcaucguggcacuccucucgcaugguguggagggcgccaucuaugguguggaugggaaacugcuccagcuccaagagguuuuucagcucuuugacaacgccaacugcccaagccuacagaacaaaccaaaaauguucuucauccaggccugccguggagaugagacugaucgugggguugaccaacaagauggaaagaaccacgcaggauccccugggugcgaggagagugaugccgguaaagaaaaguugccgaagaugagacugcccacgcgcucagacaugauaugcggcuaugccugccucaaagggacugccgccaugcggaacaccaaacgagguuccugguacaucgaggcucuugcucaaguguuuucugagcgggcuugugauaugcacguggccgacaugcugguuaaggugaacgcacuuaucaaggaucgggaagguuaugcuccuggcacagaauuccaccggugcaaggagaugucugaauacugcagcacucugugccgccaccucuaccuguucccaggacacccucccacaugaugucaccuccccaucauccacgccaaguggaagccacuggaccacaggaggugugauagagccuuugaucuucaggaugcacgguuucuguucugcccccucagggaugugggaaucucccagacuuguuuccugugcccaucaucucugccuuugagugugggacuccaggccagcuccuuuucugugaagcccuuugccuguagagccagccuugguuggaccuauugccaggaauguuucagcugcaguugaagagccugacaagugaaguuguaaacacagugugguuauggggagagggcauauaaauuccccauauuuguguucaguuccagcuuuuguagauggcacuuuagugauugcuuuuauuacauuaguuaagaugucugagagaccaucuccuaucuuuuauuucauucauauccuccgcccuuuuuguccuagagugagaguuuggaagguguccaaauuuaauguagacauuaucuuuuggcucugaagaagcaaacaugacuagagacgcaccuugcugcaguguccagaagcggccugugcguucccuucaguacugcagcgccacccaguggaaggacacucuuggcucguuugggcucaaggcaccgcagccugucagccaacauugccuugcauuuguaccuuauugaucuuugcccauggaagucucaaagaucuuucguugguuguuucucugagcuuuguuacugaaaugagccucguggggagcaucagagaaggccaggaagaaugguguguuucccuagacucuguaaccaccucucugucuuuuuccuuccugagaaacguccaucucucucccuuacuauucccacuuucauucaaucaaccugcacuucauaucuagauuucuagaaaagcuuccuagcuuaucucccugcuucauaucucucccuucuuuaccuucauuucauccuguuggcugcugccaccaaaucugucuagaauccugcuuuacaggaucauguaaaugcucaaagauguaauguaguucuuuguuccugcuuucucuuucaguauuaaacucuccuuugauauuauguggcuuuuauuucagugccauacauguuauuguuuucaaccuagaaaccuuuaucccugcuuaucugaaacuucccaacuucccuguucuuuaagacuuuuuuuuuuuuuuuuuuuuuuuuugagacagagucucgcucugucgcccaggcuggagggcaguggcacgaucucagcucacugcaagcuccaacucccggguucacgccauucuccugccucagccuuccaaguagcugggacuacaggugcccgccaccgugcccggcuaauuuuuuuguauuuuuaguagagacaggguuucaccauguuagccgggauggucuugaucuccugaccucaugauccacccaccucagccucccaaaguguugggauuacaggcgugagccacugcgcccgggcaagaccuuuuuuuaaaaaaaaaaaaaaaaaaacuuccauucuuucuuccuccagucuguucucacauaacagaguaguuuugguuuuuaauuuuuuuugguuguuugcuguuuuuuguuuuuuaaggugaguucucacuauguuucucagacuggucucgaacuccuggccucaagccaucuucccgccucagccucucaaauagcugggcuuacaggcaugagccaccacaccuggccaggauuugguuguuuaaauauaaaucugaucaccccccugcuuagaacccuucugcuuucuauuaccccucauuuaaaauguaaacucuucaccuugguuuaugagaacugguucuugccuuccccuugaaccucauuaaauggugauuucuugcuaagcuccagcccgaguggucuccucucagcuucuaauuuugugcucuuuccugcccuuuuccugggccuucucagcucuccacccccaccacucuugacucaggugguguccuucuuccucaagucuugacaauucccgggcccuucagucccugagcagucuacuucugugucugucaccacaucuugucuuuuccccucauugcauuuauugcaguuuauauauaugcuacuuuuacuuguucauuucugucuccccuaccaggcuguaaaugagggcagaaaccuuguuuguuuuauucaccaucauguaccaagugcuuggcacauagugggccuucauuaaauguuuguugaauaaaagagggaagaaggcaagccaaccuuagcuacaauccuaccuuuugauaaaauguuccuuuugacaauauacacggauuauuauuuguacuuuguuuuuccauguguuuugcuuuuauccacuggcauuuuuagcuccuugaagacauaucaugugugagauaacuuccuucacaucucccauggucccuagcaaaaugcuaggccuguaguagucaaggugcucaauaaauauuuguuugggugguuugugagccuugcugccaaguccugccuuugggucgacauaguauggaaguauuugagagagagaaccuuuccacucccacugccaggauuuuguauugccaucgggugccaaauaaaugcucauauuuauuaaaaaaaaaaaaaaaaaaa

SEQ ID NO: 2 - RNA, 3927 nt, Homo sapiens
ggguggccuggugugugggcgcggcagggcgcaggcgcaggcgcagugugcguccgcgucugaggggagggaugugggggaagcgacggcccccgguuuguuugggcugugggcggugcgcagcggagagcccgggaaaagcgggaaauggcggcgccgagcgcggggucuugguccaccuuccagcacaaggagcugauggccgcugacaggggacgcaggauauugggaguguguggcaugcauccucaucaucaggaaacucuaaaaaagaaccgaguggugcuagccaaacagcuguuguugagcgaauuguuagaacaucuucuggagaaggacaucaucaccuuggaaaugagggagcucauccaggccaaagugggcaguuucagccagaauguggaacuccucaacuugcugccuaagagggguccccaagcuuuugaugccuucugugaagccuugcacuccugaauuuuaucaaacacacuuccagcuggcauauagguugcagucucggccucguggccuagcacugguguugagcaaugugcacuucacuggagagaaagaacuggaauuucgcucuggaggggauguggaccacaguacucuagucacccucuucaagcuuuugggcuaugacguccauguucuaugugaccagacugcacaggaaaugcaagagaaacugcagaauuuugcacaguuaccugcacaccgagucacggacuccugcaucguggcacuccucucgcaugguguggagggcgccaucuaugguguggaugggaaacugcuccagcuccaagagguuuuucagcucuuugacaacgccaacugcccaagccuacagaacaaaccaaaaauguucuucauccaggccugccguggagaugagacugaucgugggguugaccaacaagauggaaagaaccacgcaggauccccugggugcgaggagagugaugccgguaaagaaaaguugccgaagaugagacugcccacgcgcucagacaugauaugcggcuaugccugccucaaagggacugccgccaugcggaacaccaaacgagguuccugguacaucgaggcucuugcucaaguguuuucugagcgggcuugugauaugcacguggccgacaugcugguuaaggugaacgcacuuaucaaggaucgggaagguuaugcuccuggcacagaauuccaccggugcaaggagaugucugaauacugcagcacucugugccgccaccucuaccuguucccaggacacccucccacaugaugucaccuccccaucauccacgccaaguggaagccacuggaccacaggaggugugauagagccuuugaucuucaggaugcacgguuucuguucugcccccucagggaugugggaaucucccagacuuguuuccugugcccaucaucucugccuuugagugugggacuccaggccagcuccuuuucugugaagcccuuugccuguagagccagccuugguuggaccuauugccaggaauguuucagcugcaguugaagagccugacaagugaaguuguaaacacagugugguuauggggagagggcauauaaauuccccauauuuguguucaguuccagcuuuuguagauggcacuuuagugauugcuuuuauuacauuaguuaagaugucugagagaccaucuccuaucuuuuauuucauucauauccuccgcccuuuuuguccuagagugagaguuuggaagguguccaaauuuaauguagacauuaucuuuuggcucugaagaagcaaacaugacuagagacgcaccuugcugcaguguccagaagcggccugugcguucccuucaguacugcagcgccacccaguggaaggacacucuuggcucguuugggcucaaggcaccgcagccugucagccaacauugccuugcauuuguaccuuauugaucuuugcccauggaagucucaaagaucuuucguugguuguuucucugagcuuuguuacugaaaugagccucguggggagcaucagagaaggccaggaagaaugguguguuucccuagacucuguaaccaccucucugucuuuuuccuuccugagaaacguccaucucucucccuuacuauucccacuuucauucaaucaaccugcacuucauaucuagauuucuagaaaagcuuccuagcuuaucucccugcuucauaucucucccuucuuuaccuucauuucauccuguuggcugcugccaccaaaucugucuagaauccugcuuuacaggaucauguaaaugcucaaagauguaauguaguucuuuguuccugcuuucucuuucaguauuaaacucuccuuugauauuauguggcuuuuauuucagugccauacauguuauuguuuucaaccuagaaaccuuuaucccugcuuaucugaaacuucccaacuucccuguucuuuaagacuuuuuuuuuuuuuuuuuuuuuuuuugagacagagucucgcucugucgcccaggcuggagggcaguggcacgaucucagcucacugcaagcuccaacucccggguucacgccauucuccugccucagccuuccaaguagcugggacuacaggugcccgccaccgugcccggcuaauuuuuuuguauuuuuaguagagacaggguuucaccauguuagccgggauggucuugaucuccugaccucaugauccacccaccucagccucccaaaguguugggauuacaggcgugagccacugcgcccgggcaagaccuuuuuuuaaaaaaaaaaaaaaaaaaacuuccauucuuucuuccuccagucuguucucacauaacagaguaguuuugguuuuuaauuuuuuuugguuguuugcuguuuuuuguuuuuuaaggugaguucucacuauguuucucagacuggucucgaacuccuggccucaagccaucuucccgccucagccucucaaauagcugggcuuacaggcaugagccaccacaccuggccaggauuugguuguuuaaauauaaaucugaucaccccccugcuuagaacccuucugcuuucuauuaccccucauuuaaaauguaaacucuucaccuugguuuaugagaacugguucuugccuuccccuugaaccucauuaaauggugauuucuugcuaagcuccagcccgaguggucuccucucagcuucuaauuuugugcucuuuccugcccuuuuccugggccuucucagcucuccacccccaccacucuugacucaggugguguccuucuuccucaagucuugacaauucccgggcccuucagucccugagcagucuacuucugugucugucaccacaucuugucuuuuccccucauugcauuuauugcaguuuauauauaugcuacuuuuacuuguucauuucugucuccccuaccaggcuguaaaugagggcagaaaccuuguuuguuuuauucaccaucauguaccaagugcuuggcacauagugggccuucauuaaauguuuguugaauaaaagagggaagaaggcaagccaaccuuagcuacaauccuaccuuuugauaaaauguuccuuuugacaauauacacggauuauuauuuguacuuuguuuuuccauguguuuugcuuuuauccacuggcauuuuuagcuccuugaagacauaucaugugugagauaacuuccuucacaucucccauggucccuagcaaaaugcuaggccuguaguagucaaggugcucaauaaauauuuguuugggugguuugugagccuugcugccaaguccugccuuugggucgacauaguauggaaguauuugagagagagaaccuuuccacucccacugccaggauuuuguauugccaucgggugccaaauaaaugcucauauuuauuaaaaaaaaaaaaaaaaaaa

SEQ ID NO: 3 - RNA, 1752 nt, Homo sapiens
agggcgcagcaggccaagggggaggugcgagcguggaccugggacgggucugggcggcucucggugguuggcacggguucgcacacccauucaagcggcaggacgcacuugucuuagcaguucucgcugaccgcgcuagcugcggcuucuacgcuccggcacucugaguucaucagcaaacgcccuggcgucuguccucaccaugccuagccuuugggaccgcuucucgucgucguccaccuccucuucgcccucguccuugccccgaacucccaccccagaucggccgccgcgcucagccugggggucggcgacccgggaggagggguuugaccgcuccacgagccuggagagcucggacugcgagucccuggacagcagcaacaguggcuucgggccggaggaagacacggcuuaccuggauggggugucguugcccgacuucgagcugcucagugacccugaggaugaacacuugugugccaaccugaugcagcugcugcaggagagccuggcccaggcgcggcugggcucucgacgcccugcgcgccugcugaugccuagccaguugguaagccaggugggcaaagaacuacugcgccuggccuacagcgagccgugcggccugcggggggcgcugcuggacgucugcguggagcagggcaagagcugccacagcgugggccagcuggcacucgaccccagccuggugcccaccuuccagcugacccucgugcugcgccuggacucacgacucuggcccaagauccaggggcuguuuagcuccgccaacucucccuuccucccuggcuucagccagucccugacgcugagcacuggcuuccgagucaucaagaagaagcuguacagcucggaacagcugcucauugaggaguguugaacuucaaccugagggggccgacagugcccuccaagacagagacgacugaacuuuugggguggagacuagaggcaggagcugagggacugauuccugugguuggaaaacugaggcagccaccuaagguggaggugggggaauaguguuucccaggaagcucauugaguugugugcggguggcugugcauuggggacacauaccccucaguacuguagcaugaaacaaaggcuuaggggccaacaaggcuuccagcuggauguguguguagcauguaccuuauuauuuuuguuacugacaguuaacaguggugugacauccagagagcagcugggcugcucccgccccagcccggcccagggugaaggaagaggcacgugcuccucagagcagccggagggaggggggaggucggaggucguggaggugguuuguguaucuuacuggucugaagggaccaaguguguuuguuguuuguuuuguaucuuguuuuucugaucggagcaucacuacugaccuguuguaggcagcuaucuuacagacgcaugaauguaagaguaggaaggggugggugucagggaucacuugggaucuuugacacuugaaaaauuacaccuggcagcugcguuuaagccuucccccaucguguacugcagaguugagcuggcaggggaggggcugagagggugggggcuggaaccccuccccgggaggagugccaucugggucuuccaucuagaacuguuuacaugaagauaagauacucacuguucaugaauacacuugauguucaaguauuaagaccuaugcaauauuuuuuacuuuucuaauaaacauguuuguuaaaacaguu

SEQ ID NO: 4 - RNA, 4976 nt, Homo sapiens
gggcgggcgggccgcaggcugucgggcuggggcugaggcugaggcugagguugaggcggcggcggcggcggccgggugcccgggacagcgacgcagcgcgccggcggccgcgacagggccagcgagagccccgcagcccgccgcagcugccgccucgccgcggccgggccggagagcacggcggcgggagcgcggccuuaggaggcggccggagcggugggcacagcucggcgcggagcguccugucaggcggcggccgagggcgucgcggacucuccccgcgaugaugccgaugauauuaacuguuuucuugagcaacaaugaacagauuuuaacagaaguuccuauaacaccggaaacaaccugucgagauguuguagaauuuugcaaggaaccuggagaaggcagcugccauuuagcugaaguguggaggggaaaugaacgucccauacccuuugaucauaugauguacgaacaucuucagaaaugggguccacggagggaagaagugaaauuuuuccuucgacacgaggacuccccaacugagaacagugaacaagguggccgucagacccaagagcaacgaacucagagaaauguaauaaauguaccuggagaaaaacguacugaaaaugggguugggaauccacguguugaacuuacccucucagagcuccaagauauggcagcuaggcaacagcagcagauugaaaaucagcagcagauguugguugccaaggaacagcguuuacauuuucuaaagcaacaggagcgccgucagcagcagucuauuucugaaaaugaaaagcuucagaaauugaaagaacgaguugaagcccaggagaacaagcugaagaaaauucgugcaaugagaggacaagucgacuacagcaaaaucaugaacggcaaucugucugcugaaauagaaagguucagugccauguuccaggaaaagaagcaggaaguacagacugcaauuuuaaggguugaucagcuuagucagcaauuggaagauuuaaagaaaggaaaacugaauggguuccagucuuacaauggcaaauugacgggaccagcggcgguggaguuaaaaagacuguaccaagaacuacagauucguaaccaacuuaaccaggaacaaaauucaaaacuucagcagcagaaggaacucuuaaauaagcgcaacauggagguggccaugauggacaagcgaaucagugaacugcgugaacgucucuaugggaaaaaaauucagcugaaccgugugaauggcacgucaucaccacaguccccucugagcacaucgggcagggucgcugcuguggggccuuauauccagguucccagugccggaagcuuuccugugcugggggacccuauaaagccccagucucucaguauugccucaaaugcugcucauggaagauccaaauccgcuaaugauggaaacuggccaacauuaaaacagaauucuagcucuuccgugaaaccagugcagguggccggugcagacuggaaggauccgagcguggaggggucugucaagcagggcacugucuccagccagccugugcccuucucagcacugggacccacggagaagccgggcaucgagauugguaaagugccaccucccaucccggguguaggcaagcagcugccuccaagcuaugggacauacccaaguccuacaccucuggguccugggucgacaagcucccuggaaaggaggaaggaaggcagcuugcccaggcccagugcaggccugccaagucgacagaggcccacccugcugcccgccacaggcagcaccccccagccaggcuccucacaacagauucagcagaggauuuccguaccgccaagucccacguacccgccagcgggaccaccugcauuuccagcuggggacagcaagccugaacucccacugacaguggccauuaggccuuuccuggcugauaaagggucaaggccacagucucccaggaaaggaccccagacagugaauucaaguuccauauacuccauguaccuccagcaagccacaccaccuaagaauuaccagccggcagcacacagcgccuuaaauaagucaguuaaagcaguguaugguaagcccguuuuaccuucggguucaaccucuccaucgccgcugccguuucuucacgggucacuguccacgggcacaccacagccucagccaccuucagaaaguacugagaaagagccugagcaggauggccccgccgcccccgcagauggcagcaccguggagagccugccacggccacucagccccaccaagcucacgcccaucgugcauucgccacugcgcuaccagagugaugcagaccuggaggcccuccgcaggaagcuggccaacgcgccccggccccugaaaaagcgcagcuccaucacagagcccgagggccccggcgggcccaacauccagaagcugcuguaccagcgcuucaacacccuggccgguggcauggagggcaccccuuucuaccagcccagccccucccaggacuucaugggcaccuuggccgauguggacaauggaaacaccaaugccaauggaaaccuggaagagcuccccccugcccagcccacagccccacuccccgcugagccugccccgucaucagaugccaaugauaaugaguuaccuucccccgaaccagaggagcucaucuguccccaaaccacccaccaaacugccgagccggcagaggacaauaacaacaacguggccacgguccccaccacggagcagaucccgaguccuguggcugaggccccaucuccaggggaagagcaggucccuccagcaccucuucccccugccagccacccuccugccaccuccacgaacaagcggaccaacuugaagaagcccaacucggagcggacggggcacgggcugagaguccgguuuaacccccuggcacugcuccuagacgcgucucuggaaggagaguucgaucuggugcagaggaucaucuaugagguggaagaucccagcaagcccaacgacgaagggaucaccccacugcacaacgccgucugcgccggccaccaucacaucgugaaguuccugcuggauuuuggugucaacgugaaugcugcugauagugauggauggacgccgcugcacugcgcugccucuuguaacagcguucaccucugcaaacagcugguggagaguggugccgccauuuuugccucaaccauaagcgacauugaaacugcugcagacaagugugaggagauggaggaaggcuacauccagugcucccaguuucuauauggggugcaggaaaagcugggugugaugaacaaagguguggcguaugcucugugggacuacgaggcccagaacagugacgagcuguccuuccacgaaggggacgcccucaccauccugaggcgcaaggacgaaagcgagacugagugguggugggcucgccuuggagaccgggagggcuaugugcccaaaaaccugcuggggcuguauccacggaucaaaccccgacagcgaacacucgccugaacuuccuuuuggagcaccgcauggucuugccagcuaccaggagccacuuaagagauuauugugcuguuuuccaggaaagcugcagcuagaaaauggucuuaauggugcucacuuuagcagacagcguccacaaugugaauccuacaguuuccaggugaggcccuuucuccaguuugcccauuaacugggagagguacuuucgccuccaaggacugaauuuugccaauuacuauaaauccaaauaaauacccacuuucaaaacacccaccccucuugccauuaagaagucccauaacccccgguugguugccagugaagacagaagcucuuacugacuuggccccgaggccaucacccccuccagcagugaacacuguccgccgcugugaggccugcuccccugcgaccgcccugccccccgucaccgaaucggacacucauccuuucucacacuucccacacaugauccuucuucccuucaucaccaaaggagccucuguauggaaacauguccaguguugcugcccaguguguaugccucccaguacccacucugcucggccgccuuggggguuccgcuuccuguuccaguucaccuaaaggcugauugugcaggcccagcacuguggcuggacugccgcgccacgggcaccaggaccccuaagaccaagugacaacugggagagccucagcauauacucuucuccuccgaucucacagccugucaugcugcucagugugguucucaccccugcaagcucaaauucaguucccugaauggagucaggugcuggaggccguggcagcggagggugguugggguuggggcuggggguggacuggugugagggcagaccagggccagguagacggggcuguuuggugccugaaggauggcagacgccuggugucaggaggggccgccaccaaggagcagcagcuggggcagaggagcuggggucaggggccaccccucucugccgaucucccugccugggcuggcugugaggccaccuuugucccaggcccagccucaaggcaaggagggcgcuucacugaggugugaauuguacguacaggcuuuuuauauaccaaaaguauuuuuugacuagaccauucaaagcuacccgaacuauguuggaaauuuuuuuuuucucauuaaaauacaggcccuuaggcucuauuuuucauguaugagucguguguaauuuauguaaaaauguguguacagacucacugaugcagcacuguagcccaucaccuuggagcacugacuguacauaguguggugaagaaaagugaacgcccuuguagagcagcccgaccacaggagcauggccgcugccagcccagacgcugcugacgcuguguaaaugugcacaauaaacccgucucaccccggcaaaaaaaaaaaaaaaaa

SEQ ID NO: 5 - RNA, 2640 nt, Homo sapiens
acuugucauggcgacuguccagcuuugugccaggagccucgcagggguugaugggauugggguuuuccccucccaugugcucaagacuggcgcuaaaaguuuugagcuucucaaaagucuagagccaccguccagggagcagguagcugcugggcuccggggacacuuugcguucgggcugggagcgugcuuuccacgacggugacacgcuucccuggauuggcagccagacugccuuccgggucacugccauggaggagccgcagucagauccuagcgucgagcccccucugagucaggaaacauuuucagaccuauggaaacuacuuccugaaaacaacguucugucccccuugccgucccaagcaauggaugauuugaugcuguccccggacgauauugaacaaugguucacugaagacccagguccagaugaagcucccagaaugccagaggcugcuccccccguggccccugcaccagcagcuccuacaccggcggccccugcaccagcccccuccuggccccugucaucuucugucccuucccagaaaaccuaccagggcagcuacgguuuccgucugggcuucuugcauucugggacagccaagucugugacuugcacguacuccccugcccucaacaagauguuuugccaacuggccaagaccugcccugugcagcuguggguugauuccacacccccgcccggcacccgcguccgcgccauggccaucuacaagcagucacagcacaugacggagguugugaggcgcugcccccaccaugagcgcugcucagauagcgauggucuggccccuccucagcaucuuauccgaguggaaggaaauuugcguguggaguauuuggaugacagaaacacuuuucgacauagugugguggugcccuaugagccgccugagguuggcucugacuguaccaccauccacuacaacuacauguguaacaguuccugcaugggcggcaugaaccggaggcccauccucaccaucaucacacuggaagacuccagugguaaucuacugggacggaacagcuuugaggugcguguuugugccuguccugggagagaccggcgcacagaggaagagaaucuccgcaagaaaggggagccucaccacgagcugcccccagggagcacuaagcgagcacugcccaacaacaccagcuccucuccccagccaaagaagaaaccacuggauggagaauauuucacccuucagauccgugggcgugagcgcuucgagauguuccgagagcugaaugaggccuuggaacucaaggaugcccaggcugggaaggagccaggggggagcagggcucacuccagccaccugaaguccaaaaagggucagucuaccucccgccauaaaaaacucauguucaagacagaagggccugacucagacugacauucuccacuucuuguuccccacugacagccucccacccccaucucucccuccccugccauuuuggguuuugggucuuugaacccuugcuugcaauaggugugcgucagaagcacccaggacuuccauuugcuuugucccggggcuccacugaacaaguuggccugcacugguguuuuguuguggggaggaggauggggaguaggacauaccagcuuagauuuuaagguuuuuacugugagggauguuugggagauguaagaaauguucuugcaguuaaggguuaguuuacaaucagccacauucuagguaggggcccacuucaccguacuaaccagggaagcugucccucacuguugaauuuucucuaacuucaaggcccauaucugugaaaugcuggcauuugcaccuaccucacagagugcauugugaggguuaaugaaauaauguacaucuggccuugaaaccaccuuuuauuacauggggucuagaacuugacccccuugagggugcuuguucccucucccuguuggucgguggguugguaguuucuacaguugggcagcugguuagguagagggaguugucaagucucugcuggcccagccaaacccugucugacaaccucuuggugaaccuuaguaccuaaaaggaaaucucaccccaucccacacccuggaggauuucaucucuuguauaugaugaucuggauccaccaagacuuguuuuaugcucagggucaauuucuuuuuucuuuuuuuuuuuuuuuuuucuuuuucuuugagacugggucucgcuuuguugcccaggcuggaguggaguggcgugaucuuggcuuacugcagccuuugccuccccggcucgagcaguccugccucagccuccggaguagcugggaccacagguucaugccaccauggccagccaacuuuugcauguuuuguagagauggggucucacaguguugcccaggcuggucucaaacuccugggcucaggcgauccaccugucucagccucccagagugcugggauuacaauugugagccaccacguccagcuggaagggucaacaucuuuuacauucugcaagcacaucugcauuuucaccccacccuuccccuccuucucccuuuuuauaucccauuuuuauaucgaucucuuauuuuacaauaaaacuuugcugccaccugugugucugaggggug

SEQ ID NO: 6 - RNA, 4670 nt, Homo sapiens
gcuggggcccgacccgggauuaguugguuucggagcggaggagggagccccgaccgucacgagcgucgaagagacaaagccgcgucagggggcccggccggggcgggggagcccggggcuuguuggugccccagcccgcgcggagggcccuucggacccgcgcgccgccgcugccgccgccgccgccucgcaacagguccgggcggccucgcucuccgcuccccucccccgcauccgcgacccuccggggcaccucagcucggccggggccgcagucuggccacccgcuuccaugcgguucggguccaagaugaugccgauguuucuuaccguguaucucaguaacaaugagcagcacuucacagaaguuccaguuacuccagaaacaauaugcagagacgugguggaucugugcaaagaacccggcgagagugauugccauuuggcugaagugugguguggcucugaacguccaguugcggauaaugagcgaauguuugauguucuucaacgauuuggaagucagaggaacgaaguucgcuucuuccuucgucaugaacgccccccuggcagggacauugugaguggaccaagaucucaggauccaaguuuaaaaagaaaugguguaaaaguuccuggugaauaucgaagaaaggagaacgguguuaauaguccuaggauggaucugacucuugcugaacuucaggaaauggcaucucgccagcagcaacagauugaagcccagcaacaauugcuggcaacuaaggaacagcgcuuaaaguuuuugaaacaacaagaucagcgacaacagcaacaaguugcugagcaggagaaacuuaaaaggcuaaaagaaauagcugagaaucaggaagcuaagcuaaaaaaagugagagcacuuaaaggccacguggaacagaagagacuaagcaaugggaaacuuguggaggaaauugaacagaugaauaauuuguuccagcaaaaacagagggagcucguccuggcugugucaaaaguagaagaacugaccaggcagcuagagaugcucaagaacggcaggaucgacagccaccaugacaaucagucugcaguggcugagcuugaucgccucuauaaggagcugcagcuaagaaacaaauugaaucaagagcagaaugccaagcuacaacaacagagggaguguuugaauaagcguaauucagaaguggcagucauggauaagcguguuaaugagcugagggaccggcuguggaagaagaaggcagcucuacagcaaaaagaaaaucuaccaguuucaucugauggaaaucuuccccagcaagccgcgucagccccaagccguguggcugcaguaggucccuauauccagucgucuacuaugccucggaugcccucaaggccugaauugcuggugaagccagcccugccggaugguuccuuggucauucaggcuucagaggggccgaugaaaauacagacacugcccaacaugagaucuggggcugcuucacaaacuaaaggcucuaaaauccauccaguuggcccugauuggaguccuucaaaugcagaucuuuucccaagccaaggcucugcuucuguaccucaaagcacugggaaugcucuggaucaaguugaugauggagagguuccgcugagggagaaagagaagaaagugcguccguucucaauguuugaugcaguagaccaguccaaugccccaccuuccuuugguacucugaggaagaaccagagcagugaagauaucuugcgggaugcucagguugcaaauaaaaauguggcuaaaguaccaccuccuguuccuacaaaaccaaaacagauuaauuugccuuauuuuggacaaacuaaucagccaccuucagacauuaagccagacggaaguucucagcaguugucaacaguuguuccguccaugggaacuaaaccaaaaccagcagggcagcagccgagagugcugcuaucucccagcauaccuucgguuggccaagaccagacccuuucuccagguucuaagcaagaaaguccaccugcugcugccguccggcccuuuacuccccagccuuccaaagacaccuuacuuccacccuucagaaaaccccagaccguggcagcaaguucaauauauuccauguauacgcaacagcaggcgccaggaaaaaacuuccagcaggcugugcagagcgcguugaccaagacucauaccagagggccacacuuuucaaguguauaugguaagccuguaauugcugcugcccagaaucaacagcagcacccagagaacauuuauuccaauagccagggcaagccuggcaguccagaaccugaaacagagccuguuucuucaguucaggagaaccaugaaaacgaaagaauuccucggccacucagcccaacuaaauuacugccuuucuuaucuaauccuuaccgaaaccagagugaugcugaccuagaagccuuacgaaagaaacugucuaacgcaccaaggccucuaaagaaacguaguucuauuacagagccagaggguccuaaugggccaaauauucagaagcuuuuauaucagaggaccaccauagcggccauggagaccaucucugucccaucauacccauccaagucagcuucugugacugccagcucagaaagcccaguagaaauccagaauccauauuuacauguggagcccgaaaaggagguggucucucugguuccugaaucauuguccccagaggauguggggaaugccaguacagagaacagugacaugccagcuccuucuccaggccuugauuaugagccugagggagucccagacaacagcccaaaucuccagaauaacccagaagaaccaaauccagaggcuccacaugugcuugauguguaccuggaggaguacccuccauacccacccccaccauacccaucuggggagccugaagggcccggagaagacucggugagcaugcgcccgccugaaaucaccgggcaggucucucugccuccugguaaaaggacaaacuugcguaaaacuggcucagagcguaucgcucauggaaugagggugaaauucaacccccuugcuuuacugcuagauucgucuuuggagggagaauuugaccuuguacagagaauuauuuaugagguugaugacccaagccuccccaaugaugaaggcaucacggcucuucacaaugcugugugugcaggccacacagaaaucguuaaguuccugguacaguuugguguaaauguaaaugcugcugauagugauggauggacuccauuacauugugcugccucauguaacaacguccaaguguguaaguuuuugguggagucaggagccgcuguguuugccaugaccuacagugacaugcagacugcugcagauaagugcgaggaaauggaggaaggcuacacucagugcucccaauuucuuuauggaguucaggagaagaugggcauaaugaauaaaggagucauuuaugcgcuuugggauuaugaaccucagaaugaugaugagcugcccaugaaagaaggagacugcaugacaaucauccacagggaagacgaagaugaaaucgaaugguggugggcgcgccuuaaugauaaggagggauauguuccacguaacuugcugggacuguacccaagaauuaaaccaagacaaaggagcuuggccugaaacuuccacacagaauuuuagucaaugaagaauuaaucucuguuaagaagaaguaauacgauuauuuuuggcaaaaauuucacaagacuuauuuuaaugacaauguagcuugaaagcgaugaagaaugucucuagaagagaaugaaggauugaagaauucaccauuagaggacauuuagcgugaugaaauaaagcaucuacgucagcaggccauacuguguuggggcaaaggugucccguguagcacucagauaaguauacagcgacaauccuguuuucuacaagaauccugucuaguaaauaggaucauuuauugggcaguugggaaaucagcucucuguccuguugaguguuuucagcagcugcuccuaaaccaguccuccugccagaaaggaccagugccgucacaucgcugucucugauuguccccggcaccagcaggcccuuggggggcucaccugaaggcucgaaggcacugcacacuuguauauugucagugaagaacuguuaguugguugucagugaacaauaacuuuauuauaugaguuuuuguagcaucuuaagaauuauacauauguuugaaauauugaaacuaagcuacgguaccaguaauuagauguagaaucuuguuuguaggcugaauuuuaaucuguauuuauugucuuuuguaucucagaaauuagaaacuugcuacagacuuacccguaauauuugucaagaucauagcugacuuuaaaaacaguuguaauaaacuuuuugaugcuagcuguuuacugguuuuuguuuuugaugucauaaauagaccuuguuuaauagucacaagccguugggauaucauacccagcugaaaaagaacaaacugcuuaacauaaguauauguaucguaauaagaguuuuuuaccagcuaagugauucaauguaagugguuuuuaaaauaaaauacuguagagaucauggugaaaaaaaaaaaaaa

SEQ ID NO: 7 - RNA, 4802 nt, Homo sapiens
gcuggggcccgacccgggauuaguugguuucggagcggaggagggagccccgaccgucacgagcgucgaagagacaaagccgcgucagggggcccggccggggcgggggagcccggggcuuguuggugccccagcccgcgcggagggcccuucggacccgcgcgccgccgcugccgccgccgccgccucgcaacagguccgggcggccucgcucuccgcuccccucccccgcauccgcgacccuccggggcaccucagcucggccggggccgcagucuggccacccgcuuccaugcgguucggguccaagaugaugccgauguuucuuaccguguaucucaguaacaaugagcagcacuucacagaaguuccaguuacuccagaaacaauaugcagagacgugguggaucugugcaaagaacccggcgagagugauugccauuuggcugaagugugguguggcucuguagagauagaguuucaucauguuggccaggauggucucgaucuccugaccuugugauccgccugccucggccucccaaagugcuggauuacaggugugagccaccacgaucagccucuaguguuuaaaaaagaacguccaguugcggauaaugagcgaauguuugauguucuucaacgauuuggaagucagaggaacgaaguucgcuucuuccuucgucaugaacgccccccuggcagggacauugugaguggaccaagaucucaggauccaaguuuaaaaagaaaugguguaaaaguuccuggugaauaucgaagaaaggagaacgguguuaauaguccuaggauggaucugacucuugcugaacuucaggaaauggcaucucgccagcagcaacagauugaagcccagcaacaauugcuggcaacuaaggaacagcgcuuaaaguuuuugaaacaacaagaucagcgacaacagcaacaaguugcugagcaggagaaacuuaaaaggcuaaaagaaauagcugagaaucaggaagcuaagcuaaaaaaagugagagcacuuaaaggccacguggaacagaagagacuaagcaaugggaaacuuguggaggaaauugaacagaugaauaauuuguuccagcaaaaacagagggagcucguccuggcugugucaaaaguagaagaacugaccaggcagcuagagaugcucaagaacggcaggaucgacagccaccaugacaaucagucugcaguggcugagcuugaucgccucuauaaggagcugcagcuaagaaacaaauugaaucaagagcagaaugccaagcuacaacaacagagggaguguuugaauaagcguaauucagaaguggcagucauggauaagcguguuaaugagcugagggaccggcuguggaagaagaaggcagcucuacagcaaaaagaaaaucuaccaguuucaucugauggaaaucuuccccagcaagccgcgucagccccaagccguguggcugcaguaggucccuauauccagucgucuacuaugccucggaugcccucaaggccugaauugcuggugaagccagcccugccggaugguuccuuggucauucaggcuucagaggggccgaugaaaauacagacacugcccaacaugagaucuggggcugcuucacaaacuaaaggcucuaaaauccauccaguuggcccugauuggaguccuucaaaugcagaucuuuucccaagccaaggcucugcuucuguaccucaaagcacugggaaugcucuggaucaaguugaugauggagagguuccgcugagggagaaagagaagaaagugcguccguucucaauguuugaugcaguagaccaguccaaugccccaccuuccuuugguacucugaggaagaaccagagcagugaagauaucuugcgggaugcucagguugcaaauaaaaauguggcuaaaguaccaccuccuguuccuacaaaaccaaaacagauuaauuugccuuauuuuggacaaacuaaucagccaccuucagacauuaagccagacggaaguucucagcaguugucaacaguuguuccguccaugggaacuaaaccaaaaccagcagggcagcagccgagagugcugcuaucucccagcauaccuucgguuggccaagaccagacccuuucuccagguucuaagcaagaaaguccaccugcugcugccguccggcccuuuacuccccagccuuccaaagacaccuuacuuccacccuucagaaaaccccagaccguggcagcaaguucaauauauuccauguauacgcaacagcaggcgccaggaaaaaacuuccagcaggcugugcagagcgcguugaccaagacucauaccagagggccacacuuuucaaguguauaugguaagccuguaauugcugcugcccagaaucaacagcagcacccagagaacauuuauuccaauagccagggcaagccuggcaguccagaaccugaaacagagccuguuucuucaguucaggagaaccaugaaaacgaaagaauuccucggccacucagcccaacuaaauuacugccuuucuuaucuaauccuuaccgaaaccagagugaugcugaccuagaagccuuacgaaagaaacugucuaacgcaccaaggccucuaaagaaacguaguucuauuacagagccagaggguccuaaugggccaaauauucagaagcuuuuauaucagaggaccaccauagcggccauggagaccaucucugucccaucauacccauccaagucagcuucugugacugccagcucagaaagcccaguagaaauccagaauccauauuuacauguggagcccgaaaaggagguggucucucugguuccugaaucauuguccccagaggauguggggaaugccaguacagagaacagugacaugccagcuccuucuccaggccuugauuaugagccugagggagucccagacaacagcccaaaucuccagaauaacccagaagaaccaaauccagaggcuccacaugugcuugauguguaccuggaggaguacccuccauacccacccccaccauacccaucuggggagccugaagggcccggagaagacucggugagcaugcgcccgccugaaaucaccgggcaggucucucugccuccugguaaaaggacaaacuugcguaaaacuggcucagagcguaucgcucauggaaugagggugaaauucaacccccuugcuuuacugcuagauucgucuuuggagggagaauuugaccuuguacagagaauuauuuaugagguugaugacccaagccuccccaaugaugaaggcaucacggcucuucacaaugcugugugugcaggccacacagaaaucguuaaguuccugguacaguuugguguaaauguaaaugcugcugauagugauggauggacuccauuacauugugcugccucauguaacaacguccaaguguguaaguuuuugguggagucaggagccgcuguguuugccaugaccuacagugacaugcagacugcugcagauaagugcgaggaaauggaggaaggcuacacucagugcucccaauuucuuuauggaguucaggagaagaugggcauaaugaauaaaggagucauuuaugcgcuuugggauuaugaaccucagaaugaugaugagcugcccaugaaagaaggagacugcaugacaaucauccacagggaagacgaagaugaaaucgaaugguggugggcgcgccuuaaugauaaggagggauauguuccacguaacuugcugggacuguacccaagaauuaaaccaagacaaaggagcuuggccugaaacuuccacacagaauuuuagucaaugaagaauuaaucucuguuaagaagaaguaauacgauuauuuuuggcaaaaauuucacaagacuuauuuuaaugacaauguagcuugaaagcgaugaagaaugucucuagaagagaaugaaggauugaagaauucaccauuagaggacauuuagcgugaugaaauaaagcaucuacgucagcaggccauacuguguuggggcaaaggugucccguguagcacucagauaaguauacagcgacaauccuguuuucuacaagaauccugucuaguaaauaggaucauuuauugggcaguugggaaaucagcucucuguccuguugaguguuuucagcagcugcuccuaaaccaguccuccugccagaaaggaccagugccgucacaucgcugucucugauuguccccggcaccagcaggcccuuggggggcucaccugaaggcucgaaggcacugcacacuuguauauugucagugaagaacuguuaguugguugucagugaacaauaacuuuauuauaugaguuuuuguagcaucuuaagaauuauacauauguuugaaauauugaaacuaagcuacgguaccaguaauuagauguagaaucuuguuuguaggcugaauuuuaaucuguauuuauugucuuuuguaucucagaaauuagaaacuugcuacagacuuacccguaauauuugucaagaucauagcugacuuuaaaaacaguuguaauaaacuuuuugaugcuagcuguuuacugguuuuuguuuuugaugucauaaauagaccuuguuuaauagucacaagccguugggauaucauacccagcugaaaaagaacaaacugcuuaacauaaguauauguaucguaauaagaguuuuuuaccagcuaagugauucaauguaagugguuuuuaaaauaaaauacuguagagaucauggugaaaaaaaaaaaaaa

SEQ ID NO: 8 - RNA, 3046 nt, Homo sapiens
gccggcgggaucccaggcgccgagcgcccgcugagcagccacccuuugcgcgccgccugcagcgcagcuuccccgggcgcugccuggacaggccugccugcgugcugggacaugucuggccuccaaggaccgucggugggcgauggcugcaacgguggaggggccagagcuggaggcagcugcugccgcaggagaugcuucagaggauucggacgcaggguccagggcgcugccuuuccugggcggcaaccggcugagcuuggaccuguaccccgggggcugccagcagcugcugcaccuguguguccagcagccucugcagcugcugcagguggaauucuugcgucugagcacucacgaggacccucagcugcuggaggccacccuggcccagcugccucagagccuguccugccuccgcucccugguccucaaagggucgaucugggaccucggacccuggcucugagggccacauccgccuccccccuucccaggagggcaacgccgggacacacugggugccugucuccggggugcccugaccaaccugcccgcuggucugaguggccuggcccaucuggcccaccuggaccugagcuucaacagccuggagacacugccggccuguguccugcagaugcgaggucugggugcgcucuugcugucucacaacugccucucugagcugccugaggcucugggggcccuccccgcccucaccuuccucacagugacacacaaccgccugcagacgcugcccccagcacugggggcccuauccacccugcagcgccucgaucucucucagaaucugcuggacacgcuaccuccugagauuggaggccugggcagccuccuggagcucaaccuggccuccaaccggcugcagagccucccagccucucuggcgggacuucgguccuugcggcuccuuguccugcacagcaaccuccuggccucugugccagcugacuuggcccgccuuccacuccucacccggcucgaccugagggacaaccagcuccgggaccugcccccugagcugcuagacgcccccuuugugcgccugcaggggaacccccugggugaggccucgccagacgccccgaguucaccaguggcagcccucauuccagaaaugcccagacuguuccugaccucagauuuggacagcuuuccugugaccccucaaggcugcucagugacccuggccuguggcguccgccugcaguucccagcgggagccaccgccacccccaucaccauccgcuaucggcugcugcugccggagccaggccucgucccccuggguccucaugacgcccugcucagccaugugcuggagcugcagccccaugggguggccuuccagcaggauguggggcuguggcugcucuucaccccaccgcaggcccggcgcugccgugaagugguggucaggacccggaaugacaacagcuggggugaccuggagaccuaccuggaggaagaggcaccccagcggcucugggcucacugccaggugccccacuucuccugguuccuugugguuucccgcccuguguccaaugccugccuggugccaccggaggggacacugcugugcuccucgggucauccuggggucaaagucaucuuccccccuggggccacugaggagccucgucgagucuccaugcagguggugcgcauggcuggccgagagcugcaggcccuccugggagaaccagaggcugcagugagcccccugcugugccugucacagagcgguccccccagcuuccuccaaccggucaccgugcagcugccucugcccucuggcaucacaggccucagucuggaccgcucccgccugcaccuguuguacugggccccuccugcagccaccugggaugacaucacagcucaggugguccuggagcucacccaccuguacuggcucugguacaccaccaagaacugugugggaggccuggcucggaaggccugggagcggcugcggcugcaccgugugaaccucaucgcucugcagcggcgccgggacccugagcagguccugcugcagugccugccccgaaacaagguggacgccacccuucggcggcugcuggagcgguaccggggccccgagcccucugacacgguggagauguucgagggcgaagaguucuuugcggccuucgagcgcggcaucgacguggaugcugaccgcccugacuguguggagggcagaaucugcuuugucuucuacucgcaccugaagaaugugaaggagguauacgugaccaccacucuggaccgggaggcucaggcugugcggggccagguguccuucuaccguggcgcggugccugugcgggugcccgaggaggcugaggcugcccggcagaggaagggcgcagacgcccuguggauggccacucugcccaucaagcugccgagacuucgaggguccgaggggccacggcggggggcuggccucuccuuggcacccuugaaucugggagaugccgagaccggcuuucugacgcagagcaaccugcugaguguggcugggcgucugggucuggacuggccagccguggcccugcaccuggggguguccuaccgggaggugcagcgcauccggcacgaguuccgggaugaucuggaugagcagauccgucacaugcucuucuccugggcugagcgccaggcugggcagccaggggcuguggggcuccuggugcaggcccuggagcagagugaccggcaggacguggcugaagaggugcgcgcagucuuggagcucggccgccgcaaguaccaggacagcauccgacgcaugggcuuggcccccaaggaccccgcucugccuggcuccucggcuccacagcccccagagccugcccaggccuaggccccacagacuuuuaggcuggcccagauauuccccaguggaugggcagagcccccaccuucaagucucuccaguguguggggacgggucccugugagcaacaaaacugcacuguuucuuucaccucaaaaaaaaaaaaaaaaa

SEQ ID NO: 9 - RNA, 3025 nt, Homo sapiens
gccggcgggaucccaggcgccgagcgcccgcugagcagccacccuuugcgcgccgccugcagcgcagcuuccccgggcgcugccuggacaggccugccugcgugcugggacaugucuggccuccaaggaccgucggugggcgauggcugcaacgguggaggggccagagcuggaggcagcugcugccgcaggagaugcuucagaggauucggacgcaggguccagggcgcugccuuuccugggcggcaaccggcugagcuuggaccuguaccccgggggcugccagcagcugcugcaccuguguguccagcagccucugcagcugcugcagguggaauucuugcgucugagcacucacgaggacccucagcugcuggaggccacccuggcccagcugccucagagccuguccugccuccgcucccugguccucaaaggagggcaacgccgggacacacugggugccugucuccggggugcccugaccaaccugcccgcuggucugaguggccuggcccaucuggcccaccuggaccugagcuucaacagccuggagacacugccggccuguguccugcagaugcgaggucugggugcgcucuugcugucucacaacugccucucugagcugccugaggcucugggggcccuccccgcccucaccuuccucacagugacacacaaccgccugcagacgcugcccccagcacugggggcccuauccacccugcagcgccucgaucucucucagaaucugcuggacacgcuaccuccugagauuggaggccugggcagccuccuggagcucaaccuggccuccaaccggcugcagagccucccagccucucuggcgggacuucgguccuugcggcuccuuguccugcacagcaaccuccuggccucugugccagcugacuuggcccgccuuccacuccucacccggcucgaccugagggacaaccagcuccgggaccugcccccugagcugcuagacgcccccuuugugcgccugcaggggaacccccugggugaggccucgccagacgccccgaguucaccaguggcagcccucauuccagaaaugcccagacuguuccugaccucagauuuggacagcuuuccugugaccccucaaggcugcucagugacccuggccuguggcguccgccugcaguucccagcgggagccaccgccacccccaucaccauccgcuaucggcugcugcugccggagccaggccucgucccccuggguccucaugacgcccugcucagccaugugcuggagcugcagccccaugggguggccuuccagcaggauguggggcuguggcugcucuucaccccaccgcaggcccggcgcugccgugaagugguggucaggacccggaaugacaacagcuggggugaccuggagaccuaccuggaggaagaggcaccccagcggcucugggcucacugccaggugccccacuucuccugguuccuugugguuucccgcccuguguccaaugccugccuggugccaccggaggggacacugcugugcuccucgggucauccuggggucaaagucaucuuccccccuggggccacugaggagccucgucgagucuccaugcagguggugcgcauggcuggccgagagcugcaggcccuccugggagaaccagaggcugcagugagcccccugcugugccugucacagagcgguccccccagcuuccuccaaccggucaccgugcagcugccucugcccucuggcaucacaggccucagucuggaccgcucccgccugcaccuguuguacugggccccuccugcagccaccugggaugacaucacagcucaggugguccuggagcucacccaccuguacgcacgcuuccaggucacacacuucuccugguacuggcucugguacaccaccaagaacugugugggaggccuggcucggaaggccugggagcggcugcggcugcaccgugugaaccucaucgcucugcagcggcgccgggacccugagcagguccugcugcagugccugccccgaaacaagguggacgccacccuucggcggcugcuggagcgguaccggggccccgagcccucugacacgguggagauguucgagggcgaagaguucuuugcggccuucgagcgcggcaucgacguggaugcugaccgcccugacuguguggagggcagaaucugcuuugucuucuacucgcaccugaagaaugugaaggagguauacgugaccaccacucuggaccgggaggcucaggcugugcggggccagguguccuucuaccguggcgcggugccugugcgggugcccgaggaggcugaggcugcccggcagaggaagggcgcagacgcccuguggauggccacucugcccaucaagcugccgagacuucgaggguccgaggggccacggcggggggcuggccucuccuuggcacccuugaaucugggagaugccgagaccggcuuucugacgcagagcaaccugcugaguguggcugggcgucugggucuggacuggccagccguggcccugcaccuggggguguccuaccgggaggugcagcgcauccggcacgaguuccgggaugaucuggaugagcagauccgucacaugcucuucuccugggcugagcgccaggcugggcagccaggggcuguggggcuccuggugcaggcccuggagcagagugaccggcaggacguggcugaagaggugcgcgcagucuuggagcucggccgccgcaaguaccaggacagcauccgacgcaugggcuuggcccccaaggaccccgcucugccuggcuccucggcuccacagcccccagagccugcccaggccuaggccccacagacuuuuaggcuggcccagauauuccccaguggaugggcagagcccccaccuucaagucucuccaguguguggggacgggucccugugagcaacaaaacugcacuguuucuuucaccucaaaaaaaaaaaaaaaaaaaaaaa

SEQ ID NO: 10 - RNA, 2902 nt, Homo sapiens
gcuuccccgggcgcugccuggacaggccugccugcgugcugggacaugucuggccuccaaggaccgucggugggcgauggcugcaacgguggaggggccagagcuggaggcagcugcugccgcaggagaugcuucagaggauucggacgcaggguccagggcgcugccuuuccugggcggcaaccggcugagcuuggaccuguaccccgggggcugccagcagcugcugcaccuguguguccagcagccucugcagcugcugcagguggaauucuugcgucugagcacucacgaggacccucagcugcuggaggccacccuggcccagcugccucagagccuguccugccuccgcucccugguccucaaaggagggcaacgccgggacacacugggugccugucuccggggugcccugaccaaccugcccgcuggucugaguggccuggcccaucuggcccaccuggaccugagcuucaacagccuggagacacugccggccuguguccugcagaugcgaggucugggugcgcucuugcugucucacaacugccucucugagcugccugaggcucugggggcccuccccgcccucaccuuccucacagugacacacaaccgccugcagacgcugcccccagcacugggggcccuauccacccugcagcgccucgaucucucucagaaucugcuggacacgcuaccuccugagauuggaggccugggcagccuccuggagcucaaccuggccuccaaccggcugcagagccucccagccucucuggcgggacuucgguccuugcggcuccuuguccugcacagcaaccuccuggccucugugccagcugacuuggcccgccuuccacuccucacccggcucgaccugagggacaaccagcuccgggaccugcccccugagcugcuagacgcccccuuugugcgccugcaggggaacccccugggugaggccucgccagacgccccgaguucaccaguggcagcccucauuccagaaaugcccagacuguuccugaccucagauuuggacagcuuuccugugaccccucaaggcugcucagugacccuggccuguggcguccgccugcaguucccagcgggagccaccgccacccccaucaccauccgcuaucggcugcugcugccggagccaggccucgucccccuggguccucaugacgcccugcucagccaugugcuggagcugcagccccaugggguggccuuccagcaggauguggggcuguggcugcucuucaccccaccgcaggcccggcgcugccgugaagugguggucaggacccggaaugacaacagcuggggugaccuggagaccuaccuggaggaagaggcaccccagcggcucugggcucacugccaggugccccacuucuccugguuccuugugguuucccgcccuguguccaaugccugccuggugccaccggaggggacacugcugugcuccucgggucauccuggggucaaagucaucuuccccccuggggccacugaggagccucgucgagucuccaugcagguggugcgcauggcuggccgagagcugcaggcccuccugggagaaccagaggcugcagugagcccccugcugugccugucacagagcgguccccccagcuuccuccaaccggucaccgugcagcugccucugcccucuggcaucacaggccucagucuggaccgcucccgccugcaccuguuguacugggccccuccugcagccaccugggaugacaucacagcucaggugguccuggagcucacccaccuguacgcacgcuuccaggucacacacuucuccugguacuggcucugguacaccaccaagaacugugugggaggccuggcucggaaggccugggagcggcugcggcugcaccgugugaaccucaucgcucugcagcggcgccgggacccugagcagguccugcugcagugccugccccgaaacaagguggacgccacccuucggcggcugcuggagcgguaccggggccccgagcccucugacacgguggagauguucgagggcgaagaguucuuugcggccuucgagcgcggcaucgacguggaugcugaccgcccugacuguguggagggcagaaucugcuuugucuucuacucgcaccugaagaaugugaaggagguguccuucuaccguggcgcggugccugugcgggugcccgaggaggcugaggcugcccggcagaggaagggcgcagacgcccuguggauggccacucugcccaucaagcugccgagacuucgaggguccgaggggccacggcggggggcuggccucuccuuggcacccuugaaucugggagaugccgagaccggcuuucugacgcagagcaaccugcugaguguggcugggcgucugggucuggacuggccagccguggcccugcaccuggggguguccuaccgggaggugcagcgcauccggcacgaguuccgggaugaucuggaugagcagauccgucacaugcucuucuccugggcugagcgccaggcugggcagccaggggcuguggggcuccuggugcaggcccuggagcagagugaccggcaggacguggcugaagaggugcgcgcagucuuggagcucggccgccgcaaguaccaggacagcauccgacgcaugggcuuggcccccaaggaccccgcucugccuggcuccucggcuccacagcccccagagccugcccaggccuaggccccacagacuuuuaggcuggcccagauauuccccaguggaugggcagagcccccaccuucaagucucuccaguguguggggacgggucccugugagcaacaaaacugcacuguuucuuucaccucaaaaaaaaaaaaaaaaa

SEQ ID NO: 11 - RNA, 743 nt, Homo sapiens
cgcgccuagcagugucccagccggguucgugucgccauggggcagaucgagugggccaugugggccaacgaacaggcgcuggcguccggccugauccucaucaccgggggcaucguggccacagcugggcgcuucacccagugguacuuuggugccuacuccauuguggcgggcguguuugugugccugcuggaguacccccgggggaagaggaagaagggcuccaccauggagcgcuggggacagaaguacaugaccgccguggugaagcuguucgggcccuuuaccaggaauuacuauguucgggccguccugcaucuccugcucucggugcccgccggcuuccugcuggccaccauccuugggaccgccugccuggccauugcgagcggcaucuaccuacuggcggcugugcguggcgagcaguggacgcccaucgagcccaagccccgggagcggccgcagaucggaggcaccaucaagcagccgcccagcaaccccccgccgcggcccccggccgaggcccgcaagaagcccagcgaggaggaggcugcgguggcggcggggggacccccgggagguccccaggucaaccccaucccggugaccgacgaggucgugugaccucgccccggaccugcccucccgccaggugcacccaccugcaauaaaugcagcgaagccgggaaaaaaaaaaaaaaaaaaaaaaaaaaaaaaaaaaaaaaaaaaaaaaaaaaaaaaaa

SEQ ID NO: 12 - RNA, 1535 nt, Homo sapiens
ccuccgcucaguccgggagcgcacgugggccgcggcgcuccgaccuccgcuuucccaccgcccgcagcugaagcacaucccgcagcccggcgcggacuccgaucgccgcaguugcccucuggcgccaugucgcagaacggagcgcccgggaugcaggaggagagccugcagggcuccuggguagaacugcacuucagcaauaaugggaacgggggcagcguuccagccucgguuucuauuuauaauggagacauggaaaaaauacugcuggacgcacagcaugagucuggacggaguagcuccaagagcucucacugugacagcccaccucgcucgcagacaccacaagauaccaacagggcuucugaaacagauacccauagcauuggagagaaaaacagcucacagucugaggaagaugauauugaaagaaggaaagaaguugaaagcaucuugaagaaaaacucagauuggauaugggauuggucaagucggccggaaaauauuccccccaaggaguuccucuuuaaacacccgaagcgcacggccacccucagcaugaggaacacgagcgucaugaagaaagggggcauauucucugcagaauuucugaaaguuuuccuuccaucucugcugcucucucauuugcuggccaucggauuggggaucuauauuggaaggcgucugacaaccuccaccagcaccuuuugaugaagaacuggagucugacuugguucguuaguggauuacuucugagcuugcaacauagcucacugaagagcuguuagauccugggguggccacgucacuuguguuuauuuguucuguaaaugcugcguuccuaauuuaguaaaauaaaagaauagacacuaaaaucauguugaucuauaauuacaccuaugggaucaauaagcaugucagacugauuaaugucuacugugaaaauuugguaguaaauuuucauuugauauuagauauaaauaucugaauauaaauaauuuuaauauacuagucaugauguguguuguauuuuaaaaauuaucugcaaccuuaauucagcugaaguacuuuauauuucaaaagaaugaauaacauugauaauaaaaucgcuacuuuaagggguuuguccaaaauaaauauuguggccuuauauaucacacuauuguagaaaguauuauuuaauuuaaauggaugcagguugucuacuaaagaaagauuauauauaacuaugcuaauuguucauaaucaacagaaaccaagauagagcuacaaacucagcuguacaguucguacacuaaacucuucuugcuuuugcauuauaaggaauuaagucuccgauuauuaggugaucacccuggaugaucaguuuucugcugaaggcaccuacucaguaucuuuuccucuuuaucacucugcauuggugaauuuaauccucuccuuuguguucaacuuuugugugcuuuuaaaaucagcuuuauucuaagcaaaucugugucuacuuuaaaaaacuggaaauggaaaaaaaaauaaaucuu

SEQ ID NO: 13 - RNA, 2413 nt, Homo sapiens
gggaggccggaugugaguggagcggccauuuccuguuucucugcaguuuuccucagcuuugggugguggccgcugccgggcaucggcuuccaguccgcggagggcgaggcggcguggacagcggccccggcacccagcgccccgccgcccgcaagccgcgcgcccguccgccgcgccccgagcccgccgcuuccuaucucagcgcccugccgccgccgccgcggcccagcgagcggcccugaugcaggccaucaagugugugguggugggagacggaaacaagaaucucaguguaacccgagcaaaaucgcgcgucucagcguugcuuguauagagcuguagguaaaacuugccuacugaucaguuacacaaccaaugcauuuccuggagaauauaucccuacugucuuugacaauuauucugccaauguuaugguagauggaaaaccggugaaucugggcuuaugggauacagcuggacaagaagauuaugacagauuacgcccccuauccuauccgcaaacagauguguucuuaauuugcuuuucccuugugaguccugcaucauuugaaaauguccgugcaaagugguauccugaggugcggcaccacugucccaacacucccaucauccuagugggaacuaaacuugaucuuagggaugauaaagacacgaucgagaaacugaaggagaagaagcugacucccaucaccuauccgcagggucuagccauggcuaaggagauuggugcuguaaaauaccuggagugcucggcgcucacacagcgaggccucaagacaguguuugacgaagcgauccgagcaguccucugcccgccucccgugaagaagaggaagagaaaaugccugcuguuguaaaugucucagccccucguucuugguccugucccuuggaaccuuuguacgcuuugcucaaaaaaaaacaaaaaaaaaaaacaaaaaaaaaaaacaacgguggagccuucgcacucaaugccaacuuuuuguuacagauuaauuuuuccauaaaaccauuuuuugaaccaaucaguaauuuuaagguuuuguuuguucuaaauguaagaguucagacucacauucuauuaaaauuuagcccuaaaaugacaagccuucuuaaagccuuauuuuucaaaagcgccccccccauucuuguucagauuaagaguugccaaaauaccuucugaacuacacugcauuguugugccgagaacaccgagcacugaacuuugcaaagaccuucgucuuugagaagacgguagcuucugcaguuaggaggugcagacacuugcucuccuauguaguucucagaugcguaaagcagaacagccucccgaaugaagcguugccauugaacucaccagugaguuagcagcacguguucccgacauaacauuguacuguaauggagugagcguagcagcucagcucuuuggaucagucuuugugauuucauagcgaguuuucugaccagcuuuugcggagauuuugaacagaacugcuauuuccucuaaugaagaauucuguuuagcugugggugugccggguggggugugugugaucaaaggacaaagacaguauuuugacaaaauacgaaguggagauuuacacuacauuguacaaggaaugaaagugucacggguaaaaacucuaaaagguuaauuucugucaaaugcaguagaugaugaaagaaagguugguauuaucaggaaauguuuucuuaagcuuuuccuuucucuuacaccugccaugccuccccaaauugggcauuuaauucaucuuuaaacugguuguucuguuagucgcuaacuuaguaagugcuuuucuuauagaaccccuucugacugagcaauaugccuccuuguauuauaaaaucuuucugauaaugcauuagaagguuuuuuugucgauuaguaaaagugcuuuccauguuacuuuauucagagcuaauaagugcuuuccuuaguuuucuaguaacuagguguaaaaaucauguguugcagcuuuauaguuuuuaaaauauuuuagauaauucuuaaacuaugaaccuucuuaacaucacugucuugccagauuaccgacacugucacuugaccaauacugacccucuuuaccucgcccacgcggacacacgccuccuguagucgcuuugccuauugauguuccuuugggucugugagguucuguaaacugugcuagugcugacgauguucuguacaacuuaacucacuggcgagaauacagcgugggacccuucagccacuacaacagaauuuuuuaaauugacaguugcagaauuguggaguguuuuuacauugaucuuuugcuaaugcaauuagcauuauguuuugcauguaugacuuaauaaauccuugaaucauaaaaaaaaaaaaaaa

SEQ ID NO: 14 - RNA, 2607 nt, Homo sapiens
agccggcgcaggguggccggggaggggugagcagggugccgcuggcugcuggggucugcaggucaccgaguccccaggagaggggacuccuaagaagccaccugccuguguuuacccggcagcgagcgcgcaggcccccgcgaacuccuggcagcgcucaggaaaggccguugcgccucgcgaaggaaacagagccguugaccaugguugcaacuggcaguuugagcagcaagaacccggccagcauuucagaauugcuggacuguggcuaucacccagagagccugcuaagugauuuugacuacugggauuauguuguuccugaacccaaccucaacgagguaauauuugaggaaucaacuugccagaauuugguuaaaaugcuggagaacugucuguccaaaucaaagcaaacuaaacuugguugcucaaagguccuugucccugagaaacugacccagagaauugcucaagauguccugcggcuuuccucaacggagcccugcggcuugcgagguuguguuaugcacgugaacuuggaaauugaaaauguauguaaaaagcuggauaggauugugugugauucuagcgucguaccuacuuuugagcuuacacuuguguuuaagcaggagaacugcucauggacuagcuucagggacuuuuucuuuaguagaggucgcuucuccucugguuucaggagaacucugauccucagcucaggauuucgacuuguuaagaaaaaacuuuacucacugauuggaacaacagugauugaaggguccuaaaaagggaaaauauauaaagauuauuucaugauuggguaguaaaacuauucagcuagucagcuaaagucauuuguaguuugccccaccugcccuaaauaagaaaccccaaauguagucucuuuucuuucuguguuucacauucauagcaacugcagcuaacaggcugauuuucuggccuuuggagaagugauucaaaauaguguagauuuucugcauagaucccauuuuuguacagaauugaaugggauggaauagguaagcaaaaguagaagcccauuugaguuuuacauuugauuccacaauuugguuucagguaggcuugguaauagacuauauaaaccagauuugccuauuuugauuuucauauggcuuuuuuuucucuaaguuuucagaggauuuuuuaaaucacagaaucauacuaaaugauauuuagccuaucaaaacuuccaaaagcccacaccaccaguuccugacucaaauuugaaggguuuuuagacaggaagguaggauuaaguaggugaguuuaauuaaagcuuaacccuagguaagaguaaaugagaaauauuacggcaauaauggaacugcuucacuguuucuuggugacuuccucacucuaauguuuuaaagaggcaacaaaagcuuguggugccauuucaguaaccacgguguuguuuuagaugccuuuauaagcucaguuuccccuguucuuaaguguugaauacugucuuuaaacuagaaaaaugcaaaauauugaacugauauuuuuguguguaguugauuacucuuccauugagugaaugaugaauaccugugaggauaggaaauuaguucugagaucuagucccucucugauucacuuaguaaucuauccucuuuucaguauuacaugugcuuaaucucagaugaaccauuucaccauggcaguguuaucucaucucugggcuuuucugggaauugaaguaucucuccuuaaccccaauugucaaggguaguagcuguauacuaccacuuugaauuauugaaacgggucaauuuacgaagucugcauuggcuauggagauaugguuuauaguacagccuagagaaugaaacucaccguccagauaaccaugcaugcacccagauuuuuuccaccuuggauaccugucacuagggaauaauaaaggccuuauuuuuugucuuauuccaacuaaguagaucauuaucucuuuccuuuuuuauguuaaugagagaauuuagccuccacucaacaauguucaauucagcaaggcuuucauauccuugcugugggucguggauaaggagcuuauucagguuuccugcccuagcuauuagcuccacuucacaugcuggagaccggcguagggacagauguauucauccugguguuacugaaaaacaggugugauccuguuacugauacuauaagugaccuaaaaugucacuguucaaauuagccaguguucuaacaaacuaaacucuucaaaugcuuggaaagauacuacaaagccaaucuuuauagaauugggccaagauaaaucaauguuguuuugcaugucuauuguuaagcuccaaagguucacuguguuucugccgcuguccuggaguugucaccacugacugggcaaggcuucuugggcaucgauguagaacuguuguccuuuuuccacuaacaguuaucuuugacucucuugccuguuaugcuuacaaaauggugauggcuuauggaaggcuguuaaauuaauauuccuguuaaaggaaauuaaaguuugucuauuuuugacaauaaaacauuauauauuuuuaaaaaaaaaaaaaaaaa

SEQ ID NO: 15 - RNA, 1641 nt, Homo sapiens
cucccuguguugguggaggaugucugcagcagcauuuaaauucugggagggcuugguugucagcagcagcaggaggaggcagagcacagcaucgucgggaccagacucgucucaggccaguugcagccuucucagccaaacgccgaccaaggaaaacucacuaccaugagaauugcagugauuugcuuuugccuccuaggcaucaccugugccauaccaguuaaacaggcugauucuggaaguucugaggaaaagcagcuuuacaacaaauacccagaugcuguggccacauggcuaaacccugacccaucucagaagcagaaucuccuagccccacagaaugcuguguccucugaagaaaccaaugacuuuaaacaagagacccuuccaaguaaguccaacgaaagccaugaccacauggaugauauggaugaugaagaugaugaugaccauguggacagccaggacuccauugacucgaacgacucugaugauguagaugacacugaugauucucaccagucugaugagucucaccauucugaugaaucugaugaacuggucacugauuuucccacggaccugccagcaaccgaaguuuucacuccaguuguccccacaguagacacauaugauggccgaggugauagugugguuuauggacugaggucaaaaucuaagaaguuucgcagaccugacauccaguacccugaugcuacagacgaggacaucaccucacacauggaaagcgaggaguugaauggugcauacaaggccauccccguugcccaggaccugaacgcgccuucugauugggacagccgugggaaggacaguuaugaaacgagucagcuggaugaccagagugcugaaacccacagccacaagcaguccagauuauauaagcggaaagccaaugaugagagcaaugagcauuccgaugugauugauagucaggaacuuuccaaagucagccgugaauuccacagccaugaauuucacagccaugaagauaugcugguuguagaccccaaaaguaaggaagaagauaaacaccugaaauuucguauuucucaugaauuagauagugcaucuucugaggucaauuaaaaggagaaaaaauacaauuucucacuuugcauuuagucaaaagaaaaaaugcuuuauagcaaaaugaaagagaacaugaaaugcuucuuucucaguuuauugguugaauguguaucuauuugagucuggaaauaacuaauguguuugauaauuaguuuaguuuguggcuucauggaaacucccuguaaacuaaaagcuucaggguuaugucuauguucauucuauagaagaaaugcaaacuaucacuguauuuuaauauuuguuauucucucaugaauagaaauuuauguagaagcaaacaaaauacuuuuacccacuuaaaaagagaauauaacauuuuaugucacuauaaucuuuuguuuuuuaaguuaguguauauuuuguugugauuaucuuuuuguggugugaauaaaucuuuuaucuugaauguaauaagaauuugguggugucaauugcuuauuuguuuucccacgguuguccagcaauuaauaaaacauaaccuuuuuuacugccuaaaaaaaaaaaaaaaaa

SEQ ID NO: 16 - RNA, 1616 nt, Homo sapiens
cucccuguguugguggaggaugucugcagcagcauuuaaauucugggagggcuugguugucagcagcagcaggaggaggcagagcacagcaucgucgggaccagacucgucucaggccaguugcagccuucucagccaaacgccgaccaaggaaaacucacuaccaugagaauugcagugauuugcuuuugccuccuaggcaucaccugugccauaccaguuaaacaggcugauucuggaaguucugaggaaaagcagcuuuacaacaaauacccagaugcuguggccacauggcuaaacccugacccaucucagaagcagaaucuccuagccccacagacccuuccaaguaaguccaacgaaagccaugaccacauggaugauauggaugaugaagaugaugaugaccauguggacagccaggacuccauugacucgaacgacucugaugauguagaugacacugaugauucucaccagucugaugagucucaccauucugaugaaucugaugaacuggucacugauuuucccacggaccugccagcaaccgaaguuuucacuccaguuguccccacaguagacacauaugauggccgaggugauagugugguuuauggacugaggucaaaaucuaagaaguuucgcagaccugacauccaguacccugaugcuacagacgaggacaucaccucacacauggaaagcgaggaguugaauggugcauacaaggccauccccguugcccaggaccugaacgcgccuucugauugggacagccgugggaaggacaguuaugaaacgagucagcuggaugaccagagugcugaaacccacagccacaagcaguccagauuauauaagcggaaagccaaugaugagagcaaugagcauuccgaugugauugauagucaggaacuuuccaaagucagccgugaauuccacagccaugaauuucacagccaugaagauaugcugguuguagaccccaaaaguaaggaagaagauaaacaccugaaauuucguauuucucaugaauuagauagugcaucuucugaggucaauuaaaaggagaaaaaauacaauuucucacuuugcauuuagucaaaagaaaaaaugcuuuauagcaaaaugaaagagaacaugaaaugcuucuuucucaguuuauugguugaauguguaucuauuugagucuggaaauaacuaauguguuugauaauuaguuuaguuuguggcuucauggaaacucccuguaaacuaaaagcuucaggguuaugucuauguucauucuauagaagaaaugcaaacuaucacuguauuuuaauauuuguuauucucucaugaauagaaauuuauguagaagcaaacaaaauacuuuuacccacuuaaaaagagaauauaacauuuuaugucacuauaaucuuuuguuuuuuaaguuaguguauauuuuguugugauuaucuuuuuguggugugaauaaaucuuuuaucuugaauguaauaagaauuugguggugucaauugcuuauuuguuuucccacgguuguccagcaauuaauaaaacauaaccuuuuuuacugccuaaaaaaaaaaaaaaaaaaaaaaaaaaaaaaaaaa

SEQ ID NO: 17 - RNA, 1560 nt, Homo sapiens
cucccuguguugguggaggaugucugcagcagcauuuaaauucugggagggcuugguugucagcagcagcaggaggaggcagagcacagcaucgucgggaccagacucgucucaggccaguugcagccuucucagccaaacgccgaccaaggaaaacucacuaccaugagaauugcagugauuugcuuuugccuccuaggcaucaccugugccauaccaguuaaacaggcugauucuggaaguucugaggaaaagcagaaugcuguguccucugaagaaaccaaugacuuuaaacaagagacccuuccaaguaaguccaacgaaagccaugaccacauggaugauauggaugaugaagaugaugaugaccauguggacagccaggacuccauugacucgaacgacucugaugauguagaugacacugaugauucucaccagucugaugagucucaccauucugaugaaucugaugaacuggucacugauuuucccacggaccugccagcaaccgaaguuuucacuccaguuguccccacaguagacacauaugauggccgaggugauagugugguuuauggacugaggucaaaaucuaagaaguuucgcagaccugacauccaguacccugaugcuacagacgaggacaucaccucacacauggaaagcgaggaguugaauggugcauacaaggccauccccguugcccaggaccugaacgcgccuucugauugggacagccgugggaaggacaguuaugaaacgagucagcuggaugaccagagugcugaaacccacagccacaagcaguccagauuauauaagcggaaagccaaugaugagagcaaugagcauuccgaugugauugauagucaggaacuuuccaaagucagccgugaauuccacagccaugaauuucacagccaugaagauaugcugguuguagaccccaaaaguaaggaagaagauaaacaccugaaauuucguauuucucaugaauuagauagugcaucuucugaggucaauuaaaaggagaaaaaauacaauuucucacuuugcauuuagucaaaagaaaaaaugcuuuauagcaaaaugaaagagaacaugaaaugcuucuuucucaguuuauugguugaauguguaucuauuugagucuggaaauaacuaauguguuugauaauuaguuuaguuuguggcuucauggaaacucccuguaaacuaaaagcuucaggguuaugucuauguucauucuauagaagaaaugcaaacuaucacuguauuuuaauauuuguuauucucucaugaauagaaauuuauguagaagcaaacaaaauacuuuuacccacuuaaaaagagaauauaacauuuuaugucacuauaaucuuuuguuuuuuaaguuaguguauauuuuguugugauuaucuuuuuguggugugaauaaaucuuuuaucuugaauguaauaagaauuugguggugucaauugcuuauuuguuuucccacgguuguccagcaauuaauaaaacauaaccuuuuuuacugccuaaaaaaaaaaaaaaaaa

SEQ ID NO: 18 - RNA, 3963 nt, Homo sapiens
ggagagccgaaagcggagcucgaaacugacuggaaacuucaguggcgcggagacucgccaguuucaaccccggaaacuuuucuuugcaggaggagaagagaaggggugcaagcgcccccacuuuugcucuuuuuccuccccuccuccuccucuccaauucgccuccccccacuuggagcgggcagcugugaacuggccaccccgcgccuuccuaagugcucgccgcgguagccggccgacgcgccagcuuccccgggagccgcuugcuccgcauccgggcagccgaggggagaggagcccgcgccucgaguccccgagccgccgcggcuucucgccuuucccggccaccagcccccugccccgggcccgcguaugaaucuccuggaccccuucaugaagaugaccgacgagcaggagaagggccuguccggcgcccccagccccaccauguccgaggacuccgcgggcucgcccugcccgucgggcuccggcucggacaccgagaacacgcggccccaggagaacacguuccccaagggcgagcccgaucugaagaaggagagcgaggaggacaaguuccccgugugcauccgcgaggcggucagccaggugcucaaaggcuacgacuggacgcuggugcccaugccggugcgcgucaacggcuccagcaagaacaagccgcacgucaagcggcccaugaacgccuucauggugugggcgcaggcggcgcgcaggaagcucgcggaccaguacccgcacuugcacaacgccgagcucagcaagacgcugggcaagcucuggagacuucugaacgagagcgagaagcggcccuucguggaggaggcggagcggcugcgcgugcagcacaagaaggaccacccggauuacaaguaccagccgcggcggaggaagucggugaagaacgggcaggcggaggcagaggaggccacggagcagacgcacaucucccccaacgccaucuucaaggcgcugcaggccgacucgccacacuccuccuccggcaugagcgaggugcacucccccggcgagcacucggggcaaucccagggcccaccgaccccacccaccacccccaaaaccgacgugcagccgggcaaggcugaccugaagcgagaggggcgccccuugccagaggggggcagacagcccccuaucgacuuccgcgacguggacaucggcgagcugagcagcgacgucaucuccaacaucgagaccuucgaugucaacgaguuugaccaguaccugccgcccaacggccacccgggggugccggccacgcacggccaggucaccuacacgggcagcuacggcaucagcagcaccgcggccaccccggcgagcgcgggccacguguggauguccaagcagcaggcgccgccgccacccccgcagcagcccccacaggccccgccggccccgcaggcgcccccgcagccgcaggcggcgcccccacagcagccggcggcacccccgcagcagccacaggcgcacacgcugaccacgcugagcagcgagccgggccagucccagcgaacgcacaucaagacggagcagcugagccccagccacuacagcgagcagcagcagcacucgccccaacagaucgccuacagccccuucaaccucccacacuacagccccuccuacccgcccaucacccgcucacaguacgacuacaccgaccaccagaacuccagcuccuacuacagccacgcggcaggccagggcaccggccucuacuccaccuucaccuacaugaaccccgcucagcgccccauguacacccccaucgccgacaccucuggggucccuuccaucccgcagacccacagcccccagcacugggaacaacccgucuacacacagcucacucgaccuugaggaggccucccacgaagggcgaagauggccgagaugauccuaaaaauaaccgaagaaagagaggaccaaccagaauucccuuuggacauuuguguuuuuuuguuuuuuuauuuuguuuuguuuuuucuucuucuucuucuuccuuaaagacauuuaagcuaaaggcaacucguacccaaauuuccaagacacaaacaugaccuauccaagcgcauuacccacuuguggccaaucaguggccaggccaaccuuggcuaaauggagcagcgaaaucaacgagaaacuggacuuuuuaaacccucuucagagcaagcguggaggaugauggagaaucgugugaucagugugcuaaaucucucugccuguuuggacuuuguaauuauuuuuuuagcaguaauuaaagaaaaaaguccucugugaggaauauucucuauuuuaaauauuuuuaguauguacuguguaugauucauuaccauuuugaggggauuuauacauauuuuuagauaaaauuaaaugcucuuauuuuuccaacagcuaaacuacucuuaguugaacagugugcccuagcuuuucuugcaaccagaguauuuuuguacagauuugcuuucucuuacaaaaagaaaaaaaaaauccuguuguauuaacauuuaaaaacagaauuguguuaugugaucaguuuuggggguuaacuuugcuuaauuccucaggcuuugcgauuuaaggaggagcugccuuaaaaaaaaauaaaggccuuauuuugcaauuaugggaguaaacaauagucuagagaagcauuugguaagcuuuaucauauauauauuuuuuaaagaagagaaaaacaccuugagccuuaaaacggugcugcugggaaacauuugcacucuuuuagugcauuuccuccugccuuugcuuguucacugcagucuuaagaaagagguaaaaggcaagcaaaggagaugaaaucuguucugggaauguuucagcagccaauaagugcccgagcacacugcccccgguugccugccugggccccauguggaaggcagaugccugcucgcucugucaccugugccucucagaacaccagcaguuaaccuucaagacauuccacuugcuaaaauuauuuauuuuguaaggagagguuuuaauuaaaacaaaaaaaaauucuuuuuuuuuuuuuuuuccaauuuuaccuucuuuaaaauagguuguuggagcuuuccucaaaggguauggucaucuguuguuaaauuauguucuuaacuguaaccaguuuuuuuuuauuuaucucuuuaaucuuuuuuuauuauuaaaagcaaguuucuuuguauuccucacccuagauuuguauaaaugccuuuuuguccaucccuuuuuucuuuguuguuuuuguugaaaacaaacuggaaacuuguuucuuuuuuuguauaaaugagagauugcaaauguaguguaucacugagucauuugcaguguuuucugccacagaccuuugggcugccuuauauuguguguguguguggguguguguguguuuugacacaaaaacaaugcaagcaugugucauccauauuucucugcaucuucucuuggagugagggaggcuaccuggaggggaucagcccacugacagaccuuaaucuuaauuacugcuguggcuagagaguuugaggauugcuuuuuaaaaaagacagcaaacuuuuuuuuuuauuuaaaaaaagauauauuaacaguuuuagaagucaguagaauaaaaucuuaaagcacucauaauauggcauccuucaauuucuguauaaaagcagaucuuuuuaaaaagauacuucuguaacuuaagaaaccuggcauuuaaaucauauuuugucuuuagguaaaagcuuugguuuguguucguguuuuguuuguuucacuuguuucccucccagccccaaaccuuuuguucucuccgugaaacuuaccuuucccuuuuucuuucucuuuuuuuuuuuuguauauuauuguuuacaauaaauauacauugcauuaaaaagaaaaaaaaaaaaaaaaaaaaaaaaaaaaaaa

SEQ ID NO: 19 - RNA, 2225 nt, Homo sapiens
ggggugugugcggggggccggaggcggcggcugucagagucggcucagccugcgccggggaacaucggccgccuccagcucccggcgcggcccggcccggcccggcucggccgccucagacgccgccugcccugcagccaugaggcccccgcagugucugcugcacacgccuucccuggcuuccccacuccuucuccuccuccucuggcuccuggguggaggagugggggcugagggccgggaggaugcagagcugcuggugacggugcgugggggccggcugcggggcauucgccugaagacccccgggggcccugucucugcuuuccugggcauccccuuugcggagccacccaugggaccccgucgcuuucugccaccggagcccaagcagccuuggucaggggugguagacgcuacaaccuuccagagugucugcuaccaauauguggacacccuauacccagguuuugagggcaccgagauguggaaccccaaccgugagcugagcgaggacugccuguaccucaacguguggacaccauacccccggccuacaucccccaccccuguccucgucuggaucuauggggguggcuucuacaguggggccuccuccuuggacguguacgauggccgcuucuugguacaggccgagaggacugugcugguguccaugaacuaccgggugggagccuuuggcuuccuggcccugccggggagccgagaggccccgggcaaugugggucuccuggaucagaggcuggcccugcagugggugcaggagaacguggcagccuucgggggugacccgacaucagugacgcuguuuggggagagcgcgggagccgccucggugggcaugcaccugcuguccccgcccagccggggccuguuccacagggccgugcugcagagcggugcccccaauggacccugggccacggugggcaugggagaggcccgucgcagggccacgcagcuggcccaccuugugggcuguccuccaggcggcacuggugggaaugacacagagcugguagccugccuucggacacgaccagcgcagguccuggugaaccacgaauggcacgugcugccucaagaaagcgucuuccgguucuccuucgugccugugguagauggagacuuccucagugacaccccagaggcccucaucaacgcgggagacuuccacggccugcaggugcugguggguguggugaaggaugagggcucguauuuucugguuuacggggccccaggcuucagcaaagacaacgagucucucaucagccgggccgaguuccuggccggggugcgggucgggguuccccagguaagugaccuggcagccgaggcugugguccugcauuacacagacuggcugcaucccgaggacccggcacgccugagggaggcccugagcgauguggugggcgaccacaaugucgugugccccguggcccagcuggcugggcgacuggcugcccagggugcccgggucuacgccuacgucuuugaacaccgugcuuccacgcucuccuggccccuguggaugggggugccccacggcuacgagaucgaguucaucuuugggaucccccuggaccccucucgaaacuacacggcagaggagaaaaucuucgcccagcgacugaugcgauacugggccaacuuugcccgcacaggggaucccaaugagccccgagaccccaaggccccacaauggcccccguacacggcgggggcucagcaguacguuagucuggaccugcggccgcuggaggugcggcgggggcugcgcgcccaggccugcgccuucuggaaccgcuuccuccccaaauugcucagcgccaccgacacgcucgacgaggcggagcgccaguggaaggccgaguuccaccgcuggagcuccuacauggugcacuggaagaaccaguucgaccacuacagcaagcaggaucgcugcucagaccugugaccccggcgggacccccauguccuccgcuccgcccggcccccuagcuguauauacuauuuauuucagggcugggcuauaacacagacgagccccagacucugcccauccccaccccaccccgacgucccccggggcucccgguccucugcaugucucaggcugagcucccucccccgcggugccuucgccccucugggcugccaauaaacuguuacagccaaaaaaaaaaaaaaaaaaaaaa

SEQ ID NO: 20 - RNA, 2918 nt, Homo sapiens
aacaucggccgccuccagcucccggcgcggcccggcccggcccggcucggccgccucagacgccgccugcccugcagccaugaggcccccgcagugucugcugcacacgccuucccuggcuuccccacuccuucuccuccuccucuggcuccuggguggaggagugggggcugagggccgggaggaugcagagcugcuggugacggugcgugggggccggcugcggggcauucgccugaagacccccgggggcccugucucugcuuuccugggcauccccuuugcggagccacccaugggaccccgucgcuuucugccaccggagcccaagcagccuuggucaggggugguagacgcuacaaccuuccagagugucugcuaccaauauguggacacccuauacccagguuuugagggcaccgagauguggaaccccaaccgugagcugagcgaggacugccuguaccucaacguguggacaccauacccccggccuacaucccccaccccuguccucgucuggaucuauggggguggcuucuacaguggggccuccuccuuggacguguacgauggccgcuucuugguacaggccgagaggacugugcugguguccaugaacuaccgggugggagccuuuggcuuccuggcccugccggggagccgagaggccccgggcaaugugggucuccuggaucagaggcuggcccugcagugggugcaggagaacguggcagccuucgggggugacccgacaucagugacgcuguuuggggagagcgcgggagccgccucggugggcaugcaccugcuguccccgcccagccggggccuguuccacagggccgugcugcagagcggugcccccaauggacccugggccacggugggcaugggagaggcccgucgcagggccacgcagcuggcccaccuugugggcuguccuccaggcggcacuggugggaaugacacagagcugguagccugccuucggacacgaccagcgcagguccuggugaaccacgaauggcacgugcugccucaagaaagcgucuuccgguucuccuucgugccugugguagauggagacuuccucagugacaccccagaggcccucaucaacgcgggagacuuccacggccugcaggugcugguggguguggugaaggaugagggcucguauuuucugguuuacggggccccaggcuucagcaaagacaacgagucucucaucagccgggccgaguuccuggccggggugcgggucgggguuccccagguaagugaccuggcagccgaggcugugguccugcauuacacagacuggcugcaucccgaggacccggcacgccugagggaggcccugagcgauguggugggcgaccacaaugucgugugccccguggcccagcuggcugggcgacuggcugcccagggugcccgggucuacgccuacgucuuugaacaccgugcuuccacgcucuccuggccccuguggaugggggugccccacggcuacgagaucgaguucaucuuugggaucccccuggaccccucucgaaacuacacggcagaggagaaaaucuucgcccagcgacugaugcgauacugggccaacuuugcccgcacaggggaucccaaugagccccgagaccccaaggccccacaauggcccccguacacggcgggggcucagcaguacguuagucuggaccugcggccgcuggaggugcggcgggggcugcgcgcccaggccugcgccuucuggaaccgcuuccuccccaaauugcucagcgccaccgccucggaggcucccagcaccugcccaggcuucacccauggggaggcugcuccgaggcccggccucccccugccccuccuccuccuccaccagcuucuccuccucuuccucucccaccuccggcggcugugaacacggccucuuccccuacggccacaggggccccuccucuaaugaguggucggaccguggggaagggccccacucagggaucucagaccuagugcucccuuccuccucaaaccgagagacucacacuggacagggcaggaggagggggccgugccucccacccuucucagggacccccacgccuuuguuguuugaauggaaauggaaaagccaguauucuuuuauaaaauuaucuuuuggaaccugagccugacauuggggggaagugggaggccccggacgggguagcaccccccauuggggcuauaacggucaaccauuucugucucuucuuuuucccccaaccucccccuccuguccccucuguucccgucuuccggucauucuuuucuccuccucucuccuuccugcuguccuucuccggccccgccucugcccucauccucccucucgucuuucgcacauucuccugauccucuugccaccgucccacguggucgccugcauuucuccgugcguccucccugcacucauacccccccuucaacccgcccaaauguccgauccccgaccuuccucgugccguccuccccucccgccucgcugggcgcccuggccgcagacacgcucgacgaggcggagcgccaguggaaggccgaguuccaccgcuggagcuccuacauggugcacuggaagaaccaguucgaccacuacagcaagcaggaucgcugcucagaccugugaccccggcgggacccccauguccuccgcuccgcccggcccccuagcuguauauacuauuuauuucagggcugggcuauaacacagacgagccccagacucugcccauccccaccccaccccgacgucccccggggcucccgguccucugcaugucucaggcugagcucccucccccgcggugccuucgccccucugggcugccaauaaacuguuacagccaaaaaaaaaaaaaaaaaaaaaa

SEQ ID NO: 21 - RNA, 2862 nt, Homo sapiens
gcaccacgccgcccgggcuucugggguguuccccaaccacggcccagcccugccacaccccccgcccccggccuccgcagcucggcaugggcgcgggggugcucguccugggcgccuccgagcccgguaaccugucgucggccgcaccgcuccccgacggcgcggccaccgcggcgcggcugcuggugcccgcgucgccgcccgccucguugcugccucccgccagcgaaagccccgagccgcugucucagcaguggacagcgggcaugggucugcugauggcgcucaucgugcugcucaucguggcgggcaaugugcuggugaucguggccaucgccaagacgccgcggcugcagacgcucaccaaccucuucaucaugucccuggccagcgccgaccuggucauggggcugcugguggugccguucggggccaccaucgugguguggggccgcugggaguacggcuccuucuucugcgagcuguggaccucaguggacgugcugugcgugacggccagcaucgagacccugugugucauugcccuggaccgcuaccucgccaucaccucgcccuuccgcuaccagagccugcugacgcgcgcgcgggcgcggggccucgugugcaccgugugggccaucucggcccugguguccuuccugcccauccucaugcacugguggcgggcggagagcgacgaggcgcgccgcugcuacaacgaccccaagugcugcgacuucgucaccaaccgggccuacgccaucgccucguccguagucuccuucuacgugccccugugcaucauggccuucguguaccugcggguguuccgcgaggcccagaagcaggugaagaagaucgacagcugcgagcgccguuuccucggcggcccagcgcggccgcccucgcccucgcccucgcccguccccgcgcccgcgccgccgcccggacccccgcgccccgccgccgccgccgccaccgccccgcuggccaacgggcgugcggguaagcggcggcccucgcgccucguggcccugcgcgagcagaaggcgcucaagacgcugggcaucaucaugggcgucuucacgcucugcuggcugcccuucuuccuggccaacguggugaaggccuuccaccgcgagcuggugcccgaccgccucuucgucuucuucaacuggcugggcuacgccaacucggccuucaaccccaucaucuacugccgcagccccgacuuccgcaaggccuuccagggacugcucugcugcgcgcgcagggcugcccgccggcgccacgcgacccacggagaccggccgcgcgccucgggcugucuggcccggcccggacccccgccaucgcccggggccgccucggacgacgacgacgacgaugucgucggggccacgccgcccgcgcgccugcuggagcccugggccggcugcaacggcggggcggcggcggacagcgacucgagccuggacgagccgugccgccccggcuucgccucggaauccaagguguagggcccggcgcggggcgcggacuccgggcacggcuucccaggggaacgaggagaucuguguuuacuuaagaccgauagcaggugaacucgaagcccacaauccucgucugaaucauccgaggcaaagagaaaagccacggaccguugcacaaaaaggaaaguuugggaagggaugggagaguggcuugcugauguuccuuguuguuuuuuuuuucuuuucuuuucuuucuucuucuuuuuuuuuuuuuuuuuuuuuucuguuugugguccggccuucuuuugugugugcgugugaugcaucuuuagauuuuuuucccccaccaggugguuuuugacacucucugagaggaccggaguggaagauggguggguuaggggaagggagaagcauuaggaggggauuaaaaucgaucaucguggcucccaucccuuucccgggaacaggaacacacuaccagccagagagaggagaaugacaguuugucaagacauauuuccuuuugcuuuccagagaaauuucauuuuaauuucuaaguaaugauuucugcuguuaugaaagcaaagagaaaggauggaggcaaaauaaaaaaaaaucacguuucaagaaauguuaagcucuucuuggaacaagccccaccuugcuuuccuuguguagggcaaacccgcugucccccgcgcgccuggguggucaggcugagggauuucuaccucacacugugcauuugcacagcagauagaaagacuuguuuauauuaaacagcuuauuuauguaucaauauuaguuggaaggaccaggcgcagagccucucucugugacaugugacucugucaauugaagacaggacauuaaaagagagcgagagagagaaacaguucagauuacugcacauguggauaaaaacaaaaacaaaaaaaaggagugguucaaaaugccauuuuugcacaguguuaggaauuacaaaauccacagaagauguuacuugcacaaaaagaaauuaaauauuuuuuaaagggagaggggcugggcagaucuuaaauaaaauucaaacucuacuucuguugucuaguauguuauugagcuaaugauucauugggaaaauaccuuuuuauacuccuuuaucaugguacuguaacuguauccauauuauaaauauaauuaucuuaaggauuuuuuauuuuuuuuuauguccaagugcccacgugaauuugcuggugaaaguuagcacuuguguguaaauucuacuuccucuuguguguuuuaccaaguauuuauacucuggugcaacuaacuacugugugaggaauugguccaugugcaauaaauaccaaugaagcacaaucaa

SEQ ID NO: 22 - RNA, 2550 nt, Homo sapiens
cguggaucccgagaaagaggcgcaggacgaggaggcagaacccgacuggcgcguagagcagcagcacgagcaguaggaagcagucacccggaagccugggggcgagaggcgaaguggucaggcgccgaaggccgagagcacgcggggaucggucucuucccgccgggucucuuaccggugcgagucaaagagccgcuccggccccggcccugagggaagcuccauaacugcugcuucaggagcgcccggccgucgccgccgccgccauuuucgcgcccggccgcaggggcucuugggaaggcggagucuuugggcauccgcccggggugaggggacccgaaguccugaggcgcgccggaagggcuagcggucccagcauaccccgcggccccuugggccgucucacaacucgcguccggcggagaccacaauucccggcauucguggggcagggaggagucggccucccggaauccuggucccggcgugcacuucugaaggacuucagguaccggcgugccccgcguccuacuguccgccugcucgcguccugggugccgccucugaguagggcgggcgaggaggcagccaaggcggagcugauggcugcgccgagggcggggcggggugcaggcuggagccuucgggcauggcgggcuuuggggggcauucgcugggggaggagaccccguuugaccccugaccuccgggcccugcugacgucaggaacuucugacccccgggcccgagugacuuaugggacccccagucucugggcccgguugucuguuggggucacugaaccccgagcaugccugacgucugggaccccggguccccgggcacaacugacugcggugaccccagauaccaggacccgggaggccucagagaacucuggaacccguucgcgcgcguggcuggcgguggcgcugggcgcugggggggcagugcuguuguuguuguggggcgggggucgggguccuccggccguccucgccgccgucccuagcccgccgcccgcuucuccccggagucaguacaacuucaucgcagaugugguggagaagacagcaccugccguggucuauaucgagauccuggaccggcacccuuucuugggccgcgaggucccuaucucgaacggcucaggauucgugguggcugccgaugggcucauugucaccaacgcccaugugguggcugaucggcgcagaguccgugugagacugcuaagcggcgacacguaugaggccguggucacagcuguggaucccguggcagacaucgcaacgcugaggauucagacuaaggagccucuccccacgcugccucugggacgcucagcugauguccggcaaggggaguuuguuguugccaugggaagucccuuugcacugcagaacacgaucacauccggcauuguuagcucugcucagcguccagccagagaccugggacucccccaaaccaauguggaauacauucaaacugaugcagcuauugauuuuggaaacucuggagguccccugguuaaccuggauggggaggugauuggagugaacaccaugaaggucacagcuggaaucuccuuugccaucccuucugaucgucuucgagaguuucugcaucguggggaaaagaagaauuccuccuccggaaucagugggucccagcggcgcuacauuggggugaugaugcugacccugagucccagcauccuugcugaacuacagcuucgagaaccaagcuuucccgauguucagcaugguguacucauccauaaagucauccugggcuccccugcacaccgggcuggucugcggccuggugaugugauuuuggccauuggggagcagaugguacaaaaugcugaagauguuuaugaagcuguucgaacccaaucccaguuggcagugcagauccggcggggacgagaaacacugaccuuauaugugaccccugaggucacagaaugaauagaucaccaagaguaugaggcuccugcucugauuuccuccuugccuuucuggcugagguucugagggcaccgagacagaggguuaaaugaaccagugggggcaggucccuccaaccaccagcacugacuccugggcucugaagaaucacagaaacacuuuuuauauaaaauaaaauuauaccuagcaacauauuauaguaaaaaaugaggugggagggcuggaucuuuucccccaccaaaaggcuagagguaaagcuguaucccccuaaacuuaggggagauacuggagcugaccauccugaccuccuauuaaagaaaaugagcugcugccaucuuuugugggcaguuagucaggugcugcucuuugugguguggugggcucuggucuguucugcucggugcugggccugggagcaaagauucccaugcuuggcuacagauacugacagcuggccucugaaggagggugaaaacuucugcuugacaguuccacauccauagugcauggucugaugagugcgguugcugacauggguuucuugguaagcuccugagguaauggcagccuc

SEQ ID NO: 23 - RNA, 2259 nt, Homo sapiens
cguggaucccgagaaagaggcgcaggacgaggaggcagaacccgacuggcgcguagagcagcagcacgagcaguaggaagcagucacccggaagccugggggcgagaggcgaaguggucaggcgccgaaggccgagagcacgcggggaucggucucuucccgccgggucucuuaccggugcgagucaaagagccgcuccggccccggcccugagggaagcuccauaacugcugcuucaggagcgcccggccgucgccgccgccgccauuuucgcgcccggccgcaggggcucuugggaaggcggagucuuugggcauccgcccggggugaggggacccgaaguccugaggcgcgccggaagggcuagcggucccagcauaccccgcggccccuugggccgucucacaacucgcguccggcggagaccacaauucccggcauucguggggcagggaggagucggccucccggaauccuggucccggcgugcacuucugaaggacuucagguaccggcgugccccgcguccuacuguccgccugcucgcguccugggugccgccucugaguagggcgggcgaggaggcagccaaggcggagcugauggcugcgccgagggcggggcggggugcaggcuggagccuucgggcauggcgggcuuuggggggcauucgcugggggaggagaccccguuugaccccugaccuccgggcccugcugacgucaggaacuucugacccccgggcccgagugacuuaugggacccccagucucugggcccgguugucuguuggggucacugaaccccgagcaugccugacgucugggaccccggguccccgggcacaacugacugcggugaccccagauaccaggacccgggaggccucagagaacucuggaacccguucgcgcgcguggcuggcgguggcgcugggcgcugggggggcagugcuguuguuguuguggggcgggggucgggguccuccggccguccucgccgccgucccuagcccgccgcccgcuucuccccggagucaguacaacuucaucgcagaugugguggagaagacagcaccugccguggucuauaucgagauccuggaccggcacccuuucuugggccgcgaggucccuaucucgaacggcucaggauucgugguggcugccgaugggcucauugucaccaacgcccaugugguggcugaucggcgcagaguccgugugagacugcuaagcggcgacacguaugaggccguggucacagcuguggaucccguggcagacaucgcaacgcugaggauucagacuaaguuuggaaacucuggagguccccugguuaaccuggauggggaggugauuggagugaacaccaugaaggucacagcuggaaucuccuuugccaucccuucugaucgucuucgagaguuucugcaucguggggaaaagaagaauuccuccuccggaaucagugggucccagcggcgcuacauuggggugaugaugcugacccugagucccagggcuggucugcggccuggugaugugauuuuggccauuggggagcagaugguacaaaaugcugaagauguuuaugaagcuguucgaacccaaucccaguuggcagugcagauccggcggggacgagaaacacugaccuuauaugugaccccugaggucacagaaugaauagaucaccaagaguaugaggcuccugcucugauuuccuccuugccuuucuggcugagguucugagggcaccgagacagaggguuaaaugaaccagugggggcaggucccuccaaccaccagcacugacuccugggcucugaagaaucacagaaacacuuuuuauauaaaauaaaauuauaccuagcaacauauuauaguaaaaaaugaggugggagggcuggaucuuuucccccaccaaaaggcuagagguaaagcuguaucccccuaaacuuaggggagauacuggagcugaccauccugaccuccuauuaaagaaaaugagcugcugccaucuuuugugggcaguuagucaggugcugcucuuugugguguggugggcucuggucuguucugcucggugcugggccugggagcaaagauucccaugcuuggcuacagauacugacagcuggccucugaaggagggugaaaacuucugcuugacaguuccacauccauagugcauggucugaugagugcgguugcugacauggguuucuugguaagcuccugagguaauggcagccuc

SEQ ID NO: 24 - RNA, 2606 nt, Homo sapiens
cuuuccgcccucuccccgccuccuuuucgggcgucccgaggccgcuccccaaccgacaaccaagaccccgcaggccacgcagcccuggagccgaggccccccgacggcggaggcgcccgcggguccccuacagccaaggucccugagugccagagguggugguguugcuuaucuucuggaaccccaugcagccagaucccaggccuagcggggcuggggccugcugccgauuccugccccugcagucacagugcccugagggggcaggggacgcggugauguacgccuccacugagugcaaggcggaggugacgcccucccagcauggcaaccgcaccuucagcuacacccuggaggaucauaccaagcaggccuuuggcaucaugaacgagcugcggcucagccagcagcugugugacgucacacugcaggucaaguaccaggaugcaccggccgcccaguucauggcccacaagguggugcuggccucauccagcccugucuucaaggccauguucaccaacgggcugcgggagcagggcauggaggugguguccauugaggguauccaccccaaggucauggagcgccucauugaauucgccuacacggccuccaucuccaugggcgagaaguguguccuccacgucaugaacggugcugucauguaccagaucgacagcguuguccgugccugcagugacuuccuggugcagcagcuggaccccagcaaugccaucggcaucgccaacuucgcugagcagauuggcuguguggaguugcaccagcgugcccgggaguacaucuacaugcauuuuggggagguggccaagcaagaggaguucuucaaccugucccacugccaacuggugacccucaucagccgggacgaccugaacgugcgcugcgaguccgaggucuuccacgccugcaucaacugggucaaguacgacugcgaacagcgacgguucuacguccaggcgcugcugcgggccgugcgcugccacucguugacgccgaacuuccugcagaugcagcugcagaagugcgagauccugcaguccgacucccgcugcaaggacuaccuggucaagaucuucgaggagcucacccugcacaagcccacgcaggugaugcccugccgggcgcccaaggugggccgccugaucuacaccgcgggcggcuacuuccgacagucgcucagcuaccuggaggcuuacaaccccagugacggcaccuggcuccgguuggcggaccugcaggugccgcggagcggccuggccggcugcguggugggcgggcuguuguacgccgugggcggcaggaacaacucgcccgacggcaacaccgacuccagcgcccuggacuguuacaaccccaugaccaaucaguggucgcccugcgcccccaugagcgugccccguaaccgcaucggggugggggucaucgauggccacaucuaugccgucggcggcucccacggcugcauccaccacaacaguguggagagguaugagccagagcgggaugaguggcacuugguggccccaaugcugacacgaaggaucggggugggcguggcuguccucaaucgucuccuuuaugccguggggggcuuugacgggacaaaccgccuuaauucagcugaguguuacuacccagagaggaacgaguggcgaaugaucacagcaaugaacaccauccgaagcggggcaggcgucugcguccugcacaacuguaucuaugcugcugggggcuaugauggucaggaccagcugaacagcguggagcgcuacgauguggaaacagagacguggacuuucguagcccccaugaagcaccggcgaagugcccuggggaucacuguccaccaggggagaaucuacguccuuggaggcuaugauggucacacguuccuggacaguguggaguguuacgacccagauacagacaccuggagcgaggugacccgaaugacaucgggccggaguggggugggcguggcugucaccauggagcccugccggaagcagauugaccagcagaacuguaccuguugaggcacuuuuguuucuugggcaaaaauacaguccaauggggaguaucauuguuuuuguacaaaaaccgggacuaaaagaaaagacagcacugcaaauaacccaucuuccgggaagggaggccaggaugccucaguguuaaaaugacaucucaaaagaaguccaaagcgggaaucaugugccccucagcggagccccgggaguguccaagacagccuggcugggaaaggggguguggaaagagcaggcuuccaggagagaggcccccaaacccucuggccggguaauaggccugggucccacucacccaugccggcagcugucaccaugugauuuauucuuggauaccugggagggggccaaugggggccucagggggaggcccccucuggaaaugugguucccagggaugggccuguacauagaagccaccggauggcacuuccccaccggauggacaguuauuuuguugauaaguaacccuguaauuuuccaaggaaaauaaagaacagacuaacuagugucuuucacccugaaaaaaaaaaaaaa

SEQ ID NO: 25 - RNA, 2577 nt, Homo sapiens
ucugcuuagucauggugaccugcgcgcgcuccgcgccucccccacgcgcagcgauggaggcgccggggcucgggcgguggaggcggagccggagcgcggccauggcggggucccugagugccagagguggugguguugcuuaucuucuggaaccccaugcagccagaucccaggccuagcggggcuggggccugcugccgauuccugccccugcagucacagugcccugagggggcaggggacgcggugauguacgccuccacugagugcaaggcggaggugacgcccucccagcauggcaaccgcaccuucagcuacacccuggaggaucauaccaagcaggccuuuggcaucaugaacgagcugcggcucagccagcagcugugugacgucacacugcaggucaaguaccaggaugcaccggccgcccaguucauggcccacaagguggugcuggccucauccagcccugucuucaaggccauguucaccaacgggcugcgggagcagggcauggaggugguguccauugaggguauccaccccaaggucauggagcgccucauugaauucgccuacacggccuccaucuccaugggcgagaaguguguccuccacgucaugaacggugcugucauguaccagaucgacagcguuguccgugccugcagugacuuccuggugcagcagcuggaccccagcaaugccaucggcaucgccaacuucgcugagcagauuggcuguguggaguugcaccagcgugcccgggaguacaucuacaugcauuuuggggagguggccaagcaagaggaguucuucaaccugucccacugccaacuggugacccucaucagccgggacgaccugaacgugcgcugcgaguccgaggucuuccacgccugcaucaacugggucaaguacgacugcgaacagcgacgguucuacguccaggcgcugcugcgggccgugcgcugccacucguugacgccgaacuuccugcagaugcagcugcagaagugcgagauccugcaguccgacucccgcugcaaggacuaccuggucaagaucuucgaggagcucacccugcacaagcccacgcaggugaugcccugccgggcgcccaaggugggccgccugaucuacaccgcgggcggcuacuuccgacagucgcucagcuaccuggaggcuuacaaccccagugacggcaccuggcuccgguuggcggaccugcaggugccgcggagcggccuggccggcugcguggugggcgggcuguuguacgccgugggcggcaggaacaacucgcccgacggcaacaccgacuccagcgcccuggacuguuacaaccccaugaccaaucaguggucgcccugcgcccccaugagcgugccccguaaccgcaucggggugggggucaucgauggccacaucuaugccgucggcggcucccacggcugcauccaccacaacaguguggagagguaugagccagagcgggaugaguggcacuugguggccccaaugcugacacgaaggaucggggugggcguggcuguccucaaucgucuccuuuaugccguggggggcuuugacgggacaaaccgccuuaauucagcugaguguuacuacccagagaggaacgaguggcgaaugaucacagcaaugaacaccauccgaagcggggcaggcgucugcguccugcacaacuguaucuaugcugcugggggcuaugauggucaggaccagcugaacagcguggagcgcuacgauguggaaacagagacguggacuuucguagcccccaugaagcaccggcgaagugcccuggggaucacuguccaccaggggagaaucuacguccuuggaggcuaugauggucacacguuccuggacaguguggaguguuacgacccagauacagacaccuggagcgaggugacccgaaugacaucgggccggaguggggugggcguggcugucaccauggagcccugccggaagcagauugaccagcagaacuguaccuguugaggcacuuuuguuucuugggcaaaaauacaguccaauggggaguaucauuguuuuuguacaaaaaccgggacuaaaagaaaagacagcacugcaaauaacccaucuuccgggaagggaggccaggaugccucaguguuaaaaugacaucucaaaagaaguccaaagcgggaaucaugugccccucagcggagccccgggaguguccaagacagccuggcugggaaaggggguguggaaagagcaggcuuccaggagagaggcccccaaacccucuggccggguaauaggccugggucccacucacccaugccggcagcugucaccaugugauuuauucuuggauaccugggagggggccaaugggggccucagggggaggcccccucuggaaaugugguucccagggaugggccuguacauagaagccaccggauggcacuuccccaccggauggacaguuauuuuguugauaaguaacccuguaauuuuccaaggaaaauaaagaacagacuaacuagugucuuucacccugaaaaaaaaaaaaaa

SEQ ID NO: 26 - RNA, 3493 nt, Homo sapiens
agagaagaggcuccacguugggcggggauggggccugaaacugucugggucugagcuggggagcggaagccacuugucccucucccuccccaggacuucugugacuccugggccacagagguccaaccaggcuaagggccuggggauacccccugccuggcccccuugcccaaacuggcaggggggccaggcugggcagcagccccucuuucaccucaacuauggaucuccugccccccaagcccaaguacaauccacuccggaaugagucucugucaucgcuggaggaaggggcuucuggguccacccccccggaggagcugccuuccccaucagcuucaucccuggggcccauccugccuccucugccuggggacgauagucccacuacccugugcuccuucuucccccggaugagcaaccugaggcuggccaacccggcuggggggcgcccagggucuaagggggagccaggaagggcagcugaugauggggaggggaucguaggggcagccaugccagacucaggcccccuaccccuccuccaggacaugaacaagcugaguggaggcggcgggcgcaggacucggguggaagggggccagcuugggggcgaggaguggacccgccacgggagcuuugucaauaagcccacgcggggcuggcugcaucccaacgacaaagucaugggacccgggguuuccuacuugguucgguacauggguuguguggagguccuccagucaaugcgugcccuggacuucaacacccggacucaggucaccagggaggccaucagucuggugugugaggcugugccgggugcuaagggggcgacaaggaggagaaagcccuguagccgcccgcucagcucuauccuggggaggaguaaccugaaauuugcuggaaugccaaucacucucaccgucuccaccagcagccucaaccucauggccgcagacugcaaacagaucaucgccaaccaccacaugcaaucuaucucauuugcauccggcggggauccggacacagccgaguaugucgccuauguugccaaagacccugugaaucagagagccugccacauucuggagugucccgaagggcuugcccaggaugucaucagcaccauuggccaggccuucgaguugcgcuucaaacaauaccucaggaacccacccaaacuggucaccccucaugacaggauggcuggcuuugauggcucagcaugggaugaggaggaggaagagccaccugaccaucaguacuauaaugacuucccggggaaggaaccccccuuggggggggugguagacaugaggcuucgggaaggagccgcuccaggggcugcucgacccacugcacccaaugcccagacccccagccacuugggagcuacauugccuguaggacagccuguugggggagauccagaaguccgcaaacagaugccaccuccaccacccuguccaggcagagagcuuuuugaugaucccuccuaugucaacguccagaaccuagacaaggcccggcaagcaguggguggugcugggccccccaauccugcuaucaauggcagugcaccccgggaccuguuugacaugaagcccuucgaagaugcucuucgcgugccuccaccuccccagucgguguccauggcugagcagcuccgaggggagcccugguuccaugggaagcugagccggcgggaggcugaggcacugcugcagcucaauggggacuuccugguacgggagagcacgaccacaccuggccaguaugugcucacuggcuugcagagugggcagccuaagcauuugcuacugguggacccugagggugugguucggacuaaggaucaccgcuuugaaagugucagucaccuuaucagcuaccacauggacaaucacuugcccaucaucucugcgggcagcgaacugugucuacagcaaccuguggagcggaaacugugaucugcccuagcgcucucuuccagaagaugcccuccaauccuuuccacccuauucccuaacucucgggaccucguuugggaguguucugugggcuuggccuugugucagagcugggaguagcauggacucuggguuucauauccagcugagugagaggguuugagucaaaagccugggugagaauccugccucuccccaaacauuaaucaccaaaguauuaauguacagaguggccccucaccugggccuuuccugugccaaccugaugccccuuccccaagaaggugagugcuugucauggaaaauguccuguggugacaggcccaguggaacagucacccuucugggcaagggggaacaaaucacaccucugggcuucaggguaucccagaccccucucaacacccgccccccccauguuuaaacuuugugccuuugaccaucucuuaggucuaaugauauuuuaugcaaacaguucuuggaccccugaauucaaugacagggaugccaacaccuucuuggcuucugggaccuguguucuugcugagcacccucuccgguuuggguugggauaacagaggcaggaguggcagcuguccccucucccuggggauaugcaacccuuagagauugccccagagccccacucccggccaggcgggagauggaccccucccuugcucagugccuccuggccggggccccucaccccaaggggucuguauauacauuucauaaggccugcccucccauguugcaugccuauguacucuacgccaaagugcagcccuuccuccugaagccucugcccugccucccuuucugggagggcggggugggggugacugaauuugggccucuuguacaguuaacucucccagguggauuuuguggaggugagaaaaggggcauugagacuauaaagcaguagacaauccccacauaccaucuguagaguuggaacugcauucuuuuaaaguuuuauaugcauauauuuuagggcuguagacuuacuuuccuauuuucuuuuccauugcuuauucuugagcacaaaaugauaaucaauuauuacauuuauacaucaccuuuuugacuuuuccaagcccuuuuacagcucuuggcauuuuccucgccuaggccugugagguaacugggaucgcaccuuuuauaccagagaccugaggcagaugaaauuuauuuccaucuaggacuagaaaaacuugggucucuuaccgcgagacugagaggcagaagucagcccgaaugccugucaguuucauggaggggaaacgcaaaaccugcaguuccugaguaccuucuacaggcccggcccagccuaggcccgggguggccacaccacagcaagccggcccccccucuuuuggccuuguggauaagggagaguugaccguuuucauccuggccuccuuuugcuguuuggauguuuccacgggucucacuuauaccaaagggaaaacucuucauuaaaguccguauuucuucuaaaaaaaaaaaaaaaa

SEQ ID NO: 27 - RNA, 3195 nt, Homo sapiens
acugccuuugugcgcgaucucgcgcugccauuggcuaacucgggaaagugggaagcgugaaggagggacccugagguagagggucagggguuagugaggccggaagugaguguaauaaaguuucuccagggaggcagggcccggggagaaaguuggagcgguaaccuaagcuggcaguggcgugauccggcaccaaaucggcccgcggugcggugcggagacuccaugaggcccuggacaugaacaagcugaguggaggcggcgggcgcaggacucggguggaagggggccagcuugggggcgaggaguggacccgccacgggagcuuugucaauaagcccacgcggggcuggcugcaucccaacgacaaagucaugggacccgggguuuccuacuugguucgguacauggguuguguggagguccuccagucaaugcgugcccuggacuucaacacccggacucaggucaccagggaggccaucagucuggugugugaggcugugccgggugcuaagggggcgacaaggaggagaaagcccuguagccgcccgcucagcucuauccuggggaggaguaaccugaaauuugcuggaaugccaaucacucucaccgucuccaccagcagccucaaccucauggccgcagacugcaaacagaucaucgccaaccaccacaugcaaucuaucucauuugcauccggcggggauccggacacagccgaguaugucgccuauguugccaaagacccugugaaucagagagccugccacauucuggagugucccgaagggcuugcccaggaugucaucagcaccauuggccaggccuucgaguugcgcuucaaacaauaccucaggaacccacccaaacuggucaccccucaugacaggauggcuggcuuugauggcucagcaugggaugaggaggaggaagagccaccugaccaucaguacuauaaugacuucccggggaaggaaccccccuuggggggggugguagacaugaggcuucgggaaggagccgcuccaggggcugcucgacccacugcacccaaugcccagacccccagccacuugggagcuacauugccuguaggacagccuguugggggagauccagaaguccgcaaacagaugccaccuccaccacccuguccagcaggcagagagcuuuuugaugaucccuccuaugucaacguccagaaccuagacaaggcccggcaagcaguggguggugcugggccccccaauccugcuaucaauggcagugcaccccgggaccuguuugacaugaagcccuucgaagaugcucuucgcgugccuccaccuccccagucgguguccauggcugagcagcuccgaggggagcccugguuccaugggaagcugagccggcgggaggcugaggcacugcugcagcucaauggggacuuccugguacgggagagcacgaccacaccuggccaguaugugcucacuggcuugcagagugggcagccuaagcauuugcuacugguggacccugagggugugguucggacuaaggaucaccgcuuugaaagugucagucaccuuaucagcuaccacauggacaaucacuugcccaucaucucugcgggcagcgaacugugucuacagcaaccuguggagcggaaacugugaucugcccuagcgcucucuuccagaagaugcccuccaauccuuuccacccuauucccuaacucucgggaccucguuugggaguguucugugggcuuggccuugugucagagcugggaguagcauggacucuggguuucauauccagcugagugagaggguuugagucaaaagccugggugagaauccugccucuccccaaacauuaaucaccaaaguauuaauguacagaguggccccucaccugggccuuuccugugccaaccugaugccccuuccccaagaaggugagugcuugucauggaaaauguccuguggugacaggcccaguggaacagucacccuucugggcaagggggaacaaaucacaccucugggcuucaggguaucccagaccccucucaacacccgccccccccauguuuaaacuuugugccuuugaccaucucuuaggucuaaugauauuuuaugcaaacaguucuuggaccccugaauucaaugacagggaugccaacaccuucuuggcuucugggaccuguguucuugcugagcacccucuccgguuuggguugggauaacagaggcaggaguggcagcuguccccucucccuggggauaugcaacccuuagagauugccccagagccccacucccggccaggcgggagauggaccccucccuugcucagugccuccuggccggggccccucaccccaaggggucuguauauacauuucauaaggccugcccucccauguugcaugccuauguacucuacgccaaagugcagcccuuccuccugaagccucugcccugccucccuuucugggagggcggggugggggugacugaauuugggccucuuguacaguuaacucucccagguggauuuuguggaggugagaaaaggggcauugagacuauaaagcaguagacaauccccacauaccaucuguagaguuggaacugcauucuuuuaaaguuuuauaugcauauauuuuagggcuguagacuuacuuuccuauuuucuuuuccauugcuuauucuugagcacaaaaugauaaucaauuauuacauuuauacaucaccuuuuugacuuuuccaagcccuuuuacagcucuuggcauuuuccucgccuaggccugugagguaacugggaucgcaccuuuuauaccagagaccugaggcagaugaaauuuauuuccaucuaggacuagaaaaacuugggucucuuaccgcgagacugagaggcagaagucagcccgaaugccugucaguuucauggaggggaaacgcaaaaccugcaguuccugaguaccuucuacaggcccggcccagccuaggcccgggguggccacaccacagcaagccggcccccccucuuuuggccuuguggauaagggagaguugaccguuuucauccuggccuccuuuugcuguuuggauguuuccacgggucucacuuauaccaaagggaaaacucuucauuaaaguccguauuucuucuaaaaaaaaaaaaaaaaaaaaaaaaaaa

SEQ ID NO: 28 - RNA, 1492 nt, Homo sapiens
cgggcgacagcagggccgcggugcaguguccgacccgagaguugcggccugagucaccggccccgcccuccggagccggacgcugcgggaggcccgggagcggcaguggaaccgacucccagaacuccggacgugugcggcgcagugagucgcagccauguuccugguuaacucguucuugaagggcggcggcggcggcggcgggggaggcgggggccugggugggggccugggaaaugugcuuggaggccugaucagcggggccgggggcggcggcggcggcggcggcggcggcggcggugguggaggcggcgguggcgguggaacggccaugcgcauccuaggcggagucaucagcgccaucagcgaggcggcugcgcaguacaacccggagcccccgcccccacgcacacauuacuccaacauugaggccaacgagagugaggagguccggcaguuccggagacucuuugcccagcuggcuggagaugacauggaggucagcgccacagaacucaugaacauucucaauaagguugugacacgacacccugaucugaagacugaugguuuuggcauugacacaugucgcagcaugguggccgugauggauagcgacaccacaggcaagcugggcuuugaggaauucaaguacuuguggaacaacaucaaaagguggcaggccauauacaaacaguucgacacugaccgaucagggaccauuugcaguagugaacucccaggugccuuugaggcagcaggguuccaccugaaugagcaucucuauaacaugaucauccgacgcuacucagaugaaagugggaacauggauuuugacaacuucaucagcugcuuggucaggcuggacgccauguuccgugccuucaaaucucuugacaaagauggcacuggacaaauccaggugaacauccaggaguggcugcagcugacuauguauuccugaacuggagccccagacccgcccccucacugccuugcuauaggagucaccuggagccucggucucucccagggccgauccugucugcagucacaucuuuguggggccugcugacccacaagcuuuuguucucucaguacuuguuacccagcuucucaacauccagggcccaauuugcccugccuggaguucccccuggcucuaggacacucuaacaagcucuguccacgggucuccccauucccaccaggcccugcacacacccacuccguaaccucuccccuguaccugugccaagccuagcacuugugaugccuccaugccccgagggcccucucucaguucugggaggaugacuccagucccugcacgcccuggcacacccuucacgguugcuacccaggcggccaagcuccagaccgugccagacccaggugccccagugccuuugucuauauucugcucccagccugccaggcccaggaggaaauaaacaugccccaguugcugaucucuaaaaaaaaaaaaaaa

SEQ ID NO: 29 - RNA, 1489 nt, Homo sapiens
cgggcgacagcagggccgcggugcaguguccgacccgagaguugcggccugagucaccggccccgcccuccggagccggacgcugcgggaggcccgggagcggcaguggaaccgacucccagaacuccggacgugugcggcgugagucgcagccauguuccugguuaacucguucuugaagggcggcggcggcggcggcgggggaggcgggggccugggugggggccugggaaaugugcuuggaggccugaucagcggggccgggggcggcggcggcggcggcggcggcggcggcggugguggaggcggcgguggcgguggaacggccaugcgcauccuaggcggagucaucagcgccaucagcgaggcggcugcgcaguacaacccggagcccccgcccccacgcacacauuacuccaacauugaggccaacgagagugaggagguccggcaguuccggagacucuuugcccagcuggcuggagaugacauggaggucagcgccacagaacucaugaacauucucaauaagguugugacacgacacccugaucugaagacugaugguuuuggcauugacacaugucgcagcaugguggccgugauggauagcgacaccacaggcaagcugggcuuugaggaauucaaguacuuguggaacaacaucaaaagguggcaggccauauacaaacaguucgacacugaccgaucagggaccauuugcaguagugaacucccaggugccuuugaggcagcaggguuccaccugaaugagcaucucuauaacaugaucauccgacgcuacucagaugaaagugggaacauggauuuugacaacuucaucagcugcuuggucaggcuggacgccauguuccgugccuucaaaucucuugacaaagauggcacuggacaaauccaggugaacauccaggaguggcugcagcugacuauguauuccugaacuggagccccagacccgcccccucacugccuugcuauaggagucaccuggagccucggucucucccagggccgauccugucugcagucacaucuuuguggggccugcugacccacaagcuuuuguucucucaguacuuguuacccagcuucucaacauccagggcccaauuugcccugccuggaguucccccuggcucuaggacacucuaacaagcucuguccacgggucuccccauucccaccaggcccugcacacacccacuccguaaccucuccccuguaccugugccaagccuagcacuugugaugccuccaugccccgagggcccucucucaguucugggaggaugacuccagucccugcacgcccuggcacacccuucacgguugcuacccaggcggccaagcuccagaccgugccagacccaggugccccagugccuuugucuauauucugcucccagccugccaggcccaggaggaaauaaacaugccccaguugcugaucucuaaaaaaaaaaaaaaa

SEQ ID NO: 30 - RNA, 4001 nt, Homo sapiens
aggcaucagcaaucuaucagggaacggcgguggccggugcggcguguucgguggcggcucuggccgcucaggcgccugcggcugggugagcgcacgcgaggcggcgaggcggcagcguguuucuaggucguggcgucgggcuuccggagcuuuggcggcagcuaggggaggauggcggagucuucggauaagcucuaucgagucgaguacgccaagagcgggcgcgccucuugcaagaaaugcagcgagagcauccccaaggacucgcuccggauggccaucauggugcagucgcccauguuugauggaaaagucccacacugguaccacuucuccugcuucuggaaggugggccacuccauccggcacccugacguugagguggauggguucucugagcuucggugggaugaccagcagaaagucaagaagacagcggaagcuggaggagugacaggcaaaggccaggauggaauugguagcaaggcagagaagacucugggugacuuugcagcagaguaugccaaguccaacagaaguacgugcaagggguguauggagaagauagaaaagggccaggugcgccuguccaagaagaugguggacccggagaagccacagcuaggcaugauugaccgcugguaccauccaggcugcuuugucaagaacagggaggagcuggguuuccggcccgaguacagugcgagucagcucaagggcuucagccuccuugcuacagaggauaaagaagcccugaagaagcagcucccaggagucaagagugaaggaaagagaaaaggcgaugagguggauggaguggaugaaguggcgaagaagaaaucuaaaaaagaaaaagacaaggauaguaagcuugaaaaagcccuaaaggcucagaacgaccugaucuggaacaucaaggacgagcuaaagaaaguguguucaacuaaugaccugaaggagcuacucaucuucaacaagcagcaagugccuucuggggagucggcgaucuuggaccgaguagcugauggcaugguguucggugcccuccuucccugcgaggaaugcucgggucagcuggucuucaagagcgaugccuauuacugcacuggggacgucacugccuggaccaaguguauggucaagacacagacacccaaccggaaggaguggguaaccccaaaggaauuccgagaaaucucuuaccucaagaaauugaagguuaaaaaacaggaccguauauuccccccagaaaccagcgccuccguggcggccacgccuccgcccuccacagccucggcuccugcugcugugaacuccucugcuucagcagauaagccauuauccaacaugaagauccugacucucgggaagcugucccggaacaaggaugaagugaaggccaugauugagaaacucggggggaaguugacggggacggccaacaaggcuucccugugcaucagcaccaaaaaggagguggaaaagaugaauaagaagauggaggaaguaaaggaagccaacauccgaguugugucugaggacuuccuccaggacgucuccgccuccaccaagagccuucaggaguuguucuuagcgcacaucuuguccccuuggggggcagaggugaaggcagagccuguugaaguuguggccccaagagggaagucaggggcugcgcucuccaaaaaaagcaagggccaggucaaggaggaagguaucaacaaaucugaaaagagaaugaaauuaacucuuaaaggaggagcagcuguggauccugauucuggacuggaacacucugcgcauguccuggagaaaggugggaaggucuucagugccacccuuggccugguggacaucguuaaaggaaccaacuccuacuacaagcugcagcuucuggaggacgacaaggaaaacagguauuggauauucagguccuggggccguguggguacggugaucgguagcaacaaacuggaacagaugccguccaaggaggaugccauugagcacuucaugaaauuauaugaagaaaaaaccgggaacgcuuggcacuccaaaaauuucacgaaguaucccaaaaaguucuacccccuggagauugacuauggccaggaugaagaggcagugaagaagcugacaguaaauccuggcaccaaguccaagcuccccaagccaguucaggaccucaucaagaugaucuuugauguggaaaguaugaagaaagccaugguggaguaugagaucgaccuucagaagaugcccuuggggaagcugagcaaaaggcagauccaggccgcauacuccauccucagugagguccagcaggcggugucucagggcagcagcgacucucagauccuggaucucucaaaucgcuuuuacacccugaucccccacgacuuugggaugaagaagccuccgcuccugaacaaugcagacagugugcaggccaagguggaaaugcuugacaaccugcuggacaucgagguggccuacagucugcucaggggagggucugaugauagcagcaaggaucccaucgaugucaacuaugagaagcucaaaacugacauuaaggugguugacagagauucugaagaagccgagaucaucaggaaguauguuaagaacacucaugcaaccacacacaaugcguaugacuuggaagucaucgauaucuuuaagauagagcgugaaggcgaaugccagcguuacaagcccuuuaagcagcuucauaaccgaagauugcuguggcacggguccaggaccaccaacuuugcugggauccugucccagggucuucggauagccccgccugaagcgcccgugacaggcuacauguuugguaaagggaucuauuucgcugacauggucuccaagagugccaacuacugccauacgucucagggagacccaauaggcuuaauccuguugggagaaguugcccuuggaaacauguaugaacugaagcacgcuucacauaucagcaaguuacccaagggcaagcacagugucaaagguuugggcaaaacuaccccugauccuucagcuaacauuagucuggaugguguagacguuccucuugggaccgggauuucaucuggugugaaugacaccucucuacuauauaacgaguacauugucuaugauauugcucagguaaaucugaaguaucugcugaaacugaaauucaauuuuaagaccucccugugguaauugggagagguagccgagucacacccgguggcucugguaugaauucacccgaagcgcuucugcaccaacucaccuggccgcuaaguugcugauggguaguaccuguacuaaaccaccucagaaaggauuuuacagaaacguguuaaagguuuucucuaacuucucaagucccuuguuuuguguugugucuguggggagggguuguuuugggguuguuuuuguuuuuucuugccagguagauaaaacugacauagagaaaaggcuggagagagauucuguugcauagacuaguccuauggaaaaaaccaagcuucguuagaaugucugccuuacugguuuccccagggaaggaaaaauacacuuccacccuuuuuucuaaguguucgucuuuaguuuugauuuuggaaagauguuaagcauuuauuuuuaguuaaaaauaaaaacuaauuucauacuauuuagauuuucuuuuuuaucuugcacuuauuguccccuuuuuaguuuuuuuuguuugccucuuguggugaggggugugggaagaccaaaggaaggaacgcuaacaauuucucauacuuagaaacaaaaagagcuuuccuucuccaggaauacugaacaugggagcucuugaaauauguaguauuaaaaguugcauuugaaauucuugacuuucuuaugggcacuuuugucuuccaaauuaaaacucuaccacaaauauacuuacccaagggcuaauaguaauacucgauuaaaaaugcagaugccuucucuaaaaaaaaaaaaaaaaa

SEQ ID NO: 31 - RNA, 1925 nt, Homo sapiens
gcccaggcuggagugcaauggugugaucucugcucaccacaaccuccgccucccagguucaagcgauucuccugucucagccucuggaguagcugggauuacaggcaugcaccaccacaccuggcuaauuuuguauuuuugguagagacaggguuucuccauguuggucaggcuggucuugaacucccaaccucaggugauccacccaccucggccacccaaagugcugggauuauaggugugagucacugcaccuggccaacagcaauacuuucuuuccuuucuuuuccucuacccucuaugccaggacuccuuagaaauaaaauauuaaggaaagugaguuaugaagaugauaagggcaaugcagacuacagaauuaugggugucuuugaacugcugcuuccuguaaaaugccaaaaacuucuuugggcacaugaugguucccagcuugagagaucugugagcuccaguuggaauguuucauggcaacuaguuuucuuaauguucuuuuucagauauaugaaaucagggcaucuuuucaggaggaugcuuccuauucagagguugcaaagcacuuauguaagccuuaggugacugcauggguggaagugcacagaguucaccaucugaagcuuaaucuggggccagcaguucugauaccuguuguauuugcguuacaaaugaacuugagcaccgaggcccucaugcccacuguccuguaagugggcgcucggccuggauugcagcucugcccugucuguagugagggcugccugcugcuccuuuacuucucuuccuguauuccuaggauugacuuuugcuuccugcuguaacuacucuguuucuucuucccagcucgagccuugggcacagaagugauucaacucuuccccgagaaaggaaauaugggaaagauccuccccgaauaccucagcaacuggaccauggaaaaagucagacgagaggggguuaaggugaugcccaaugcuauugugcaauccguuggagucagcaguggcaaguuacuuaucaagcugaaagacggcaggaagguagaaacugaccacauaguggcagcugugggccuggagcccaauguugaguuggccaagacugguggccuggaaauagacucagauuuugguggcuuccggguaaaugcagagcuacaagcacgcucuaacaucuggguggcaggagaugcugcaugcuucuacgauauaaaguugggaaggaggcggguagagcaccaugaucacgcuguugugaguggaagauuggcuggagaaaauaugacuggagcugcuaagccguacuggcaucagucaauguucuggagugauuugggccccgauguuggcuaugaagcuauuggucuuguggacaguaguuugcccacaguugguguuuuugcaaaagcaacugcacaagacaaccccaaaucugccacagagcagucaggaacugguauccgaucagagagugagacagaguccgaggccucagaaauuacuauuccucccagcaccccggcaguuccacaggcucccguccagggggaggacuacggcaaaggugucaucuucuaccucagggacaaaguggucguggggauugugcuauggaacaucuuuaaccgaaugccaauagcaaggaagaucauuaaggacggugagcagcaugaagaucucaaugaaguagccaaacuauucaacauucaugaagacugaagccccacaguggaauuggcaaacccacugcagccccugagaggaggucgaauggguaaaggagcauuuuuuuauucagcagacuuucucuguguaugagugugaaugaucaaguccuuugugaauauuuucaacuauguagguaaauucuuaauguucacauagugaaauaaauucugauucuucuaaauuaaa

SEQ ID NO: 32 - RNA, 2418 nt, Homo sapiens
uuccccggcucuagcaggccggcuucucuguccaaugcccacccggagcugggaggaggagucugcguaaugugcgugugaagagacugggggagcuggccggggcucacgguguuugacccgucggucgugcgugagaggaaagggaaggaggaggucccgaauagcggucgccgaaauguuccgguguggaggccuggcggcgggugcuuugaagcagaagcuggugcccuuggugcggaccgugugcguccgaagcccgaggcagaggaaccggcucccaggcaacuuguuccagcgauggcauguuccucuagaacuccagaugacaagacaaauggcuagcucuggugcaucagggggcaaaaucgauaauucuguguuaguccuuauugugggcuuaucaacaguaggagcuggugccuaugccuacaagacuaugaaagaggaugaaaaaagauacaaugaaagaauuucaggguuagggcugacaccagaacagaaacagaaaaaggccgcguuaucugcuucagaaggagaggaaguuccucaagacaaggcgccaagucauguuccuuuccugcuaauugguggaggcacagcugcuuuugcugcagccagauccauccgggcucgggauccuggggccaggguacugauuguaucugaagauccugagcugccguacaugcgaccuccucuuucaaaagaacugugguuuucagaugacccaaaugucacaaagacacugcgauucaaacaguggaauggaaaagagagaagcauauauuuccagccaccuucuuucuaugucucugcucaggaccugccucauauugagaauggugguguggcuguccucacugggaagaagguaguacagcuggaugugagagacaacauggugaaacuuaaugauggcucucaaauaaccuaugaaaagugcuugauugcaacaggagguacuccaagaagucugucugccauugauagggcuggagcagaggugaagaguagaacaacgcuuuucagaaagauuggagacuuuagaagcuuggagaagauuucacgggaagucaaaucaauuacgauuaucggugggggcuuccuugguagcgaacuggccugugcucuuggcagaaaggauauaugaaaucagggcaucuuuucaggaggaugcuuccuauucagagguugcaaagcacuuauguaagccuuaggugacugcauggguggaagugcacagaguucaccaucugaagcuuaaucuggggccagcaguucugauaccuguuguauuugcguuacaaaugaacuugagcaccgaggcccucaugcccacuguccucucgagccuugggcacagaagugauucaacucuuccccgagaaaggaaauaugggaaagauccuccccgaauaccucagcaacuggaccauggaaaaagucagacgagaggggguuaaggugaugcccaaugcuauugugcaauccguuggagucagcaguggcaaguuacuuaucaagcugaaagacggcaggaagguagaaacugaccacauaguggcagcugugggccuggagcccaauguugaguuggccaagacugguggccuggaaauagacucagauuuugguggcuuccggguaaaugcagagcuacaagcacgcucuaacaucuggguggcaggagaugcugcaugcuucuacgauauaaaguugggaaggaggcggguagagcaccaugaucacgcuguugugaguggaagauuggcuggagaaaauaugacuggagcugcuaagccguacuggcaucagucaauguucuggagugauuugggccccgauguuggcuaugaagcuauuggucuuguggacaguaguuugcccacaguugguguuuuugcaaaagcaacugcacaagacaaccccaaaucugccacagagcagucaggaacugguauccgaucagagagugagacagaguccgaggccucagaaauuacuauuccucccagcaccccggcaguuccacaggcucccguccagggggaggacuacggcaaaggugucaucuucuaccucagggacaaaguggucguggggauugugcuauggaacaucuuuaaccgaaugccaauagcaaggaagaucauuaaggacggugagcagcaugaagaucucaaugaaguagccaaacuauucaacauucaugaagacugaagccccacaguggaauuggcaaacccacugcagccccugagaggaggucgaauggguaaaggagcauuuuuuuauucagcagacuuucucuguguaugagugugaaugaucaaguccuuugugaauauuuucaacuauguagguaaauucuuaauguucacauagugaaauaaauucugauucuucuaaauuaaa

SEQ ID NO: 33 - RNA, 7126 nt, Homo sapiens
agagcggcucuuuuaaugaggguugcgacgucucccuccccacacccauaaaccagucggguuggacgucacugcuaauucguuucagugaugauaggauaaaggagggacauuaagaaauaaauucccccucacgacccucgcugagcucacggcucagucccuacauauuuaugccgcguuuccagccgcugggugaggagcuacuuagcgccgcggcuccuccgaggggcggccgggcagcgagcagcggccgagcggacgggcucaugaugccucagaucugauccgcaucuaacaggcuggcaaugaagauacccagagaauaguucacaucuaucaugcgucacuucuagacacagccaucagacgcaucuccuccccuuucugccugaccuuagggacacgucccaccgccucucuugacgucugccuggucaaccaucacuuccuuagagaauaaggagagaggcggaugcaggaaaucaugccaccgacgggccaccagccaugagugggugacgcugagcugacgucaaagacagagagggcugaagccuugucagcaccugucaccccggcuccugcucuccguguagccugaagccuggauccuccuggugaaaucaucuuggccugauagcauugugaggucuucagacaggaccccucggaagcuaguuaccauggaggaucacauguucgguguucagcaaauccagcccaaugucauuucuguucgucucuucaagcgcaaaguugggggccugggauuucuggugaaggagcgggucaguaagccgcccgugaucaucucugaccugauucgugggggcgccgcagagcagaguggccucauccaggccggagacaucauucuugcggucaacggccggcccuugguggaccugagcuaugacagcgcccuggagguacucagaggcauugccucugagacccacgugguccucauucugaggggcccugaagguuucaccacgcaccuggagaccaccuuuacaggugaugggacccccaagaccauccgggugacacagccccuggguccccccaccaaagccguggaucugucccaccagccaccggccggcaaagaacagccccuggcaguggauggggccucgggucccgggaaugggccucagcaugccuacgaugaugggcaggaggcuggcucacucccccaugccaacggccuggcccccaggcccccaggccaggaccccgcgaagaaagcaaccagagucagccuccaaggcagaggggagaacaaugaacugcucaaggagauagagccugugcugagccuucucaccagugggagcagaggggucaagggaggggcaccugccaaggcagagaugaaagauaugggaauccagguggacagagauuuggacggcaagucacacaaaccucugccccucggcguggagaacgaccgagucuucaaugaccuaugggggaagggcaaugugccugucguccucaacaacccauauucagagaaggagcagccccccaccucaggaaaacagucccccacaaagaauggcagccccuccaaguguccacgcuuccucaaggucaagaacugggagacugaggugguucucacugacacccuccaccuuaagagcacauuggaaacgggaugcacugaguacaucugcaugggcuccaucaugcauccuucucagcaugcaaggaggccugaagacguccgcacaaaaggacagcucuucccucucgccaaagaguuuauugaucaauacuauucaucaauuaaaagauuuggcuccaaagcccacauggaaaggcuggaagaggugaacaaagagaucgacaccacuagcacuuaccagcucaaggacacagagcucaucuauggggccaagcacgccuggcggaaugccucgcgcugugugggcaggauccagugguccaagcugcagguauucgaugcccgugacugcaccacggcccacgggauguucaacuacaucuguaaccaugucaaguaugccaccaacaaagggaaccucaggucugccaucaccauauucccccagaggacagacggcaagcacgacuuccgagucuggaacucccagcucauccgcuacgcuggcuacaagcagccugacggcuccacccugggggacccagccaaugugcaguucacagagauaugcauacagcagggcuggaaaccgccuagaggccgcuucgauguccugccgcuccugcuucaggccaacggcaaugacccugagcucuuccagauuccuccagagcugguguuggaaguucccaucaggcaccccaaguuugagugguucaaggaccuggggcugaagugguacggccuccccgccguguccaacaugcuccuagagauuggcggccuggaguucagcgccugucccuucaguggcugguacaugggcacagagauugguguccgcgacuacugugacaacucccgcuacaauauccuggaggaaguggccaagaagaugaacuuagacaugaggaagacguccucccuguggaaggaccaggcgcugguggagaucaauaucgcgguucucuauagcuuccagagugacaaagugaccauuguugaccaucacuccgccaccgaguccuucauuaagcacauggagaaugaguaccgcugccgggggggcugcccugccgacuggguguggaucgugccccccauguccggaagcaucaccccuguguuccaccaggagaugcucaacuaccggcucacccccuccuucgaauaccagccugaucccuggaacacgcaugucuggaaaggcaccaacgggacccccacaaagcggcgagccauuggcuucaagaagcuagcagaagcugucaaguucucggccaagcugauggggcaggcuauggccaagagggugaaagcgaccauccucuaugccacagagacaggcaaaucgcaagcuuaugccaagaccuugugugagaucuucaaacacgccuuugaugccaaggugauguccauggaagaauaugacauugugcaccuggaacaugaaacucugguccuuguggucaccagcaccuuuggcaauggagaucccccugagaauggggagaaauucggcugugcuuugauggaaaugaggcaccccaacucugugcaggaagaaaggaagagcuacaagguccgauucaacagcgucuccuccuacucugacucccaaaaaucaucaggcgaugggcccgaccucagagacaacuuugagagugcuggaccccuggccaaugugagguucucaguuuuuggccucggcucacgagcauacccucacuuuugcgccuucggacacgcuguggacacccuccuggaagaacugggaggggagaggauccugaagaugagggaaggggaugagcucugugggcaggaagaggcuuucaggaccugggccaagaaggucuucaaggcagccugugaugucuucugugugggagaugaugucaacauugaaaaggccaacaauucccucaucagcaaugaucgcagcuggaagagaaacaaguuccgccucaccuuuguggccgaagcuccagaacucacacaaggucuauccaauguccacaaaaagcgagucucagcugcccggcuccuuagccgucaaaaccuccagagcccuaaauccagucggucaacuaucuucgugcgucuccacaccaacgggagccaggagcugcaguaccagccuggggaccaccugggugucuucccuggcaaccacgaggaccucgugaaugcccugaucgagcggcuggaggacgcgccgccugucaaccagauggugaaaguggaacugcuggaggagcggaacacggcuuuaggugucaucaguaacuggacagacgagcuccgccucccgcccugcaccaucuuccaggccuucaaguacuaccuggacaucaccacgccaccaacgccucugcagcugcagcaguuugccucccuagcuaccagcgagaaggagaagcagcgucugcugguccucagcaaggguuugcaggaguacgaggaauggaaauggggcaagaaccccaccaucguggaggugcuggaggaguucccaucuauccagaugccggccacccugcuccugacccagcugucccugcugcagccccgcuacuauuccaucagcuccuccccagacauguacccugaugaagugcaccucacuguggccaucguuuccuaccgcacucgagauggagaaggaccaauucaccacggcguaugcuccuccuggcucaaccggauacaggcugacgaacugguccccuguuucgugagaggagcacccagcuuccaccugccccggaacccccaaguccccugcauccucguuggaccaggcaccggcauugccccuuuccgaagcuucuggcaacagcggcaauuugauauccaacacaaaggaaugaaccccugccccaugguccuggucuucgggugccggcaauccaagauagaucauaucuacagggaagagacccugcaggccaagaacaagggggucuucagagagcuguacacggcuuacucccgggagccagacaaaccaaagaaguacgugcaggacauccugcaggagcagcuggcggagucuguguaccgagcccugaaggagcaagggggccacauauacgucuguggggacgucaccauggcugcugauguccucaaagccauccagcgcaucaugacccagcaggggaagcucucggcagaggacgccggcguauucaucagccggaugagggaugacaaccgauaccaugaggauauuuuuggagucacccugcgaacguacgaagugaccaaccgccuuagaucugaguccauugccuucauugaagagagcaaaaaagacaccgaugagguuuucagcuccuaacuggacccucuugcccagccggcugcaaguuuuguaagcgcggacagacacugcugaaccuuuccucugggacccccuguggcccucgcucugccuccuguccuugucgcugugcccugguuucccuccucgggcuucucgccccucagugguuuccucggcccuccuggguuuacuccuugaguuuuccugcugcgaugcaaugcuuuucuaaucugcaguggcucuuacaaaacucuguucccacucccucucuugccgacaagggcaacucacgggugcaugaaaccacuggaacauggccgucgcuguggggguuuuuuucucugggguuccccuggaaaggcugcaggaacuaggcacaagcucucugagccagucccucagccacugaagucccccuuucuccuuuuuuaugaugacauuuugguugugcgugccugugugugugugugugugugugugugugugugugaugggccaggucucuguccguccucuucccugcacaagugugucgaucuuagauugccacugcuuucauugaagacccucaaugccaagaaacgugucccuggcccauauuaaucccucguguguccauaauuaggguccacgcccauguaccugaaacauuuggaagccccauaauuguucuaguuagaaaggguucagggcauggggagaggagugggaaauugauuaaaggggcugucucccaaugaaagaggcauucccagaauuugcugcauuuagauuuugauaccagugagcagagcccucaugugacaugaacccauccaauggauugugcaaauccccuccccaaacccacccauaccagcuagaaucacuugacuuugccacauccauugacugacccccuccuccagcaauagcauccaaggggccuggaaguuauguuguucaaagaagccugguggcaauaaggaucuucccacuuugccacuggaugacuuuggaugggucacuuguccucaguuuuuccuagucauaaugucauacgaaccuaaagaauaugaauggauuaaauguuaaagcuuuggugccuggaaacaauaucaaguaacaauaugauuauuauuuuuuuauucccccaaagcgggcuugcugcuucacccuuggggaugaaauaauggaagcugguuaaaguggaugagguuggaaagaguugccauaaugaggucccacguggcuucuucgauaggagccacaacuuggggugggaagaacuugucccucaggcuuguugcccucugcaguugaucuccaaaguuuuaaaccuguuaaauuaauuuugacaaauaaguuacccucaacucagaucaaaaaugggcagccaagucuucgguaggaauuggagccgguguaauuccucccuaagaggcaaccuguugaauuuacucucucagaguaaauggugggaagggaucccuuuguauacuuuuuuaaauacuacaaauuagugucaggcaguucccagaaagagacaagaaauccuaguggccucccagacugcaggguccccaaggauggaaagggaauguucugcugguucuacccuguuuguugugucuugcuauacagaaaaaccacauuucuuuuauauacuguacgugggcauaucuuguuguucaguuugggugucugcuaaagaggaagugcacuggcccucuuugaaagggcuuuacagugggggcaccaagaccccaaagggcccaggccaggagacuguuaaagugaaaaggcaaucuaugacucaccuugcucugccaucccuggcagcccccaccgguguccuguuccugccacauggagcuugacuucaugccagcuauaaucuccccugccuuccuuuaaucccaauuuccccugcucacucuuccacagauauaaagaacaaacacuuagcaucccacacucaccccuucuaauccugaagggaagcccauucuaaacuccuuuccugcaaacccauuuccagcuccuaguagcuuuccucccaaaggcuuucuuuccaauccuuuauagcuuuggagacgccuccccaauuccccagggaaggaaacuguuguguccaauccccauuaaagacaaauugaucagugcuuccc

SEQ ID NO: 34 - RNA, 4206 nt, Homo sapiens
auaacuuuguagcgagucgaaaacugaggcuccggccgcagagaacucagccucauuccugcuuuaaaaucucucggccaccuuugaugaggggacugggcaguucuagacagucccgaaguucucaaggcacaggucucuuccugguuugacuguccuuaccccggggaggcagugcagccagcugcaagccccacagugaagaacaucugagcucaaauccagauaagugacauaagugaccugcuuuguaaagccauagagauggccuguccuuggaaauuucuguucaagaccaaauuccaccaguaugcaaugaauggggaaaaagacaucaacaacaauguggagaaagcccccugugccaccuccaguccagugacacaggaugaccuucaguaucacaaccucagcaagcagcagaaugaguccccgcagccccucguggagacgggaaagaagucuccagaaucucuggucaagcuggaugcaaccccauuguccuccccacggcaugugaggaucaaaaacuggggcagcgggaugacuuuccaagacacacuucaccauaaggccaaagggauuuuaacuugcagguccaaaucuugccugggguccauuaugacucccaaaaguuugaccagaggacccagggacaagccuaccccuccagaugagcuucuaccucaagcuaucgaauuugucaaccaauauuacggcuccuucaaagaggcaaaaauagaggaacaucuggccaggguggaagcgguaacaaaggagauagaaacaacaggaaccuaccaacugacgggagaugagcucaucuucgccaccaagcaggccuggcgcaaugccccacgcugcauugggaggauccagugguccaaccugcaggucuucgaugcccgcagcuguuccacugcccgggaaauguuugaacacaucugcagacacgugcguuacuccaccaacaauggcaacaucaggucggccaucaccguguucccccagcggagugauggcaagcacgacuuccggguguggaaugcucagcucauccgcuaugcuggcuaccagaugccagauggcagcaucagaggggacccugccaacguggaauucacucagcugugcaucgaccugggcuggaagcccaaguacggccgcuucgauguggucccccugguccugcaggccaauggccgugacccugagcucuucgaaaucccaccugaccuugugcuugagguggccauggaacaucccaaauacgagugguuucgggaacuggagcuaaagugguacgcccugccugcaguggccaacaugcugcuugaggugggcggccuggaguucccagggugccccuucaauggcugguacaugggcacagagaucggaguccgggacuucugugacguccagcgcuacaacauccuggaggaagugggcaggagaaugggccuggaaacgcacaagcuggccucgcucuggaaagaccaggcugucguugagaucaacauugcugugcuccauaguuuccagaagcagaaugugaccaucauggaccaccacucggcugcagaauccuucaugaaguacaugcagaaugaauaccggucccgugggggcugcccggcagacuggauuuggcuggucccucccaugucugggagcaucacccccguguuucaccaggagaugcugaacuacguccuguccccuuucuacuacuaucagguagaggccuggaaaacccaugucuggcaggacgagaagcggagacccaagagaagagagauuccauugaaagucuuggucaaagcugugcucuuugccuguaugcugaugcgcaagacaauggcgucccgagucagagucaccauccucuuugcgacagagacaggaaaaucagaggcgcuggccugggaccugggggccuuauucagcugugccuucaaccccaagguugucugcauggauaaguacaggcugagcugccuggaggaggaacggcugcuguugguggugaccaguacguuuggcaauggagacugcccuggcaauggagagaaacugaagaaaucgcucuucaugcugaaagagcucaacaacaaauucagguacgcuguguuuggccucggcuccagcauguacccucgguucugcgccuuugcucaugacauugaucagaagcugucccaccugggggccucucagcucaccccgaugggagaaggggaugagcucagugggcaggaggacgccuuccgcagcugggccgugcaaaccuucaaggcagccugugagacguuugauguccgaggcaaacagcacauucagauccccaagcucuacaccuccaaugugaccugggacccgcaccacuacaggcucgugcaggacucacagccuuuggaccucagcaaagcccucagcagcaugcaugccaagaacguguucaccaugaggcucaaaucucggcagaaucuacaaaguccgacauccagccgugccaccauccugguggaacucuccugugaggauggccaaggccugaacuaccugccgggggagcaccuugggguuugcccaggcaaccagccggcccugguccaagguauccuggagcgagugguggauggccccacaccccaccagacagugcgccuggaggcccuggaugagaguggcagcuacugggucagugacaagaggcugccccccugcucacucagccaggcccucaccuacuuccuggacaucaccacacccccaacccagcugcugcuccaaaagcuggcccagguggccacagaagagccugagagacagaggcuggaggcccugugccagcccucagaguacagcaaguggaaguucaccaacagccccacauuccuggaggugcuagaggaguucccgucccugcgggugucugcuggcuuccugcuuucccagcuccccauucugaagcccagguucuacuccaucagcuccucccgggaucacacgcccacagagauccaccugacuguggccguggucaccuaccacacccgagauggccaggguccccugcaccacggcgucugcagcacauggcucaacagccugaagccccaagacccagugcccugcuuugugcggaaugccagcggcuuccaccuccccgaggaucccucccauccuugcauccucaucgggccuggcacaggcaucgcgcccuuccgcaguuucuggcagcaacggcuccaugacucccagcacaagggagugcggggaggccgcaugaccuugguguuugggugccgccgcccagaugaggaccacaucuaccaggaggagaugcuggagauggcccagaagggggugcugcaugcggugcacacagccuauucccgccugccuggcaagcccaaggucuauguucaggacauccugcggcagcagcuggccagcgaggugcuccgugugcuccacaaggagccaggccaccucuauguuugcggggaugugcgcauggcccgggacguggcccacacccugaagcagcugguggcugccaagcugaaauugaaugaggagcaggucgaggacuauuucuuucagcucaagagccagaagcgcuaucacgaagauaucuuuggugcuguauuuccuuacgaggcgaagaaggacaggguggcggugcagcccagcagccuggagaugucagcgcucugagggccuacaggagggguuaaagcugccggcacagaacuuaaggauggagccagcucugcauuaucugaggucacagggccuggggagauggaggaaagugauaucccccagccucaagucuuauuuccucaacguugcuccccaucaagcccuuuacuugaccuccuaacaaguagcacccuggauugaucggagccuccucucucaaacuggggccucccuggucccuuggagacaaaaucuuaaaugccaggccuggcaagugggugaaagauggaacuugcugcugagugcaccacuucaagugaccaccaggaggugcuaucgcaccacuguguauuuaacugccuuguguacaguuauuuaugccucuguauuuaaaaaacuaacacccagucuguuccccauggccacuugggucuucccuguaugauuccuugauggagauauuuacaugaauugcauuuuacuuuaaucaca

SEQ ID NO: 35 - RNA, 8413 nt, Homo sapiens
uuuccagauuggggcucgggccgcgccuccuccgggacccuccccuuggaccgagccgaucgccgcggggcaguucgggccggcuguccuggcgcgaaaagguggacaaguccuauuuucaagagaagaugacuuuuaacaguuuugaaggaucuaaaacuuguguaccugcagacaucaauaaggaagaagaauuuguagaagaguuuaauagauuaaaaacuuuugcuaauuuuccaagugguaguccuguuucagcaucaacacuggcacgagcaggguuucuuuauacuggugaaggagauaccgugcggugcuuuaguugucaugcagcuguagauagauggcaauauggagacucagcaguuggaagacacaggaaaguauccccaaauugcagauuuaucaacggcuuuuaucuugaaaauagugccacgcagucuacaaauucugguauccagaauggucaguacaaaguugaaaacuaucugggaagcagagaucauuuugccuuagacaggccaucugagacacaugcagacuaucuuuugagaacugggcagguuguagauauaucagacaccauauacccgaggaacccugccauguauagugaagaagcuagauuaaaguccuuucagaacuggccagacuaugcucaccuaaccccaagagaguuagcaagugcuggacucuacuacacagguauuggugaccaagugcagugcuuuuguugugguggaaaacugaaaaauugggaaccuugugaucgugccuggucagaacacaggcgacacuuuccuaauugcuucuuuguuuugggccggaaucuuaauauucgaagugaaucugaugcugugaguucugauaggaauuucccaaauucaacaaaucuuccaagaaauccauccauggcagauuaugaagcacggaucuuuacuuuugggacauggauauacucaguuaacaaggagcagcuugcaagagcuggauuuuaugcuuuaggugaaggugauaaaguaaagugcuuucacuguggaggagggcuaacugauuggaagcccagugaagacccuugggaacaacaugcuaaaugguauccagggugcaaauaucuguuagaacagaagggacaagaauauauaaacaauauucauuuaacucauucacuugaggagugucugguaagaacuacugagaaaacaccaucacuaacuagaagaauugaugauaccaucuuccaaaauccuaugguacaagaagcuauacgaaugggguucaguuucaaggacauuaagaaaauaauggaggaaaaaauucagauaucugggagcaacuauaaaucacuugagguucugguugcagaucuagugaaugcucagaaagacaguaugcaagaugagucaagucagacuucauuacagaaagagauuaguacugaagagcagcuaaggcgccugcaagaggagaagcuuugcaaaaucuguauggauagaaauauugcuaucguuuuuguuccuuguggacaucuagucacuuguaaacaaugugcugaagcaguugacaagugucccaugugcuacacagucauuacuuucaagcaaaaaauuuuuaugucuuaaucuaacucuauaguaggcauguuauguuguucuuauuacccugauugaaugugugaugugaacugacuuuaaguaaucaggauugaauuccauuagcauuugcuaccaaguaggaaaaaaaauguacauggcaguguuuuaguuggcaauauaaucuuugaauuucuugauuuuucaggguauuagcuguauuauccauuuuuuuuacuguuauuuaauugaaaccauagacuaagaauaagaagcaucauacuauaacugaacacaauguguauucauaguauacugauuuaauuucuaaguguaagugaauuaaucaucuggauuuuuuauucuuuucagauaggcuuaacaaauggagcuuucuguauauaaauguggagauuagaguuaaucuccccaaucacauaauuuguuuugugugaaaaaggaauaaauuguuccaugcugguggaaagauagagauuguuuuuagagguugguuguuguguuuuaggauucuguccauuuucuuuuaaaguuauaaacacguacuugugcgaauuauuuuuuuaaagugauuugccauuuuugaaagcguauuuaaugauagaauacuaucgagccaacauguacugacauggaaagaugucaaagauauguuaaguguaaaaugcaaguggcaaaacacuauguauagucugagccagaucaaaguauguauguuuuuaauaugcauagaacaaaagauuuggaaagauauacaccaaacuguuaaaugugguuucucuucggggagggggggauugggggaggggccccagagggguuuuauaggggccuuuucacuuucuacuuuuuucauuuuguucuguucgaauuuuuuauaaguauguauuacuuuuguaaucagaauuuuuagaaaguauuuugcugauuuaaaggcuuaggcauguucaaacgccugcaaaacuacuuaucacucagcuuuaguuuuucuaauccaagaaggcagggcaguuaaccuuuuuggugccaaugugaaauguaaaugauuuuauguuuuuccugcuuuguggaugaaaaauauuucugagugguaguuuuuugacagguagaccaugucuuaucuuguuucaaaauaaguauuucugauuuuguaaaaugaaauauaaaauaugucucagaucuuccaauuaauuaguaaggauucauccuuaauccuugcuaguuuaagccugccuaagucacuuuacuaaaagaucuuuguuaacucaguauuuuaaacaucugucagcuuauguagguaaaaguagaagcauguuuguacacugcuuguaguuauagugacagcuuuccauguugagauucucauaucaucuuguaucuuaaaguuucaugugaguuuuuaccguuaggaugauuaagauguauauaggacaaaauguuaagucuuuccucuaccuacauuuguuuucuuggcuaguaauaguaguagauacuucugaaauaaauguucucucaagauccuuaaaaccucuuggaaauuauaaaaauauuggcaagaaaagaagaauaguuguuuaaauauuuuuuaaaaaacacuugaauaagaaucaguaggguauaaacuagaaguuuaaaaaugcuucauagaacguccaggguuuacauuacaagauucucacaacaaaccuauuguagaggugaguaaggcauguuacuacagaggaaaguuugagaguaaaacuguaaaaaauuauauuuuuguuguacuuucuaagagaaagaguauuguuauguucuccuaacuucuguugauuacuacuuuaagugauauucauuuaaaacauugcaaauuuauuuuauuuauuuaauuuucuuuuugagauggagucuugcuugucacccaggcuggagugcaguggagugaucucugcucacugcaaccuccgccuucuggguucaagcgauucucgugccucagcuuccugaguagcuggaauuacaggcaggugccaccaugcccgacuaauuuuuuuuuauuuuuaguagagacgggguuucaccauguuggccaggcugguaucaaacuccugaccucaagagauccacucgccuugcccucccaaagugcugggauuacaggcuugagccaccacgcccggcuaaaacauugcaaauuuaaaugagaguuuuaaaaauuaaauaaugacugcccuguuucuguuuuaguauguaaauccucaguucuucaccuuugcacugucugccacuuaguuugguuauauagucauuaacuugaauuuggucuguauagucuagacuuuaaauuuaaaguuuucuacaaggggagaaaaguguuaaaauuuuuaaaauauguuuuccaggacacuucacuuccaagucagguagguaguucaaucuaguuguuagccaaggacucaaggacugaauuguuuuaacauaaggcuuuuccuguucugggagccgcacuucauuaaaauucuucuaaaacuuguauguuuagaguuaagcaagacuuuuuuucuuccucuccaugaguugugaaauuuaaugcacaacgcugauguggcuaacaaguuuauuuuaagaauuguuuagaaaugcuguugcuucagguucuuaaaaucacucagcacuccaacuucuaaucaaauuuuuggagacuuaacagcauuugucuguguuugaacuauaaaaagcaccggaucuuuuccaucuaauuccgcaaaaauugaucauuugcaaagucaaaacuauagccauauccaaaucuuuucccccucccaagaguucucagugucuacauguagacuauuccuuuucuguauaaaguucacucuaggauuucaagucaccacuuauuuuacauuuuagucaugcaaagauucaaguaguuuugcaauaaguacuuaucuuuauuuguaauaauuuagucugcugaucaaaagcauugucuuaauuuuugagaacugguuuuagcauuuacaaacuaaauuccaguuaauuaauuaauagcuuuauauugccuuuccugcuacauuugguuuuuuccccugucccuuugauuacgggcuaagguaggguagaguggguguagugaguguauauaaugugauuuggcccuguguauuaugauauuuuguuauuuuuguuguuauauuauuuacauuucaguaguuguuuuuuguguuuccauuuuaguggauaaaauuuguauuuugaacuaugaauggagacuaccgccccagcauuaguuucacaugauauacccuuuaaacccgaaucauuguuuuauuuccugauuacacagguguugaauggggaaaggggcuaguauaucaguaggauauacuaugggauguauauauaucauugcuguuagagaaaugaaauaaaauggggcugggcucaguggcucacgccuguaaucccagcacuuugggaggcugaggcagguggaucacgaggucaggagaucgagaccauccuggcuaacacggugaaaccccgucucuacuaaaaaacagaaaauuagccgggcgugguggcgggcgccuguagucccagcuacucgggaggcugaggcaggagaauggugugaacccgggaggcagagcuugcagugagccgagaucucgccacugcacuccagccugggcaacagagcaagacucugucucaaaaaaaaaaaaaaaagaaauaagaaaaugggaagcaauauuugacauaguucuuuuuagucaaaucuacuuguuaaaaaaaggguagcaguuuauucaucugugaaaggaaaauaauacuuaucuuacaagguugcaagagcucaaggagaccauguauguaaaguuccugcuguaaauaugaacucccauccuaauacccuuuuaccucucuguggguuugucuugaccuggaaauuugggcuaaaacuuagaaaaaauucuuacaugauaacucagugaugcuuacucauaguuuuugguguuucucauagauaagauauaaaucagcugggcgcgguggcucaugccuguaaucccagcacuuugggaggccgaggcgggcagaucaccugaggucgggaggucgagaccagccugaccaacauggagaaaccccgucucuacuaaaaauacaaaauuagcugggcgugguggcucaugccuguaaucccagcuacuugggaggcugaggcaggagaaucgcuugaacccaggaggcggagguuguggugagcgaagaucgugccauugcacuccagccugggcaacaagagcaaaacucugucucaaaaaaaaaaaaagauauaaaucacaauaaauaaauaggucaauacaaauguuagccaggcgugguggcacaugcccauagucgcagcuacucuggaggcagaggcaggaggaucacuugagcccaugaauuugaggcagcagugagcuaugauugugccacuguacuccagucugggugacagagugagaccccaucucuaaauaaauaggucaaacccuuaaaaauauuuaaauucuuaaaaaauugaaaagauuauucuucucaaauuuaguugagcuuucuaagagaagcaauuggcuuuuucccacuucaauaaucauuuucaguuugacucauacaguuaacacaaugugaauuucuuccucagcauaacagaguuauagaaugacagggcuggaagugaccuuagagaguauccaguucuuucauuuuacaggugaggcaacugagacucaaaggugauguaauuugugcaaagauuauagcuaauuaguagcagagcccugacugggacauaguuugaaggugaaaaacuucaccaagcuaccuuucuugaaagguccaaauguuuauguuuucaacuacucuuuccacuguaccauaacuuucacuacauauuaaaugacacuuuauaacuaauauaauaggacaaucaucaaugcauauauagccagcccuucauaucuguggguuuugcauccauggauucaaccaaggaggaauugaaaacacugagaaaaaaaaaaaagaccacacaauaaaaaaaaaaaauacaaaauaauacaaagaaaaagccaaaauugucauacuguuguuaagcaacaguauaacaacuauuuacauagcauuaagguuggugcaaaaaugcaaaaaaaaaaaaagcaauuauuuuuaaaccaaccuaauauauuguauuagguauuaaagucaucuggacaugaauuaaaguauaugaugccagccuggacaaaaggcaaaacccugucucuacaaaaaauacaaaaauuagcugggcaugguggugugugccuguaguccuggcuacuccggagccugaggugggaggaucgcuugagucugggaggcagaggcugcauugagcuaugaucauggcacugcauuccagccugggugacagugcaagaccuugucucagaauaaauaaaguaugugaugaagaugugcauacauuauaugcaaauacuguuuuuuuuuuuuuuaauuuaaacagucucacuguguugcccaggauggagugcaauggcacaaucuuggcucauggcaaacucugccucgcaagcagcugggacuacaggcaugcuccacggugcccaguuaauuuuuuuuguauucuuaguagagacaggguuucaccauguuggccaggcuagucuugaauuucugaccucaagugauucaucucccaaagugcugggauuacaggcgugagccaccacggccggcuaauuuuuguauuuuuuaguagugacugguuucgcgguguugaccaggcuggucucgaacuccugaucucaggugaucugccugccucggccucacaaagugcugggauuacaggugugaaccacugcucccggccuugugugauuuuaucuaagggacuuaagcguccucagguccuagggggucgugaaaccaaaaccccagggauagcaagggacaauuguaucuucaaaguagacaaauggcgccgggcacgguggcucacgccuguaaucccagcaguuuccgaggcugaggcaggcggcucaccugaggucaggaguuggagaccagccuggccaacaugcugaaacccugucuguacaaaaauacaaaaauagcugggcaugguggcgcaugccuguagucccagcuacuagagcgacugaggcaggagaauugcuugaaccugggaggcggagguugcagggagccaagauggcgccaccgcacuccagccuaggugauagagugagacucccucucaaaaacaaaacaaaacaaaaaaauuagacaaaugcuacauuaauguuuggguggucagauucuacuuugaaucugaaguuugcagauaugccuauagauuuuuggaguuuaccacuuucuuauucuguaucauuaauguaauauuuuaaauuacuauauauguuaccauuuuucuggauuuaguaagaaauuugcaguuuugguuugauguaacaaggguuuuaauguaauuuauguuagauuuugcauuuuuuucauuacuguuauauuuuaaccugacugacugaucuaauuguauuaguauugugaauaaucaugugaaauguuuugagacagaguacuauauuugugaauauaauuuuaugguuuuuuucacuuagaaccuuucuguguggaaaacuaagaaaauugcuuucugcuguauaaucuggcauucauuguagauuaaagcuuauuuuucugugaauaaaacguauucaauaaaauacuauucuuuaaaauua

SEQ ID NO: 36 - RNA, 2755 nt, Homo sapiens
ccuacccgcgcgcaggccaaguugcugaaucaauggagcccuccccaacccgggcguuccccagcgaggcuuccuucccauccuccugaccaccggggcuuuucgugagcucgucucugaucucgcgcaagagugacacacagguguucaaagacgcuucuggggagugagggaagcgguuuacgagugacuuggcuggagccucaggggcgggcacuggcacggaacacacccugaggccagcccuggcugcccaggcggagcugccucuucucccgcggguugguggacccgcucaguacggaguuggggaagcucuuucacuucggaggauugcucaacaaccaugcugggcaucuggacccuccuaccucugguucuuacgucuguugcuagauuaucguccaaaaguguuaaugcccaagugacugacaucaacuccaagggauuggaauugaggaagacuguuacuacaguugagacucagaacuuggaaggccugcaucaugauggccaauucugccauaagcccuguccuccaggugaaaggaaagcuagggacugcacagucaauggggaugaaccagacugcgugcccugccaagaagggaaggaguacacagacaaagcccauuuuucuuccaaaugcagaagauguagauugugugaugaaggacauggcuuagaaguggaaauaaacugcacccggacccagaauaccaagugcagauguaaaccaaacuuuuuuuguaacucuacuguaugugaacacugugacccuugcaccaaaugugaacauggaaucaucaaggaaugcacacucaccagcaacaccaagugcaaagaggaaggauccagaucuaacuugggguggcuuugucuucuucuuuugccaauuccacuaauuguuugggugaagagaaaggaaguacagaaaacaugcagaaagcacagaaaggaaaaccaagguucucaugaaucuccaaccuuaaauccugaaacaguggcaauaaauuuaucugauguugacuugaguaaauauaucaccacuauugcuggagucaugacacuaagucaaguuaaaggcuuuguucgaaagaauggugucaaugaagccaaaauagaugagaucaagaaugacaauguccaagacacagcagaacagaaaguucaacugcuucguaauuggcaucaacuucauggaaagaaagaagcguaugacacauugauuaaagaucucaaaaaagccaaucuuuguacucuugcagagaaaauucagacuaucauccucaaggacauuacuagugacucagaaaauucaaacuucagaaaugaaauccaaagcuuggucuagagugaaaaacaacaaauucaguucugaguauaugcaauuaguguuugaaaagauucuuaauagcuggcuguaaauacugcuugguuuuuuacuggguacauuuuaucauuuauuagcgcugaagagccaacauauuuguagauuuuuaauaucucaugauucugccuccaaggauguuuaaaaucuaguugggaaaacaaacuucaucaagaguaaaugcaguggcaugcuaaguacccaaauaggaguguaugcagaggaugaaagauuaagauuaugcucuggcaucuaacauaugauucuguaguaugaauguaaucaguguauguuaguacaaaugucuauccacaggcuaaccccacucuaugaaucaauagaagaagcuaugaccuuuugcugaaauaucaguuacugaacaggcaggccacuuugccucuaaauuaccucugauaauucuagagauuuuaccauauuucuaaacuuuguuuauaacucugagaagaucauauuuauguaaaguauauguauuugagugcagaauuuaaauaaggcucuaccucaaagaccuuugcacaguuuauuggugucauauuauacaauauuucaauugugaauucacauagaaaacauuaaauuauaauguuugacuauuauauauguguaugcauuuuacuggcucaaaacuaccuacuucuuucucaggcaucaaaagcauuuugagcaggagaguauuacuagagcuuugccaccucuccauuuuugccuuggugcucaucuuaauggccuaaugcacccccaaacauggaaauaucaccaaaaaauacuuaauaguccaccaaaaggcaagacugcccuuagaaauucuagccugguuuggagauacuaacugcucucagagaaaguagcuuugugacaugucaugaacccauguuugcaaucaaagaugauaaaauagauucuuauuuuucccccacccccgaaaauguucaauaaugucccauguaaaaccugcuacaaauggcagcuuauacauagcaaugguaaaaucaucaucuggauuuaggaauugcucuugucauacccccaaguuucuaagauuuaagauucuccuuacuacuauccuacguuuaaauaucuuugaaaguuuguauuaaaugugaauuuuaagaaauaauauuuauauuucuguaaauguaaacugugaagauaguuauaaacugaagcagauaccuggaaccaccuaaagaacuuccauuuauggaggauuuuuuugccccuuguguuuggaauuauaaaauauagguaaaaguacguaauuaaauaauguuuuugguaaaaaaaaaaaaaaaaaaaaaaaaaaaaaaaaaaaaaaaaaaaaaaaaaaaaaaaaaaaaaaaaaaa

SEQ ID NO: 37 - RNA, 2730 nt, Homo sapiens
ccuacccgcgcgcaggccaaguugcugaaucaauggagcccuccccaacccgggcguuccccagcgaggcuuccuucccauccuccugaccaccggggcuuuucgugagcucgucucugaucucgcgcaagagugacacacagguguucaaagacgcuucuggggagugagggaagcgguuuacgagugacuuggcuggagccucaggggcgggcacuggcacggaacacacccugaggccagcccuggcugcccaggcggagcugccucuucucccgcggguugguggacccgcucaguacggaguuggggaagcucuuucacuucggaggauugcucaacaaccaugcugggcaucuggacccuccuaccucugguucuuacgucuguugcuagauuaucguccaaaaguguuaaugcccaagugacugacaucaacuccaagggauuggaauugaggaagacuguuacuacaguugagacucagaacuuggaaggccugcaucaugauggccaauucugccauaagcccuguccuccaggugaaaggaaagcuagggacugcacagucaauggggaugaaccagacugcgugcccugccaagaagggaaggaguacacagacaaagcccauuuuucuuccaaaugcagaagauguagauugugugaugaaggacauggcuuagaaguggaaauaaacugcacccggacccagaauaccaagugcagauguaaaccaaacuuuuuuuguaacucuacuguaugugaacacugugacccuugcaccaaaugugaacauggaaucaucaaggaaugcacacucaccagcaacaccaagugcaaagaggaaggauccagaucuaacuugggguggcuuugucuucuucuuuugccaauuccacuaauuguuugggugaagagaaaggaaguacagaaaacaugcagaaagcacagaaaggaaaaccaagguucucaugaaucuccaaccuuaaauccuauguugacuugaguaaauauaucaccacuauugcuggagucaugacacuaagucaaguuaaaggcuuuguucgaaagaauggugucaaugaagccaaaauagaugagaucaagaaugacaauguccaagacacagcagaacagaaaguucaacugcuucguaauuggcaucaacuucauggaaagaaagaagcguaugacacauugauuaaagaucucaaaaaagccaaucuuuguacucuugcagagaaaauucagacuaucauccucaaggacauuacuagugacucagaaaauucaaacuucagaaaugaaauccaaagcuuggucuagagugaaaaacaacaaauucaguucugaguauaugcaauuaguguuugaaaagauucuuaauagcuggcuguaaauacugcuugguuuuuuacuggguacauuuuaucauuuauuagcgcugaagagccaacauauuuguagauuuuuaauaucucaugauucugccuccaaggauguuuaaaaucuaguugggaaaacaaacuucaucaagaguaaaugcaguggcaugcuaaguacccaaauaggaguguaugcagaggaugaaagauuaagauuaugcucuggcaucuaacauaugauucuguaguaugaauguaaucaguguauguuaguacaaaugucuauccacaggcuaaccccacucuaugaaucaauagaagaagcuaugaccuuuugcugaaauaucaguuacugaacaggcaggccacuuugccucuaaauuaccucugauaauucuagagauuuuaccauauuucuaaacuuuguuuauaacucugagaagaucauauuuauguaaaguauauguauuugagugcagaauuuaaauaaggcucuaccucaaagaccuuugcacaguuuauuggugucauauuauacaauauuucaauugugaauucacauagaaaacauuaaauuauaauguuugacuauuauauauguguaugcauuuuacuggcucaaaacuaccuacuucuuucucaggcaucaaaagcauuuugagcaggagaguauuacuagagcuuugccaccucuccauuuuugccuuggugcucaucuuaauggccuaaugcacccccaaacauggaaauaucaccaaaaaauacuuaauaguccaccaaaaggcaagacugcccuuagaaauucuagccugguuuggagauacuaacugcucucagagaaaguagcuuugugacaugucaugaacccauguuugcaaucaaagaugauaaaauagauucuuauuuuucccccacccccgaaaauguucaauaaugucccauguaaaaccugcuacaaauggcagcuuauacauagcaaugguaaaaucaucaucuggauuuaggaauugcucuugucauacccccaaguuucuaagauuuaagauucuccuuacuacuauccuacguuuaaauaucuuugaaaguuuguauuaaaugugaauuuuaagaaauaauauuuauauuucuguaaauguaaacugugaagauaguuauaaacugaagcagauaccuggaaccaccuaaagaacuuccauuuauggaggauuuuuuugccccuuguguuuggaauuauaaaauauagguaaaaguacguaauuaaauaauguuuuugguaaaaaaaaaaaaaaaaaaaaaaaaaaaaaaaaaaaaaaaaaaaaaaaaaaaaaaaaaaaaaaaaaaa

SEQ ID NO: 38 - RNA, 2692 nt, Homo sapiens
ccuacccgcgcgcaggccaaguugcugaaucaauggagcccuccccaacccgggcguuccccagcgaggcuuccuucccauccuccugaccaccggggcuuuucgugagcucgucucugaucucgcgcaagagugacacacagguguucaaagacgcuucuggggagugagggaagcgguuuacgagugacuuggcuggagccucaggggcgggcacuggcacggaacacacccugaggccagcccuggcugcccaggcggagcugccucuucucccgcggguugguggacccgcucaguacggaguuggggaagcucuuucacuucggaggauugcucaacaaccaugcugggcaucuggacccuccuaccucugguucuuacgucuguugcuagauuaucguccaaaaguguuaaugcccaagugacugacaucaacuccaagggauuggaauugaggaagacuguuacuacaguugagacucagaacuuggaaggccugcaucaugauggccaauucugccauaagcccuguccuccaggugaaaggaaagcuagggacugcacagucaauggggaugaaccagacugcgugcccugccaagaagggaaggaguacacagacaaagcccauuuuucuuccaaaugcagaagauguagauugugugaugaaggacauggcuuagaaguggaaauaaacugcacccggacccagaauaccaagugcagauguaaaccaaacuuuuuuuguaacucuacuguaugugaacacugugacccuugcaccaaaugugaacauggaaucaucaaggaaugcacacucaccagcaacaccaagugcaaagaggaagugaagagaaaggaaguacagaaaacaugcagaaagcacagaaaggaaaaccaagguucucaugaaucuccaaccuuaaauccugaaacaguggcaauaaauuuaucugauguugacuugaguaaauauaucaccacuauugcuggagucaugacacuaagucaaguuaaaggcuuuguucgaaagaauggugucaaugaagccaaaauagaugagaucaagaaugacaauguccaagacacagcagaacagaaaguucaacugcuucguaauuggcaucaacuucauggaaagaaagaagcguaugacacauugauuaaagaucucaaaaaagccaaucuuuguacucuugcagagaaaauucagacuaucauccucaaggacauuacuagugacucagaaaauucaaacuucagaaaugaaauccaaagcuuggucuagagugaaaaacaacaaauucaguucugaguauaugcaauuaguguuugaaaagauucuuaauagcuggcuguaaauacugcuugguuuuuuacuggguacauuuuaucauuuauuagcgcugaagagccaacauauuuguagauuuuuaauaucucaugauucugccuccaaggauguuuaaaaucuaguugggaaaacaaacuucaucaagaguaaaugcaguggcaugcuaaguacccaaauaggaguguaugcagaggaugaaagauuaagauuaugcucuggcaucuaacauaugauucuguaguaugaauguaaucaguguauguuaguacaaaugucuauccacaggcuaaccccacucuaugaaucaauagaagaagcuaugaccuuuugcugaaauaucaguuacugaacaggcaggccacuuugccucuaaauuaccucugauaauucuagagauuuuaccauauuucuaaacuuuguuuauaacucugagaagaucauauuuauguaaaguauauguauuugagugcagaauuuaaauaaggcucuaccucaaagaccuuugcacaguuuauuggugucauauuauacaauauuucaauugugaauucacauagaaaacauuaaauuauaauguuugacuauuauauauguguaugcauuuuacuggcucaaaacuaccuacuucuuucucaggcaucaaaagcauuuugagcaggagaguauuacuagagcuuugccaccucuccauuuuugccuuggugcucaucuuaauggccuaaugcacccccaaacauggaaauaucaccaaaaaauacuuaauaguccaccaaaaggcaagacugcccuuagaaauucuagccugguuuggagauacuaacugcucucagagaaaguagcuuugugacaugucaugaacccauguuugcaaucaaagaugauaaaauagauucuuauuuuucccccacccccgaaaauguucaauaaugucccauguaaaaccugcuacaaauggcagcuuauacauagcaaugguaaaaucaucaucuggauuuaggaauugcucuugucauacccccaaguuucuaagauuuaagauucuccuuacuacuauccuacguuuaaauaucuuugaaaguuuguauuaaaugugaauuuuaagaaauaauauuuauauuucuguaaauguaaacugugaagauaguuauaaacugaagcagauaccuggaaccaccuaaagaacuuccauuuauggaggauuuuuuugccccuuguguuuggaauuauaaaauauagguaaaaguacguaauuaaauaauguuuuugguaaaaaaaaaaaaaaaaaaaaaaaaaaaaaaaaaaaaaaaaaaaaaaaaaaaaaaaaaaaaaaaaaaa

SEQ ID NO: 39 - RNA, 2646 nt, Homo sapiens
ccuacccgcgcgcaggccaaguugcugaaucaauggagcccuccccaacccgggcguuccccagcgaggcuuccuucccauccuccugaccaccggggcuuuucgugagcucgucucugaucucgcgcaagagugacacacagguguucaaagacgcuucuggggagugagggaagcgguuuacgagugacuuggcuggagccucaggggcgggcacuggcacggaacacacccugaggccagcccuggcugcccaggcggagcugccucuucucccgcggguugguggacccgcucaguacggaguuggggaagcucuuucacuucggaggauugcucaacaaccaugcugggcaucuggacccuccuaccucugguucuuacgucuguugcuagauuaucguccaaaaguguuaaugcccaagugacugacaucaacuccaagggauuggaauugaggaagacuguuacuacaguugagacucagaacuuggaaggccugcaucaugauggccaauucugccauaagcccuguccuccaggugaaaggaaagcuagggacugcacagucaauggggaugaaccagacugcgugcccugccaagaagggaaggaguacacagacaaagcccauuuuucuuccaaaugcagaagauguagauugugugaugaaggacaugaugugaacauggaaucaucaaggaaugcacacucaccagcaacaccaagugcaaagaggaaggauccagaucuaacuugggguggcuuugucuucuucuuuugccaauuccacuaauuguuugggugaagagaaaggaaguacagaaaacaugcagaaagcacagaaaggaaaaccaagguucucaugaaucuccaaccuuaaauccugaaacaguggcaauaaauuuaucugauguugacuugaguaaauauaucaccacuauugcuggagucaugacacuaagucaaguuaaaggcuuuguucgaaagaauggugucaaugaagccaaaauagaugagaucaagaaugacaauguccaagacacagcagaacagaaaguucaacugcuucguaauuggcaucaacuucauggaaagaaagaagcguaugacacauugauuaaagaucucaaaaaagccaaucuuuguacucuugcagagaaaauucagacuaucauccucaaggacauuacuagugacucagaaaauucaaacuucagaaaugaaauccaaagcuuggucuagagugaaaaacaacaaauucaguucugaguauaugcaauuaguguuugaaaagauucuuaauagcuggcuguaaauacugcuugguuuuuuacuggguacauuuuaucauuuauuagcgcugaagagccaacauauuuguagauuuuuaauaucucaugauucugccuccaaggauguuuaaaaucuaguugggaaaacaaacuucaucaagaguaaaugcaguggcaugcuaaguacccaaauaggaguguaugcagaggaugaaagauuaagauuaugcucuggcaucuaacauaugauucuguaguaugaauguaaucaguguauguuaguacaaaugucuauccacaggcuaaccccacucuaugaaucaauagaagaagcuaugaccuuuugcugaaauaucaguuacugaacaggcaggccacuuugccucuaaauuaccucugauaauucuagagauuuuaccauauuucuaaacuuuguuuauaacucugagaagaucauauuuauguaaaguauauguauuugagugcagaauuuaaauaaggcucuaccucaaagaccuuugcacaguuuauuggugucauauuauacaauauuucaauugugaauucacauagaaaacauuaaauuauaauguuugacuauuauauauguguaugcauuuuacuggcucaaaacuaccuacuucuuucucaggcaucaaaagcauuuugagcaggagaguauuacuagagcuuugccaccucuccauuuuugccuuggugcucaucuuaauggccuaaugcacccccaaacauggaaauaucaccaaaaaauacuuaauaguccaccaaaaggcaagacugcccuuagaaauucuagccugguuuggagauacuaacugcucucagagaaaguagcuuugugacaugucaugaacccauguuugcaaucaaagaugauaaaauagauucuuauuuuucccccacccccgaaaauguucaauaaugucccauguaaaaccugcuacaaauggcagcuuauacauagcaaugguaaaaucaucaucuggauuuaggaauugcucuugucauacccccaaguuucuaagauuuaagauucuccuuacuacuauccuacguuuaaauaucuuugaaaguuuguauuaaaugugaauuuuaagaaauaauauuuauauuucuguaaauguaaacugugaagauaguuauaaacugaagcagauaccuggaaccaccuaaagaacuuccauuuauggaggauuuuuuugccccuuguguuuggaauuauaaaauauagguaaaaguacguaauuaaauaauguuuuugguaaaaaaaaaaaaaaaaaaaaaaaaaaaaaaaaaaaaaaaaaaaaaaaaaaaaaaaaaaaaaaaaaaa

SEQ ID NO: 40 - RNA, 2563 nt, Homo sapiens
ccuacccgcgcgcaggccaaguugcugaaucaauggagcccuccccaacccgggcguuccccagcgaggcuuccuucccauccuccugaccaccggggcuuuucgugagcucgucucugaucucgcgcaagagugacacacagguguucaaagacgcuucuggggagugagggaagcgguuuacgagugacuuggcuggagccucaggggcgggcacuggcacggaacacacccugaggccagcccuggcugcccaggcggagcugccucuucucccgcggguugguggacccgcucaguacggaguuggggaagcucuuucacuucggaggauugcucaacaaccaugcugggcaucuggacccuccuaccucugguucuuacgucuguugcuagauuaucguccaaaaguguuaaugcccaagugacugacaucaacuccaagggauuggaauugaggaagacuguuacuacaguugagacucagaacuuggaaggccugcaucaugauggccaauucugccauaagcccuguccuccaggugaaaggaaagcuagggacugcacagucaauggggaugaaccagacugcgugcccugccaagaagggaaggaguacacagacaaagcccauuuuucuuccaaaugcagaagauguagauugugugaugaaggacaugaugugaacauggaaucaucaaggaaugcacacucaccagcaacaccaagugcaaagaggaaggauccagaucuaacuugggguggcuuugucuucuucuuuugccaauuccacuaauuguuuggggaaacaguggcaauaaauuuaucugauguugacuugaguaaauauaucaccacuauugcuggagucaugacacuaagucaaguuaaaggcuuuguucgaaagaauggugucaaugaagccaaaauagaugagaucaagaaugacaauguccaagacacagcagaacagaaaguucaacugcuucguaauuggcaucaacuucauggaaagaaagaagcguaugacacauugauuaaagaucucaaaaaagccaaucuuuguacucuugcagagaaaauucagacuaucauccucaaggacauuacuagugacucagaaaauucaaacuucagaaaugaaauccaaagcuuggucuagagugaaaaacaacaaauucaguucugaguauaugcaauuaguguuugaaaagauucuuaauagcuggcuguaaauacugcuugguuuuuuacuggguacauuuuaucauuuauuagcgcugaagagccaacauauuuguagauuuuuaauaucucaugauucugccuccaaggauguuuaaaaucuaguugggaaaacaaacuucaucaagaguaaaugcaguggcaugcuaaguacccaaauaggaguguaugcagaggaugaaagauuaagauuaugcucuggcaucuaacauaugauucuguaguaugaauguaaucaguguauguuaguacaaaugucuauccacaggcuaaccccacucuaugaaucaauagaagaagcuaugaccuuuugcugaaauaucaguuacugaacaggcaggccacuuugccucuaaauuaccucugauaauucuagagauuuuaccauauuucuaaacuuuguuuauaacucugagaagaucauauuuauguaaaguauauguauuugagugcagaauuuaaauaaggcucuaccucaaagaccuuugcacaguuuauuggugucauauuauacaauauuucaauugugaauucacauagaaaacauuaaauuauaauguuugacuauuauauauguguaugcauuuuacuggcucaaaacuaccuacuucuuucucaggcaucaaaagcauuuugagcaggagaguauuacuagagcuuugccaccucuccauuuuugccuuggugcucaucuuaauggccuaaugcacccccaaacauggaaauaucaccaaaaaauacuuaauaguccaccaaaaggcaagacugcccuuagaaauucuagccugguuuggagauacuaacugcucucagagaaaguagcuuugugacaugucaugaacccauguuugcaaucaaagaugauaaaauagauucuuauuuuucccccacccccgaaaauguucaauaaugucccauguaaaaccugcuacaaauggcagcuuauacauagcaaugguaaaaucaucaucuggauuuaggaauugcucuugucauacccccaaguuucuaagauuuaagauucuccuuacuacuauccuacguuuaaauaucuuugaaaguuuguauuaaaugugaauuuuaagaaauaauauuuauauuucuguaaauguaaacugugaagauaguuauaaacugaagcagauaccuggaaccaccuaaagaacuuccauuuauggaggauuuuuuugccccuuguguuuggaauuauaaaauauagguaaaaguacguaauuaaauaauguuuuugguaaaaaaaaaaaaaaaaaaaaaaaaaaaaaaaaaaaaaaaaaaaaaaaaaaaaaaaaaaaaaaaaaaa

SEQ ID NO: 41 - RNA, 2583 nt, Homo sapiens
ccuacccgcgcgcaggccaaguugcugaaucaauggagcccuccccaacccgggcguuccccagcgaggcuuccuucccauccuccugaccaccggggcuuuucgugagcucgucucugaucucgcgcaagagugacacacagguguucaaagacgcuucuggggagugagggaagcgguuuacgagugacuuggcuggagccucaggggcgggcacuggcacggaacacacccugaggccagcccuggcugcccaggcggagcugccucuucucccgcggguugguggacccgcucaguacggaguuggggaagcucuuucacuucggaggauugcucaacaaccaugcugggcaucuggacccuccuaccucugguucuuacgucuguugcuagauuaucguccaaaaguguuaaugcccaagugacugacaucaacuccaagggauuggaauugaggaagacuguuacuacaguugagacucagaacuuggaaggccugcaucaugauggccaauucugccauaagcccuguccuccaggugaaaggaaagcuagggacugcacagucaauggggaugaaccagacugcgugcccugccaagaagggaaggaguacacagacaaagcccauuuuucuuccaaaugcagaagauguagauugugugaugaaggacaugaugugaacauggaaucaucaaggaaugcacacucaccagcaacaccaagugcaaagaggaagugaagagaaaggaaguacagaaaacaugcagaaagcacagaaaggaaaaccaagguucucaugaaucuccaaccuuaaauccugaaacaguggcaauaaauuuaucugauguugacuugaguaaauauaucaccacuauugcuggagucaugacacuaagucaaguuaaaggcuuuguucgaaagaauggugucaaugaagccaaaauagaugagaucaagaaugacaauguccaagacacagcagaacagaaaguucaacugcuucguaauuggcaucaacuucauggaaagaaagaagcguaugacacauugauuaaagaucucaaaaaagccaaucuuuguacucuugcagagaaaauucagacuaucauccucaaggacauuacuagugacucagaaaauucaaacuucagaaaugaaauccaaagcuuggucuagagugaaaaacaacaaauucaguucugaguauaugcaauuaguguuugaaaagauucuuaauagcuggcuguaaauacugcuugguuuuuuacuggguacauuuuaucauuuauuagcgcugaagagccaacauauuuguagauuuuuaauaucucaugauucugccuccaaggauguuuaaaaucuaguugggaaaacaaacuucaucaagaguaaaugcaguggcaugcuaaguacccaaauaggaguguaugcagaggaugaaagauuaagauuaugcucuggcaucuaacauaugauucuguaguaugaauguaaucaguguauguuaguacaaaugucuauccacaggcuaaccccacucuaugaaucaauagaagaagcuaugaccuuuugcugaaauaucaguuacugaacaggcaggccacuuugccucuaaauuaccucugauaauucuagagauuuuaccauauuucuaaacuuuguuuauaacucugagaagaucauauuuauguaaaguauauguauuugagugcagaauuuaaauaaggcucuaccucaaagaccuuugcacaguuuauuggugucauauuauacaauauuucaauugugaauucacauagaaaacauuaaauuauaauguuugacuauuauauauguguaugcauuuuacuggcucaaaacuaccuacuucuuucucaggcaucaaaagcauuuugagcaggagaguauuacuagagcuuugccaccucuccauuuuugccuuggugcucaucuuaauggccuaaugcacccccaaacauggaaauaucaccaaaaaauacuuaauaguccaccaaaaggcaagacugcccuuagaaauucuagccugguuuggagauacuaacugcucucagagaaaguagcuuugugacaugucaugaacccauguuugcaaucaaagaugauaaaauagauucuuauuuuucccccacccccgaaaauguucaauaaugucccauguaaaaccugcuacaaauggcagcuuauacauagcaaugguaaaaucaucaucuggauuuaggaauugcucuugucauacccccaaguuucuaagauuuaagauucuccuuacuacuauccuacguuuaaauaucuuugaaaguuuguauuaaaugugaauuuuaagaaauaauauuuauauuucuguaaauguaaacugugaagauaguuauaaacugaagcagauaccuggaaccaccuaaagaacuuccauuuauggaggauuuuuuugccccuuguguuuggaauuauaaaauauagguaaaaguacguaauuaaauaauguuuuugguaaaaaaaaaaaaaaaaaaaaaaaaaaaaaaaaaaaaaaaaaaaaaaaaaaaaaaaaaaaaaaaaaaa

SEQ ID NO: 42 - RNA, 2508 nt, Homo sapiens
ccuacccgcgcgcaggccaaguugcugaaucaauggagcccuccccaacccgggcguuccccagcgaggcuuccuucccauccuccugaccaccggggcuuuucgugagcucgucucugaucucgcgcaagagugacacacagguguucaaagacgcuucuggggagugagggaagcgguuuacgagugacuuggcuggagccucaggggcgggcacuggcacggaacacacccugaggccagcccuggcugcccaggcggagcugccucuucucccgcggguugguggacccgcucaguacggaguuggggaagcucuuucacuucggaggauugcucaacaaccaugcugggcaucuggacccuccuaccucugguucuuacgucuguugcuagauuaucguccaaaaguguuaaugcccaagugacugacaucaacuccaagggauuggaauugaggaagacuguuacuacaguugagacucagaacuuggaaggccugcaucaugauggccaauucugccauaagcccuguccuccagaugugaacauggaaucaucaaggaaugcacacucaccagcaacaccaagugcaaagaggaaggauccagaucuaacuugggguggcuuugucuucuucuuuugccaauuccacuaauuguuugggugaagagaaaggaaguacagaaaacaugcagaaagcacagaaaggaaaaccaagguucucaugaaucuccaaccuuaaauccugaaacaguggcaauaaauuuaucugauguugacuugaguaaauauaucaccacuauugcuggagucaugacacuaagucaaguuaaaggcuuuguucgaaagaauggugucaaugaagccaaaauagaugagaucaagaaugacaauguccaagacacagcagaacagaaaguucaacugcuucguaauuggcaucaacuucauggaaagaaagaagcguaugacacauugauuaaagaucucaaaaaagccaaucuuuguacucuugcagagaaaauucagacuaucauccucaaggacauuacuagugacucagaaaauucaaacuucagaaaugaaauccaaagcuuggucuagagugaaaaacaacaaauucaguucugaguauaugcaauuaguguuugaaaagauucuuaauagcuggcuguaaauacugcuugguuuuuuacuggguacauuuuaucauuuauuagcgcugaagagccaacauauuuguagauuuuuaauaucucaugauucugccuccaaggauguuuaaaaucuaguugggaaaacaaacuucaucaagaguaaaugcaguggcaugcuaaguacccaaauaggaguguaugcagaggaugaaagauuaagauuaugcucuggcaucuaacauaugauucuguaguaugaauguaaucaguguauguuaguacaaaugucuauccacaggcuaaccccacucuaugaaucaauagaagaagcuaugaccuuuugcugaaauaucaguuacugaacaggcaggccacuuugccucuaaauuaccucugauaauucuagagauuuuaccauauuucuaaacuuuguuuauaacucugagaagaucauauuuauguaaaguauauguauuugagugcagaauuuaaauaaggcucuaccucaaagaccuuugcacaguuuauuggugucauauuauacaauauuucaauugugaauucacauagaaaacauuaaauuauaauguuugacuauuauauauguguaugcauuuuacuggcucaaaacuaccuacuucuuucucaggcaucaaaagcauuuugagcaggagaguauuacuagagcuuugccaccucuccauuuuugccuuggugcucaucuuaauggccuaaugcacccccaaacauggaaauaucaccaaaaaauacuuaauaguccaccaaaaggcaagacugcccuuagaaauucuagccugguuuggagauacuaacugcucucagagaaaguagcuuugugacaugucaugaacccauguuugcaaucaaagaugauaaaauagauucuuauuuuucccccacccccgaaaauguucaauaaugucccauguaaaaccugcuacaaauggcagcuuauacauagcaaugguaaaaucaucaucuggauuuaggaauugcucuugucauacccccaaguuucuaagauuuaagauucuccuuacuacuauccuacguuuaaauaucuuugaaaguuuguauuaaaugugaauuuuaagaaauaauauuuauauuucuguaaauguaaacugugaagauaguuauaaacugaagcagauaccuggaaccaccuaaagaacuuccauuuauggaggauuuuuuugccccuuguguuuggaauuauaaaauauagguaaaaguacguaauuaaauaauguuuuugguaaaaaaaaaaaaaaaaaaaaaaaaaaaaaaaaaaaaaaaaaaaaaaaaaaaaaaaaaaaaaaaaaaa

SEQ ID NO: 43 - RNA, 2445 nt, Homo sapiens
ccuacccgcgcgcaggccaaguugcugaaucaauggagcccuccccaacccgggcguuccccagcgaggcuuccuucccauccuccugaccaccggggcuuuucgugagcucgucucugaucucgcgcaagagugacacacagguguucaaagacgcuucuggggagugagggaagcgguuuacgagugacuuggcuggagccucaggggcgggcacuggcacggaacacacccugaggccagcccuggcugcccaggcggagcugccucuucucccgcggguugguggacccgcucaguacggaguuggggaagcucuuucacuucggaggauugcucaacaaccaugcugggcaucuggacccuccuaccucugguucuuacgucuguugcuagauuaucguccaaaaguguuaaugcccaagugacugacaucaacuccaagggauuggaauugaggaagacuguuacuacaguugagacucagaacuuggaaggccugcaucaugauggccaauucugccauaagcccuguccuccagaugugaacauggaaucaucaaggaaugcacacucaccagcaacaccaagugcaaagaggaagugaagagaaaggaaguacagaaaacaugcagaaagcacagaaaggaaaaccaagguucucaugaaucuccaaccuuaaauccugaaacaguggcaauaaauuuaucugauguugacuugaguaaauauaucaccacuauugcuggagucaugacacuaagucaaguuaaaggcuuuguucgaaagaauggugucaaugaagccaaaauagaugagaucaagaaugacaauguccaagacacagcagaacagaaaguucaacugcuucguaauuggcaucaacuucauggaaagaaagaagcguaugacacauugauuaaagaucucaaaaaagccaaucuuuguacucuugcagagaaaauucagacuaucauccucaaggacauuacuagugacucagaaaauucaaacuucagaaaugaaauccaaagcuuggucuagagugaaaaacaacaaauucaguucugaguauaugcaauuaguguuugaaaagauucuuaauagcuggcuguaaauacugcuugguuuuuuacuggguacauuuuaucauuuauuagcgcugaagagccaacauauuuguagauuuuuaauaucucaugauucugccuccaaggauguuuaaaaucuaguugggaaaacaaacuucaucaagaguaaaugcaguggcaugcuaaguacccaaauaggaguguaugcagaggaugaaagauuaagauuaugcucuggcaucuaacauaugauucuguaguaugaauguaaucaguguauguuaguacaaaugucuauccacaggcuaaccccacucuaugaaucaauagaagaagcuaugaccuuuugcugaaauaucaguuacugaacaggcaggccacuuugccucuaaauuaccucugauaauucuagagauuuuaccauauuucuaaacuuuguuuauaacucugagaagaucauauuuauguaaaguauauguauuugagugcagaauuuaaauaaggcucuaccucaaagaccuuugcacaguuuauuggugucauauuauacaauauuucaauugugaauucacauagaaaacauuaaauuauaauguuugacuauuauauauguguaugcauuuuacuggcucaaaacuaccuacuucuuucucaggcaucaaaagcauuuugagcaggagaguauuacuagagcuuugccaccucuccauuuuugccuuggugcucaucuuaauggccuaaugcacccccaaacauggaaauaucaccaaaaaauacuuaauaguccaccaaaaggcaagacugcccuuagaaauucuagccugguuuggagauacuaacugcucucagagaaaguagcuuugugacaugucaugaacccauguuugcaaucaaagaugauaaaauagauucuuauuuuucccccacccccgaaaauguucaauaaugucccauguaaaaccugcuacaaauggcagcuuauacauagcaaugguaaaaucaucaucuggauuuaggaauugcucuugucauacccccaaguuucuaagauuuaagauucuccuuacuacuauccuacguuuaaauaucuuugaaaguuuguauuaaaugugaauuuuaagaaauaauauuuauauuucuguaaauguaaacugugaagauaguuauaaacugaagcagauaccuggaaccaccuaaagaacuuccauuuauggaggauuuuuuugccccuuguguuuggaauuauaaaauauagguaaaaguacguaauuaaauaauguuuuugguaaaaaaaaaaaaaaaaaaaaaaaaaaaaaaaaaaaaaaaaaaaaaaaaaaaaaaaaaaaaaaaaaaa

SEQ ID NO: 44 - RNA, 1909 nt, Homo sapiens
gagguguuucccuuagcuauggaaacucuauaagagagauccagcuugccuccucuugagcagucagcaacagggucccguccuugacaccucagccucuacaggacugagaagaaguaaaaccguuugcuggggcuggccugacucaccagcugccaugcagcagcccuucaauuacccauauccccagaucuacuggguggacagcagugccagcucucccugggccccuccaggcacaguucuucccuguccaaccucugugcccagaaggccuggucaaaggaggccaccaccaccaccgccaccgccaccacuaccaccuccgccgccgccgccaccacugccuccacuaccgcugccaccccugaagaagagagggaaccacagcacaggccugugucuccuugugauguuuuucaugguucugguugccuugguaggauugggccuggggauguuucagcucuuccaccuacagaaggagcuggcagaacuccgagagucuaccagccagaugcacacagcaucaucuuuggagaagcaaauaggccaccccaguccacccccugaaaaaaaggagcugaggaaaguggcccauuuaacaggcaaguccaacucaagguccaugccucuggaaugggaagacaccuauggaauuguccugcuuucuggagugaaguauaagaaggguggccuugugaucaaugaaacugggcuguacuuuguauauuccaaaguauacuuccggggucaaucuugcaacaaccugccccugagccacaaggucuacaugaggaacucuaaguauccccaggaucuggugaugauggaggggaagaugaugagcuacugcacuacugggcagaugugggcccgcagcagcuaccugggggcaguguucaaucuuaccagugcugaucauuuauaugucaacguaucugagcucucucuggucaauuuugaggaaucucagacguuuuucggcuuauauaagcucuaagagaagcacuuugggauucuuuccauuaugauucuuuguuacaggcaccgagaauguuguauucagugagggucuucuuacaugcauuugaggucaaguaagaagacaugaaccaaguggaccuugagaccacaggguucaaaaugucuguagcuccucaacucaccuaauguuuaugagccagacaaauggaggaauaugacggaagaacauagaacucugggcugccaugugaagagggagaagcaugaaaaagcagcuaccagguguucuacacucaucuuagugccugagaguauuuaggcagauugaaaaggacaccuuuuaacucaccucucaaggugggccuugcuaccucaagggggacugucuuucagauacaugguugugaccugaggauuuaagggauggaaaaggaagacuagaggcuugcauaauaagcuaaagaggcugaaagaggccaaugccccacuggcagcaucuucacuucuaaaugcauauccugagccaucggugaaacuaacagauaagcaagagagauguuuuggggacucauuucauuccuaacacagcauguguauuuccagugcaauuguagggguguguguguguguguguguguguguguguguaugacuaaagagagaauguagauauugugaaguacauauuaggaaaauauggguugcauuuggucaagauuuugaaugcuuccugacaaucaacucuaauagugcuuaaaaaucauugauugucagcuacuaaugauguuuuccuauaauauaauaaauauuuauguagaugugcauuuuugugaaaugaaaacauguaauaaaaaguauauguuaggauacaaaaaaaaaaaaaaaaaaaaaaaaaaaaaaaaaaaaaaaaaaaaaaaaaaaa

SEQ ID NO: 45 - RNA, 1080 nt, Homo sapiens
ggagaggacuggcugggcaggggcgccgccccgccucgggagaggcgggccgggcggggcugggaguauuugaggcucggagccaccgccccgccggcgcccgcagcaccuccucgccagcagccguccggagccagccaacgagcggaaaauggcagacaauuuuucgcuccaugaugcguuaucugggucuggaaacccaaacccucaaggauggccuggcgcaugggggaaccagccugcuggggcagggggcuacccaggggcuuccuauccuggggccuaccccgggcaggcacccccaggggcuuauccuggacaggcaccuccaggcgccuacccuggagcaccuggagcuuaucccggagcaccugcaccuggagucuacccagggccacccagcggcccuggggccuacccaucuucuggacagccaagugccaccggagccuacccugccacuggccccuauggcgccccugcugggccacugauugugccuuauaaccugccuuugccugggggaguggugccucgcaugcugauaacaauucugggcacggugaagcccaaugcaaacagaauugcuuuagauuuccaaagagggaaugauguugccuuccacuuuaacccacgcuucaaugagaacaacaggagagucauuguuugcaauacaaagcuggauaauaacuggggaagggaagaaagacagucgguuuucccauuugaaagugggaaaccauucaaaauacaaguacugguugaaccugaccacuucaagguugcagugaaugaugcucacuuguugcaguacaaucaucggguuaaaaaacucaaugaaaucagcaaacugggaauuucuggugacauagaccucaccagugcuucauauaccaugauauaaucugaaaggggcagauuaaaaaaaaaaaaagaaucuaaaccuuacauguguaaagguuucauguucacugugagugaaaauuuuuacauucaucaauaucccucuuguaagucaucuacuuaauaaauauuacagugaauuaccugucucaauaugucaaaaaaaaaaaaaaaaaa

SEQ ID NO: 46 - RNA, 1768 nt, Homo sapiens
uggcaaucuagcuggauagcaucccugccccuugaagagauguuuuuguggcgccacacuacugacuuaggcauaaugccuagagauggauuagaacugcacaaugaacuaguggugagguucaguuuaauggaaauuggugaaagcuuuuaggauaaaaugauaaucuuuguuucuuucaggaaaauggcagacaauuuuucgguaaguguuuuaugccuguuucuuccccuugaucagcuccacaugguugaggguuggggguuuuguuuuuaccaugacuuucccuuuucacucucccacugcguggcuuccccuggacucauuuguccaaugagggcuugcaagcuggagccuuguuuuuccagcagcagauuugggaagaaagccaggcagagcgaggccugggacucacucacaguaacccuuucaccaaaaggcccagggcggaagggaguggacucugccggcaggagcugagaaauccucugaguagcgggaagugcgguacagucugggcauucugauguuugugauuguuuuucucacggugaugaaaaaguaugugcuauaaguagaggagcgcuaacuccugacuugagcuaauuaugaaaaugcagcccucccugaucugagacguugggaggcaagaauaaagugaaaaaguauauguaaucccaacaucuaauuuuagucuuagaaacucaaacuauuaauaaguggaaaaaguuuaaugauaugcauguaaugccuuugccauauuccucuccuucuuagaucacauauuccuauuuuccugaaaauucugcuuuugagaaugcuuucugucccguaauuguguaugucuuucuuuccagcuccaugaugcguuaucugggucuggaaacccaaacccucaaggauggccuggcgcaugggggaaccagccugcuggggcagggggcuacccaggggcuuccuauccuggggccuaccccgggcaggcacccccaggggcuuauccuggacaggcaccuccaggcgccuacccuggagcaccuggagcuuaucccggagcaccugcaccuggagucuacccagggccacccagcggcccuggggccuacccaucuucuggacagccaagugccaccggagccuacccugccacuggccccuauggcgccccugcugggccacugauugugccuuauaaccugccuuugccugggggaguggugccucgcaugcugauaacaauucugggcacggugaagcccaaugcaaacagaauugcuuuagauuuccaaagagggaaugauguugccuuccacuuuaacccacgcuucaaugagaacaacaggagagucauuguuugcaauacaaagcuggauaauaacuggggaagggaagaaagacagucgguuuucccauuugaaagugggaaaccauucaaaauacaaguacugguugaaccugaccacuucaagguugcagugaaugaugcucacuuguugcaguacaaucaucggguuaaaaaacucaaugaaaucagcaaacugggaauuucuggugacauagaccucaccagugcuucauauaccaugauauaaucugaaaggggcagauuaaaaaaaaaaaaagaaucuaaaccuuacauguguaaagguuucauguucacugugagugaaaauuuuuacauucaucaauaucccucuuguaagucaucuacuuaauaaauauuacagugaauuaccugucucaauaugucaaaaaaaaaaaaaaaaaa

SEQ ID NO: 47 - RNA, 2205 nt, Homo sapiens
gcgcacgccggccgcgcccacgugaccgguccgggugcaaacacgcgggucagcugauccggcccaacugcggcgucaucccggcuauaagcgcacggccucggcgacccucuccgacccggccgccgccgccaugcagcccuccagccuucugccgcucgcccucugccugcuggcugcacccgccuccgcgcucgucaggaucccgcugcacaaguucacguccauccgccggaccaugucggagguugggggcucuguggaggaccugauugccaaaggccccgucucaaaguacucccaggcggugccagccgugaccgaggggcccauucccgaggugcucaagaacuacauggacgcccaguacuacggggagauuggcaucgggacgcccccccagugcuucacagucgucuucgacacgggcuccuccaaccuguggguccccuccauccacugcaaacugcuggacaucgcuugcuggauccaccacaaguacaacagcgacaaguccagcaccuacgugaagaaugguaccucguuugacauccacuauggcucgggcagccucuccggguaccugagccaggacacugugucggugcccugccagucagcgucgucagccucugcccugggcggugucaaaguggagaggcaggucuuuggggaggccaccaagcagccaggcaucaccuucaucgcagccaaguucgauggcauccugggcauggccuacccccgcaucuccgucaacaacgugcugcccgucuucgacaaccugaugcagcagaagcugguggaccagaacaucuucuccuucuaccugagcagggacccagaugcgcagccugggggugagcugaugcuggguggcacagacuccaaguauuacaaggguucucuguccuaccugaaugucacccgcaaggccuacuggcagguccaccuggaccagguggagguggccagcgggcugacccugugcaaggagggcugugaggccauuguggacacaggcacuucccucauggugggcccgguggaugaggugcgcgagcugcagaaggccaucggggccgugccgcugauucagggcgaguacaugauccccugugagaagguguccacccugcccgcgaucacacugaagcugggaggcaaaggcuacaagcuguccccagaggacuacacgcucaaggugucgcaggccgggaagacccucugccugagcggcuucaugggcauggacaucccgccacccagcgggccacucuggauccugggcgacgucuucaucggccgcuacuacacuguguuugaccgugacaacaacagggugggcuucgccgaggcugcccgccucuaguucccaaggcguccgcgcgccagcacagaaacagaggagagucccagagcaggaggccccuggcccagcggccccucccacacacacccacacacucgcccgcccacuguccugggcgcccuggaagccggcggcccaagcccgacuugcuguuuuguucugugguuuuccccucccuggguucagaaaugcugccugccugucugucucuccaucuguuugguggggguagagcugauccagagcacagaucuguuucgugcauuggaagaccccacccaagcuuggcagccgagcucguguauccuggggcucccuucaucuccagggaguccccuccccggcccuaccagcgcccgcugggcugagccccuaccccacaccaggccguccucccgggcccucccuuggaaaccugcccugccugagggccccucugcccagcuugggcccagcugggcucugccacccuaccuguucagugucccgggcccguugaggaugaggccgcuagaggccugaggaugagcuggaaggagugagaggggacaaaacccaccuuguuggagccugcaggguggugcugggacugagccagucccaggggcauguauuggccuggaggugggguugggauugggggcuggugccagccuuccucugcagcugaccucuguuguccuccccuugggcggcugagagccccagcugacauggaaauacaguuguuggccuccggccuccccucaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 48 - RNA, 1416 nt, Homo sapiens
acgggcuauuuaaagguacgcgccgcggccaaggccgcaccguacugggcgggggucuggggagcgcagcagccauggcaagccgucuccugcucaacaacggcgccaagaugcccauccugggguuggguaccuggaaguccccuccagggcaggugacugaggccgugaagguggccauugacgucggguaccgccacaucgacugugcccauguguaccagaaugagaaugagguggggguggccauucaggagaagcucagggagcagguggugaagcgugaggagcucuucaucgucagcaagcuguggugcacguaccaugagaagggccuggugaaaggagccugccagaagacacucagcgaccugaagcuggacuaccuggaccucuaccuuauucacuggccgacuggcuuuaagccugggaaggaauuuuucccauuggaugagucgggcaaugugguucccagugacaccaacauucuggacacgugggcggccauggaagagcugguggaugaagggcuggugaaagcuauuggcaucuccaacuucaaccaucuccagguggagaugaucuuaaacaaaccuggcuugaaguauaagccugcaguuaaccagauugagugccacccauaucucacucaggagaaguuaauccaguacugccaguccaaaggcaucguggugaccgccuacagcccccucggcucuccugacaggcccugggccaagcccgaggacccuucucuccuggaggaucccaggaucaaggcgaucgcagccaagcacaauaaaacuacagcccagguccugauccgguuccccaugcagaggaacuugguggugauccccaagucugugacaccagaacgcauugcugagaacuuuaaggucuuugacuuugaacugagcagccaggauaugaccaccuuacucagcuacaacaggaacuggagggucugugccuuguugagcuguaccucccacaaggauuaccccuuccaugaagaguuuugaagcugugguugccugcucguccccaagugaccuauaccuguguuucuugccucauuuuuuuccuugcaaauguaguauggccugugucacucagcagugggacagcaaccuguagaguggccagcgagggcgugucuagcuugauguuggaucucaagagcccugucaguagaguagaagucucuuccaguuugcuuugcccuucuuucuacccugcuggggaaaguacaaccugaauacccuuuucugaccaaagagaagcaaaaucuaccaggucaaaauagugccacuaacgguugaguuuugacugcuuggaacuggaauccuuucagcaagacuucucuuugccucaaauaaaaagugcuuuugugagaaaaaaaaaaaaaaaaaa

SEQ ID NO: 49 - RNA, 3687 nt, Homo sapiens
uccaccauuuugcuagagaaggccgcggaggcucagagaggugcgcacacuugcccugagucacacagcgaaugcccuccgcggucccaacgcagagagaacgagccgaucggcagccugagcgaggcagugguuagggggggccccggccccggccacuccccucacccccuccccgcagagcgccgcccaggacaggcugggccccaggccccgccccgagguccugcccacacaccccugacacaccggcgucgccagccaauggccgggguccuauaaacgcuacgguccgcgcgcucucuggcaagaggcaagagguagcaacagcgagcgugccggucgcuagucgcggguccccgagugagcacgccagggagcaggagaccaaacgacgggggucggagucagagucgcagugggaguccccggaccggagcacgagccugagcgggagagcgccgcucgcacgcccgucgccacccgcguacccggcgcagccagagccaccagcgcagcgcugccauggagcccagcagcaagaagcugacgggucgccucaugcuggccgugggaggagcagugcuuggcucccugcaguuuggcuacaacacuggagucaucaaugccccccagaaggugaucgaggaguucuacaaccagacauggguccaccgcuauggggagagcauccugcccaccacgcucaccacgcucuggucccucucaguggccaucuuuucuguugggggcaugauuggcuccuucucugugggccuuuucguuaaccgcuuuggccggcggaauucaaugcugaugaugaaccugcuggccuucguguccgccgugcucaugggcuucucgaaacugggcaaguccuuugagaugcugauccugggccgcuucaucaucgguguguacugcggccugaccacaggcuucgugcccauguaugugggugaagugucacccacagcccuucguggggcccugggcacccugcaccagcugggcaucgucgucggcauccucaucgcccagguguucggccuggacuccaucaugggcaacaaggaccuguggccccugcugcugagcaucaucuucaucccggcccugcugcagugcaucgugcugcccuucugccccgagaguccccgcuuccugcucaucaaccgcaacgaggagaaccgggccaagagugugcuaaagaagcugcgcgggacagcugacgugacccaugaccugcaggagaugaaggaagagagucggcagaugaugcgggagaagaaggucaccauccuggagcuguuccgcucccccgccuaccgccagcccauccucaucgcuguggugcugcagcugucccagcagcugucuggcaucaacgcugucuucuauuacuccacgagcaucuucgagaaggcgggggugcagcagccuguguaugccaccauuggcuccgguaucgucaacacggccuucacugucgugucgcuguuugugguggagcgagcaggccggcggacccugcaccucauaggccucgcuggcauggcggguugugccauacucaugaccaucgcgcuagcacugcuggagcagcuacccuggauguccuaucugagcaucguggccaucuuuggcuuuguggccuucuuugaaguggguccuggccccaucccaugguucaucguggcugaacucuucagccaggguccacguccagcugccauugccguugcaggcuucuccaacuggaccucaaauuucauugugggcaugugcuuccaguauguggagcaacuguguggucccuacgucuucaucaucuucacugugcuccugguucuguucuucaucuucaccuacuucaaaguuccugagacuaaaggccggaccuucgaugagaucgcuuccggcuuccggcaggggggagccagccaaagugacaagacacccgaggagcuguuccauccccugggggcugauucccaagugugagucgccccagaucaccagcccggccugcucccagcagcccuaaggaucucucaggagcacaggcagcuggaugagacuuccaaaccugacagaugucagccgagccgggccuggggcuccuuucuccagccagcaaugauguccagaagaauauucaggacuuaacggcuccaggauuuuaacaaaagcaagacuguugcucaaaucuauucagacaagcaacagguuuuauaauuuuuuuauuacugauuuuguuauuuuuauaucagccugagucuccugugcccacaucccaggcuucacccugaaugguuccaugccugaggguggagacuaagcccugucgagacacuugccuucuucacccagcuaaucuguagggcuggaccuauguccuaaggacacacuaaucgaacuaugaacuacaaagcuucuaucccaggagguggcuauggccacccguucugcuggccuggaucuccccacucuaggggucaggcuccauuaggauuugccccuucccaucucuuccuacccaaccacucaaauuaaucuuucuuuaccugagaccaguugggagcacuggagugcagggaggagaggggaagggccagucugggcugccggguucuagucuccuuugcacugagggccacacuauuaccaugagaagagggccugugggagccugcaaacucacugcucaagaagacauggagacuccugcccuguuguguauagaugcaagauauuuauauauauuuuugguugucaauauuaaauacagacacuaaguuauaguauaucuggacaagccaacuuguaaauacaccaccucacuccuguuacuuaccuaaacagauauaaauggcugguuuuuagaaacaugguuuugaaaugcuuguggauugaggguaggagguuuggaugggagugagacagaaguaagugggguugcaaccacugcaacggcuuagacuucgacucaggauccagucccuuacacguaccucucaucaguguccucuugcucaaaaaucuguuugaucccuguuacccagagaauauauacauucuuuaucuugacauucaaggcauuucuaucacauauuugauaguugguguucaaaaaaacacuaguuuugugccagccgugaugcucaggcuugaaaugcauuauuuugaaugugaaguaaauacuguaccuuuauuggacaggcucaaagagguuaugugccugaagucgcacagugaauaagcuaaaacaccugcuuuuaacaaugguaccauacaaccacuacuccauuaacuccacccaccuccugcaccccuccccacacacacaaaaugaaccacguucuuuguaugggcccaaugagcugucaagcugcccuguguucauuucauuuggaauugcccccucugguuccucuguauacuacugcuucaucucuaaagacagcucauccuccuccuucaccccugaauuuccagagcacuucaucugcuccuucaucacaaguccaguuuucugccacuagucugaauuucaugagaagaugccgauuugguuccuguggguccucagcacuauucaguacagugcuugaugcacagcaggcacucagaaaauacuggaggaaauaaaacaccaaagauauuugucaaaaaaaaaaaaaaaaa

SEQ ID NO: 50 - RNA, 3439 nt, Homo sapiens
ucugguuuguaacuuaugccuaagggaccugcucccauuuucuuuccuaguggaacaaagguauugaagccacagguugcugaggcaaagcacuuauugauuagauucccaucaauauucagcugccgcugagaagauuagacuuggacucucaggucuggguagcccaacuccucccucuccuugcuccuccuccugcaaugcauaacuaggccuaggcagagcugcgaauaaacaggcaggagcuagucaggugcaugugccacacucacacaagaccuggaauugacaggacucccaacuaguacaaugacagaagauaaggucacugggacccugguuuucacugucaucacugcugugcuggguuccuuccaguuuggauaugacauuggugugaucaaugcaccucaacagguaauaauaucucacuauagacauguuuuggguguuccacuggaugaccgaaaagcuaucaacaacuauguuaucaacaguacagaugaacugcccacaaucucauacucaaugaacccaaaaccaaccccuugggcugaggaagagacuguggcagcugcucaacuaaucaccaugcucuggucccugucuguauccagcuuugcaguugguggaaugacugcaucauucuuugguggguggcuuggggacacacuuggaagaaucaaagccauguuaguagcaaacauucugucauuaguuggagcucucuugaugggguuuucaaaauugggaccaucucauauacuuauaauugcuggaagaagcauaucaggacuauauugugggcuaauuucaggccugguuccuauguauaucggugaaauugcuccaaccgcucucaggggagcacuuggcacuuuucaucagcuggccaucgucacgggcauucuuauuagucagauuauuggucuugaauuuaucuugggcaauuaugaucuguggcacauccugcuuggccugucuggugugcgagccauccuucagucucugcuacucuuuuucuguccagaaagccccagauaccuuuacaucaaguuagaugaggaagucaaagcaaaacaaagcuugaaaagacucagaggauaugaugaugucaccaaagauauuaaugaaaugagaaaagaaagagaagaagcaucgagugagcagaaagucucuauaauucagcucuucaccaauuccagcuaccgacagccuauucuaguggcacugaugcugcauguggcucagcaauuuuccggaaucaauggcauuuuuuacuacucaaccagcauuuuucagacggcugguaucagcaaaccuguuuaugcaaccauuggaguuggcgcuguaaacaugguuuucacugcugucucuguauuccuuguggagaaggcagggcgacguucucucuuucuaauuggaaugagugggauguuuguuugugccaucuucaugucagugggacuugugcugcugaauaaguucucuuggaugaguuaugugagcaugauagccaucuuccucuuugucagcuucuuugaaauugggccaggcccgauccccugguucaugguggcugaguuuuucagucaaggaccacguccugcugcuuuagcaauagcugcauucagcaauuggaccugcaauuucauuguagcucuguguuuccaguacauugcggacuucuguggaccuuauguguuuuuccucuuugcuggagugcuccuggccuuuacccuguucacauuuuuuaaaguuccagaaaccaaaggaaagucuuuugaggaaauugcugcagaauuccaaaagaagaguggcucagcccacaggccaaaagcugcuguagaaaugaaauuccuaggagcuacagagacuguguaaaaaaaaaacccugcuuuuugacaugaacagaaacaauaagggaaccgucuguuuuuaaaugaugauuccuugagcauuuuauauccacaucuuuaaguauuguuuuauuuuuaugugcucucaucagaaaugucaucaaauauuaccaaaaaaguauuuuuuuaaguuagagaauauauuuuugaugguaagacuguaauuaaguaaaccaaaaaggcuaguuuauuuuguuacacuaaagggcaggugguucuaauauuuuuagcucuguucuuuauaacaagguucuucuaaaauugaagagauuucaacauaucauuuuuuuaacacauaacuagaaaccugaggaugcaacaaauauuuauauauuugaauaucauuaaauuggaauuuucuuacccauauaucuuauguuaaaggagauauggcuaguggcaauaaguuccauguuaaaauagacaacucuuccauuuauugcacucagcuuuuuucuugaguacuagaauuuguauuuugcuuaaaauuuuacuuuuguucuguauuuucauguggaauggauuauagaguauacuaaaaaaugucuauagagaaaaacuuucauuuuugguaggcuuaucaaaaucuuucagcacucagaaaagaaaaccauuuuaguuccuuuauuuaauggccaaaugguuuuugcaagauuuaacacuaaaaagguuucaccugaucauauagcguggguuaucaguuaacauuaacaucuauuauaaaaccauguugauucccuucugguacaauccuuugaguuauaguuugcuuugcuuuuuaauugaggacagccugguuuucacauacacucaaacaaucaugagucagacauuugguauauuaccucaaauuccuaauaaguuugaucaaaucuaauguaagaaaauuugaaguaaaggauugaucacuuuguuaaaaauauuuucugaauuauuaugucucaaaauaaguugaaaagguaggguuugaggauuccugagugugggcuucugaaacuucauaaauguucagcuucagacuuuuaucaaaaucccuauuuaauuuuccuggaaagacugauuguuuuaugguguguuccuaacauaaaauaaucgucuccuuugacauuuccuucuuugucuuagcuguauacagauucuagccaaacuauucuauggccauuacuaacacgcauuguacacuaucuaucugccuuuaccuacauaggcaaauuggaaauacacagaugauuaaacagacuuuagcuuacagucaauuuuacaauuauggaaauauaguucugaugggucccaaaagcuuagcagggugcuaacguaucucuaggcuguuuucuccaccaacuggagcacugaucaauccuucuuauguuugcuuuaauguguauugaagaaaagcacuuuuuaaaaaguacucuuuaagagugaaauaauuaaaaaccacugaacauuugcuuuguuuucuaaaguuguucacauauauguaauuuagcaguccaaagaacaagaaauuguuucuuuuc

SEQ ID NO: 51 - RNA, 3938 nt, Homo sapiens
agauugcuucaggggggugggguggggugggguggggcugggggcuugucgcccuuucaggcuccacccuuugcggagauuauaaauagucaugaucccagcgagacccagagaugcuguaaugguaagacuuuggauccuuccugaggacguggagaaaacuugcugcugagaaggacauuuugaagguuuuguuggcugaaaaagcuguuucuggaaucaccccuagaucuuucuugaagacuugaauuagauuacagcgauggggacacagaaggucaccccagcucugauauuugccaucacaguugcuacaaucggcucuuuccaauuuggcuacaacacuggggucaucaaugcuccugagaagaucauaaaggaauuuaucaauaaaacuuugacggacaagggaaaugccccacccucugaggugcugcucacgucucucugguccuugucuguggccauauuuuccgucggggguaugaucggcuccuuuuccgucggacucuucgucaaccgcuuuggcaggcgcaauucaaugcugauugucaaccuguuggcugucacugguggcugcuuuaugggacuguguaaaguagcuaagucgguugaaaugcugauccugggucgcuugguuauuggccucuucugcggacucugcacagguuuugugcccauguacauuggagagaucucgccuacugcccugcggggugccuuuggcacucucaaccagcugggcaucguuguuggaauucugguggcccagaucuuuggucuggaauucauccuugggucugaagagcuauggccgcugcuacuggguuuuaccauccuuccugcuauccuacaaagugcagcccuuccauuuugcccugaaagucccagauuuuugcucauuaacagaaaagaagaggagaaugcuaagcagauccuccagcgguuguggggcacccaggauguaucccaagacauccaggagaugaaagaugagagugcaaggaugucacaagaaaagcaagucaccgugcuagagcucuuuagaguguccagcuaccgacagcccaucaucauuuccauugugcuccagcucucucagcagcucucugggaucaaugcuguguucuauuacucaacaggaaucuucaaggaugcagguguucaagagcccaucuaugccaccaucggcgcgggugugguuaauacuaucuucacuguaguuucucuauuucugguggaaagggcaggaagaaggacucugcauaugauaggccuuggagggauggcuuuuuguuccacgcucaugacuguuucuuuguuauuaaaggauaacuauaaugggaugagcuuugucuguauuggggcuaucuuggucuuuguagccuucuuugaaauuggaccaggccccauucccugguuuauuguggccgaacucuucagccagggcccccgcccagcugcgauggcaguggccggcugcuccaacuggaccuccaacuuccuagucggauugcucuuccccuccgcugcucacuauuuaggagccuacguuuuuauuaucuucaccggcuuccucauuaccuucuuggcuuuuaccuucuucaaagucccugagacccguggcaggacuuuugaggauaucacacgggccuuugaagggcaggcacacggugcagauagaucuggaaaggacggcgucauggagaugaacagcaucgagccugcuaaggagaccaccaccaaugucuaagucgugccuccuuccaccucccucccggcaugggaaagccaccucucccucaacaagggagagaccucaucaggaugaacccaggacgcuucugaaugcugcuacuuaauuccuuucucaucccacgcacuccaugagcaccccaaggcugcgguuuguuggaucuucaauggcuuuuuaaauuuuauuuccuggacauccucuucugcuuaggagagaccgagugaaccuaccuucauuucaggagggauuggccgcuuggcacaugacaacuuugccagcuuuuccucccuuggguucugauauugccgcacuaggggauauaggagaggaaaaguaaggugcaguucccccaaccucagacuuaccaggaagcagauacauaugaguguggaagccggaggguguuuauguaagagcaccuuccucacuuccauacagcucuacguggcaaauuaacuugaguuuuauuuauuuuauccucugguuuaauuacauaauuuuuuuuuuuuaacuuuaaguuucaggauacaugugccgaaugugcagguuuguuacauagguauauauaugccaugauggaaauauuuauuuuuuuaagcguaauuuugccaaauaauaaaaacagaaggaaauugagauuagagggagguguuuaaagagagguuauagaguagaagauuugaugcuggagagguuaaggugcaauaagaauuuagggagaaauguuguucauuauuggaggguaaaugauguggugccugaggucuguacguuaccucuuaacaauuucuguccuucagauggaaacucuuuaacuucucguaaaagucauauaccuauauaauaaagcuacugauuuccuuuggagcuuuuuucuuuaagauaauaguuuacauguaguaguacuugaaaucuaggauuauuaacuaauaugggcauuguaguuaaugaugguugauggguucuaauuuuggauggaguccagggaagagaaagugauuucuagaaagccuguuccccucacuggaugaaauaacuccuucuuguaguagucucauuacuuuugaaguaaucccgccaccuaucucgugggagagccauccaaauaagaaaccuaaaauaauugguucuugguagagauucauuauuuuuccacuuuguucuuuaggagauuuuagguguugauuuucuguuguauuuuaacucauaccuuuaaaggaauuccccaaagaauguuuauagcaaacuuggaauuuguaaccucagcucugggagaggauuuuuuucugagcgauuauuaucuaaaguguguuguugcuuuaggcucacggcacgcuugcguaugucuguuaccaugucacugugguccuaugccgaaugcccucaggggacuugaaucuuuccaauaaaccagguuuagacaguaugagucaaugugcaguguagcccacacuugagaggaugaauguaugugcacugucacuuugcucuggguggaaguacguuauuguugacuuauuuucucuguguuuguuccuacagccccuuuuucauauguugcucagucucccuuucccuucuuggugcuuacacaucucagacccuuuagccaaacccuugucagugacaguauuuugguucuuaguucucacuguucccucugcuccuggagccuuugaauaaaaaugcacguagcugaggccggaugcgguggcucacgccuguaaucccagcacuuugggaggccuaggcgggcggucagggguucgagaccagucuggccaacaucgugaaacccugucucuacuaaaaaugcaaaaauuagccgggcgugguggcgggcgccuguaaucccagcuacuugggaagcugaggcgggagaaucaugugaacccgggacgcagggguugcagugagcggagaucgcaucauugcacucuagccugggccacagggcgagacuccgucucaaaaaaaaaaaaaugcacauagcuaucaagugugcuuuagcuugaaaaggugaccuugcaacuucaugucaacuucuggcuccucaaacaguagguuggcaguaaggcagggucccauuucucacugagaagauugugaauauuuccauauggauuuucuauuguuacucugguucuuuguuuuaaaauaaaaauucugaauguacacgaca

SEQ ID NO: 52 - RNA, 5054 nt, Homo sapiens
ucuuaccugccgggccgccgccccagccaacagcucagccgggugcuccuuccugggcuccacgcccggagcugcuuccugacggugcagccgcaaggcaucgcaggggccccgcgcuacugcccugcucccucaaagucccagguccccuccccuggugcugaucauuaaccaggaggccguauaaggagcuagcggcccuggcgagagggaaggacgcaacgcugccaccauggacaguagcaccuggagccccaagaccaccgcggucacccggccuguugagacccacgagcucauucgcaaugcagccgauaucuccaucaucguuaucuacuucgugguagugauggccgucggacugugggcuauguuuuccaccaaucgugggacuguuggaggcuucuuccuggcaggccgaaguauggugugguggccgauuggagccucccucuuugcuaguaacauuggaaguggccacuuuguggggcuggccgggacuggggcagcuucaggcaucgccauuggaggcuuugaauggaaugcccugguuuuggugguugugcugggcuggcuguuuguccccaucuauauuaaggcugggguggugacaaugccagaguaccugaggaagcgguuuggaggccagcggauccaggucuaccuuucccuucugucccugcugcucuacauuuucaccaagaucucggcagacaucuucucgggggccauauucaucaaucuggccuuaggccugaaucuguauuuagccaucuuucucuuauuggcaaucacugcccuuuacacaauuacagggggccuggcggcggugauuuacacggacaccuugcagacggugaucaugcugguggggucuuuaauccugacuggguuugcuuuucacgaagugggaggcuaugacgccuucauggaaaaguacaugaaagccauuccaaccauagugucugauggcaacaccaccuuucaggaaaaaugcuacacuccaagggccgacuccuuccacaucuuccgagauccccucacgggagaccucccauggccuggguucaucuuugggauguccauccuuaccuugugguacuggugcacagaucaggucauugugcagcgcugccucucagccaagaauaugucucacgugaaggguggcugcauccuguguggguaucuaaagcugaugcccauguucaucauggugaugccaggaaugaucagccgcauucuguacacagaaaaaauugccugugucgucccuucagaaugugagaaauauugcgguaccaagguuggcuguaccaacaucgccuauccaaccuuagugguggagcucaugcccaauggacugcgaggccugaugcuaucagucaugcuggccucccucaugagcucccugaccuccaucuucaacagcgccagcacccucuucaccauggacaucuacgccaagguccgcaagagagcaucugagaaagagcucaugauugccggaagguuguuuauccuggugcugauuggcaucagcaucgccugggugcccauugugcagucagcacaaagugggcaacucuucgauuacauccaguccaucaccaguuacuugggaccacccauugcggcugucuuccugcuugcuauuuucuggaagagagucaaugagccaggagccuuuuggggacugauccuaggacuucugauugggauuucacguaugauuacugaguuugcuuauggaaccgggagcugcauggagcccagcaacugucccacgauuaucuguggggugcacuacuuguacuuugccauuauccucuucgccauuucuuucaucaccaucguggucaucucccuccucaccaaacccauuccggaugugcaucucuaccgucuguguuggagccugcgcaacagcaaagaggagcguauugaccuggaugcggaagaggagaacauccaagaaggcccuaaggagaccauugaaauagaaacacaaguuccugagaagaaaaaaggaaucuucaggagagccuaugaccuauuuugugggcuagagcagcacggugcacccaagaugacugaggaagaggagaaagccaugaagaugaagaugacggacaccucugagaagccuuuguggaggacaguguugaacgucaauggcaucauccuggugaccguggcugucuuuugccaugcauauuuugccugaguccuaccuuuugcuguagauuuaccauggcuggacucuuacucaccuuccuuuagucucguccugugguguugaagggaaaucagccaguuguaaauuuugcccagguggauaaauguguacauguguaauuauaggcuagcuggaagaaaaccauuaguuugcuguuaauuuaugcauuugaagccagugugauacagccaucuguaccuacuggagcugcagaagggaaguccacucagucacauccagaaaaaggcagacuaagaaucagaagccaugugauugaugucugacgugagucugucucagguagauuccgggugucagugugguuuauaauccuugaauauuguuuuagaaacuuuggucucccugguuccugccacuuuuccuguccguccuccuccccauuuuuuuuuuaaaagaaagcuguuuuccccucaucauaucccucuugaguuuugccuggacuuucccucucaagugugucaaucagguaaacugaggaaugcauggaagcugaggauggagcuugaugggcucccuguccuggguguuugcucucugaaguggaggccugaggaagguaguacuuccacaaaagggagggacccgggccccagccucaagcuagugggggaggcagauagccugaauccaggggauuuucugggcuucuuaaaauguccauugugaguuccccguguuugggauuccacucauuuuggcauucacagugccuggaaugucuuagauuuucagcaaugcguguugaauaaaugaaugacauaggcauuuauuuuuaaaucuuugcuugcuuuuuacaugagccuggcccuuaguuaaccuuuucuuguggcuacacaaaguaugcucacugguuacuaaugacuugggaugcauuugucaaacugauuauauuaguuuucuagggaugccauaacaaaguagcacagaccagauggcucaagcagcagacauuuauuuucucacaguucuagaggcuagaaguuggaggccaagaugucagcaggguugguuucuucugaggccucucuccuugguugcagauggucauaucucacucugucuuccguggccuuccuuuugucuguguccuaaaucuacucuucugauaaggacaucagucauauuggaauaggacccacccuaaugucuucauuuuaaucaccucuuuaaagccccuaccuccaaauacagucacacugugagaaacugaggguuaggaagucagcaagugagucuugaagagauacuaaacaaacccacaacacagauaaaguaugcauuuuggagauuuccaagccagagucucccgugaaaaagguaaacggaagcaguuauugugcagcaaaaggaaaaagaauuacaaacugaacguauguaggugaggcaaggcaggguagggcagggccuuuggguaggcugaucagaggguuuuucaacaauaaaucaaugggaaugcauuuguugcucccaggacccuggcaccuugacucugguacuauagcaugucagcaaauacaagcaaagcccaacacucugauuugcauuuaugccaaucuaaacuauccgguguuuaguuugauuuuuugagugcagguucauucaaggaccagguucccuugugcucagggugaaguagaaccagaaaacaucguuauccauucccagaaguuuuggaagagccuugguagaaaagcagaagcugcuuugaccgugaaaauauuugacuccuaucaguuuuuggucaggagaagauauccaccuagaccaaccugaggagaaggcucagaguacagauauaccccgagcaacgugaucaauguccuugaaccuucauuuuucaucugaaaacagagacauaaaugccuggcucacagauuuaaauguuauacauugacagcauuuaucaguauaacauuuauuuaaauaaguaggugcucaauagguguuggucuucuaacuugucuacaucccauccccauuccagggucuucagaauugaaggagagauguuguaucacuguuagaaggcugcuuugggacauucugcagcagggaggagggacugucaaccccuacaccaugaccaccaaguuccucaccuuggcugagucccuaaaacucucugaaccucagguuccuccaagcauaaugcagacuucacagagcuguuguaaagauuaggugaggucaauugauacugcuuaaaaggcccgguccguagaaaaugcccaauaaacauuacugcuuucccccucacccuacugccugaaaaaauauuacaccugugagacugacuuugagaaccaguguggguggggaguugugcauauaaacuauuuaaugaguaccaaacacaaaagucaagcuuguaaaauaucaggccuugccccagaaagacaaauaccacaugaucucacugauauguagaaucuuaaaaagucaaacucagaagcagagaguagaaugaugguuaucaagggcugggggagggagggacuggggagauguuggucaaaugauacaaagguuuaguuagguggaauaaguucagaaaaucaauuguacaauguaucaauuauaguuaauagcaauauaacauauacuugaaaauugcugagaguagugugaguguucuaccacaaaaaaauaugugcaguaauagauguuaauuaccuuaauuuagucauuucacaauauguacauauauaaaaauauguuguaugccaugaguauauauaauuauuauuugugaauuuaaaaaauaaaaauaauuuccaaaaaaaaaaaaaaaaaa

SEQ ID NO: 53 - RNA, 2526 nt, Homo sapiens
gccuagucccgccccugcgugcggcgcuucucccaggccccaccuuccauccagugcccuggacccucggcuggguagcgccaccagagcgaccaaacgucccgcgccuuccaggccgcacuccagagccaaaagagcuccauggcggcggcggccaagcccaacaaccuuucccugguggugcacggaccgggggacuugcgccuggagaacuauccuaucccugaaccaggcccaaaugaggucuugcugaggaugcauucuguuggaaucuguggcucagauguccacuacugggaguauggucgaauugggaauuuuauugugaaaaagcccauggugcugggacaugaagcuucgggaacagucgaaaaagugggaucaucgguaaagcaccuaaaaccaggugaucguguugccaucgagccuggugcuccccgagaaaaugaugaauucugcaagaugggccgauacaaucugucaccuuccaucuucuucugugccacgccccccgaugacgggaaccucugccgguucuauaagcacaaugcagccuuuuguuacaagcuuccugacaaugucaccuuugaggaaggcgcccugaucgagccacuuucuguggggauccaugccugcaggagaggcggaguuacccugggacacaagguccuuguguguggagcugggccaaucgggauggucacuuugcucguggccaaagcaaugggagcagcucaaguaguggugacugaucugucugcuacccgauuguccaaagccaaggagauuggggcugauuuaguccuccagaucuccaaggagagcccucaggaaaucgccaggaaaguagaaggucagcuggggugcaagccggaagucaccaucgagugcacgggggcagaggccuccauccaggcgggcaucuacgccacucgcucuggugggaaccucgugcuuguggggcugggcucugagaugaccaccguaccccuacugcaugcagccauccgggagguggauaucaagggcguguuucgauacugcaacacguggccaguggcgauuucgaugcuugcguccaagucugugaauguaaaaccccucgucacccauagguuuccucuggagaaagcucuggaggccuuugaaacauuuaaaaagggauugggguugaaaaucaugcucaagugugaccccagugaccagaaucccugauguuaaugggcucugcccucauccccacagucuugggaucucagggcacaauggcuggacaugggugggcucugaugcagaacuuucucuuuugaauguuaagaauaacuaauacaauucauugugaacagaaguccuuaagcagaggaauuggugugccuuaaagauacaaucugggauaguuugggggaacuuguagccagaaugcccuguucaugcugagcaaaguucagcaaguagagcagaguuuggcaggcaggugccaggaacuccccuucuuccuggagugccuucauugaggaaggaaaucuggcccuuggguuuccugguuccacugcuacugacccagaggggaaugagggcugaguuaugaaaagauaacuucaugaagacuuaacuggcccagaagcugauuuucaugaaaaucugccacucagggucugggaugaaggcuugucagcacuuccaguuuagaacgcaauguuucuagagacauauuggcuguuuguuuugaugauaaaaggagaauaagaaaaggcaucacuuuccuggauccaggauaauuuuuaaaccaaucaaaugaaaaaaacaaacaaacaaaaaaggaaaugucaugugagguuaaaccaguuugcauuccccuaauguggaaaaaguaagaggacuacucagcacuguuugaagauugccucuucuacagcuucugagaauuguguuauuucacuugccaagugaaggacccccuccccaacaugccccagcccaccccuaagcauggucccuugucaccaggcaaccaggaaacugcuacuuguggaccucaccagagaccaggaggguuugguuagcucacaggacuucccccaccccagaagauuagcaucccauacuagacucauacucaacucaacuaggcucauacucaauugaugguuauuagacaauuccauuucuuucugguuauuauaaacagaaaaucuuuccucuucucauuaccaguaaaggcucuugguaucuuucuguuggaaugauuucuaugaacuugucuuauuuuaaugguggguuuuuuuucugguaagauuuagaccuaaaucgcaucaugccaacuugugacuuugagacuauucaucaagaaugaggauauaguagccaugacauagcuugagcuauagccuuuaauuccuuacuuuggcuauggguggagggugaguuugaagagguucugauuuucuuguaaccugggaaagccaugaccuugugcccgauucuuucagauugcuuuggguaauaaauauugguggugguaucuga

SEQ ID NO: 54 - RNA, 416 nt, Homo sapiens
gggaggagagaaaagccauggccgacaagguccugaaggagaagagaaagcuguuuauccguuccaugggugaagauaauguuucuuggagacaucccacaaugggcucuguuuuuauuggaagacucauugaacauaugcaagaauaugccuguuccugugauguggaggaaauuuuccgcaagguucgauuuucauuugagcagccagaugguagagcgcagaugcccaccacugaaagagugacuuugacaagauguuucuaccucuucccaggacauuaaaauaaggaaacuguaugaaugucugugggcaggaagugaagagauccuucuguaaagguuuuuggaauuaugucugcugaauaauaaacuuuuuugaaauaauaaaucugguagaaaaaugaaaaaaaaaaa

SEQ ID NO: 55 - RNA, 1364 nt, Homo sapiens
gggaggagagaaaagccauggccgacaagguccugaaggagaagagaaagcuguuuauccguuccaugggugaagguacaauaaauggcuuacuggaugaauuauuacagacaagggugcugaacaaggaagagauggagaaaguaaaacgugaaaaugcuacaguuauggauaagacccgagcuuugauugacuccguuauuccgaaaggggcacaggcaugccaaauuugcaucacauacauuugugaagaagacaguuaccuggcagggacgcugggacucucagcagaucaaacaucuggaaauuaccuuaauaugcaagacucucaaggaguacuuucuuccuuuccagcuccucaggcagugcaggacaacccagcuaugcccacauccucaggcucagaagggaaugucaagcuuugcucccuagaagaagcucaaaggauauggaaacaaaagucggcagagauuuauccaauaauggacaagucaagccgcacacgucuugcucucauuaucugcaaugaagaauuugacaguauuccuagaagaacuggagcugagguugacaucacaggcaugacaaugcugcuacaaaaucugggguacagcguagaugugaaaaaaaaucucacugcuucggacaugacuacagagcuggaggcauuugcacaccgcccagagcacaagaccucugacagcacguuccugguguucaugucucaugguauucgggaaggcauuugugggaagaaacacucugagcaagucccagauauacuacaacucaaugcaaucuuuaacauguugaauaccaagaacugcccaaguuugaaggacaaaccgaaggugaucaucauccaggccugccguggugacagcccugguguggugugguuuaaagauucaguaggaguuucuggaaaccuaucuuuaccaacuacagaagaguuugaggaugaugcuauuaagaaagcccacauagagaaggauuuuaucgcuuucugcucuuccacaccagauaauguuucuuggagacaucccacaaugggcucuguuuuuauuggaagacucauugaacauaugcaagaauaugccuguuccugugauguggaggaaauuuuccgcaagguucgauuuucauuugagcagccagaugguagagcgcagaugcccaccacugaaagagugacuuugacaagauguuucuaccucuucccaggacauuaaaauaaggaaacuguaugaaugucugugggcaggaagugaagagauccuucuguaaagguuuuuggaauuaugucugcugaauaauaaacuuuuuugaaauaauaaaucugguagaaaaaugaaaaaaaaaaa

SEQ ID NO: 56 - RNA, 2689 nt, Homo sapiens
acaucucccggcggcgggccgcggaagcagugcagacgcggcuccuagcggaugggugcuauugugaggcgguuguagaagaguuucgugagugcucgcagcucauaccuguggcuguguauccguggccacagcugguuggcgucgccuugaaaucccaggccgugaggaguuagcgagcccugcucacacucggcgcucugguuuucggugggugugcccugcaccugccucuucccccauucucauuaauaaagguauccauggagaacacugaaaacucaguggauucaaaauccauuaaaaauuuggaaccaaagaucauacauggaagcgaaucaauggacucuggaauaucccuggacaacaguuauaaaauggauuauccugagauggguuuauguauaauaauuaauaauaagaauuuucauaaaagcacuggaaugacaucucggucugguacagaugucgaugcagcaaaccucagggaaacauucagaaacuugaaauaugaagucaggaauaaaaaugaucuuacacgugaagaaauuguggaauugaugcgugauguuucuaaagaagaucacagcaaaaggagcaguuuuguuugugugcuucugagccauggugaagaaggaauaauuuuuggaacaaauggaccuguugaccugaaaaaaauaacaaacuuuuucagaggggaucguuguagaagucuaacuggaaaacccaaacuuuucauuauucaggccugccgugguacagaacuggacuguggcauugagacagacagugguguugaugaugacauggcgugucauaaaauaccaguggaggccgacuucuuguaugcauacuccacagcaccugguuauuauucuuggcgaaauucaaaggauggcuccugguucauccagucgcuuugugccaugcugaaacaguaugccgacaagcuugaauuuaugcacauucuuacccggguuaaccgaaagguggcaacagaauuugaguccuuuuccuuugacgcuacuuuucaugcaaagaaacagauuccauguauuguuuccaugcucacaaaagaacucuauuuuuaucacuaaagaaaugguugguuggugguuuuuuuuaguuuguaugccaagugagaagaugguauauuugguacuguauuucccucucauuuugaccuacucucaugcugcagaggguacuuuaagacauacuccuuccaucaaauagaaccacuaugaagcuaccucaaacuuccagucagguaguugcaauugaauuaaauuaggaauaaauaaaaauggauacuggugcagucauuaugagaggcaaugauuguuaauuuacagcuuucaugauuagcaaguuacagugaugcugugcuaugaauuuucaaguaauugugaaaaaguuaaacauugaaguaaugaauuuuuaugauauuccccccacuuaagacuguguauucuaguuuugucaaacuguagaaaugaugauguggaagaacuuaggcaucugugggcauggucaaaggcucaaaccuuuauuuuagaauugauauacacggaugacuuaacugcauuuuuagaccauuuaucugggauuaugguuuugugauguuuguccugaacacuuuuguuguaaaaaaauaauaauaauguuuaauauugagaaagaaacuaauauuuuaugugagagaaagugugagcaaacuaacuugacuuuuaaggcuaaaacuuaacauucauagagggguggaguuuuaacuguaaggugcuacaaugccccuggaucuaccagcauaaauaucuucugauuugucccuaugcauaucaguugagcuucauauaccagcaauauaucugaagagcuauuauauaaaaaccccaaacuguugauuauuagccagguaaugugaauaaauucuauaggaacauaugaaaauacaacuuaaauaauaaacaguggaauauaaggaaagcaauaaaugaaugggcugagcugccuguaacuugagaguagaugguuugagccugagcagagacaugacucagccuguuccaugaaggcagagccauggaccacgcaggaagggccuacagcccauuucuccauacgcacugguauguguggaugaugcugccagggcgccaucgccaaguaagaaagugaagcaaaucagaaacuugugaaguggaaauguucuaaagguggugaggcaauaaaaaucauaguacucuuuguagcaaaauucuuaaguauguuauuuucuguugaaguuuacaaucaaaggaaaauaguaauguuuuauacuguuuacugaaagaaaaagaccuaugagcacauaggacucuagacggcauccagccggaggccagagcugagcccucagcccgggaggcaggcuccaggccucagcaggugcggagccgucacugcaccaagucucacuggcugucaguaugacauuucacgggagauuucuuguugcucaaaaaaugagcucgcauuugucaaugacaguuucuuuuuucuuacuagaccuguaacuuuuguaaauacacauagcauguaaugguaucuuaaaguguguuucuaugugacaauuuuguacaaauuuguuauuuuccauuuuuauuucaaaauauacauucaaacuuaaaauuaaaaaaaaaaaaaaaaa

SEQ ID NO: 57 - RNA, 2522 nt, Homo sapiens
acaucucccggcggcgggccgcggaagcagugcagacgcggcuccuagcggaugggugcuauugugaggcgguuguagaaguuaauaaagguauccauggagaacacugaaaacucaguggauucaaaauccauuaaaaauuuggaaccaaagaucauacauggaagcgaaucaauggacucuggaauaucccuggacaacaguuauaaaauggauuauccugagauggguuuauguauaauaauuaauaauaagaauuuucauaaaagcacuggaaugacaucucggucugguacagaugucgaugcagcaaaccucagggaaacauucagaaacuugaaauaugaagucaggaauaaaaaugaucuuacacgugaagaaauuguggaauugaugcgugauguuucuaaagaagaucacagcaaaaggagcaguuuuguuugugugcuucugagccauggugaagaaggaauaauuuuuggaacaaauggaccuguugaccugaaaaaaauaacaaacuuuuucagaggggaucguuguagaagucuaacuggaaaacccaaacuuuucauuauucaggccugccgugguacagaacuggacuguggcauugagacagacagugguguugaugaugacauggcgugucauaaaauaccaguggaggccgacuucuuguaugcauacuccacagcaccugguuauuauucuuggcgaaauucaaaggauggcuccugguucauccagucgcuuugugccaugcugaaacaguaugccgacaagcuugaauuuaugcacauucuuacccggguuaaccgaaagguggcaacagaauuugaguccuuuuccuuugacgcuacuuuucaugcaaagaaacagauuccauguauuguuuccaugcucacaaaagaacucuauuuuuaucacuaaagaaaugguugguuggugguuuuuuuuaguuuguaugccaagugagaagaugguauauuugguacuguauuucccucucauuuugaccuacucucaugcugcagaggguacuuuaagacauacuccuuccaucaaauagaaccacuaugaagcuaccucaaacuuccagucagguaguugcaauugaauuaaauuaggaauaaauaaaaauggauacuggugcagucauuaugagaggcaaugauuguuaauuuacagcuuucaugauuagcaaguuacagugaugcugugcuaugaauuuucaaguaauugugaaaaaguuaaacauugaaguaaugaauuuuuaugauauuccccccacuuaagacuguguauucuaguuuugucaaacuguagaaaugaugauguggaagaacuuaggcaucugugggcauggucaaaggcucaaaccuuuauuuuagaauugauauacacggaugacuuaacugcauuuuuagaccauuuaucugggauuaugguuuugugauguuuguccugaacacuuuuguuguaaaaaaauaauaauaauguuuaauauugagaaagaaacuaauauuuuaugugagagaaagugugagcaaacuaacuugacuuuuaaggcuaaaacuuaacauucauagagggguggaguuuuaacuguaaggugcuacaaugccccuggaucuaccagcauaaauaucuucugauuugucccuaugcauaucaguugagcuucauauaccagcaauauaucugaagagcuauuauauaaaaaccccaaacuguugauuauuagccagguaaugugaauaaauucuauaggaacauaugaaaauacaacuuaaauaauaaacaguggaauauaaggaaagcaauaaaugaaugggcugagcugccuguaacuugagaguagaugguuugagccugagcagagacaugacucagccuguuccaugaaggcagagccauggaccacgcaggaagggccuacagcccauuucuccauacgcacugguauguguggaugaugcugccagggcgccaucgccaaguaagaaagugaagcaaaucagaaacuugugaaguggaaauguucuaaagguggugaggcaauaaaaaucauaguacucuuuguagcaaaauucuuaaguauguuauuuucuguugaaguuuacaaucaaaggaaaauaguaauguuuuauacuguuuacugaaagaaaaagaccuaugagcacauaggacucuagacggcauccagccggaggccagagcugagcccucagcccgggaggcaggcuccaggccucagcaggugcggagccgucacugcaccaagucucacuggcugucaguaugacauuucacgggagauuucuuguugcucaaaaaaugagcucgcauuugucaaugacaguuucuuuuuucuuacuagaccuguaacuuuuguaaauacacauagcauguaaugguaucuuaaaguguguuucuaugugacaauuuuguacaaauuuguuauuuuccauuuuuauuucaaaauauacauucaaacuuaaaauuaaaaaaaaaaaaaaaaa

SEQ ID NO: 58 - RNA, 1071 nt, Homo sapiens
guguacaugauuucauucuguucacuuuguuaugucaaaaagaagaaaacaccuucugcuuccuauuuuccaaaggaaagcaguuauacacgagaucagagucuaauuuuaucuuggcaaagaaaaagagaauuugaggacugggaauuuuccauucaggguaauaucaacaagcugguccacugagaggagagcaagccuguugaaauuguuuuugcuuucacagcuuuuuccuguccggggagcaggagaagccauggcugaugagaaaccauccaacgguguucugguccacauggugaaguugcugaucaagaccuuucuagauggcauuuuugaugauuugauggaaaauaauguguuaaauacagaugagauacaccuuauaggaaaaugucuaaaguuuguggugagcaaugcugaaaaccugguugaugauaucacugagacagcucaaauugcaggcaaaauauuuagggaacaccuguggaauuccaaaaaacagcugaguucagauauauccagugauggagaaagagaggcgaacaugccuggccucaacauccgcaacaaagaauucaacuaucuucauaaucgaaaugguucugaacuugaccuuuuggggaugugagaucuacuugaaaaccuuggauacucagugguuauaaaagagaaucucacagcucagauggugcugggauuguuugguucaccacugacaguggaaaagccagugcagauacucauggucggcucuugcaagguaacaucuguaaugaugcuguuacaaaggcucauguggaaaaggacuucauugcuuucaaaucuuccacaccacauaauguuucuuggagacaugaaacaaauggcucugucuucauuucccaaauuaucuacuacuucagagaguauucuuggagucaucaucuagaggaaauuuuucaaaagguucaacauucauuugagaccccaaauauacugacccagcugcccaccauugaaagacuauccaugacacgauauuucuaucucuuuccugggaauuaaaacucauaagaagcaacucaggua

SEQ ID NO: 59 - RNA, 19 nt, artificial
  Oligomer
caggcuucagcaaagacaa

SEQ ID NO: 60 - RNA, 19 nt, artificial
  Oligomer
aggacugccuguaccucaa

SEQ ID NO: 61 - RNA, 19 nt, artificial
  Oligomer
ccuacauggugcacuggaa

SEQ ID NO: 62 - RNA, 19 nt, artificial
  Oligomer
cugugcugguguccaugaa

SEQ ID NO: 63 - RNA, 19 nt, artificial
  Oligomer
agcuguauauacuauuuau

SEQ ID NO: 64 - RNA, 19 nt, artificial
  Oligomer
gcuacgagaucgaguucau

SEQ ID NO: 65 - RNA, 19 nt, artificial
  Oligomer
gcucguauuuucugguuua

SEQ ID NO: 66 - RNA, 19 nt, artificial
  Oligomer
cagagugucugcuaccaau

SEQ ID NO: 67 - RNA, 19 nt, artificial
  Oligomer
cgacaucagugacgcuguu

SEQ ID NO: 68 - RNA, 19 nt, artificial
  Oligomer
cuacgccuacgucuuugaa

SEQ ID NO: 69 - RNA, 19 nt, artificial
  Oligomer
uggguguggugaaggauga

SEQ ID NO: 70 - RNA, 19 nt, artificial
  Oligomer
ggagacuuccucagugaca

SEQ ID NO: 71 - RNA, 19 nt, artificial
  Oligomer
gaaggaugagggcucguau

SEQ ID NO: 72 - RNA, 19 nt, artificial
  Oligomer
acgccuacgucuuugaaca

SEQ ID NO: 73 - RNA, 19 nt, artificial
  Oligomer
cggcagaggagaaaaucuu

SEQ ID NO: 74 - RNA, 19 nt, artificial
  Oligomer
ccagagugucugcuaccaa

SEQ ID NO: 75 - RNA, 19 nt, artificial
  Oligomer
cacgugcugccucaagaaa

SEQ ID NO: 76 - RNA, 19 nt, artificial
  Oligomer
ggaagaaccaguucgacca

SEQ ID NO: 77 - RNA, 19 nt, artificial
  Oligomer
gacgcuacaaccuuccaga

SEQ ID NO: 78 - RNA, 19 nt, artificial
  Oligomer
gaaacuacacggcagagga

SEQ ID NO: 79 - RNA, 19 nt, artificial
  Oligomer
ugcugguguccaugaacua

SEQ ID NO: 80 - RNA, 19 nt, artificial
  Oligomer
cccuagcuguauauacuau

SEQ ID NO: 81 - RNA, 19 nt, artificial
  Oligomer
ccaauauguggacacccua

SEQ ID NO: 82 - RNA, 19 nt, artificial
  Oligomer
caaugugggucuccuggau

SEQ ID NO: 83 - RNA, 19 nt, artificial
  Oligomer
aggcugugguccugcauua

SEQ ID NO: 84 - RNA, 19 nt, artificial
  Oligomer
aguucgaccacuacagcaa

SEQ ID NO: 85 - RNA, 19 nt, artificial
  Oligomer
agaaccaguucgaccacua

SEQ ID NO: 86 - RNA, 19 nt, artificial
  Oligomer
ccaggcuucagcaaagaca

SEQ ID NO: 87 - RNA, 19 nt, artificial
  Oligomer
gcuguauauacuauuuauu

SEQ ID NO: 88 - RNA, 19 nt, artificial
  Oligomer
cgagaucgaguucaucuuu

SEQ ID NO: 89 - RNA, 19 nt, artificial
  Oligomer
gaaccaguucgaccacuac

SEQ ID NO: 90 - RNA, 19 nt, artificial
  Oligomer
gcuucagcaaagacaacga

SEQ ID NO: 91 - RNA, 19 nt, artificial
  Oligomer
caguucgaccacuacagca

SEQ ID NO: 92 - RNA, 19 nt, artificial
  Oligomer
gagugucugcuaccaauau

SEQ ID NO: 93 - RNA, 19 nt, artificial
  Oligomer
aaccaguucgaccacuaca

SEQ ID NO: 94 - RNA, 19 nt, artificial
  Oligomer
ggaugagggcucguauuuu

SEQ ID NO: 95 - RNA, 19 nt, artificial
  Oligomer
cuagcuguauauacuauuu

SEQ ID NO: 96 - RNA, 19 nt, artificial
  Oligomer
acuacacggcagaggagaa

SEQ ID NO: 97 - RNA, 19 nt, artificial
  Oligomer
acuggaagaaccaguucga

SEQ ID NO: 98 - RNA, 19 nt, artificial
  Oligomer
ggcucagcaguacguuagu

SEQ ID NO: 99 - RNA, 19 nt, artificial
  Oligomer
guagauggagacuuccuca

SEQ ID NO: 100 - RNA, 19 nt, artificial
  Oligomer
caauauguggacacccuau

SEQ ID NO: 101 - RNA, 19 nt, artificial
  Oligomer
auggagacuuccucaguga

SEQ ID NO: 102 - RNA, 19 nt, artificial
  Oligomer
ucaacguguggacaccaua

SEQ ID NO: 103 - RNA, 19 nt, artificial
  Oligomer
cagcgacugaugcgauacu

SEQ ID NO: 104 - RNA, 19 nt, artificial
  Oligomer
ucgaguucaucuuugggau

SEQ ID NO: 105 - RNA, 19 nt, artificial
  Oligomer
cuguccucgucuggaucua

SEQ ID NO: 106 - RNA, 19 nt, artificial
  Oligomer
agcaguacguuagucugga

SEQ ID NO: 107 - RNA, 19 nt, artificial
  Oligomer
cucgaaacuacacggcaga

SEQ ID NO: 108 - RNA, 19 nt, artificial
  Oligomer
cuacacggcagaggagaaa

SEQ ID NO: 109 - RNA, 19 nt, artificial
  Oligomer
accacuacagcaagcagga

SEQ ID NO: 110 - RNA, 19 nt, artificial
  Oligomer
ccuagcuguauauacuauu

SEQ ID NO: 111 - RNA, 19 nt, artificial
  Oligomer
ucagggcugggcuauaaca

SEQ ID NO: 112 - RNA, 19 nt, artificial
  Oligomer
aggagaaaaucuucgccca

SEQ ID NO: 113 - RNA, 19 nt, artificial
  Oligomer
cuucgugccugugguagau

SEQ ID NO: 114 - RNA, 19 nt, artificial
  Oligomer
gcugugguccugcauuaca

SEQ ID NO: 115 - RNA, 19 nt, artificial
  Oligomer
cccuauacccagguuuuga

SEQ ID NO: 116 - RNA, 19 nt, artificial
  Oligomer
agagugucugcuaccaaua

SEQ ID NO: 117 - RNA, 19 nt, artificial
  Oligomer
guucgaccacuacagcaag

SEQ ID NO: 118 - RNA, 19 nt, artificial
  Oligomer
acacggcagaggagaaaau

SEQ ID NO: 119 - RNA, 19 nt, artificial
  Oligomer
acgagaucgaguucaucuu

SEQ ID NO: 120 - RNA, 19 nt, artificial
  Oligomer
ccuuccagagugucugcua

SEQ ID NO: 121 - RNA, 19 nt, artificial
  Oligomer
cgucuuugaacaccgugcu

SEQ ID NO: 122 - RNA, 19 nt, artificial
  Oligomer
cuacgucuuugaacaccgu

SEQ ID NO: 123 - RNA, 19 nt, artificial
  Oligomer
cguauuuucugguuuacgg

SEQ ID NO: 124 - RNA, 19 nt, artificial
  Oligomer
ggucuacgccuacgucuuu

SEQ ID NO: 125 - RNA, 19 nt, artificial
  Oligomer
cuacaaccuuccagagugu

SEQ ID NO: 126 - RNA, 19 nt, artificial
  Oligomer
cugugguccugcauuacac

SEQ ID NO: 127 - RNA, 19 nt, artificial
  Oligomer
cacccuauacccagguuuu

SEQ ID NO: 128 - RNA, 19 nt, artificial
  Oligomer
uggugcacuggaagaacca

SEQ ID NO: 129 - RNA, 19 nt, artificial
  Oligomer
uguggacacccuauaccca

SEQ ID NO: 130 - RNA, 19 nt, artificial
  Oligomer
acauggugcacuggaagaa

SEQ ID NO: 131 - RNA, 19 nt, artificial
  Oligomer
ccacuacagcaagcaggau

SEQ ID NO: 132 - RNA, 19 nt, artificial
  Oligomer
augugggucuccuggauca

SEQ ID NO: 133 - RNA, 19 nt, artificial
  Oligomer
aaggaugagggcucguauu

SEQ ID NO: 134 - RNA, 19 nt, artificial
  Oligomer
ucugcaugucucaggcuga

SEQ ID NO: 135 - RNA, 19 nt, artificial
  Oligomer
caacguguggacaccauac

SEQ ID NO: 136 - RNA, 19 nt, artificial
  Oligomer
cgccuacgucuuugaacac

SEQ ID NO: 137 - RNA, 19 nt, artificial
  Oligomer
cagcaaagacaacgagucu

SEQ ID NO: 138 - RNA, 19 nt, artificial
  Oligomer
uagcuguauauacuauuua

SEQ ID NO: 139 - RNA, 19 nt, artificial
  Oligomer
caagaaagcgucuuccggu

SEQ ID NO: 140 - RNA, 19 nt, artificial
  Oligomer
cucaacguguggacaccau

SEQ ID NO: 141 - RNA, 19 nt, artificial
  Oligomer
gcaguacguuagucuggac

SEQ ID NO: 142 - RNA, 19 nt, artificial
  Oligomer
uuucagggcugggcuauaa

SEQ ID NO: 143 - RNA, 19 nt, artificial
  Oligomer
gauggagacuuccucagug

SEQ ID NO: 144 - RNA, 19 nt, artificial
  Oligomer
gagacuuccucagugacac

SEQ ID NO: 145 - RNA, 19 nt, artificial
  Oligomer
acggcagaggagaaaaucu

SEQ ID NO: 146 - RNA, 19 nt, artificial
  Oligomer
ugccugugguagauggaga

SEQ ID NO: 147 - RNA, 19 nt, artificial
  Oligomer
aauauguggacacccuaua

SEQ ID NO: 148 - RNA, 19 nt, artificial
  Oligomer
cuccuuggacguguacgau

SEQ ID NO: 149 - RNA, 19 nt, artificial
  Oligomer
agauggagacuuccucagu

SEQ ID NO: 150 - RNA, 19 nt, artificial
  Oligomer
cucucgaaacuacacggca

SEQ ID NO: 151 - RNA, 19 nt, artificial
  Oligomer
acggcuacgagaucgaguu

SEQ ID NO: 152 - RNA, 19 nt, artificial
  Oligomer
guaccucaacguguggaca

SEQ ID NO: 153 - RNA, 19 nt, artificial
  Oligomer
ggcuacgagaucgaguuca

SEQ ID NO: 154 - RNA, 19 nt, artificial
  Oligomer
aagacaacgagucucucau

SEQ ID NO: 155 - RNA, 19 nt, artificial
  Oligomer
gaaaaucuucgcccagcga

SEQ ID NO: 156 - RNA, 19 nt, artificial
  Oligomer
gacaacgagucucucauca

SEQ ID NO: 157 - RNA, 19 nt, artificial
  Oligomer
accaguucgaccacuacag

SEQ ID NO: 158 - RNA, 19 nt, artificial
  Oligomer
gguagacgcuacaaccuuc

SEQ ID NO: 159 - RNA, 19 nt, artificial
  Oligomer
caucagugacgcuguuugg

SEQ ID NO: 160 - RNA, 19 nt, artificial
  Oligomer
cgcuacaaccuuccagagu

SEQ ID NO: 161 - RNA, 19 nt, artificial
  Oligomer
ggcucguauuuucugguuu

SEQ ID NO: 162 - RNA, 19 nt, artificial
  Oligomer
gggcucguauuuucugguu

SEQ ID NO: 163 - RNA, 19 nt, artificial
  Oligomer
ugugguagauggagacuuc

SEQ ID NO: 164 - RNA, 19 nt, artificial
  Oligomer
uguccucgucuggaucuau

SEQ ID NO: 165 - RNA, 19 nt, artificial
  Oligomer
ggcagaggagaaaaucuuc

SEQ ID NO: 166 - RNA, 19 nt, artificial
  Oligomer
gugcugguguccaugaacu

SEQ ID NO: 167 - RNA, 19 nt, artificial
  Oligomer
ucaucaacgcgggagacuu

SEQ ID NO: 168 - RNA, 19 nt, artificial
  Oligomer
gugucugcuaccaauaugu

SEQ ID NO: 169 - RNA, 19 nt, artificial
  Oligomer
agaucgaguucaucuuugg

SEQ ID NO: 170 - RNA, 19 nt, artificial
  Oligomer
gugguagacgcuacaaccu

SEQ ID NO: 171 - RNA, 19 nt, artificial
  Oligomer
acgugcugccucaagaaag

SEQ ID NO: 172 - RNA, 19 nt, artificial
  Oligomer
ucuacgccuacgucuuuga

SEQ ID NO: 173 - RNA, 19 nt, artificial
  Oligomer
cugccucaagaaagcgucu

SEQ ID NO: 174 - RNA, 19 nt, artificial
  Oligomer
gaugagggcucguauuuuc

SEQ ID NO: 175 - RNA, 19 nt, artificial
  Oligomer
gcaaagacaacgagucucu

SEQ ID NO: 176 - RNA, 19 nt, artificial
  Oligomer
ugguagacgcuacaaccuu

SEQ ID NO: 177 - RNA, 19 nt, artificial
  Oligomer
guuuugagggcaccgagau

SEQ ID NO: 178 - RNA, 19 nt, artificial
  Oligomer
caacgagucucucaucagc

SEQ ID NO: 179 - RNA, 19 nt, artificial
  Oligomer
ccuauacccagguuuugag

SEQ ID NO: 180 - RNA, 19 nt, artificial
  Oligomer
uggagacuuccucagugac

SEQ ID NO: 181 - RNA, 19 nt, artificial
  Oligomer
uacacggcagaggagaaaa

SEQ ID NO: 182 - RNA, 19 nt, artificial
  Oligomer
gguagauggagacuuccuc

SEQ ID NO: 183 - RNA, 19 nt, artificial
  Oligomer
aagaaagcgucuuccgguu

SEQ ID NO: 184 - RNA, 19 nt, artificial
  Oligomer
ugguguccaugaacuaccg

SEQ ID NO: 185 - RNA, 19 nt, artificial
  Oligomer
aggcuucagcaaagacaac

SEQ ID NO: 186 - RNA, 19 nt, artificial
  Oligomer
cuacgagaucgaguucauc

SEQ ID NO: 187 - RNA, 19 nt, artificial
  Oligomer
aaagacaacgagucucuca

SEQ ID NO: 188 - RNA, 19 nt, artificial
  Oligomer
gaaagcgucuuccgguucu

SEQ ID NO: 189 - RNA, 19 nt, artificial
  Oligomer
acugugcugguguccauga

SEQ ID NO: 190 - RNA, 19 nt, artificial
  Oligomer
gaagaaccaguucgaccac

SEQ ID NO: 191 - RNA, 19 nt, artificial
  Oligomer
gucuuugaacaccgugcuu

SEQ ID NO: 192 - RNA, 19 nt, artificial
  Oligomer
ugguagauggagacuuccu

SEQ ID NO: 193 - RNA, 19 nt, artificial
  Oligomer
gcuacaaccuuccagagug

SEQ ID NO: 194 - RNA, 19 nt, artificial
  Oligomer
auuucagggcugggcuaua

SEQ ID NO: 195 - RNA, 19 nt, artificial
  Oligomer
gaucgaguucaucuuuggg

SEQ ID NO: 196 - RNA, 19 nt, artificial
  Oligomer
uagacgcuacaaccuucca

SEQ ID NO: 197 - RNA, 19 nt, artificial
  Oligomer
cuacauggugcacuggaag

SEQ ID NO: 198 - RNA, 19 nt, artificial
  Oligomer
cauggugcacuggaagaac

SEQ ID NO: 199 - RNA, 19 nt, artificial
  Oligomer
aggaugagggcucguauuu

SEQ ID NO: 200 - RNA, 19 nt, artificial
  Oligomer
ucgaccacuacagcaagca

SEQ ID NO: 201 - RNA, 19 nt, artificial
  Oligomer
acgcuacaaccuuccagag

SEQ ID NO: 202 - RNA, 19 nt, artificial
  Oligomer
aaaucuucgcccagcgacu

SEQ ID NO: 203 - RNA, 19 nt, artificial
  Oligomer
gagggcucguauuuucugg

SEQ ID NO: 204 - RNA, 19 nt, artificial
  Oligomer
cuggaagaaccaguucgac

SEQ ID NO: 205 - RNA, 19 nt, artificial
  Oligomer
guccucgucuggaucuaug

SEQ ID NO: 206 - RNA, 19 nt, artificial
  Oligomer
ggagaaaaucuucgcccag

SEQ ID NO: 207 - RNA, 19 nt, artificial
  Oligomer
ucucgaaacuacacggcag

SEQ ID NO: 208 - RNA, 19 nt, artificial
  Oligomer
cucguauuuucugguuuac

SEQ ID NO: 209 - RNA, 19 nt, artificial
  Oligomer
aaacuacacggcagaggag

SEQ ID NO: 210 - RNA, 19 nt, artificial
  Oligomer
aucgaguucaucuuuggga

SEQ ID NO: 211 - RNA, 19 nt, artificial
  Oligomer
guccuggugaaccacgaau

SEQ ID NO: 212 - RNA, 19 nt, artificial
  Oligomer
ugugcugguguccaugaac

SEQ ID NO: 213 - RNA, 19 nt, artificial
  Oligomer
uccagagugucugcuacca

SEQ ID NO: 214 - RNA, 19 nt, artificial
  Oligomer
cuuugaacaccgugcuucc

SEQ ID NO: 215 - RNA, 19 nt, artificial
  Oligomer
ugcacuggaagaaccaguu

SEQ ID NO: 216 - RNA, 19 nt, artificial
  Oligomer
ugaaggaugagggcucgua

SEQ ID NO: 217 - RNA, 19 nt, artificial
  Oligomer
cgaguucaucuuugggauc

SEQ ID NO: 218 - RNA, 19 nt, artificial
  Oligomer
ccaauaaacuguuacagcc

SEQ ID NO: 219 - RNA, 19 nt, artificial
  Oligomer
ccuacgucuuugaacaccg

SEQ ID NO: 220 - RNA, 19 nt, artificial
  Oligomer
uacauggugcacuggaaga

SEQ ID NO: 221 - RNA, 19 nt, artificial
  Oligomer
gcugguguccaugaacuac

SEQ ID NO: 222 - RNA, 19 nt, artificial
  Oligomer
guacguuagucuggaccug

SEQ ID NO: 223 - RNA, 19 nt, artificial
  Oligomer
gagaucgaguucaucuuug

SEQ ID NO: 224 - RNA, 19 nt, artificial
  Oligomer
cuuccagagugucugcuac

SEQ ID NO: 225 - RNA, 19 nt, artificial
  Oligomer
ucugcuaccaauaugugga

SEQ ID NO: 226 - RNA, 19 nt, artificial
  Oligomer
agggcucguauuuucuggu

SEQ ID NO: 227 - RNA, 19 nt, artificial
  Oligomer
ugccuguaccucaacgugu

SEQ ID NO: 228 - RNA, 19 nt, artificial
  Oligomer
accaauauguggacacccu

SEQ ID NO: 229 - RNA, 19 nt, artificial
  Oligomer
cuguaccucaacgugugga

SEQ ID NO: 230 - RNA, 19 nt, artificial
  Oligomer
cugugguagauggagacuu

SEQ ID NO: 231 - RNA, 19 nt, artificial
  Oligomer
aacuacacggcagaggaga

SEQ ID NO: 232 - RNA, 19 nt, artificial
  Oligomer
augagggcucguauuuucu

SEQ ID NO: 233 - RNA, 19 nt, artificial
  Oligomer
cacggcagaggagaaaauc

SEQ ID NO: 234 - RNA, 19 nt, artificial
  Oligomer
caaagacaacgagucucuc

SEQ ID NO: 235 - RNA, 19 nt, artificial
  Oligomer
aguacguuagucuggaccu

SEQ ID NO: 236 - RNA, 19 nt, artificial
  Oligomer
auauguggacacccuauac

SEQ ID NO: 237 - RNA, 19 nt, artificial
  Oligomer
uuauuucagggcugggcua

SEQ ID NO: 238 - RNA, 19 nt, artificial
  Oligomer
cuucagcaaagacaacgag

SEQ ID NO: 239 - RNA, 19 nt, artificial
  Oligomer
uguccaugaacuaccgggu

SEQ ID NO: 240 - RNA, 19 nt, artificial
  Oligomer
cagcaguacguuagucugg

SEQ ID NO: 241 - RNA, 19 nt, artificial
  Oligomer
agacgcuacaaccuuccag

SEQ ID NO: 242 - RNA, 19 nt, artificial
  Oligomer
uacgagaucgaguucaucu

SEQ ID NO: 243 - RNA, 19 nt, artificial
  Oligomer
guauuuucugguuuacggg

SEQ ID NO: 244 - RNA, 19 nt, artificial
  Oligomer
caaccuuccagagugucug

SEQ ID NO: 245 - RNA, 19 nt, artificial
  Oligomer
gccucaagaaagcgucuuc

SEQ ID NO: 246 - RNA, 19 nt, artificial
  Oligomer
uccuacauggugcacugga

SEQ ID NO: 247 - RNA, 19 nt, artificial
  Oligomer
ucucugcuuuccugggcau

SEQ ID NO: 248 - RNA, 19 nt, artificial
  Oligomer
gugcacuggaagaaccagu

SEQ ID NO: 249 - RNA, 19 nt, artificial
  Oligomer
cucaagaaagcgucuuccg

SEQ ID NO: 250 - RNA, 19 nt, artificial
  Oligomer
cugcuaccaauauguggac

SEQ ID NO: 251 - RNA, 19 nt, artificial
  Oligomer
acaacgagucucucaucag

SEQ ID NO: 252 - RNA, 19 nt, artificial
  Oligomer
agugucugcuaccaauaug

SEQ ID NO: 253 - RNA, 19 nt, artificial
  Oligomer
ucagcaguacguuagucug

SEQ ID NO: 254 - RNA, 19 nt, artificial
  Oligomer
agacaacgagucucucauc

SEQ ID NO: 255 - RNA, 19 nt, artificial
  Oligomer
uccucgucuggaucuaugg

SEQ ID NO: 256 - RNA, 19 nt, artificial
  Oligomer
acugccuguaccucaacgu

SEQ ID NO: 257 - RNA, 19 nt, artificial
  Oligomer
ucuuccgguucuccuucgu

SEQ ID NO: 258 - RNA, 19 nt, artificial
  Oligomer
ugagggcucguauuuucug

SEQ ID NO: 259 - RNA, 19 nt, artificial
  Oligomer
agcgacugaugcgauacug

SEQ ID NO: 260 - RNA, 19 nt, artificial
  Oligomer
uacgccuacgucuuugaac

SEQ ID NO: 261 - RNA, 19 nt, artificial
  Oligomer
uacccagguuuugagggca

SEQ ID NO: 262 - RNA, 19 nt, artificial
  Oligomer
acaucagugacgcuguuug

SEQ ID NO: 263 - RNA, 19 nt, artificial
  Oligomer
cacuggaagaaccaguucg

SEQ ID NO: 264 - RNA, 19 nt, artificial
  Oligomer
agacuuccucagugacacc

SEQ ID NO: 265 - RNA, 19 nt, artificial
  Oligomer
gacacccuauacccagguu

SEQ ID NO: 266 - RNA, 19 nt, artificial
  Oligomer
ugcugccucaagaaagcgu

SEQ ID NO: 267 - RNA, 19 nt, artificial
  Oligomer
acaaccuuccagagugucu

SEQ ID NO: 268 - RNA, 19 nt, artificial
  Oligomer
uuugaacaccgugcuucca

SEQ ID NO: 269 - RNA, 19 nt, artificial
  Oligomer
uuuugagggcaccgagaug

SEQ ID NO: 270 - RNA, 19 nt, artificial
  Oligomer
gacaucagugacgcuguuu

SEQ ID NO: 271 - RNA, 19 nt, artificial
  Oligomer
aaagcgucuuccgguucuc

SEQ ID NO: 272 - RNA, 19 nt, artificial
  Oligomer
cucagcaguacguuagucu

SEQ ID NO: 273 - RNA, 19 nt, artificial
  Oligomer
ugcuaccaauauguggaca

SEQ ID NO: 274 - RNA, 19 nt, artificial
  Oligomer
ccugugguagauggagacu

SEQ ID NO: 275 - RNA, 19 nt, artificial
  Oligomer
agaaaaucuucgcccagcg

SEQ ID NO: 276 - RNA, 19 nt, artificial
  Oligomer
uucagggcugggcuauaac

SEQ ID NO: 277 - RNA, 19 nt, artificial
  Oligomer
ccucaagaaagcgucuucc

SEQ ID NO: 278 - RNA, 19 nt, artificial
  Oligomer
aguucaucuuugggauccc

SEQ ID NO: 279 - RNA, 19 nt, artificial
  Oligomer
auauacuauuuauuucagg

SEQ ID NO: 280 - RNA, 19 nt, artificial
  Oligomer
uguaccucaacguguggac

SEQ ID NO: 281 - RNA, 19 nt, artificial
  Oligomer
gugguagauggagacuucc

SEQ ID NO: 282 - RNA, 19 nt, artificial
  Oligomer
cuaccaauauguggacacc

SEQ ID NO: 283 - RNA, 19 nt, artificial
  Oligomer
ucaagaaagcgucuuccgg

SEQ ID NO: 284 - RNA, 19 nt, artificial
  Oligomer
cugguguccaugaacuacc

SEQ ID NO: 285 - RNA, 19 nt, artificial
  Oligomer
uccuuggacguguacgaug

SEQ ID NO: 286 - RNA, 19 nt, artificial
  Oligomer
gcacuggaagaaccaguuc

SEQ ID NO: 287 - RNA, 19 nt, artificial
  Oligomer
aagaaccaguucgaccacu

SEQ ID NO: 288 - RNA, 19 nt, artificial
  Oligomer
uagauggagacuuccucag

SEQ ID NO: 289 - RNA, 19 nt, artificial
  Oligomer
uacuauuuauuucagggcu

SEQ ID NO: 290 - RNA, 19 nt, artificial
  Oligomer
ucgaaacuacacggcagag

SEQ ID NO: 291 - RNA, 19 nt, artificial
  Oligomer
uccuggugaaccacgaaug

SEQ ID NO: 292 - RNA, 19 nt, artificial
  Oligomer
gucugcuaccaauaugugg

SEQ ID NO: 293 - RNA, 19 nt, artificial
  Oligomer
gcagaggagaaaaucuucg

SEQ ID NO: 294 - RNA, 19 nt, artificial
  Oligomer
acacccuauacccagguuu

SEQ ID NO: 295 - RNA, 19 nt, artificial
  Oligomer
ucguauuuucugguuuacg

SEQ ID NO: 296 - RNA, 19 nt, artificial
  Oligomer
uucagcaaagacaacgagu

SEQ ID NO: 297 - RNA, 19 nt, artificial
  Oligomer
cagaggagaaaaucuucgc

SEQ ID NO: 298 - RNA, 19 nt, artificial
  Oligomer
acccuauacccagguuuug

SEQ ID NO: 299 - RNA, 19 nt, artificial
  Oligomer
gcuaccaauauguggacac

SEQ ID NO: 300 - RNA, 19 nt, artificial
  Oligomer
acuacagcaagcaggaucg

SEQ ID NO: 301 - RNA, 19 nt, artificial
  Oligomer
gucuacgccuacgucuuug

SEQ ID NO: 302 - RNA, 19 nt, artificial
  Oligomer
ugucugcuaccaauaugug

SEQ ID NO: 303 - RNA, 19 nt, artificial
  Oligomer
cuauacccagguuuugagg

SEQ ID NO: 304 - RNA, 19 nt, artificial
  Oligomer
cacuacagcaagcaggauc

SEQ ID NO: 305 - RNA, 19 nt, artificial
  Oligomer
auguggacacccuauaccc

SEQ ID NO: 306 - RNA, 19 nt, artificial
  Oligomer
gcucagcaguacguuaguc

SEQ ID NO: 307 - RNA, 19 nt, artificial
  Oligomer
acgucuuugaacaccgugc

SEQ ID NO: 308 - RNA, 19 nt, artificial
  Oligomer
ggcuucagcaaagacaacg

SEQ ID NO: 309 - RNA, 19 nt, artificial
  Oligomer
uucgaccacuacagcaagc

SEQ ID NO: 310 - RNA, 19 nt, artificial
  Oligomer
ucagcaaagacaacgaguc

SEQ ID NO: 311 - RNA, 19 nt, artificial
  Oligomer
uaccucaacguguggacac

SEQ ID NO: 312 - RNA, 19 nt, artificial
  Oligomer
uauacuauuuauuucaggg

SEQ ID NO: 313 - RNA, 19 nt, artificial
  Oligomer
uggaagaaccaguucgacc

SEQ ID NO: 314 - RNA, 19 nt, artificial
  Oligomer
cuauuuauuucagggcugg

SEQ ID NO: 315 - RNA, 19 nt, artificial
  Oligomer
ugccucaagaaagcgucuu

SEQ ID NO: 316 - RNA, 19 nt, artificial
  Oligomer
acuauuuauuucagggcug

SEQ ID NO: 317 - RNA, 19 nt, artificial
  Oligomer
gccuacgucuuugaacacc

SEQ ID NO: 318 - RNA, 19 nt, artificial
  Oligomer
gagaaaaucuucgcccagc

SEQ ID NO: 319 - RNA, 19 nt, artificial
  Oligomer
guagacgcuacaaccuucc

SEQ ID NO: 320 - RNA, 19 nt, artificial
  Oligomer
uuugagggcaccgagaugu

SEQ ID NO: 321 - RNA, 19 nt, artificial
  Oligomer
uacagcaagcaggaucgcu

SEQ ID NO: 322 - RNA, 19 nt, artificial
  Oligomer
caguacguuagucuggacc

SEQ ID NO: 323 - RNA, 19 nt, artificial
  Oligomer
uucuugguacaggccgaga

SEQ ID NO: 324 - RNA, 19 nt, artificial
  Oligomer
aaccuuccagagugucugc

SEQ ID NO: 325 - RNA, 19 nt, artificial
  Oligomer
uacgucuuugaacaccgug

SEQ ID NO: 326 - RNA, 19 nt, artificial
  Oligomer
agaggagaaaaucuucgcc

SEQ ID NO: 327 - RNA, 19 nt, artificial
  Oligomer
aacguguggacaccauacc

SEQ ID NO: 328 - RNA, 19 nt, artificial
  Oligomer
aacgagucucucaucagcc

SEQ ID NO: 329 - RNA, 19 nt, artificial
  Oligomer
uauuucagggcugggcuau

SEQ ID NO: 330 - RNA, 19 nt, artificial
  Oligomer
agcaaagacaacgagucuc

SEQ ID NO: 331 - RNA, 19 nt, artificial
  Oligomer
gaggagaaaaucuucgccc

SEQ ID NO: 332 - RNA, 19 nt, artificial
  Oligomer
auggugcacuggaagaacc

SEQ ID NO: 333 - RNA, 19 nt, artificial
  Oligomer
uuuauuucagggcugggcu

SEQ ID NO: 334 - RNA, 19 nt, artificial
  Oligomer
gaguucaucuuugggaucc

SEQ ID NO: 335 - RNA, 19 nt, artificial
  Oligomer
uugaacaccgugcuuccac

SEQ ID NO: 336 - RNA, 19 nt, artificial
  Oligomer
aaaaucuucgcccagcgac

SEQ ID NO: 337 - RNA, 19 nt, artificial
  Oligomer
aucagugacgcuguuuggg

SEQ ID NO: 338 - RNA, 19 nt, artificial
  Oligomer
aaugugggucuccuggauc

SEQ ID NO: 339 - RNA, 19 nt, artificial
  Oligomer
agcuccuacauggugcacu

SEQ ID NO: 340 - RNA, 19 nt, artificial
  Oligomer
uauguggacacccuauacc

SEQ ID NO: 341 - RNA, 19 nt, artificial
  Oligomer
agaaagcgucuuccgguuc

SEQ ID NO: 342 - RNA, 19 nt, artificial
  Oligomer
accuuccagagugucugcu

SEQ ID NO: 343 - RNA, 19 nt, artificial
  Oligomer
uuccagagugucugcuacc

SEQ ID NO: 344 - RNA, 19 nt, artificial
  Oligomer
uauuuauuucagggcuggg

SEQ ID NO: 345 - RNA, 19 nt, artificial
  Oligomer
uacguuagucuggaccugc

SEQ ID NO: 346 - RNA, 19 nt, artificial
  Oligomer
auacccagguuuugagggc

SEQ ID NO: 347 - RNA, 19 nt, artificial
  Oligomer
uaccaauauguggacaccc

SEQ ID NO: 348 - RNA, 19 nt, artificial
  Oligomer
auacuauuuauuucagggc

SEQ ID NO: 349 - RNA, 19 nt, artificial
  Oligomer
uacaaccuuccagaguguc

SEQ ID NO: 350 - RNA, 19 nt, artificial
  Oligomer
ucuuugaacaccgugcuuc

SEQ ID NO: 351 - RNA, 19 nt, artificial
  Oligomer
uauacccagguuuugaggg

SEQ ID NO: 352 - RNA, 19 nt, artificial
  Oligomer
uucgugccugugguagaug

SEQ ID NO: 353 - RNA, 19 nt, artificial
  Oligomer
auuuauuucagggcugggc

SEQ ID NO: 354 - RNA, 19 nt, artificial
  Oligomer
uugucuuugcugaagccug

SEQ ID NO: 355 - RNA, 19 nt, artificial
  Oligomer
uugagguacaggcaguccu

SEQ ID NO: 356 - RNA, 19 nt, artificial
  Oligomer
uuccagugcaccauguagg

SEQ ID NO: 357 - RNA, 19 nt, artificial
  Oligomer
uucauggacaccagcacag

SEQ ID NO: 358 - RNA, 19 nt, artificial
  Oligomer
auaaauaguauauacagcu

SEQ ID NO: 359 - RNA, 19 nt, artificial
  Oligomer
augaacucgaucucguagc

SEQ ID NO: 360 - RNA, 19 nt, artificial
  Oligomer
uaaaccagaaaauacgagc

SEQ ID NO: 361 - RNA, 19 nt, artificial
  Oligomer
auugguagcagacacucug

SEQ ID NO: 362 - RNA, 19 nt, artificial
  Oligomer
aacagcgucacugaugucg

SEQ ID NO: 363 - RNA, 19 nt, artificial
  Oligomer
uucaaagacguaggcguag

SEQ ID NO: 364 - RNA, 19 nt, artificial
  Oligomer
ucauccuucaccacaccca

SEQ ID NO: 365 - RNA, 19 nt, artificial
  Oligomer
ugucacugaggaagucucc

SEQ ID NO: 366 - RNA, 19 nt, artificial
  Oligomer
auacgagcccucauccuuc

SEQ ID NO: 367 - RNA, 19 nt, artificial
  Oligomer
uguucaaagacguaggcgu

SEQ ID NO: 368 - RNA, 19 nt, artificial
  Oligomer
aagauuuucuccucugccg

SEQ ID NO: 369 - RNA, 19 nt, artificial
  Oligomer
uugguagcagacacucugg

SEQ ID NO: 370 - RNA, 19 nt, artificial
  Oligomer
uuucuugaggcagcacgug

SEQ ID NO: 371 - RNA, 19 nt, artificial
  Oligomer
uggucgaacugguucuucc

SEQ ID NO: 372 - RNA, 19 nt, artificial
  Oligomer
ucuggaagguuguagcguc

SEQ ID NO: 373 - RNA, 19 nt, artificial
  Oligomer
uccucugccguguaguuuc

SEQ ID NO: 374 - RNA, 19 nt, artificial
  Oligomer
uaguucauggacaccagca

SEQ ID NO: 375 - RNA, 19 nt, artificial
  Oligomer
auaguauauacagcuaggg

SEQ ID NO: 376 - RNA, 19 nt, artificial
  Oligomer
uaggguguccacauauugg

SEQ ID NO: 377 - RNA, 19 nt, artificial
  Oligomer
auccaggagacccacauug

SEQ ID NO: 378 - RNA, 19 nt, artificial
  Oligomer
uaaugcaggaccacagccu

SEQ ID NO: 379 - RNA, 19 nt, artificial
  Oligomer
uugcuguaguggucgaacu

SEQ ID NO: 380 - RNA, 19 nt, artificial
  Oligomer
uaguggucgaacugguucu

SEQ ID NO: 381 - RNA, 19 nt, artificial
  Oligomer
ugucuuugcugaagccugg

SEQ ID NO: 382 - RNA, 19 nt, artificial
  Oligomer
aauaaauaguauauacagc

SEQ ID NO: 383 - RNA, 19 nt, artificial
  Oligomer
aaagaugaacucgaucucg

SEQ ID NO: 384 - RNA, 19 nt, artificial
  Oligomer
guaguggucgaacugguuc

SEQ ID NO: 385 - RNA, 19 nt, artificial
  Oligomer
ucguugucuuugcugaagc

SEQ ID NO: 386 - RNA, 19 nt, artificial
  Oligomer
ugcuguaguggucgaacug

SEQ ID NO: 387 - RNA, 19 nt, artificial
  Oligomer
auauugguagcagacacuc

SEQ ID NO: 388 - RNA, 19 nt, artificial
  Oligomer
uguaguggucgaacugguu

SEQ ID NO: 389 - RNA, 19 nt, artificial
  Oligomer
aaaauacgagcccucaucc

SEQ ID NO: 390 - RNA, 19 nt, artificial
  Oligomer
aaauaguauauacagcuag

SEQ ID NO: 391 - RNA, 19 nt, artificial
  Oligomer
uucuccucugccguguagu

SEQ ID NO: 392 - RNA, 19 nt, artificial
  Oligomer
ucgaacugguucuuccagu

SEQ ID NO: 393 - RNA, 19 nt, artificial
  Oligomer
acuaacguacugcugagcc

SEQ ID NO: 394 - RNA, 19 nt, artificial
  Oligomer
ugaggaagucuccaucuac

SEQ ID NO: 395 - RNA, 19 nt, artificial
  Oligomer
auaggguguccacauauug

SEQ ID NO: 396 - RNA, 19 nt, artificial
  Oligomer
ucacugaggaagucuccau

SEQ ID NO: 397 - RNA, 19 nt, artificial
  Oligomer
uaugguguccacacguuga

SEQ ID NO: 398 - RNA, 19 nt, artificial
  Oligomer
aguaucgcaucagucgcug

SEQ ID NO: 399 - RNA, 19 nt, artificial
  Oligomer
aucccaaagaugaacucga

SEQ ID NO: 400 - RNA, 19 nt, artificial
  Oligomer
uagauccagacgaggacag

SEQ ID NO: 401 - RNA, 19 nt, artificial
  Oligomer
uccagacuaacguacugcu

SEQ ID NO: 402 - RNA, 19 nt, artificial
  Oligomer
ucugccguguaguuucgag

SEQ ID NO: 403 - RNA, 19 nt, artificial
  Oligomer
uuucuccucugccguguag

SEQ ID NO: 404 - RNA, 19 nt, artificial
  Oligomer
uccugcuugcuguaguggu

SEQ ID NO: 405 - RNA, 19 nt, artificial
  Oligomer
aauaguauauacagcuagg

SEQ ID NO: 406 - RNA, 19 nt, artificial
  Oligomer
uguuauagcccagcccuga

SEQ ID NO: 407 - RNA, 19 nt, artificial
  Oligomer
ugggcgaagauuuucuccu

SEQ ID NO: 408 - RNA, 19 nt, artificial
  Oligomer
aucuaccacaggcacgaag

SEQ ID NO: 409 - RNA, 19 nt, artificial
  Oligomer
uguaaugcaggaccacagc

SEQ ID NO: 410 - RNA, 19 nt, artificial
  Oligomer
ucaaaaccuggguauaggg

SEQ ID NO: 411 - RNA, 19 nt, artificial
  Oligomer
uauugguagcagacacucu

SEQ ID NO: 412 - RNA, 19 nt, artificial
  Oligomer
cuugcuguaguggucgaac

SEQ ID NO: 413 - RNA, 19 nt, artificial
  Oligomer
auuuucuccucugccgugu

SEQ ID NO: 414 - RNA, 19 nt, artificial
  Oligomer
aagaugaacucgaucucgu

SEQ ID NO: 415 - RNA, 19 nt, artificial
  Oligomer
uagcagacacucuggaagg

SEQ ID NO: 416 - RNA, 19 nt, artificial
  Oligomer
agcacgguguucaaagacg

SEQ ID NO: 417 - RNA, 19 nt, artificial
  Oligomer
acgguguucaaagacguag

SEQ ID NO: 418 - RNA, 19 nt, artificial
  Oligomer
ccguaaaccagaaaauacg

SEQ ID NO: 419 - RNA, 19 nt, artificial
  Oligomer
aaagacguaggcguagacc

SEQ ID NO: 420 - RNA, 19 nt, artificial
  Oligomer
acacucuggaagguuguag

SEQ ID NO: 421 - RNA, 19 nt, artificial
  Oligomer
guguaaugcaggaccacag

SEQ ID NO: 422 - RNA, 19 nt, artificial
  Oligomer
aaaaccuggguauagggug

SEQ ID NO: 423 - RNA, 19 nt, artificial
  Oligomer
ugguucuuccagugcacca

SEQ ID NO: 424 - RNA, 19 nt, artificial
  Oligomer
uggguauaggguguccaca

SEQ ID NO: 425 - RNA, 19 nt, artificial
  Oligomer
uucuuccagugcaccaugu

SEQ ID NO: 426 - RNA, 19 nt, artificial
  Oligomer
auccugcuugcuguagugg

SEQ ID NO: 427 - RNA, 19 nt, artificial
  Oligomer
ugauccaggagacccacau

SEQ ID NO: 428 - RNA, 19 nt, artificial
  Oligomer
aauacgagcccucauccuu

SEQ ID NO: 429 - RNA, 19 nt, artificial
  Oligomer
ucagccugagacaugcaga

SEQ ID NO: 430 - RNA, 19 nt, artificial
  Oligomer
guaugguguccacacguug

SEQ ID NO: 431 - RNA, 19 nt, artificial
  Oligomer
guguucaaagacguaggcg

SEQ ID NO: 432 - RNA, 19 nt, artificial
  Oligomer
agacucguugucuuugcug

SEQ ID NO: 433 - RNA, 19 nt, artificial
  Oligomer
uaaauaguauauacagcua

SEQ ID NO: 434 - RNA, 19 nt, artificial
  Oligomer
accggaagacgcuuucuug

SEQ ID NO: 435 - RNA, 19 nt, artificial
  Oligomer
augguguccacacguugag

SEQ ID NO: 436 - RNA, 19 nt, artificial
  Oligomer
guccagacuaacguacugc

SEQ ID NO: 437 - RNA, 19 nt, artificial
  Oligomer
uuauagcccagcccugaaa

SEQ ID NO: 438 - RNA, 19 nt, artificial
  Oligomer
cacugaggaagucuccauc

SEQ ID NO: 439 - RNA, 19 nt, artificial
  Oligomer
gugucacugaggaagucuc

SEQ ID NO: 440 - RNA, 19 nt, artificial
  Oligomer
agauuuucuccucugccgu

SEQ ID NO: 441 - RNA, 19 nt, artificial
  Oligomer
ucuccaucuaccacaggca

SEQ ID NO: 442 - RNA, 19 nt, artificial
  Oligomer
uauaggguguccacauauu

SEQ ID NO: 443 - RNA, 19 nt, artificial
  Oligomer
aucguacacguccaaggag

SEQ ID NO: 444 - RNA, 19 nt, artificial
  Oligomer
acugaggaagucuccaucu

SEQ ID NO: 445 - RNA, 19 nt, artificial
  Oligomer
ugccguguaguuucgagag

SEQ ID NO: 446 - RNA, 19 nt, artificial
  Oligomer
aacucgaucucguagccgu

SEQ ID NO: 447 - RNA, 19 nt, artificial
  Oligomer
uguccacacguugagguac

SEQ ID NO: 448 - RNA, 19 nt, artificial
  Oligomer
ugaacucgaucucguagcc

SEQ ID NO: 449 - RNA, 19 nt, artificial
  Oligomer
augagagacucguugucuu

SEQ ID NO: 450 - RNA, 19 nt, artificial
  Oligomer
ucgcugggcgaagauuuuc

SEQ ID NO: 451 - RNA, 19 nt, artificial
  Oligomer
ugaugagagacucguuguc

SEQ ID NO: 452 - RNA, 19 nt, artificial
  Oligomer
cuguaguggucgaacuggu

SEQ ID NO: 453 - RNA, 19 nt, artificial
  Oligomer
gaagguuguagcgucuacc

SEQ ID NO: 454 - RNA, 19 nt, artificial
  Oligomer
ccaaacagcgucacugaug

SEQ ID NO: 455 - RNA, 19 nt, artificial
  Oligomer
acucuggaagguuguagcg

SEQ ID NO: 456 - RNA, 19 nt, artificial
  Oligomer
aaaccagaaaauacgagcc

SEQ ID NO: 457 - RNA, 19 nt, artificial
  Oligomer
aaccagaaaauacgagccc

SEQ ID NO: 458 - RNA, 19 nt, artificial
  Oligomer
gaagucuccaucuaccaca

SEQ ID NO: 459 - RNA, 19 nt, artificial
  Oligomer
auagauccagacgaggaca

SEQ ID NO: 460 - RNA, 19 nt, artificial
  Oligomer
gaagauuuucuccucugcc

SEQ ID NO: 461 - RNA, 19 nt, artificial
  Oligomer
aguucauggacaccagcac

SEQ ID NO: 462 - RNA, 19 nt, artificial
  Oligomer
aagucucccgcguugauga

SEQ ID NO: 463 - RNA, 19 nt, artificial
  Oligomer
acauauugguagcagacac

SEQ ID NO: 464 - RNA, 19 nt, artificial
  Oligomer
ccaaagaugaacucgaucu

SEQ ID NO: 465 - RNA, 19 nt, artificial
  Oligomer
agguuguagcgucuaccac

SEQ ID NO: 466 - RNA, 19 nt, artificial
  Oligomer
cuuucuugaggcagcacgu

SEQ ID NO: 467 - RNA, 19 nt, artificial
  Oligomer
ucaaagacguaggcguaga

SEQ ID NO: 468 - RNA, 19 nt, artificial
  Oligomer
agacgcuuucuugaggcag

SEQ ID NO: 469 - RNA, 19 nt, artificial
  Oligomer
gaaaauacgagcccucauc

SEQ ID NO: 470 - RNA, 19 nt, artificial
  Oligomer
agagacucguugucuuugc

SEQ ID NO: 471 - RNA, 19 nt, artificial
  Oligomer
aagguuguagcgucuacca

SEQ ID NO: 472 - RNA, 19 nt, artificial
  Oligomer
aucucggugcccucaaaac

SEQ ID NO: 473 - RNA, 19 nt, artificial
  Oligomer
gcugaugagagacucguug

SEQ ID NO: 474 - RNA, 19 nt, artificial
  Oligomer
cucaaaaccuggguauagg

SEQ ID NO: 475 - RNA, 19 nt, artificial
  Oligomer
gucacugaggaagucucca

SEQ ID NO: 476 - RNA, 19 nt, artificial
  Oligomer
uuuucuccucugccgugua

SEQ ID NO: 477 - RNA, 19 nt, artificial
  Oligomer
gaggaagucuccaucuacc

SEQ ID NO: 478 - RNA, 19 nt, artificial
  Oligomer
aaccggaagacgcuuucuu

SEQ ID NO: 479 - RNA, 19 nt, artificial
  Oligomer
cgguaguucauggacacca

SEQ ID NO: 480 - RNA, 19 nt, artificial
  Oligomer
guugucuuugcugaagccu

SEQ ID NO: 481 - RNA, 19 nt, artificial
  Oligomer
gaugaacucgaucucguag

SEQ ID NO: 482 - RNA, 19 nt, artificial
  Oligomer
ugagagacucguugucuuu

SEQ ID NO: 483 - RNA, 19 nt, artificial
  Oligomer
agaaccggaagacgcuuuc

SEQ ID NO: 484 - RNA, 19 nt, artificial
  Oligomer
ucauggacaccagcacagu

SEQ ID NO: 485 - RNA, 19 nt, artificial
  Oligomer
guggucgaacugguucuuc

SEQ ID NO: 486 - RNA, 19 nt, artificial
  Oligomer
aagcacgguguucaaagac

SEQ ID NO: 487 - RNA, 19 nt, artificial
  Oligomer
aggaagucuccaucuacca

SEQ ID NO: 488 - RNA, 19 nt, artificial
  Oligomer
cacucuggaagguuguagc

SEQ ID NO: 489 - RNA, 19 nt, artificial
  Oligomer
uauagcccagcccugaaau

SEQ ID NO: 490 - RNA, 19 nt, artificial
  Oligomer
cccaaagaugaacucgauc

SEQ ID NO: 491 - RNA, 19 nt, artificial
  Oligomer
uggaagguuguagcgucua

SEQ ID NO: 492 - RNA, 19 nt, artificial
  Oligomer
cuuccagugcaccauguag

SEQ ID NO: 493 - RNA, 19 nt, artificial
  Oligomer
guucuuccagugcaccaug

SEQ ID NO: 494 - RNA, 19 nt, artificial
  Oligomer
aaauacgagcccucauccu

SEQ ID NO: 495 - RNA, 19 nt, artificial
  Oligomer
ugcuugcuguaguggucga

SEQ ID NO: 496 - RNA, 19 nt, artificial
  Oligomer
cucuggaagguuguagcgu

SEQ ID NO: 497 - RNA, 19 nt, artificial
  Oligomer
agucgcugggcgaagauuu

SEQ ID NO: 498 - RNA, 19 nt, artificial
  Oligomer
ccagaaaauacgagcccuc

SEQ ID NO: 499 - RNA, 19 nt, artificial
  Oligomer
gucgaacugguucuuccag

SEQ ID NO: 500 - RNA, 19 nt, artificial
  Oligomer
cauagauccagacgaggac

SEQ ID NO: 501 - RNA, 19 nt, artificial
  Oligomer
cugggcgaagauuuucucc

SEQ ID NO: 502 - RNA, 19 nt, artificial
  Oligomer
cugccguguaguuucgaga

SEQ ID NO: 503 - RNA, 19 nt, artificial
  Oligomer
guaaaccagaaaauacgag

SEQ ID NO: 504 - RNA, 19 nt, artificial
  Oligomer
cuccucugccguguaguuu

SEQ ID NO: 505 - RNA, 19 nt, artificial
  Oligomer
ucccaaagaugaacucgau

SEQ ID NO: 506 - RNA, 19 nt, artificial
  Oligomer
auucgugguucaccaggac

SEQ ID NO: 507 - RNA, 19 nt, artificial
  Oligomer
guucauggacaccagcaca

SEQ ID NO: 508 - RNA, 19 nt, artificial
  Oligomer
ugguagcagacacucugga

SEQ ID NO: 509 - RNA, 19 nt, artificial
  Oligomer
ggaagcacgguguucaaag

SEQ ID NO: 510 - RNA, 19 nt, artificial
  Oligomer
aacugguucuuccagugca

SEQ ID NO: 511 - RNA, 19 nt, artificial
  Oligomer
uacgagcccucauccuuca

SEQ ID NO: 512 - RNA, 19 nt, artificial
  Oligomer
gaucccaaagaugaacucg

SEQ ID NO: 513 - RNA, 19 nt, artificial
  Oligomer
ggcuguaacaguuuauugg

SEQ ID NO: 514 - RNA, 19 nt, artificial
  Oligomer
cgguguucaaagacguagg

SEQ ID NO: 515 - RNA, 19 nt, artificial
  Oligomer
ucuuccagugcaccaugua

SEQ ID NO: 516 - RNA, 19 nt, artificial
  Oligomer
guaguucauggacaccagc

SEQ ID NO: 517 - RNA, 19 nt, artificial
  Oligomer
cagguccagacuaacguac

SEQ ID NO: 518 - RNA, 19 nt, artificial
  Oligomer
caaagaugaacucgaucuc

SEQ ID NO: 519 - RNA, 19 nt, artificial
  Oligomer
guagcagacacucuggaag

SEQ ID NO: 520 - RNA, 19 nt, artificial
  Oligomer
uccacauauugguagcaga

SEQ ID NO: 521 - RNA, 19 nt, artificial
  Oligomer
accagaaaauacgagcccu

SEQ ID NO: 522 - RNA, 19 nt, artificial
  Oligomer
acacguugagguacaggca

SEQ ID NO: 523 - RNA, 19 nt, artificial
  Oligomer
aggguguccacauauuggu

SEQ ID NO: 524 - RNA, 19 nt, artificial
  Oligomer
uccacacguugagguacag

SEQ ID NO: 525 - RNA, 19 nt, artificial
  Oligomer
aagucuccaucuaccacag

SEQ ID NO: 526 - RNA, 19 nt, artificial
  Oligomer
ucuccucugccguguaguu

SEQ ID NO: 527 - RNA, 19 nt, artificial
  Oligomer
agaaaauacgagcccucau

SEQ ID NO: 528 - RNA, 19 nt, artificial
  Oligomer
gauuuucuccucugccgug

SEQ ID NO: 529 - RNA, 19 nt, artificial
  Oligomer
gagagacucguugucuuug

SEQ ID NO: 530 - RNA, 19 nt, artificial
  Oligomer
agguccagacuaacguacu

SEQ ID NO: 531 - RNA, 19 nt, artificial
  Oligomer
guauaggguguccacauau

SEQ ID NO: 532 - RNA, 19 nt, artificial
  Oligomer
uagcccagcccugaaauaa

SEQ ID NO: 533 - RNA, 19 nt, artificial
  Oligomer
cucguugucuuugcugaag

SEQ ID NO: 534 - RNA, 19 nt, artificial
  Oligomer
acccgguaguucauggaca

SEQ ID NO: 535 - RNA, 19 nt, artificial
  Oligomer
ccagacuaacguacugcug

SEQ ID NO: 536 - RNA, 19 nt, artificial
  Oligomer
cuggaagguuguagcgucu

SEQ ID NO: 537 - RNA, 19 nt, artificial
  Oligomer
agaugaacucgaucucgua

SEQ ID NO: 538 - RNA, 19 nt, artificial
  Oligomer
cccguaaaccagaaaauac

SEQ ID NO: 539 - RNA, 19 nt, artificial
  Oligomer
cagacacucuggaagguug

SEQ ID NO: 540 - RNA, 19 nt, artificial
  Oligomer
gaagacgcuuucuugaggc

SEQ ID NO: 541 - RNA, 19 nt, artificial
  Oligomer
uccagugcaccauguagga

SEQ ID NO: 542 - RNA, 19 nt, artificial
  Oligomer
augcccaggaaagcagaga

SEQ ID NO: 543 - RNA, 19 nt, artificial
  Oligomer
acugguucuuccagugcac

SEQ ID NO: 544 - RNA, 19 nt, artificial
  Oligomer
cggaagacgcuuucuugag

SEQ ID NO: 545 - RNA, 19 nt, artificial
  Oligomer
guccacauauugguagcag

SEQ ID NO: 546 - RNA, 19 nt, artificial
  Oligomer
cugaugagagacucguugu

SEQ ID NO: 547 - RNA, 19 nt, artificial
  Oligomer
cauauugguagcagacacu

SEQ ID NO: 548 - RNA, 19 nt, artificial
  Oligomer
cagacuaacguacugcuga

SEQ ID NO: 549 - RNA, 19 nt, artificial
  Oligomer
gaugagagacucguugucu

SEQ ID NO: 550 - RNA, 19 nt, artificial
  Oligomer
ccauagauccagacgagga

SEQ ID NO: 551 - RNA, 19 nt, artificial
  Oligomer
acguugagguacaggcagu

SEQ ID NO: 552 - RNA, 19 nt, artificial
  Oligomer
acgaaggagaaccggaaga

SEQ ID NO: 553 - RNA, 19 nt, artificial
  Oligomer
cagaaaauacgagcccuca

SEQ ID NO: 554 - RNA, 19 nt, artificial
  Oligomer
caguaucgcaucagucgcu

SEQ ID NO: 555 - RNA, 19 nt, artificial
  Oligomer
guucaaagacguaggcgua

SEQ ID NO: 556 - RNA, 19 nt, artificial
  Oligomer
ugcccucaaaaccugggua

SEQ ID NO: 557 - RNA, 19 nt, artificial
  Oligomer
caaacagcgucacugaugu

SEQ ID NO: 558 - RNA, 19 nt, artificial
  Oligomer
cgaacugguucuuccagug

SEQ ID NO: 559 - RNA, 19 nt, artificial
  Oligomer
ggugucacugaggaagucu

SEQ ID NO: 560 - RNA, 19 nt, artificial
  Oligomer
aaccuggguauaggguguc

SEQ ID NO: 561 - RNA, 19 nt, artificial
  Oligomer
acgcuuucuugaggcagca

SEQ ID NO: 562 - RNA, 19 nt, artificial
  Oligomer
agacacucuggaagguugu

SEQ ID NO: 563 - RNA, 19 nt, artificial
  Oligomer
uggaagcacgguguucaaa

SEQ ID NO: 564 - RNA, 19 nt, artificial
  Oligomer
caucucggugcccucaaaa

SEQ ID NO: 565 - RNA, 19 nt, artificial
  Oligomer
aaacagcgucacugauguc

SEQ ID NO: 566 - RNA, 19 nt, artificial
  Oligomer
gagaaccggaagacgcuuu

SEQ ID NO: 567 - RNA, 19 nt, artificial
  Oligomer
agacuaacguacugcugag

SEQ ID NO: 568 - RNA, 19 nt, artificial
  Oligomer
uguccacauauugguagca

SEQ ID NO: 569 - RNA, 19 nt, artificial
  Oligomer
agucuccaucuaccacagg

SEQ ID NO: 570 - RNA, 19 nt, artificial
  Oligomer
cgcugggcgaagauuuucu

SEQ ID NO: 571 - RNA, 19 nt, artificial
  Oligomer
guuauagcccagcccugaa

SEQ ID NO: 572 - RNA, 19 nt, artificial
  Oligomer
ggaagacgcuuucuugagg

SEQ ID NO: 573 - RNA, 19 nt, artificial
  Oligomer
gggaucccaaagaugaacu

SEQ ID NO: 574 - RNA, 19 nt, artificial
  Oligomer
ccugaaauaaauaguauau

SEQ ID NO: 575 - RNA, 19 nt, artificial
  Oligomer
guccacacguugagguaca

SEQ ID NO: 576 - RNA, 19 nt, artificial
  Oligomer
ggaagucuccaucuaccac

SEQ ID NO: 577 - RNA, 19 nt, artificial
  Oligomer
gguguccacauauugguag

SEQ ID NO: 578 - RNA, 19 nt, artificial
  Oligomer
ccggaagacgcuuucuuga

SEQ ID NO: 579 - RNA, 19 nt, artificial
  Oligomer
gguaguucauggacaccag

SEQ ID NO: 580 - RNA, 19 nt, artificial
  Oligomer
caucguacacguccaagga

SEQ ID NO: 581 - RNA, 19 nt, artificial
  Oligomer
gaacugguucuuccagugc

SEQ ID NO: 582 - RNA, 19 nt, artificial
  Oligomer
aguggucgaacugguucuu

SEQ ID NO: 583 - RNA, 19 nt, artificial
  Oligomer
cugaggaagucuccaucua

SEQ ID NO: 584 - RNA, 19 nt, artificial
  Oligomer
agcccugaaauaaauagua

SEQ ID NO: 585 - RNA, 19 nt, artificial
  Oligomer
cucugccguguaguuucga

SEQ ID NO: 586 - RNA, 19 nt, artificial
  Oligomer
cauucgugguucaccagga

SEQ ID NO: 587 - RNA, 19 nt, artificial
  Oligomer
ccacauauugguagcagac

SEQ ID NO: 588 - RNA, 19 nt, artificial
  Oligomer
cgaagauuuucuccucugc

SEQ ID NO: 589 - RNA, 19 nt, artificial
  Oligomer
aaaccuggguauagggugu

SEQ ID NO: 590 - RNA, 19 nt, artificial
  Oligomer
cguaaaccagaaaauacga

SEQ ID NO: 591 - RNA, 19 nt, artificial
  Oligomer
acucguugucuuugcugaa

SEQ ID NO: 592 - RNA, 19 nt, artificial
  Oligomer
gcgaagauuuucuccucug

SEQ ID NO: 593 - RNA, 19 nt, artificial
  Oligomer
caaaaccuggguauagggu

SEQ ID NO: 594 - RNA, 19 nt, artificial
  Oligomer
guguccacauauugguagc

SEQ ID NO: 595 - RNA, 19 nt, artificial
  Oligomer
cgauccugcuugcuguagu

SEQ ID NO: 596 - RNA, 19 nt, artificial
  Oligomer
caaagacguaggcguagac

SEQ ID NO: 597 - RNA, 19 nt, artificial
  Oligomer
cacauauugguagcagaca

SEQ ID NO: 598 - RNA, 19 nt, artificial
  Oligomer
ccucaaaaccuggguauag

SEQ ID NO: 599 - RNA, 19 nt, artificial
  Oligomer
gauccugcuugcuguagug

SEQ ID NO: 600 - RNA, 19 nt, artificial
  Oligomer
ggguauaggguguccacau

SEQ ID NO: 601 - RNA, 19 nt, artificial
  Oligomer
gacuaacguacugcugagc

SEQ ID NO: 602 - RNA, 19 nt, artificial
  Oligomer
gcacgguguucaaagacgu

SEQ ID NO: 603 - RNA, 19 nt, artificial
  Oligomer
cguugucuuugcugaagcc

SEQ ID NO: 604 - RNA, 19 nt, artificial
  Oligomer
gcuugcuguaguggucgaa

SEQ ID NO: 605 - RNA, 19 nt, artificial
  Oligomer
gacucguugucuuugcuga

SEQ ID NO: 606 - RNA, 19 nt, artificial
  Oligomer
guguccacacguugaggua

SEQ ID NO: 607 - RNA, 19 nt, artificial
  Oligomer
cccugaaauaaauaguaua

SEQ ID NO: 608 - RNA, 19 nt, artificial
  Oligomer
ggucgaacugguucuucca

SEQ ID NO: 609 - RNA, 19 nt, artificial
  Oligomer
ccagcccugaaauaaauag

SEQ ID NO: 610 - RNA, 19 nt, artificial
  Oligomer
aagacgcuuucuugaggca

SEQ ID NO: 611 - RNA, 19 nt, artificial
  Oligomer
cagcccugaaauaaauagu

SEQ ID NO: 612 - RNA, 19 nt, artificial
  Oligomer
gguguucaaagacguaggc

SEQ ID NO: 613 - RNA, 19 nt, artificial
  Oligomer
gcugggcgaagauuuucuc

SEQ ID NO: 614 - RNA, 19 nt, artificial
  Oligomer
ggaagguuguagcgucuac

SEQ ID NO: 615 - RNA, 19 nt, artificial
  Oligomer
acaucucggugcccucaaa

SEQ ID NO: 616 - RNA, 19 nt, artificial
  Oligomer
agcgauccugcuugcugua

SEQ ID NO: 617 - RNA, 19 nt, artificial
  Oligomer
gguccagacuaacguacug

SEQ ID NO: 618 - RNA, 19 nt, artificial
  Oligomer
ucucggccuguaccaagaa

SEQ ID NO: 619 - RNA, 19 nt, artificial
  Oligomer
gcagacacucuggaagguu

SEQ ID NO: 620 - RNA, 19 nt, artificial
  Oligomer
cacgguguucaaagacgua

SEQ ID NO: 621 - RNA, 19 nt, artificial
  Oligomer
ggcgaagauuuucuccucu

SEQ ID NO: 622 - RNA, 19 nt, artificial
  Oligomer
gguaugguguccacacguu

SEQ ID NO: 623 - RNA, 19 nt, artificial
  Oligomer
ggcugaugagagacucguu

SEQ ID NO: 624 - RNA, 19 nt, artificial
  Oligomer
auagcccagcccugaaaua

SEQ ID NO: 625 - RNA, 19 nt, artificial
  Oligomer
gagacucguugucuuugcu

SEQ ID NO: 626 - RNA, 19 nt, artificial
  Oligomer
gggcgaagauuuucuccuc

SEQ ID NO: 627 - RNA, 19 nt, artificial
  Oligomer
gguucuuccagugcaccau

SEQ ID NO: 628 - RNA, 19 nt, artificial
  Oligomer
agcccagcccugaaauaaa

SEQ ID NO: 629 - RNA, 19 nt, artificial
  Oligomer
ggaucccaaagaugaacuc

SEQ ID NO: 630 - RNA, 19 nt, artificial
  Oligomer
guggaagcacgguguucaa

SEQ ID NO: 631 - RNA, 19 nt, artificial
  Oligomer
gucgcugggcgaagauuuu

SEQ ID NO: 632 - RNA, 19 nt, artificial
  Oligomer
cccaaacagcgucacugau

SEQ ID NO: 633 - RNA, 19 nt, artificial
  Oligomer
gauccaggagacccacauu

SEQ ID NO: 634 - RNA, 19 nt, artificial
  Oligomer
agugcaccauguaggagcu

SEQ ID NO: 635 - RNA, 19 nt, artificial
  Oligomer
gguauaggguguccacaua

SEQ ID NO: 636 - RNA, 19 nt, artificial
  Oligomer
gaaccggaagacgcuuucu

SEQ ID NO: 637 - RNA, 19 nt, artificial
  Oligomer
agcagacacucuggaaggu

SEQ ID NO: 638 - RNA, 19 nt, artificial
  Oligomer
gguagcagacacucuggaa

SEQ ID NO: 639 - RNA, 19 nt, artificial
  Oligomer
cccagcccugaaauaaaua

SEQ ID NO: 640 - RNA, 19 nt, artificial
  Oligomer
gcagguccagacuaacgua

SEQ ID NO: 641 - RNA, 19 nt, artificial
  Oligomer
gcccucaaaaccuggguau

SEQ ID NO: 642 - RNA, 19 nt, artificial
  Oligomer
ggguguccacauauuggua

SEQ ID NO: 643 - RNA, 19 nt, artificial
  Oligomer
gcccugaaauaaauaguau

SEQ ID NO: 644 - RNA, 19 nt, artificial
  Oligomer
gacacucuggaagguugua

SEQ ID NO: 645 - RNA, 19 nt, artificial
  Oligomer
gaagcacgguguucaaaga

SEQ ID NO: 646 - RNA, 19 nt, artificial
  Oligomer
cccucaaaaccuggguaua

SEQ ID NO: 647 - RNA, 19 nt, artificial
  Oligomer
caucuaccacaggcacgaa

SEQ ID NO: 648 - RNA, 19 nt, Artificial
  Oligomer
gcccagcccugaaauaaau

SEQ ID NO: 649 - RNA, 19 nt, artificial
  Oligomer
gaggcaaaauaaaaaaaaa

SEQ ID NO: 650 - RNA, 19 nt, artificial
  Oligomer
ggauggaggcaaaauaaaa

SEQ ID NO: 651 - RNA, 19 nt, artificial
  Oligomer
gggcagaucuuaaauaaaa

SEQ ID NO: 652 - RNA, 19 nt, artificial
  Oligomer
caguguuaggaauuacaaa

SEQ ID NO: 653 - RNA, 19 nt, artificial
  Oligomer
ggcagaucuuaaauaaaau

SEQ ID NO: 654 - RNA, 19 nt, artificial
  Oligomer
gauggaggcaaaauaaaaa

SEQ ID NO: 655 - RNA, 19 nt, artificial
  Oligomer
cagagaaauuucauuuuaa

SEQ ID NO: 656 - RNA, 19 nt, artificial
  Oligomer
ggaggcaaaauaaaaaaaa

SEQ ID NO: 657 - RNA, 19 nt, artificial
  Oligomer
gccucuucgucuucuucaa

SEQ ID NO: 658 - RNA, 19 nt, artificial
  Oligomer
gagaaaggauggaggcaaa

SEQ ID NO: 659 - RNA, 19 nt, artificial
  Oligomer
gggcugggcagaucuuaaa

SEQ ID NO: 660 - RNA, 19 nt, artificial
  Oligomer
cacggaccguugcacaaaa

SEQ ID NO: 661 - RNA, 19 nt, artificial
  Oligomer
gauguuacuugcacaaaaa

SEQ ID NO: 662 - RNA, 19 nt, artificial
  Oligomer
gggaaaauaccuuuuuaua

SEQ ID NO: 663 - RNA, 19 nt, artificial
  Oligomer
cugggcagaucuuaaauaa

SEQ ID NO: 664 - RNA, 19 nt, artificial
  Oligomer
gguccaugugcaauaaaua

SEQ ID NO: 665 - RNA, 19 nt, artificial
  Oligomer
ccacaauccucgucugaau

SEQ ID NO: 666 - RNA, 19 nt, artificial
  Oligomer
aaggauggaggcaaaauaa

SEQ ID NO: 667 - RNA, 19 nt, artificial
  Oligomer
agauguuacuugcacaaaa

SEQ ID NO: 668 - RNA, 19 nt, artificial
  Oligomer
gacaguuugucaagacaua

SEQ ID NO: 669 - RNA, 19 nt, artificial
  Oligomer
ccuuuaucaugguacugua

SEQ ID NO: 670 - RNA, 19 nt, artificial
  Oligomer
aggauggaggcaaaauaaa

SEQ ID NO: 671 - RNA, 19 nt, artificial
  Oligomer
acgugaauuugcuggugaa

SEQ ID NO: 672 - RNA, 19 nt, artificial
  Oligomer
gcuuauuuauguaucaaua

SEQ ID NO: 673 - RNA, 19 nt, artificial
  Oligomer
cccagaagcaggugaagaa

SEQ ID NO: 674 - RNA, 19 nt, artificial
  Oligomer
ggagaaugacaguuuguca

SEQ ID NO: 675 - RNA, 19 nt, artificial
  Oligomer
cguccguagucuccuucua

SEQ ID NO: 676 - RNA, 19 nt, artificial
  Oligomer
caugugcaauaaauaccaa

SEQ ID NO: 677 - RNA, 19 nt, artificial
  Oligomer
ugggcagaucuuaaauaaa

SEQ ID NO: 678 - RNA, 19 nt, artificial
  Oligomer
ugcaauaaauaccaaugaa

SEQ ID NO: 679 - RNA, 19 nt, artificial
  Oligomer
cauccgaggcaaagagaaa

SEQ ID NO: 680 - RNA, 19 nt, artificial
  Oligomer
ugcacaaaaagaaauuaaa

SEQ ID NO: 681 - RNA, 19 nt, artificial
  Oligomer
cugcuguuaugaaagcaaa

SEQ ID NO: 682 - RNA, 19 nt, artificial
  Oligomer
gauuucugcuguuaugaaa

SEQ ID NO: 683 - RNA, 19 nt, artificial
  Oligomer
gcacaaaaagaaauuaaau

SEQ ID NO: 684 - RNA, 19 nt, artificial
  Oligomer
ugaagacaggacauuaaaa

SEQ ID NO: 685 - RNA, 19 nt, artificial
  Oligomer
gagaaugacaguuugucaa

SEQ ID NO: 686 - RNA, 19 nt, artificial
  Oligomer
cgugaauuugcuggugaaa

SEQ ID NO: 687 - RNA, 19 nt, artificial
  Oligomer
gcuaaugauucauugggaa

SEQ ID NO: 688 - RNA, 19 nt, artificial
  Oligomer
gauagcaggugaacucgaa

SEQ ID NO: 689 - RNA, 19 nt, artificial
  Oligomer
cacaguguuaggaauuaca

SEQ ID NO: 690 - RNA, 19 nt, artificial
  Oligomer
acggaccguugcacaaaaa

SEQ ID NO: 691 - RNA, 19 nt, artificial
  Oligomer
ggaauugguccaugugcaa

SEQ ID NO: 692 - RNA, 19 nt, artificial
  Oligomer
ccagagaaauuucauuuua

SEQ ID NO: 693 - RNA, 19 nt, artificial
  Oligomer
acaguguuaggaauuacaa

SEQ ID NO: 694 - RNA, 19 nt, artificial
  Oligomer
gaccguugcacaaaaagga

SEQ ID NO: 695 - RNA, 19 nt, artificial
  Oligomer
gaaagacuuguuuauauua

SEQ ID NO: 696 - RNA, 19 nt, artificial
  Oligomer
cccaccaggugguuuuuga

SEQ ID NO: 697 - RNA, 19 nt, artificial
  Oligomer
gauagaaagacuuguuuau

SEQ ID NO: 698 - RNA, 19 nt, artificial
  Oligomer
accaaugaagcacaaucaa

SEQ ID NO: 699 - RNA, 19 nt, artificial
  Oligomer
aaaggauggaggcaaaaua

SEQ ID NO: 700 - RNA, 19 nt, artificial
  Oligomer
cagcuuauuuauguaucaa

SEQ ID NO: 701 - RNA, 19 nt, artificial
  Oligomer
guggaagauggguggguua

SEQ ID NO: 702 - RNA, 19 nt, artificial
  Oligomer
ccucggaauccaaggugua

SEQ ID NO: 703 - RNA, 19 nt, artificial
  Oligomer
gaagggagaagcauuagga

SEQ ID NO: 704 - RNA, 19 nt, artificial
  Oligomer
gguuuuugacacucucuga

SEQ ID NO: 705 - RNA, 19 nt, artificial
  Oligomer
ccguugcacaaaaaggaaa

SEQ ID NO: 706 - RNA, 19 nt, artificial
  Oligomer
ucaggcugagggauuucua

SEQ ID NO: 707 - RNA, 19 nt, artificial
  Oligomer
aguguuaggaauuacaaaa

SEQ ID NO: 708 - RNA, 19 nt, artificial
  Oligomer
cgugugaugcaucuuuaga

SEQ ID NO: 709 - RNA, 19 nt, artificial
  Oligomer
guuacuugcacaaaaagaa

SEQ ID NO: 710 - RNA, 19 nt, artificial
  Oligomer
cugaaucauccgaggcaaa

SEQ ID NO: 711 - RNA, 19 nt, artificial
  Oligomer
accguugcacaaaaaggaa

SEQ ID NO: 712 - RNA, 19 nt, artificial
  Oligomer
uggaggcaaaauaaaaaaa

SEQ ID NO: 713 - RNA, 19 nt, artificial
  Oligomer
ggaaaguuugggaagggau

SEQ ID NO: 714 - RNA, 19 nt, artificial
  Oligomer
ccaugugcaauaaauacca

SEQ ID NO: 715 - RNA, 19 nt, artificial
  Oligomer
cagagagaggagaaugaca

SEQ ID NO: 716 - RNA, 19 nt, artificial
  Oligomer
cacguuucaagaaauguua

SEQ ID NO: 717 - RNA, 19 nt, artificial
  Oligomer
agauagaaagacuuguuua

SEQ ID NO: 718 - RNA, 19 nt, artificial
  Oligomer
aaauaccaaugaagcacaa

SEQ ID NO: 719 - RNA, 19 nt, artificial
  Oligomer
gagggauuucuaccucaca

SEQ ID NO: 720 - RNA, 19 nt, artificial
  Oligomer
auggaggcaaaauaaaaaa

SEQ ID NO: 721 - RNA, 19 nt, artificial
  Oligomer
acuguauccauauuauaaa

SEQ ID NO: 722 - RNA, 19 nt, artificial
  Oligomer
uugggaaaauaccuuuuua

SEQ ID NO: 723 - RNA, 19 nt, artificial
  Oligomer
ccuuuugcuuuccagagaa

SEQ ID NO: 724 - RNA, 19 nt, artificial
  Oligomer
guaucaauauuaguuggaa

SEQ ID NO: 725 - RNA, 19 nt, artificial
  Oligomer
cuguauccauauuauaaau

SEQ ID NO: 726 - RNA, 19 nt, artificial
  Oligomer
ggcugggcagaucuuaaau

SEQ ID NO: 727 - RNA, 19 nt, artificial
  Oligomer
caggcugagggauuucuac

SEQ ID NO: 728 - RNA, 19 nt, artificial
  Oligomer
caagaaauguuaagcucuu

SEQ ID NO: 729 - RNA, 19 nt, artificial
  Oligomer
ugcgugugaugcaucuuua

SEQ ID NO: 730 - RNA, 19 nt, artificial
  Oligomer
gugugaugcaucuuuagau

SEQ ID NO: 731 - RNA, 19 nt, artificial
  Oligomer
uugaagacaggacauuaaa

SEQ ID NO: 732 - RNA, 19 nt, artificial
  Oligomer
uuaugaaagcaaagagaaa

SEQ ID NO: 733 - RNA, 19 nt, artificial
  Oligomer
cuaguauguuauugagcua

SEQ ID NO: 734 - RNA, 19 nt, artificial
  Oligomer
uagaaagacuuguuuauau

SEQ ID NO: 735 - RNA, 19 nt, artificial
  Oligomer
acagcuuauuuauguauca

SEQ ID NO: 736 - RNA, 19 nt, artificial
  Oligomer
ugauuucugcuguuaugaa

SEQ ID NO: 737 - RNA, 19 nt, artificial
  Oligomer
gugcaauaaauaccaauga

SEQ ID NO: 738 - RNA, 19 nt, artificial
  Oligomer
gcagauagaaagacuuguu

SEQ ID NO: 739 - RNA, 19 nt, artificial
  Oligomer
caaaaaggaaaguuuggga

SEQ ID NO: 740 - RNA, 19 nt, artificial
  Oligomer
agaagcaggugaagaagau

SEQ ID NO: 741 - RNA, 19 nt, artificial
  Oligomer
guaacuguauccauauuau

SEQ ID NO: 742 - RNA, 19 nt, artificial
  Oligomer
aacuguauccauauuauaa

SEQ ID NO: 743 - RNA, 19 nt, artificial
  Oligomer
gaaucauccgaggcaaaga

SEQ ID NO: 744 - RNA, 19 nt, artificial
  Oligomer
gcgugugaugcaucuuuag

SEQ ID NO: 745 - RNA, 19 nt, artificial
  Oligomer
ucaugguacuguaacugua

SEQ ID NO: 746 - RNA, 19 nt, artificial
  Oligomer
guuuuaccaaguauuuaua

SEQ ID NO: 747 - RNA, 19 nt, artificial
  Oligomer
ggugaaaguuagcacuugu

SEQ ID NO: 748 - RNA, 19 nt, artificial
  Oligomer
auugaagacaggacauuaa

SEQ ID NO: 749 - RNA, 19 nt, artificial
  Oligomer
gacaggacauuaaaagaga

SEQ ID NO: 750 - RNA, 19 nt, artificial
  Oligomer
ugggaaaauaccuuuuuau

SEQ ID NO: 751 - RNA, 19 nt, artificial
  Oligomer
agcuaaugauucauuggga

SEQ ID NO: 752 - RNA, 19 nt, artificial
  Oligomer
ugcacagcagauagaaaga

SEQ ID NO: 753 - RNA, 19 nt, artificial
  Oligomer
agacgcugggcaucaucau

SEQ ID NO: 754 - RNA, 19 nt, artificial
  Oligomer
agaaagacuuguuuauauu

SEQ ID NO: 755 - RNA, 19 nt, artificial
  Oligomer
acguuucaagaaauguuaa

SEQ ID NO: 756 - RNA, 19 nt, artificial
  Oligomer
ugguccaugugcaauaaau

SEQ ID NO: 757 - RNA, 19 nt, artificial
  Oligomer
agagagcgagagagagaaa

SEQ ID NO: 758 - RNA, 19 nt, artificial
  Oligomer
cuacuucuguugucuagua

SEQ ID NO: 759 - RNA, 19 nt, artificial
  Oligomer
ggacauuaaaagagagcga

SEQ ID NO: 760 - RNA, 19 nt, artificial
  Oligomer
gaagauguuacuugcacaa

SEQ ID NO: 761 - RNA, 19 nt, artificial
  Oligomer
gcugggcagaucuuaaaua

SEQ ID NO: 762 - RNA, 19 nt, artificial
  Oligomer
caugguacuguaacuguau

SEQ ID NO: 763 - RNA, 19 nt, artificial
  Oligomer
ccauuuuugcacaguguua

SEQ ID NO: 764 - RNA, 19 nt, artificial
  Oligomer
cuuuaucaugguacuguaa

SEQ ID NO: 765 - RNA, 19 nt, artificial
  Oligomer
guguuuuaccaaguauuua

SEQ ID NO: 766 - RNA, 19 nt, artificial
  Oligomer
cgauagcaggugaacucga

SEQ ID NO: 767 - RNA, 19 nt, artificial
  Oligomer
gcagaucuuaaauaaaauu

SEQ ID NO: 768 - RNA, 19 nt, artificial
  Oligomer
gcgagagagagaaacaguu

SEQ ID NO: 769 - RNA, 19 nt, artificial
  Oligomer
ugugacucugucaauugaa

SEQ ID NO: 770 - RNA, 19 nt, artificial
  Oligomer
accuuuuuauacuccuuua

SEQ ID NO: 771 - RNA, 19 nt, artificial
  Oligomer
ucauccgaggcaaagagaa

SEQ ID NO: 772 - RNA, 19 nt, artificial
  Oligomer
agaaaggauggaggcaaaa

SEQ ID NO: 773 - RNA, 19 nt, artificial
  Oligomer
gagagaggagaaugacagu

SEQ ID NO: 774 - RNA, 19 nt, artificial
  Oligomer
uacuguaacuguauccaua

SEQ ID NO: 775 - RNA, 19 nt, artificial
  Oligomer
aaaaaaaaaucacguuuca

SEQ ID NO: 776 - RNA, 19 nt, artificial
  Oligomer
cgccucuucgucuucuuca

SEQ ID NO: 777 - RNA, 19 nt, artificial
  Oligomer
gcacaaaaaggaaaguuug

SEQ ID NO: 778 - RNA, 19 nt, artificial
  Oligomer
aguucagauuacugcacau

SEQ ID NO: 779 - RNA, 19 nt, artificial
  Oligomer
cgcucaccaaccucuucau

SEQ ID NO: 780 - RNA, 19 nt, artificial
  Oligomer
cccacaauccucgucugaa

SEQ ID NO: 781 - RNA, 19 nt, artificial
  Oligomer
uuacuugcacaaaaagaaa

SEQ ID NO: 782 - RNA, 19 nt, artificial
  Oligomer
cguugcacaaaaaggaaag

SEQ ID NO: 783 - RNA, 19 nt, artificial
  Oligomer
aagacaggacauuaaaaga

SEQ ID NO: 784 - RNA, 19 nt, artificial
  Oligomer
aggaaaguuugggaaggga

SEQ ID NO: 785 - RNA, 19 nt, artificial
  Oligomer
guuaugaaagcaaagagaa

SEQ ID NO: 786 - RNA, 19 nt, artificial
  Oligomer
cagauagaaagacuuguuu

SEQ ID NO: 787 - RNA, 19 nt, artificial
  Oligomer
uaacuguauccauauuaua

SEQ ID NO: 788 - RNA, 19 nt, artificial
  Oligomer
agagcgagagagagaaaca

SEQ ID NO: 789 - RNA, 19 nt, artificial
  Oligomer
gaaaauaccuuuuuauacu

SEQ ID NO: 790 - RNA, 19 nt, artificial
  Oligomer
cauuugcacagcagauaga

SEQ ID NO: 791 - RNA, 19 nt, artificial
  Oligomer
gaugcaucuuuagauuuuu

SEQ ID NO: 792 - RNA, 19 nt, artificial
  Oligomer
ccaggugguuuuugacacu

SEQ ID NO: 793 - RNA, 19 nt, artificial
  Oligomer
caguuugucaagacauauu

SEQ ID NO: 794 - RNA, 19 nt, artificial
  Oligomer
gacuuguuuauauuaaaca

SEQ ID NO: 795 - RNA, 19 nt, artificial
  Oligomer
uaaacagcuuauuuaugua

SEQ ID NO: 796 - RNA, 19 nt, artificial
  Oligomer
gagagagagaaacaguuca

SEQ ID NO: 797 - RNA, 19 nt, artificial
  Oligomer
ccuuuuuauacuccuuuau

SEQ ID NO: 798 - RNA, 19 nt, artificial
  Oligomer
augugacucugucaauuga

SEQ ID NO: 799 - RNA, 19 nt, artificial
  Oligomer
guguuaggaauuacaaaau

SEQ ID NO: 800 - RNA, 19 nt, artificial
  Oligomer
agaagauguuacuugcaca

SEQ ID NO: 801 - RNA, 19 nt, artificial
  Oligomer
caauccucgucugaaucau

SEQ ID NO: 802 - RNA, 19 nt, artificial
  Oligomer
cagaagcaggugaagaaga

SEQ ID NO: 803 - RNA, 19 nt, artificial
  Oligomer
ucaccaaccucuucaucau

SEQ ID NO: 804 - RNA, 19 nt, artificial
  Oligomer
cggaccguugcacaaaaag

SEQ ID NO: 805 - RNA, 19 nt, artificial
  Oligomer
agauuacugcacaugugga

SEQ ID NO: 806 - RNA, 19 nt, artificial
  Oligomer
uguuuuaccaaguauuuau

SEQ ID NO: 807 - RNA, 19 nt, artificial
  Oligomer
cuuuugcuuuccagagaaa

SEQ ID NO: 808 - RNA, 19 nt, artificial
  Oligomer
uuugcacagcagauagaaa

SEQ ID NO: 809 - RNA, 19 nt, artificial
  Oligomer
gagagagaaacaguucaga

SEQ ID NO: 810 - RNA, 19 nt, artificial
  Oligomer
gauuaaaaucgaucaucgu

SEQ ID NO: 811 - RNA, 19 nt, artificial
  Oligomer
gaaugacaguuugucaaga

SEQ ID NO: 812 - RNA, 19 nt, artificial
  Oligomer
uguuaagcucuucuuggaa

SEQ ID NO: 813 - RNA, 19 nt, artificial
  Oligomer
gauuacugcacauguggau

SEQ ID NO: 814 - RNA, 19 nt, artificial
  Oligomer
ugacaugugacucugucaa

SEQ ID NO: 815 - RNA, 19 nt, artificial
  Oligomer
agagaaacaguucagauua

SEQ ID NO: 816 - RNA, 19 nt, artificial
  Oligomer
agcaggugaagaagaucga

SEQ ID NO: 817 - RNA, 19 nt, artificial
  Oligomer
ccaccaggugguuuuugac

SEQ ID NO: 818 - RNA, 19 nt, artificial
  Oligomer
aauaaauaccaaugaagca

SEQ ID NO: 819 - RNA, 19 nt, artificial
  Oligomer
ucugaaucauccgaggcaa

SEQ ID NO: 820 - RNA, 19 nt, artificial
  Oligomer
gugacaugugacucuguca

SEQ ID NO: 821 - RNA, 19 nt, artificial
  Oligomer
aaaaaaucacguuucaaga

SEQ ID NO: 822 - RNA, 19 nt, artificial
  Oligomer
auagaaagacuuguuuaua

SEQ ID NO: 823 - RNA, 19 nt, artificial
  Oligomer
auguuaagcucuucuugga

SEQ ID NO: 824 - RNA, 19 nt, artificial
  Oligomer
ugcacaguguuaggaauua

SEQ ID NO: 825 - RNA, 19 nt, artificial
  Oligomer
aggaauugguccaugugca

SEQ ID NO: 826 - RNA, 19 nt, artificial
  Oligomer
uaccaaugaagcacaauca

SEQ ID NO: 827 - RNA, 19 nt, artificial
  Oligomer
ggugguuuuugacacucuc

SEQ ID NO: 828 - RNA, 19 nt, artificial
  Oligomer
aggaauuacaaaauccaca

SEQ ID NO: 829 - RNA, 19 nt, artificial
  Oligomer
agcuuauuuauguaucaau

SEQ ID NO: 830 - RNA, 19 nt, artificial
  Oligomer
aguauguuauugagcuaau

SEQ ID NO: 831 - RNA, 19 nt, artificial
  Oligomer
gacaugugacucugucaau

SEQ ID NO: 832 - RNA, 19 nt, artificial
  Oligomer
ucuguugucuaguauguua

SEQ ID NO: 833 - RNA, 19 nt, artificial
  Oligomer
caguucagauuacugcaca

SEQ ID NO: 834 - RNA, 19 nt, artificial
  Oligomer
aaaucacguuucaagaaau

SEQ ID NO: 835 - RNA, 19 nt, artificial
  Oligomer
cuaaugauucauugggaaa

SEQ ID NO: 836 - RNA, 19 nt, artificial
  Oligomer
aaugauucauugggaaaau

SEQ ID NO: 837 - RNA, 19 nt, artificial
  Oligomer
uguuaugaaagcaaagaga

SEQ ID NO: 838 - RNA, 19 nt, artificial
  Oligomer
aaaaaaaaucacguuucaa

SEQ ID NO: 839 - RNA, 19 nt, artificial
  Oligomer
gagagaaacaguucagauu

SEQ ID NO: 840 - RNA, 19 nt, artificial
  Oligomer
gugaacucgaagcccacaa

SEQ ID NO: 841 - RNA, 19 nt, artificial
  Oligomer
cuguaacuguauccauauu

SEQ ID NO: 842 - RNA, 19 nt, artificial
  Oligomer
ugaauuugcuggugaaagu

SEQ ID NO: 843 - RNA, 19 nt, artificial
  Oligomer
gugcauuugcacagcagau

SEQ ID NO: 844 - RNA, 19 nt, artificial
  Oligomer
ugugaugcaucuuuagauu

SEQ ID NO: 845 - RNA, 19 nt, artificial
  Oligomer
aauugaagacaggacauua

SEQ ID NO: 846 - RNA, 19 nt, artificial
  Oligomer
guguuuacuuaagaccgau

SEQ ID NO: 847 - RNA, 19 nt, artificial
  Oligomer
aagagagcgagagagagaa

SEQ ID NO: 848 - RNA, 19 nt, artificial
  Oligomer
cucucucugugacauguga

SEQ ID NO: 849 - RNA, 19 nt, artificial
  Oligomer
uggucaggcugagggauuu

SEQ ID NO: 850 - RNA, 19 nt, artificial
  Oligomer
aaaaaggaaaguuugggaa

SEQ ID NO: 851 - RNA, 19 nt, artificial
  Oligomer
gcaaugugcuggugaucgu

SEQ ID NO: 852 - RNA, 19 nt, artificial
  Oligomer
auugguccaugugcaauaa

SEQ ID NO: 853 - RNA, 19 nt, artificial
  Oligomer
gaggagaaugacaguuugu

SEQ ID NO: 854 - RNA, 19 nt, artificial
  Oligomer
caccaggugguuuuugaca

SEQ ID NO: 855 - RNA, 19 nt, artificial
  Oligomer
ugcacaaaaaggaaaguuu

SEQ ID NO: 856 - RNA, 19 nt, artificial
  Oligomer
cuuuccagagaaauuucau

SEQ ID NO: 857 - RNA, 19 nt, artificial
  Oligomer
gcaucaucaugggcgucuu

SEQ ID NO: 858 - RNA, 19 nt, artificial
  Oligomer
uuaggaauuacaaaaucca

SEQ ID NO: 859 - RNA, 19 nt, artificial
  Oligomer
aagaccgauagcaggugaa

SEQ ID NO: 860 - RNA, 19 nt, artificial
  Oligomer
auguuauugagcuaaugau

SEQ ID NO: 861 - RNA, 19 nt, artificial
  Oligomer
uguugucuaguauguuauu

SEQ ID NO: 862 - RNA, 19 nt, artificial
  Oligomer
ggaaaauaccuuuuuauac

SEQ ID NO: 863 - RNA, 19 nt, artificial
  Oligomer
aacaguucagauuacugca

SEQ ID NO: 864 - RNA, 19 nt, artificial
  Oligomer
ggauuaaaaucgaucaucg

SEQ ID NO: 865 - RNA, 19 nt, artificial
  Oligomer
aagggagaagcauuaggag

SEQ ID NO: 866 - RNA, 19 nt, artificial
  Oligomer
auccgaggcaaagagaaaa

SEQ ID NO: 867 - RNA, 19 nt, artificial
  Oligomer
gaaaggauggaggcaaaau

SEQ ID NO: 868 - RNA, 19 nt, artificial
  Oligomer
agagagaaacaguucagau

SEQ ID NO: 869 - RNA, 19 nt, artificial
  Oligomer
gcaauaaauaccaaugaag

SEQ ID NO: 870 - RNA, 19 nt, artificial
  Oligomer
gaaagcaaagagaaaggau

SEQ ID NO: 871 - RNA, 19 nt, artificial
  Oligomer
acauuaaaagagagcgaga

SEQ ID NO: 872 - RNA, 19 nt, artificial
  Oligomer
uugcacaaaaagaaauuaa

SEQ ID NO: 873 - RNA, 19 nt, artificial
  Oligomer
cacagcagauagaaagacu

SEQ ID NO: 874 - RNA, 19 nt, artificial
  Oligomer
cugagggauuucuaccuca

SEQ ID NO: 875 - RNA, 19 nt, artificial
  Oligomer
ccucgucugaaucauccga

SEQ ID NO: 876 - RNA, 19 nt, artificial
  Oligomer
gugcccacgugaauuugcu

SEQ ID NO: 877 - RNA, 19 nt, artificial
  Oligomer
agaggagaaugacaguuug

SEQ ID NO: 878 - RNA, 19 nt, artificial
  Oligomer
agagaaaggauggaggcaa

SEQ ID NO: 879 - RNA, 19 nt, artificial
  Oligomer
aaaaaucacguuucaagaa

SEQ ID NO: 880 - RNA, 19 nt, artificial
  Oligomer
cuguugucuaguauguuau

SEQ ID NO: 881 - RNA, 19 nt, artificial
  Oligomer
ugugguccggccuucuuuu

SEQ ID NO: 882 - RNA, 19 nt, artificial
  Oligomer
aauauuuuuuaaagggaga

SEQ ID NO: 883 - RNA, 19 nt, artificial
  Oligomer
agagccucucucugugaca

SEQ ID NO: 884 - RNA, 19 nt, artificial
  Oligomer
gcuugcugauguuccuugu

SEQ ID NO: 885 - RNA, 19 nt, artificial
  Oligomer
acuguaacuguauccauau

SEQ ID NO: 886 - RNA, 19 nt, artificial
  Oligomer
gaguacggcuccuucuucu

SEQ ID NO: 887 - RNA, 19 nt, artificial
  Oligomer
uuacaaaauccacagaaga

SEQ ID NO: 888 - RNA, 19 nt, artificial
  Oligomer
acagcagauagaaagacuu

SEQ ID NO: 889 - RNA, 19 nt, artificial
  Oligomer
ucaagacgcugggcaucau

SEQ ID NO: 890 - RNA, 19 nt, artificial
  Oligomer
gcuuuccagagaaauuuca

SEQ ID NO: 891 - RNA, 19 nt, artificial
  Oligomer
ugugcauuugcacagcaga

SEQ ID NO: 892 - RNA, 19 nt, artificial
  Oligomer
uguuauugagcuaaugauu

SEQ ID NO: 893 - RNA, 19 nt, artificial
  Oligomer
uguuacuugcacaaaaaga

SEQ ID NO: 894 - RNA, 19 nt, artificial
  Oligomer
gcuguuaugaaagcaaaga

SEQ ID NO: 895 - RNA, 19 nt, artificial
  Oligomer
uuauugagcuaaugauuca

SEQ ID NO: 896 - RNA, 19 nt, artificial
  Oligomer
uaaugauucauugggaaaa

SEQ ID NO: 897 - RNA, 19 nt, artificial
  Oligomer
acuccuuuaucaugguacu

SEQ ID NO: 898 - RNA, 19 nt, artificial
  Oligomer
acucuacuucuguugucua

SEQ ID NO: 899 - RNA, 19 nt, artificial
  Oligomer
aguggaagauggguggguu

SEQ ID NO: 900 - RNA, 19 nt, artificial
  Oligomer
agacauauuuccuuuugcu

SEQ ID NO: 901 - RNA, 19 nt, artificial
  Oligomer
auauuaguuggaaggacca

SEQ ID NO: 902 - RNA, 19 nt, artificial
  Oligomer
gagccucucucugugacau

SEQ ID NO: 903 - RNA, 19 nt, artificial
  Oligomer
ugaacucgaagcccacaau

SEQ ID NO: 904 - RNA, 19 nt, artificial
  Oligomer
gagaaacaguucagauuac

SEQ ID NO: 905 - RNA, 19 nt, artificial
  Oligomer
augauucauugggaaaaua

SEQ ID NO: 906 - RNA, 19 nt, artificial
  Oligomer
cucacacugugcauuugca

SEQ ID NO: 907 - RNA, 19 nt, artificial
  Oligomer
uaaugauuucugcuguuau

SEQ ID NO: 908 - RNA, 19 nt, artificial
  Oligomer
gcacaguguuaggaauuac

SEQ ID NO: 909 - RNA, 19 nt, artificial
  Oligomer
uguuuauauuaaacagcuu

SEQ ID NO: 910 - RNA, 19 nt, artificial
  Oligomer
guuuauauuaaacagcuua

SEQ ID NO: 911 - RNA, 19 nt, artificial
  Oligomer
ccaccuugcuuuccuugug

SEQ ID NO: 912 - RNA, 19 nt, artificial
  Oligomer
agacuuguuuauauuaaac

SEQ ID NO: 913 - RNA, 19 nt, artificial
  Oligomer
cacaaaaaggaaaguuugg

SEQ ID NO: 914 - RNA, 19 nt, artificial
  Oligomer
uuuuuauacuccuuuauca

SEQ ID NO: 915 - RNA, 19 nt, artificial
  Oligomer
ugucuaguauguuauugag

SEQ ID NO: 916 - RNA, 19 nt, artificial
  Oligomer
caauauuaguuggaaggac

SEQ ID NO: 917 - RNA, 19 nt, artificial
  Oligomer
gauucauugggaaaauacc

SEQ ID NO: 918 - RNA, 19 nt, artificial
  Oligomer
aauugguccaugugcaaua

SEQ ID NO: 919 - RNA, 19 nt, artificial
  Oligomer
caggugaagaagaucgaca

SEQ ID NO: 920 - RNA, 19 nt, artificial
  Oligomer
guacuguaacuguauccau

SEQ ID NO: 921 - RNA, 19 nt, artificial
  Oligomer
gcuggugaaaguuagcacu

SEQ ID NO: 922 - RNA, 19 nt, artificial
  Oligomer
acaguuugucaagacauau

SEQ ID NO: 923 - RNA, 19 nt, artificial
  Oligomer
ucugcuguuaugaaagcaa

SEQ ID NO: 924 - RNA, 19 nt, artificial
  Oligomer
cuugcacaaaaagaaauua

SEQ ID NO: 925 - RNA, 19 nt, artificial
  Oligomer
gaaaguuugggaagggaug

SEQ ID NO: 926 - RNA, 19 nt, artificial
  Oligomer
auuugcacagcagauagaa

SEQ ID NO: 927 - RNA, 19 nt, artificial
  Oligomer
caaguauuuauacucuggu

SEQ ID NO: 928 - RNA, 19 nt, artificial
  Oligomer
accgccucuucgucuucuu

SEQ ID NO: 929 - RNA, 19 nt, artificial
  Oligomer
aaugauuucugcuguuaug

SEQ ID NO: 930 - RNA, 19 nt, artificial
  Oligomer
ggcugagggauuucuaccu

SEQ ID NO: 931 - RNA, 19 nt, artificial
  Oligomer
ggaccguugcacaaaaagg

SEQ ID NO: 932 - RNA, 19 nt, artificial
  Oligomer
aaaaucacguuucaagaaa

SEQ ID NO: 933 - RNA, 19 nt, artificial
  Oligomer
gucaauugaagacaggaca

SEQ ID NO: 934 - RNA, 19 nt, artificial
  Oligomer
ggcaaaauaaaaaaaaauc

SEQ ID NO: 935 - RNA, 19 nt, artificial
  Oligomer
augugcaauaaauaccaau

SEQ ID NO: 936 - RNA, 19 nt, artificial
  Oligomer
cugucaauugaagacagga

SEQ ID NO: 937 - RNA, 19 nt, artificial
  Oligomer
uguuuacuuaagaccgaua

SEQ ID NO: 938 - RNA, 19 nt, artificial
  Oligomer
gaaauguuaagcucuucuu

SEQ ID NO: 939 - RNA, 19 nt, artificial
  Oligomer
uuuugcacaguguuaggaa

SEQ ID NO: 940 - RNA, 19 nt, artificial
  Oligomer
aagacgcugggcaucauca

SEQ ID NO: 941 - RNA, 19 nt, artificial
  Oligomer
uuugcacaguguuaggaau

SEQ ID NO: 942 - RNA, 19 nt, artificial
  Oligomer
ugcuguuaugaaagcaaag

SEQ ID NO: 943 - RNA, 19 nt, artificial
  Oligomer
ggugcaacuaacuacugug

SEQ ID NO: 944 - RNA, 19 nt, artificial
  Oligomer
cauugggaaaauaccuuuu

SEQ ID NO: 945 - RNA, 19 nt, artificial
  Oligomer
ucagauuacugcacaugug

SEQ ID NO: 946 - RNA, 19 nt, artificial
  Oligomer
gggauuucuaccucacacu

SEQ ID NO: 947 - RNA, 19 nt, artificial
  Oligomer
uugucuaguauguuauuga

SEQ ID NO: 948 - RNA, 19 nt, artificial
  Oligomer
aaagagagcgagagagaga

SEQ ID NO: 949 - RNA, 19 nt, artificial
  Oligomer
gugacucugucaauugaag

SEQ ID NO: 950 - RNA, 19 nt, artificial
  Oligomer
aggugguuuuugacacucu

SEQ ID NO: 951 - RNA, 19 nt, artificial
  Oligomer
aggugaagaagaucgacag

SEQ ID NO: 952 - RNA, 19 nt, artificial
  Oligomer
uuaucaugguacuguaacu

SEQ ID NO: 953 - RNA, 19 nt, artificial
  Oligomer
uauacucuggugcaacuaa

SEQ ID NO: 954 - RNA, 19 nt, artificial
  Oligomer
aguuugucaagacauauuu

SEQ ID NO: 955 - RNA, 19 nt, artificial
  Oligomer
uugguccaugugcaauaaa

SEQ ID NO: 956 - RNA, 19 nt, artificial
  Oligomer
gagcgagagagagaaacag

SEQ ID NO: 957 - RNA, 19 nt, artificial
  Oligomer
cguuucaagaaauguuaag

SEQ ID NO: 958 - RNA, 19 nt, artificial
  Oligomer
cacgugaauuugcugguga

SEQ ID NO: 959 - RNA, 19 nt, artificial
  Oligomer
acucgaagcccacaauccu

SEQ ID NO: 960 - RNA, 19 nt, artificial
  Oligomer
ugaugcaucuuuagauuuu

SEQ ID NO: 961 - RNA, 19 nt, artificial
  Oligomer
gugaggaauugguccaugu

SEQ ID NO: 962 - RNA, 19 nt, artificial
  Oligomer
uacaaaauccacagaagau

SEQ ID NO: 963 - RNA, 19 nt, artificial
  Oligomer
ugacucugucaauugaaga

SEQ ID NO: 964 - RNA, 19 nt, artificial
  Oligomer
cuucuguugucuaguaugu

SEQ ID NO: 965 - RNA, 19 nt, artificial
  Oligomer
ccguagucuccuucuacgu

SEQ ID NO: 966 - RNA, 19 nt, artificial
  Oligomer
agacgcucaccaaccucuu

SEQ ID NO: 967 - RNA, 19 nt, artificial
  Oligomer
gugugcgugugaugcaucu

SEQ ID NO: 968 - RNA, 19 nt, artificial
  Oligomer
augacaguuugucaagaca

SEQ ID NO: 969 - RNA, 19 nt, artificial
  Oligomer
gaagacaggacauuaaaag

SEQ ID NO: 970 - RNA, 19 nt, artificial
  Oligomer
agcagauagaaagacuugu

SEQ ID NO: 971 - RNA, 19 nt, artificial
  Oligomer
gaauuacaaaauccacaga

SEQ ID NO: 972 - RNA, 19 nt, artificial
  Oligomer
cagcagauagaaagacuug

SEQ ID NO: 973 - RNA, 19 nt, artificial
  Oligomer
ccagaagcaggugaagaag

SEQ ID NO: 974 - RNA, 19 nt, artificial
  Oligomer
gggaagggagaagcauuag

SEQ ID NO: 975 - RNA, 19 nt, artificial
  Oligomer
gucugaaucauccgaggca

SEQ ID NO: 976 - RNA, 19 nt, artificial
  Oligomer
ucaucgugcugcucaucgu

SEQ ID NO: 977 - RNA, 19 nt, artificial
  Oligomer
aguaaugauuucugcuguu

SEQ ID NO: 978 - RNA, 19 nt, artificial
  Oligomer
caaaauccacagaagaugu

SEQ ID NO: 979 - RNA, 19 nt, artificial
  Oligomer
agaagaucgacagcugcga

SEQ ID NO: 980 - RNA, 19 nt, artificial
  Oligomer
agcgagagagagaaacagu

SEQ ID NO: 981 - RNA, 19 nt, artificial
  Oligomer
augcaucuuuagauuuuuu

SEQ ID NO: 982 - RNA, 19 nt, artificial
  Oligomer
acucuggugcaacuaacua

SEQ ID NO: 983 - RNA, 19 nt, artificial
  Oligomer
ggaauuacaaaauccacag

SEQ ID NO: 984 - RNA, 19 nt, artificial
  Oligomer
uuugggaagggaugggaga

SEQ ID NO: 985 - RNA, 19 nt, artificial
  Oligomer
uggugcaacuaacuacugu

SEQ ID NO: 986 - RNA, 19 nt, artificial
  Oligomer
gguacuguaacuguaucca

SEQ ID NO: 987 - RNA, 19 nt, artificial
  Oligomer
cucuacuucuguugucuag

SEQ ID NO: 988 - RNA, 19 nt, artificial
  Oligomer
gcauuugcacagcagauag

SEQ ID NO: 989 - RNA, 19 nt, artificial
  Oligomer
cuguuaugaaagcaaagag

SEQ ID NO: 990 - RNA, 19 nt, artificial
  Oligomer
ucacguuucaagaaauguu

SEQ ID NO: 991 - RNA, 19 nt, artificial
  Oligomer
gagaggagaaugacaguuu

SEQ ID NO: 992 - RNA, 19 nt, artificial
  Oligomer
guugcacaaaaaggaaagu

SEQ ID NO: 993 - RNA, 19 nt, artificial
  Oligomer
gugcgugugaugcaucuuu

SEQ ID NO: 994 - RNA, 19 nt, artificial
  Oligomer
guauuuauacucuggugca

SEQ ID NO: 995 - RNA, 19 nt, artificial
  Oligomer
ccaaguauuuauacucugg

SEQ ID NO: 996 - RNA, 19 nt, artificial
  Oligomer
uuuuauacuccuuuaucau

SEQ ID NO: 997 - RNA, 19 nt, artificial
  Oligomer
aauucaaacucuacuucug

SEQ ID NO: 998 - RNA, 19 nt, artificial
  Oligomer
uauuuauacucuggugcaa

SEQ ID NO: 999 - RNA, 19 nt, artificial
  Oligomer
acuuguuuauauuaaacag

SEQ ID NO: 1000 - RNA, 19 nt, artificial
  Oligomer
caauaaauaccaaugaagc

SEQ ID NO: 1001 - RNA, 19 nt, artificial
  Oligomer
ccaagugcccacgugaauu

SEQ ID NO: 1002 - RNA, 19 nt, artificial
  Oligomer
acaugugacucugucaauu

SEQ ID NO: 1003 - RNA, 19 nt, artificial
  Oligomer
ccagagagaggagaaugac

SEQ ID NO: 1004 - RNA, 19 nt, artificial
  Oligomer
cugugacaugugacucugu

SEQ ID NO: 1005 - RNA, 19 nt, artificial
  Oligomer
uaaaagagagcgagagaga

SEQ ID NO: 1006 - RNA, 19 nt, artificial
  Oligomer
ucuggugcaacuaacuacu

SEQ ID NO: 1007 - RNA, 19 nt, artificial
  Oligomer
gccucucucugugacaugu

SEQ ID NO: 1008 - RNA, 19 nt, artificial
  Oligomer
gaccgauagcaggugaacu

SEQ ID NO: 1009 - RNA, 19 nt, artificial
  Oligomer
agcucuucuuggaacaagc

SEQ ID NO: 1010 - RNA, 19 nt, artificial
  Oligomer
gaauuugcuggugaaaguu

SEQ ID NO: 1011 - RNA, 19 nt, artificial
  Oligomer
gcaggugaagaagaucgac

SEQ ID NO: 1012 - RNA, 19 nt, artificial
  Oligomer
ugacaguuugucaagacau

SEQ ID NO: 1013 - RNA, 19 nt, artificial
  Oligomer
gcaucuuuagauuuuuuuc

SEQ ID NO: 1014 - RNA, 19 nt, artificial
  Oligomer
acaggacauuaaaagagag

SEQ ID NO: 1015 - RNA, 19 nt, artificial
  Oligomer
uaagcucuucuuggaacaa

SEQ ID NO: 1016 - RNA, 19 nt, artificial
  Oligomer
ggaagggagaagcauuagg

SEQ ID NO: 1017 - RNA, 19 nt, artificial
  Oligomer
ugucaagacauauuuccuu

SEQ ID NO: 1018 - RNA, 19 nt, artificial
  Oligomer
aauuacaaaauccacagaa

SEQ ID NO: 1019 - RNA, 19 nt, artificial
  Oligomer
guauguuauugagcuaaug

SEQ ID NO: 1020 - RNA, 19 nt, artificial
  Oligomer
gugguuuuugacacucucu

SEQ ID NO: 1021 - RNA, 19 nt, artificial
  Oligomer
aguuugggaagggauggga

SEQ ID NO: 1022 - RNA, 19 nt, artificial
  Oligomer
cucuucgucuucuucaacu

SEQ ID NO: 1023 - RNA, 19 nt, artificial
  Oligomer
cuggugaaaguuagcacuu

SEQ ID NO: 1024 - RNA, 19 nt, artificial
  Oligomer
auucauugggaaaauaccu

SEQ ID NO: 1025 - RNA, 19 nt, artificial
  Oligomer
acagaagauguuacuugca

SEQ ID NO: 1026 - RNA, 19 nt, artificial
  Oligomer
uaggaauuacaaaauccac

SEQ ID NO: 1027 - RNA, 19 nt, artificial
  Oligomer
caagugcccacgugaauuu

SEQ ID NO: 1028 - RNA, 19 nt, artificial
  Oligomer
gacauauuuccuuuugcuu

SEQ ID NO: 1029 - RNA, 19 nt, artificial
  Oligomer
gucaagacauauuuccuuu

SEQ ID NO: 1030 - RNA, 19 nt, artificial
  Oligomer
cuaaguaaugauuucugcu

SEQ ID NO: 1031 - RNA, 19 nt, artificial
  Oligomer
ucaauugaagacaggacau

SEQ ID NO: 1032 - RNA, 19 nt, artificial
  Oligomer
auuugcuggugaaaguuag

SEQ ID NO: 1033 - RNA, 19 nt, artificial
  Oligomer
uacuucuguugucuaguau

SEQ ID NO: 1034 - RNA, 19 nt, artificial
  Oligomer
cacacugugcauuugcaca

SEQ ID NO: 1035 - RNA, 19 nt, artificial
  Oligomer
cgaggcaaagagaaaagcc

SEQ ID NO: 1036 - RNA, 19 nt, artificial
  Oligomer
accucuucaucaugucccu

SEQ ID NO: 1037 - RNA, 19 nt, artificial
  Oligomer
uauguuauugagcuaauga

SEQ ID NO: 1038 - RNA, 19 nt, artificial
  Oligomer
uauugagcuaaugauucau

SEQ ID NO: 1039 - RNA, 19 nt, artificial
  Oligomer
auuaaaagagagcgagaga

SEQ ID NO: 1040 - RNA, 19 nt, artificial
  Oligomer
caauugaagacaggacauu

SEQ ID NO: 1041 - RNA, 19 nt, artificial
  Oligomer
uguaacuguauccauauua

SEQ ID NO: 1042 - RNA, 19 nt, artificial
  Oligomer
cgagagagagaaacaguuc

SEQ ID NO: 1043 - RNA, 19 nt, artificial
  Oligomer
acuugcacaaaaagaaauu

SEQ ID NO: 1044 - RNA, 19 nt, artificial
  Oligomer
cagauuacugcacaugugg

SEQ ID NO: 1045 - RNA, 19 nt, artificial
  Oligomer
aagugcugcgacuucguca

SEQ ID NO: 1046 - RNA, 19 nt, artificial
  Oligomer
aagauguuacuugcacaaa

SEQ ID NO: 1047 - RNA, 19 nt, artificial
  Oligomer
uugugguccggccuucuuu

SEQ ID NO: 1048 - RNA, 19 nt, artificial
  Oligomer
agggauuucuaccucacac

SEQ ID NO: 1049 - RNA, 19 nt, artificial
  Oligomer
guccaugugcaauaaauac

SEQ ID NO: 1050 - RNA, 19 nt, artificial
  Oligomer
uaaaauucaaacucuacuu

SEQ ID NO: 1051 - RNA, 19 nt, artificial
  Oligomer
aauuugcuggugaaaguua

SEQ ID NO: 1052 - RNA, 19 nt, artificial
  Oligomer
acaauccucgucugaauca

SEQ ID NO: 1053 - RNA, 19 nt, artificial
  Oligomer
uccaagugcccacgugaau

SEQ ID NO: 1054 - RNA, 19 nt, artificial
  Oligomer
uacucuggugcaacuaacu

SEQ ID NO: 1055 - RNA, 19 nt, artificial
  Oligomer
uccuuuugcuuuccagaga

SEQ ID NO: 1056 - RNA, 19 nt, artificial
  Oligomer
cccaccuugcuuuccuugu

SEQ ID NO: 1057 - RNA, 19 nt, artificial
  Oligomer
cucugucaauugaagacag

SEQ ID NO: 1058 - RNA, 19 nt, artificial
  Oligomer
uaguauguuauugagcuaa

SEQ ID NO: 1059 - RNA, 19 nt, artificial
  Oligomer
caaacucuacuucuguugu

SEQ ID NO: 1060 - RNA, 19 nt, artificial
  Oligomer
auucaaacucuacuucugu

SEQ ID NO: 1061 - RNA, 19 nt, artificial
  Oligomer
aaauauuuuuuaaagggag

SEQ ID NO: 1062 - RNA, 19 nt, artificial
  Oligomer
ccucuucgucuucuucaac

SEQ ID NO: 1063 - RNA, 19 nt, artificial
  Oligomer
guaaugauuucugcuguua

SEQ ID NO: 1064 - RNA, 19 nt, artificial
  Oligomer
ucaucaugggcgucuucac

SEQ ID NO: 1065 - RNA, 19 nt, artificial
  Oligomer
agcaaagagaaaggaugga

SEQ ID NO: 1066 - RNA, 19 nt, artificial
  Oligomer
gaaacaguucagauuacug

SEQ ID NO: 1067 - RNA, 19 nt, artificial
  Oligomer
cucggaauccaagguguag

SEQ ID NO: 1068 - RNA, 19 nt, artificial
  Oligomer
uaagaccgauagcagguga

SEQ ID NO: 1069 - RNA, 19 nt, artificial
  Oligomer
ugcauuugcacagcagaua

SEQ ID NO: 1070 - RNA, 19 nt, artificial
  Oligomer
uaucaauauuaguuggaag

SEQ ID NO: 1071 - RNA, 19 nt, artificial
  Oligomer
uuaagcucuucuuggaaca

SEQ ID NO: 1072 - RNA, 19 nt, artificial
  Oligomer
uugucaagacauauuuccu

SEQ ID NO: 1073 - RNA, 19 nt, artificial
  Oligomer
agaaacaguucagauuacu

SEQ ID NO: 1074 - RNA, 19 nt, artificial
  Oligomer
aucauccgaggcaaagaga

SEQ ID NO: 1075 - RNA, 19 nt, artificial
  Oligomer
cacagaagauguuacuugc

SEQ ID NO: 1076 - RNA, 19 nt, artificial
  Oligomer
aagagaaaggauggaggca

SEQ ID NO: 1077 - RNA, 19 nt, artificial
  Oligomer
aaauccacagaagauguua

SEQ ID NO: 1078 - RNA, 19 nt, artificial
  Oligomer
ugaaagcaaagagaaagga

SEQ ID NO: 1079 - RNA, 19 nt, artificial
  Oligomer
guuugucaagacauauuuc

SEQ ID NO: 1080 - RNA, 19 nt, artificial
  Oligomer
guccguagucuccuucuac

SEQ ID NO: 1081 - RNA, 19 nt, artificial
  Oligomer
uaaauaccaaugaagcaca

SEQ ID NO: 1082 - RNA, 19 nt, artificial
  Oligomer
aaauucaaacucuacuucu

SEQ ID NO: 1083 - RNA, 19 nt, artificial
  Oligomer
uuuccuuuugcuuuccaga

SEQ ID NO: 1084 - RNA, 19 nt, artificial
  Oligomer
aaguaaugauuucugcugu

SEQ ID NO: 1085 - RNA, 19 nt, artificial
  Oligomer
augauuucugcuguuauga

SEQ ID NO: 1086 - RNA, 19 nt, artificial
  Oligomer
ugaagaagaucgacagcug

SEQ ID NO: 1087 - RNA, 19 nt, artificial
  Oligomer
uaccaaguauuuauacucu

SEQ ID NO: 1088 - RNA, 19 nt, artificial
  Oligomer
guaaauucuacuuccucuu

SEQ ID NO: 1089 - RNA, 19 nt, artificial
  Oligomer
ucaauauuaguuggaagga

SEQ ID NO: 1090 - RNA, 19 nt, artificial
  Oligomer
cucucugugacaugugacu

SEQ ID NO: 1091 - RNA, 19 nt, artificial
  Oligomer
aaguauuuauacucuggug

SEQ ID NO: 1092 - RNA, 19 nt, artificial
  Oligomer
uguaaauucuacuuccucu

SEQ ID NO: 1093 - RNA, 19 nt, artificial
  Oligomer
cauuuuugcacaguguuag

SEQ ID NO: 1094 - RNA, 19 nt, artificial
  Oligomer
uuuccagagaaauuucauu

SEQ ID NO: 1095 - RNA, 19 nt, artificial
  Oligomer
auaccuuuuuauacuccuu

SEQ ID NO: 1096 - RNA, 19 nt, artificial
  Oligomer
uucaaacucuacuucuguu

SEQ ID NO: 1097 - RNA, 19 nt, artificial
  Oligomer
gugugaggaauugguccau

SEQ ID NO: 1098 - RNA, 19 nt, artificial
  Oligomer
uccagagaaauuucauuuu

SEQ ID NO: 1099 - RNA, 19 nt, artificial
  Oligomer
uuguuuauauuaaacagcu

SEQ ID NO: 1100 - RNA, 19 nt, artificial
  Oligomer
uuugcuuuccagagaaauu

SEQ ID NO: 1101 - RNA, 19 nt, artificial
  Oligomer
ugcaucuuuagauuuuuuu

SEQ ID NO: 1102 - RNA, 19 nt, artificial
  Oligomer
uuuuugacacucucugaga

SEQ ID NO: 1103 - RNA, 19 nt, artificial
  Oligomer
cugugcauuugcacagcag

SEQ ID NO: 1104 - RNA, 19 nt, artificial
  Oligomer
agagagagaaacaguucag

SEQ ID NO: 1105 - RNA, 19 nt, artificial
  Oligomer
ugauucauugggaaaauac

SEQ ID NO: 1106 - RNA, 19 nt, artificial
  Oligomer
aaacagcuuauuuauguau

SEQ ID NO: 1107 - RNA, 19 nt, artificial
  Oligomer
cguagucuccuucuacgug

SEQ ID NO: 1108 - RNA, 19 nt, artificial
  Oligomer
uguuaggaauuacaaaauc

SEQ ID NO: 1109 - RNA, 19 nt, artificial
  Oligomer
uacuugcacaaaaagaaau

SEQ ID NO: 1110 - RNA, 19 nt, artificial
  Oligomer
cucuggugcaacuaacuac

SEQ ID NO: 1111 - RNA, 19 nt, artificial
  Oligomer
ucgucugaaucauccgagg

SEQ ID NO: 1112 - RNA, 19 nt, artificial
  Oligomer
aaaaggaaaguuugggaag

SEQ ID NO: 1113 - RNA, 19 nt, artificial
  Oligomer
auuacaaaauccacagaag

SEQ ID NO: 1114 - RNA, 19 nt, artificial
  Oligomer
uugcacagcagauagaaag

SEQ ID NO: 1115 - RNA, 19 nt, artificial
  Oligomer
gugaaaguuagcacuugug

SEQ ID NO: 1116 - RNA, 19 nt, artificial
  Oligomer
cuugcugauguuccuuguu

SEQ ID NO: 1117 - RNA, 19 nt, artificial
  Oligomer
ugugcaauaaauaccaaug

SEQ ID NO: 1118 - RNA, 19 nt, artificial
  Oligomer
aauaaaauucaaacucuac

SEQ ID NO: 1119 - RNA, 19 nt, artificial
  Oligomer
ugagggauuucuaccucac

SEQ ID NO: 1120 - RNA, 19 nt, artificial
  Oligomer
aaucauccgaggcaaagag

SEQ ID NO: 1121 - RNA, 19 nt, artificial
  Oligomer
cucugugacaugugacucu

SEQ ID NO: 1122 - RNA, 19 nt, artificial
  Oligomer
uguaucaauauuaguugga

SEQ ID NO: 1123 - RNA, 19 nt, artificial
  Oligomer
ucauugggaaaauaccuuu

SEQ ID NO: 1124 - RNA, 19 nt, artificial
  Oligomer
auaaaauucaaacucuacu

SEQ ID NO: 1125 - RNA, 19 nt, artificial
  Oligomer
agaaauguuaagcucuucu

SEQ ID NO: 1126 - RNA, 19 nt, artificial
  Oligomer
cucaccaaccucuucauca

SEQ ID NO: 1127 - RNA, 19 nt, artificial
  Oligomer
gugaugcaucuuuagauuu

SEQ ID NO: 1128 - RNA, 19 nt, artificial
  Oligomer
caagacauauuuccuuuug

SEQ ID NO: 1129 - RNA, 19 nt, artificial
  Oligomer
gaagcaggugaagaagauc

SEQ ID NO: 1130 - RNA, 19 nt, artificial
  Oligomer
auugggaaaauaccuuuuu

SEQ ID NO: 1131 - RNA, 19 nt, artificial
  Oligomer
agagagaggagaaugacag

SEQ ID NO: 1132 - RNA, 19 nt, artificial
  Oligomer
uucagauuacugcacaugu

SEQ ID NO: 1133 - RNA, 19 nt, artificial
  Oligomer
gucaggcugagggauuucu

SEQ ID NO: 1134 - RNA, 19 nt, artificial
  Oligomer
cacaauccucgucugaauc

SEQ ID NO: 1135 - RNA, 19 nt, artificial
  Oligomer
uacuuaagaccgauagcag

SEQ ID NO: 1136 - RNA, 19 nt, artificial
  Oligomer
ucaagacauauuuccuuuu

SEQ ID NO: 1137 - RNA, 19 nt, artificial
  Oligomer
ggugaagaagaucgacagc

SEQ ID NO: 1138 - RNA, 19 nt, artificial
  Oligomer
aaauguuaagcucuucuug

SEQ ID NO: 1139 - RNA, 19 nt, artificial
  Oligomer
ggauuucuaccucacacug

SEQ ID NO: 1140 - RNA, 19 nt, artificial
  Oligomer
ucaagaaauguuaagcucu

SEQ ID NO: 1141 - RNA, 19 nt, artificial
  Oligomer
cauuaaaagagagcgagag

SEQ ID NO: 1142 - RNA, 19 nt, artificial
  Oligomer
ucuucgucuucuucaacug

SEQ ID NO: 1143 - RNA, 19 nt, artificial
  Oligomer
uccgaggcaaagagaaaag

SEQ ID NO: 1144 - RNA, 19 nt, artificial
  Oligomer
gaauugguccaugugcaau

SEQ ID NO: 1145 - RNA, 19 nt, artificial
  Oligomer
uauacuccuuuaucauggu

SEQ ID NO: 1146 - RNA, 19 nt, artificial
  Oligomer
aauaccaaugaagcacaau

SEQ ID NO: 1147 - RNA, 19 nt, artificial
  Oligomer
uggugaaaguuagcacuug

SEQ ID NO: 1148 - RNA, 19 nt, artificial
  Oligomer
auacucuggugcaacuaac

SEQ ID NO: 1149 - RNA, 19 nt, artificial
  Oligomer
uuuuuuuuuauuuugccuc

SEQ ID NO: 1150 - RNA, 19 nt, artificial
  Oligomer
uuuuauuuugccuccaucc

SEQ ID NO: 1151 - RNA, 19 nt, artificial
  Oligomer
uuuuauuuaagaucugccc

SEQ ID NO: 1152 - RNA, 19 nt, artificial
  Oligomer
uuuguaauuccuaacacug

SEQ ID NO: 1153 - RNA, 19 nt, artificial
  Oligomer
auuuuauuuaagaucugcc

SEQ ID NO: 1154 - RNA, 19 nt, artificial
  Oligomer
uuuuuauuuugccuccauc

SEQ ID NO: 1155 - RNA, 19 nt, artificial
  Oligomer
uuaaaaugaaauuucucug

SEQ ID NO: 1156 - RNA, 19 nt, artificial
  Oligomer
uuuuuuuuauuuugccucc

SEQ ID NO: 1157 - RNA, 19 nt, artificial
  Oligomer
uugaagaagacgaagaggc

SEQ ID NO: 1158 - RNA, 19 nt, artificial
  Oligomer
uuugccuccauccuuucuc

SEQ ID NO: 1159 - RNA, 19 nt, artificial
  Oligomer
uuuaagaucugcccagccc

SEQ ID NO: 1160 - RNA, 19 nt, artificial
  Oligomer
uuuugugcaacgguccgug

SEQ ID NO: 1161 - RNA, 19 nt, artificial
  Oligomer
uuuuugugcaaguaacauc

SEQ ID NO: 1162 - RNA, 19 nt, artificial
  Oligomer
uauaaaaagguauuuuccc

SEQ ID NO: 1163 - RNA, 19 nt, artificial
  Oligomer
uuauuuaagaucugcccag

SEQ ID NO: 1164 - RNA, 19 nt, artificial
  Oligomer
uauuuauugcacauggacc

SEQ ID NO: 1165 - RNA, 19 nt, artificial
  Oligomer
auucagacgaggauugugg

SEQ ID NO: 1166 - RNA, 19 nt, artificial
  Oligomer
uuauuuugccuccauccuu

SEQ ID NO: 1167 - RNA, 19 nt, artificial
  Oligomer
uuuugugcaaguaacaucu

SEQ ID NO: 1168 - RNA, 19 nt, artificial
  Oligomer
uaugucuugacaaacuguc

SEQ ID NO: 1169 - RNA, 19 nt, artificial
  Oligomer
uacaguaccaugauaaagg

SEQ ID NO: 1170 - RNA, 19 nt, artificial
  Oligomer
uuuauuuugccuccauccu

SEQ ID NO: 1171 - RNA, 19 nt, artificial
  Oligomer
uucaccagcaaauucacgu

SEQ ID NO: 1172 - RNA, 19 nt, artificial
  Oligomer
uauugauacauaaauaagc

SEQ ID NO: 1173 - RNA, 19 nt, artificial
  Oligomer
uucuucaccugcuucuggg

SEQ ID NO: 1174 - RNA, 19 nt, artificial
  Oligomer
ugacaaacugucauucucc

SEQ ID NO: 1175 - RNA, 19 nt, artificial
  Oligomer
uagaaggagacuacggacg

SEQ ID NO: 1176 - RNA, 19 nt, artificial
  Oligomer
uugguauuuauugcacaug

SEQ ID NO: 1177 - RNA, 19 nt, artificial
  Oligomer
uuuauuuaagaucugccca

SEQ ID NO: 1178 - RNA, 19 nt, artificial
  Oligomer
uucauugguauuuauugca

SEQ ID NO: 1179 - RNA, 19 nt, artificial
  Oligomer
uuucucuuugccucggaug

SEQ ID NO: 1180 - RNA, 19 nt, artificial
  Oligomer
uuuaauuucuuuuugugca

SEQ ID NO: 1181 - RNA, 19 nt, artificial
  Oligomer
uuugcuuucauaacagcag

SEQ ID NO: 1182 - RNA, 19 nt, artificial
  Oligomer
uuucauaacagcagaaauc

SEQ ID NO: 1183 - RNA, 19 nt, artificial
  Oligomer
auuuaauuucuuuuugugc

SEQ ID NO: 1184 - RNA, 19 nt, artificial
  Oligomer
uuuuaauguccugucuuca

SEQ ID NO: 1185 - RNA, 19 nt, artificial
  Oligomer
uugacaaacugucauucuc

SEQ ID NO: 1186 - RNA, 19 nt, artificial
  Oligomer
uuucaccagcaaauucacg

SEQ ID NO: 1187 - RNA, 19 nt, artificial
  Oligomer
uucccaaugaaucauuagc

SEQ ID NO: 1188 - RNA, 19 nt, artificial
  Oligomer
uucgaguucaccugcuauc

SEQ ID NO: 1189 - RNA, 19 nt, artificial
  Oligomer
uguaauuccuaacacugug

SEQ ID NO: 1190 - RNA, 19 nt, artificial
  Oligomer
uuuuugugcaacgguccgu

SEQ ID NO: 1191 - RNA, 19 nt, artificial
  Oligomer
uugcacauggaccaauucc

SEQ ID NO: 1192 - RNA, 19 nt, artificial
  Oligomer
uaaaaugaaauuucucugg

SEQ ID NO: 1193 - RNA, 19 nt, artificial
  Oligomer
uuguaauuccuaacacugu

SEQ ID NO: 1194 - RNA, 19 nt, artificial
  Oligomer
uccuuuuugugcaacgguc

SEQ ID NO: 1195 - RNA, 19 nt, artificial
  Oligomer
uaauauaaacaagucuuuc

SEQ ID NO: 1196 - RNA, 19 nt, artificial
  Oligomer
ucaaaaaccaccugguggg

SEQ ID NO: 1197 - RNA, 19 nt, artificial
  Oligomer
auaaacaagucuuucuauc

SEQ ID NO: 1198 - RNA, 19 nt, artificial
  Oligomer
uugauugugcuucauuggu

SEQ ID NO: 1199 - RNA, 19 nt, artificial
  Oligomer
uauuuugccuccauccuuu

SEQ ID NO: 1200 - RNA, 19 nt, artificial
  Oligomer
uugauacauaaauaagcug

SEQ ID NO: 1201 - RNA, 19 nt, artificial
  Oligomer
uaacccacccaucuuccac

SEQ ID NO: 1202 - RNA, 19 nt, artificial
  Oligomer
uacaccuuggauuccgagg

SEQ ID NO: 1203 - RNA, 19 nt, artificial
  Oligomer
uccuaaugcuucucccuuc

SEQ ID NO: 1204 - RNA, 19 nt, artificial
  Oligomer
ucagagagugucaaaaacc

SEQ ID NO: 1205 - RNA, 19 nt, artificial
  Oligomer
uuuccuuuuugugcaacgg

SEQ ID NO: 1206 - RNA, 19 nt, artificial
  Oligomer
uagaaaucccucagccuga

SEQ ID NO: 1207 - RNA, 19 nt, artificial
  Oligomer
uuuuguaauuccuaacacu

SEQ ID NO: 1208 - RNA, 19 nt, artificial
  Oligomer
ucuaaagaugcaucacacg

SEQ ID NO: 1209 - RNA, 19 nt, artificial
  Oligomer
uucuuuuugugcaaguaac

SEQ ID NO: 1210 - RNA, 19 nt, artificial
  Oligomer
uuugccucggaugauucag

SEQ ID NO: 1211 - RNA, 19 nt, artificial
  Oligomer
uuccuuuuugugcaacggu

SEQ ID NO: 1212 - RNA, 19 nt, artificial
  Oligomer
uuuuuuuauuuugccucca

SEQ ID NO: 1213 - RNA, 19 nt, artificial
  Oligomer
aucccuucccaaacuuucc

SEQ ID NO: 1214 - RNA, 19 nt, artificial
  Oligomer
ugguauuuauugcacaugg

SEQ ID NO: 1215 - RNA, 19 nt, artificial
  Oligomer
ugucauucuccucucucug

SEQ ID NO: 1216 - RNA, 19 nt, artificial
  Oligomer
uaacauuucuugaaacgug

SEQ ID NO: 1217 - RNA, 19 nt, artificial
  Oligomer
uaaacaagucuuucuaucu

SEQ ID NO: 1218 - RNA, 19 nt, artificial
  Oligomer
uugugcuucauugguauuu

SEQ ID NO: 1219 - RNA, 19 nt, artificial
  Oligomer
ugugagguagaaaucccuc

SEQ ID NO: 1220 - RNA, 19 nt, artificial
  Oligomer
uuuuuuauuuugccuccau

SEQ ID NO: 1221 - RNA, 19 nt, artificial
  Oligomer
uuuauaauauggauacagu

SEQ ID NO: 1222 - RNA, 19 nt, artificial
  Oligomer
uaaaaagguauuuucccaa

SEQ ID NO: 1223 - RNA, 19 nt, artificial
  Oligomer
uucucuggaaagcaaaagg

SEQ ID NO: 1224 - RNA, 19 nt, artificial
  Oligomer
uuccaacuaauauugauac

SEQ ID NO: 1225 - RNA, 19 nt, artificial
  Oligomer
auuuauaauauggauacag

SEQ ID NO: 1226 - RNA, 19 nt, artificial
  Oligomer
auuuaagaucugcccagcc

SEQ ID NO: 1227 - RNA, 19 nt, artificial
  Oligomer
guagaaaucccucagccug

SEQ ID NO: 1228 - RNA, 19 nt, artificial
  Oligomer
aagagcuuaacauuucuug

SEQ ID NO: 1229 - RNA, 19 nt, artificial
  Oligomer
uaaagaugcaucacacgca

SEQ ID NO: 1230 - RNA, 19 nt, artificial
  Oligomer
aucuaaagaugcaucacac

SEQ ID NO: 1231 - RNA, 19 nt, artificial
  Oligomer
uuuaauguccugucuucaa

SEQ ID NO: 1232 - RNA, 19 nt, artificial
  Oligomer
uuucucuuugcuuucauaa

SEQ ID NO: 1233 - RNA, 19 nt, artificial
  Oligomer
uagcucaauaacauacuag

SEQ ID NO: 1234 - RNA, 19 nt, artificial
  Oligomer
auauaaacaagucuuucua

SEQ ID NO: 1235 - RNA, 19 nt, artificial
  Oligomer
ugauacauaaauaagcugu

SEQ ID NO: 1236 - RNA, 19 nt, artificial
  Oligomer
uucauaacagcagaaauca

SEQ ID NO: 1237 - RNA, 19 nt, artificial
  Oligomer
ucauugguauuuauugcac

SEQ ID NO: 1238 - RNA, 19 nt, artificial
  Oligomer
aacaagucuuucuaucugc

SEQ ID NO: 1239 - RNA, 19 nt, artificial
  Oligomer
ucccaaacuuuccuuuuug

SEQ ID NO: 1240 - RNA, 19 nt, artificial
  Oligomer
aucuucuucaccugcuucu

SEQ ID NO: 1241 - RNA, 19 nt, artificial
  Oligomer
auaauauggauacaguuac

SEQ ID NO: 1242 - RNA, 19 nt, artificial
  Oligomer
uuauaauauggauacaguu

SEQ ID NO: 1243 - RNA, 19 nt, artificial
  Oligomer
ucuuugccucggaugauuc

SEQ ID NO: 1244 - RNA, 19 nt, artificial
  Oligomer
cuaaagaugcaucacacgc

SEQ ID NO: 1245 - RNA, 19 nt, artificial
  Oligomer
uacaguuacaguaccauga

SEQ ID NO: 1246 - RNA, 19 nt, artificial
  Oligomer
uauaaauacuugguaaaac

SEQ ID NO: 1247 - RNA, 19 nt, artificial
  Oligomer
acaagugcuaacuuucacc

SEQ ID NO: 1248 - RNA, 19 nt, artificial
  Oligomer
uuaauguccugucuucaau

SEQ ID NO: 1249 - RNA, 19 nt, artificial
  Oligomer
ucucuuuuaauguccuguc

SEQ ID NO: 1250 - RNA, 19 nt, artificial
  Oligomer
auaaaaagguauuuuccca

SEQ ID NO: 1251 - RNA, 19 nt, artificial
  Oligomer
ucccaaugaaucauuagcu

SEQ ID NO: 1252 - RNA, 19 nt, artificial
  Oligomer
ucuuucuaucugcugugca

SEQ ID NO: 1253 - RNA, 19 nt, artificial
  Oligomer
augaugaugcccagcgucu

SEQ ID NO: 1254 - RNA, 19 nt, artificial
  Oligomer
aauauaaacaagucuuucu

SEQ ID NO: 1255 - RNA, 19 nt, artificial
  Oligomer
uuaacauuucuugaaacgu

SEQ ID NO: 1256 - RNA, 19 nt, artificial
  Oligomer
auuuauugcacauggacca

SEQ ID NO: 1257 - RNA, 19 nt, artificial
  Oligomer
uuucucucucucgcucucu

SEQ ID NO: 1258 - RNA, 19 nt, artificial
  Oligomer
uacuagacaacagaaguag

SEQ ID NO: 1259 - RNA, 19 nt, artificial
  Oligomer
ucgcucucuuuuaaugucc

SEQ ID NO: 1260 - RNA, 19 nt, artificial
  Oligomer
uugugcaaguaacaucuuc

SEQ ID NO: 1261 - RNA, 19 nt, artificial
  Oligomer
uauuuaagaucugcccagc

SEQ ID NO: 1262 - RNA, 19 nt, artificial
  Oligomer
auacaguuacaguaccaug

SEQ ID NO: 1263 - RNA, 19 nt, artificial
  Oligomer
uaacacugugcaaaaaugg

SEQ ID NO: 1264 - RNA, 19 nt, artificial
  Oligomer
uuacaguaccaugauaaag

SEQ ID NO: 1265 - RNA, 19 nt, artificial
  Oligomer
uaaauacuugguaaaacac

SEQ ID NO: 1266 - RNA, 19 nt, artificial
  Oligomer
ucgaguucaccugcuaucg

SEQ ID NO: 1267 - RNA, 19 nt, artificial
  Oligomer
aauuuuauuuaagaucugc

SEQ ID NO: 1268 - RNA, 19 nt, artificial
  Oligomer
aacuguuucucucucucgc

SEQ ID NO: 1269 - RNA, 19 nt, artificial
  Oligomer
uucaauugacagagucaca

SEQ ID NO: 1270 - RNA, 19 nt, artificial
  Oligomer
uaaaggaguauaaaaaggu

SEQ ID NO: 1271 - RNA, 19 nt, artificial
  Oligomer
uucucuuugccucggauga

SEQ ID NO: 1272 - RNA, 19 nt, artificial
  Oligomer
uuuugccuccauccuuucu

SEQ ID NO: 1273 - RNA, 19 nt, artificial
  Oligomer
acugucauucuccucucuc

SEQ ID NO: 1274 - RNA, 19 nt, artificial
  Oligomer
uauggauacaguuacagua

SEQ ID NO: 1275 - RNA, 19 nt, artificial
  Oligomer
ugaaacgugauuuuuuuuu

SEQ ID NO: 1276 - RNA, 19 nt, artificial
  Oligomer
ugaagaagacgaagaggcg

SEQ ID NO: 1277 - RNA, 19 nt, artificial
  Oligomer
caaacuuuccuuuuugugc

SEQ ID NO: 1278 - RNA, 19 nt, artificial
  Oligomer
augugcaguaaucugaacu

SEQ ID NO: 1279 - RNA, 19 nt, artificial
  Oligomer
augaagagguuggugagcg

SEQ ID NO: 1280 - RNA, 19 nt, artificial
  Oligomer
uucagacgaggauuguggg

SEQ ID NO: 1281 - RNA, 19 nt, artificial
  Oligomer
uuucuuuuugugcaaguaa

SEQ ID NO: 1282 - RNA, 19 nt, artificial
  Oligomer
cuuuccuuuuugugcaacg

SEQ ID NO: 1283 - RNA, 19 nt, artificial
  Oligomer
ucuuuuaauguccugucuu

SEQ ID NO: 1284 - RNA, 19 nt, artificial
  Oligomer
ucccuucccaaacuuuccu

SEQ ID NO: 1285 - RNA, 19 nt, artificial
  Oligomer
uucucuuugcuuucauaac

SEQ ID NO: 1286 - RNA, 19 nt, artificial
  Oligomer
aaacaagucuuucuaucug

SEQ ID NO: 1287 - RNA, 19 nt, artificial
  Oligomer
uauaauauggauacaguua

SEQ ID NO: 1288 - RNA, 19 nt, artificial
  Oligomer
uguuucucucucucgcucu

SEQ ID NO: 1289 - RNA, 19 nt, artificial
  Oligomer
aguauaaaaagguauuuuc

SEQ ID NO: 1290 - RNA, 19 nt, artificial
  Oligomer
ucuaucugcugugcaaaug

SEQ ID NO: 1291 - RNA, 19 nt, artificial
  Oligomer
aaaaaucuaaagaugcauc

SEQ ID NO: 1292 - RNA, 19 nt, artificial
  Oligomer
agugucaaaaaccaccugg

SEQ ID NO: 1293 - RNA, 19 nt, artificial
  Oligomer
aauaugucuugacaaacug

SEQ ID NO: 1294 - RNA, 19 nt, artificial
  Oligomer
uguuuaauauaaacaaguc

SEQ ID NO: 1295 - RNA, 19 nt, artificial
  Oligomer
uacauaaauaagcuguuua

SEQ ID NO: 1296 - RNA, 19 nt, artificial
  Oligomer
ugaacuguuucucucucuc

SEQ ID NO: 1297 - RNA, 19 nt, artificial
  Oligomer
auaaaggaguauaaaaagg

SEQ ID NO: 1298 - RNA, 19 nt, artificial
  Oligomer
ucaauugacagagucacau

SEQ ID NO: 1299 - RNA, 19 nt, artificial
  Oligomer
auuuuguaauuccuaacac

SEQ ID NO: 1300 - RNA, 19 nt, artificial
  Oligomer
ugugcaaguaacaucuucu

SEQ ID NO: 1301 - RNA, 19 nt, artificial
  Oligomer
augauucagacgaggauug

SEQ ID NO: 1302 - RNA, 19 nt, artificial
  Oligomer
ucuucuucaccugcuucug

SEQ ID NO: 1303 - RNA, 19 nt, artificial
  Oligomer
augaugaagagguugguga

SEQ ID NO: 1304 - RNA, 19 nt, artificial
  Oligomer
cuuuuugugcaacgguccg

SEQ ID NO: 1305 - RNA, 19 nt, artificial
  Oligomer
uccacaugugcaguaaucu

SEQ ID NO: 1306 - RNA, 19 nt, artificial
  Oligomer
auaaauacuugguaaaaca

SEQ ID NO: 1307 - RNA, 19 nt, artificial
  Oligomer
uuucucuggaaagcaaaag

SEQ ID NO: 1308 - RNA, 19 nt, artificial
  Oligomer
uuucuaucugcugugcaaa

SEQ ID NO: 1309 - RNA, 19 nt, artificial
  Oligomer
ucugaacuguuucucucuc

SEQ ID NO: 1310 - RNA, 19 nt, artificial
  Oligomer
acgaugaucgauuuuaauc

SEQ ID NO: 1311 - RNA, 19 nt, artificial
  Oligomer
ucuugacaaacugucauuc

SEQ ID NO: 1312 - RNA, 19 nt, artificial
  Oligomer
uuccaagaagagcuuaaca

SEQ ID NO: 1313 - RNA, 19 nt, artificial
  Oligomer
auccacaugugcaguaauc

SEQ ID NO: 1314 - RNA, 19 nt, artificial
  Oligomer
uugacagagucacauguca

SEQ ID NO: 1315 - RNA, 19 nt, artificial
  Oligomer
uaaucugaacuguuucucu

SEQ ID NO: 1316 - RNA, 19 nt, artificial
  Oligomer
ucgaucuucuucaccugcu

SEQ ID NO: 1317 - RNA, 19 nt, artificial
  Oligomer
gucaaaaaccaccuggugg

SEQ ID NO: 1318 - RNA, 19 nt, artificial
  Oligomer
ugcuucauugguauuuauu

SEQ ID NO: 1319 - RNA, 19 nt, artificial
  Oligomer
uugccucggaugauucaga

SEQ ID NO: 1320 - RNA, 19 nt, artificial
  Oligomer
ugacagagucacaugucac

SEQ ID NO: 1321 - RNA, 19 nt, artificial
  Oligomer
ucuugaaacgugauuuuuu

SEQ ID NO: 1322 - RNA, 19 nt, artificial
  Oligomer
uauaaacaagucuuucuau

SEQ ID NO: 1323 - RNA, 19 nt, artificial
  Oligomer
uccaagaagagcuuaacau

SEQ ID NO: 1324 - RNA, 19 nt, artificial
  Oligomer
uaauuccuaacacugugca

SEQ ID NO: 1325 - RNA, 19 nt, artificial
  Oligomer
ugcacauggaccaauuccu

SEQ ID NO: 1326 - RNA, 19 nt, artificial
  Oligomer
ugauugugcuucauuggua

SEQ ID NO: 1327 - RNA, 19 nt, artificial
  Oligomer
gagagugucaaaaaccacc

SEQ ID NO: 1328 - RNA, 19 nt, artificial
  Oligomer
uguggauuuuguaauuccu

SEQ ID NO: 1329 - RNA, 19 nt, artificial
  Oligomer
auugauacauaaauaagcu

SEQ ID NO: 1330 - RNA, 19 nt, artificial
  Oligomer
auuagcucaauaacauacu

SEQ ID NO: 1331 - RNA, 19 nt, artificial
  Oligomer
auugacagagucacauguc

SEQ ID NO: 1332 - RNA, 19 nt, artificial
  Oligomer
uaacauacuagacaacaga

SEQ ID NO: 1333 - RNA, 19 nt, artificial
  Oligomer
ugugcaguaaucugaacug

SEQ ID NO: 1334 - RNA, 19 nt, artificial
  Oligomer
auuucuugaaacgugauuu

SEQ ID NO: 1335 - RNA, 19 nt, artificial
  Oligomer
uuucccaaugaaucauuag

SEQ ID NO: 1336 - RNA, 19 nt, artificial
  Oligomer
auuuucccaaugaaucauu

SEQ ID NO: 1337 - RNA, 19 nt, artificial
  Oligomer
ucucuuugcuuucauaaca

SEQ ID NO: 1338 - RNA, 19 nt, artificial
  Oligomer
uugaaacgugauuuuuuuu

SEQ ID NO: 1339 - RNA, 19 nt, artificial
  Oligomer
aaucugaacuguuucucuc

SEQ ID NO: 1340 - RNA, 19 nt, artificial
  Oligomer
uugugggcuucgaguucac

SEQ ID NO: 1341 - RNA, 19 nt, artificial
  Oligomer
aauauggauacaguuacag

SEQ ID NO: 1342 - RNA, 19 nt, artificial
  Oligomer
acuuucaccagcaaauuca

SEQ ID NO: 1343 - RNA, 19 nt, artificial
  Oligomer
aucugcugugcaaaugcac

SEQ ID NO: 1344 - RNA, 19 nt, artificial
  Oligomer
aaucuaaagaugcaucaca

SEQ ID NO: 1345 - RNA, 19 nt, artificial
  Oligomer
uaauguccugucuucaauu

SEQ ID NO: 1346 - RNA, 19 nt, artificial
  Oligomer
aucggucuuaaguaaacac

SEQ ID NO: 1347 - RNA, 19 nt, artificial
  Oligomer
uucucucucucgcucucuu

SEQ ID NO: 1348 - RNA, 19 nt, artificial
  Oligomer
ucacaugucacagagagag

SEQ ID NO: 1349 - RNA, 19 nt, artificial
  Oligomer
aaaucccucagccugacca

SEQ ID NO: 1350 - RNA, 19 nt, artificial
  Oligomer
uucccaaacuuuccuuuuu

SEQ ID NO: 1351 - RNA, 19 nt, artificial
  Oligomer
acgaucaccagcacauugc

SEQ ID NO: 1352 - RNA, 19 nt, artificial
  Oligomer
uuauugcacauggaccaau

SEQ ID NO: 1353 - RNA, 19 nt, artificial
  Oligomer
acaaacugucauucuccuc

SEQ ID NO: 1354 - RNA, 19 nt, artificial
  Oligomer
ugucaaaaaccaccuggug

SEQ ID NO: 1355 - RNA, 19 nt, artificial
  Oligomer
aaacuuuccuuuuugugca

SEQ ID NO: 1356 - RNA, 19 nt, artificial
  Oligomer
augaaauuucucuggaaag

SEQ ID NO: 1357 - RNA, 19 nt, artificial
  Oligomer
aagacgcccaugaugaugc

SEQ ID NO: 1358 - RNA, 19 nt, artificial
  Oligomer
uggauuuuguaauuccuaa

SEQ ID NO: 1359 - RNA, 19 nt, artificial
  Oligomer
uucaccugcuaucggucuu

SEQ ID NO: 1360 - RNA, 19 nt, artificial
  Oligomer
aucauuagcucaauaacau

SEQ ID NO: 1361 - RNA, 19 nt, artificial
  Oligomer
aauaacauacuagacaaca

SEQ ID NO: 1362 - RNA, 19 nt, artificial
  Oligomer
guauaaaaagguauuuucc

SEQ ID NO: 1363 - RNA, 19 nt, artificial
  Oligomer
ugcaguaaucugaacuguu

SEQ ID NO: 1364 - RNA, 19 nt, artificial
  Oligomer
cgaugaucgauuuuaaucc

SEQ ID NO: 1365 - RNA, 19 nt, artificial
  Oligomer
cuccuaaugcuucucccuu

SEQ ID NO: 1366 - RNA, 19 nt, artificial
  Oligomer
uuuucucuuugccucggau

SEQ ID NO: 1367 - RNA, 19 nt, artificial
  Oligomer
auuuugccuccauccuuuc

SEQ ID NO: 1368 - RNA, 19 nt, artificial
  Oligomer
aucugaacuguuucucucu

SEQ ID NO: 1369 - RNA, 19 nt, artificial
  Oligomer
cuucauugguauuuauugc

SEQ ID NO: 1370 - RNA, 19 nt, artificial
  Oligomer
auccuuucucuuugcuuuc

SEQ ID NO: 1371 - RNA, 19 nt, artificial
  Oligomer
ucucgcucucuuuuaaugu

SEQ ID NO: 1372 - RNA, 19 nt, artificial
  Oligomer
uuaauuucuuuuugugcaa

SEQ ID NO: 1373 - RNA, 19 nt, artificial
  Oligomer
agucuuucuaucugcugug

SEQ ID NO: 1374 - RNA, 19 nt, artificial
  Oligomer
ugagguagaaaucccucag

SEQ ID NO: 1375 - RNA, 19 nt, artificial
  Oligomer
ucggaugauucagacgagg

SEQ ID NO: 1376 - RNA, 19 nt, artificial
  Oligomer
agcaaauucacgugggcac

SEQ ID NO: 1377 - RNA, 19 nt, artificial
  Oligomer
caaacugucauucuccucu

SEQ ID NO: 1378 - RNA, 19 nt, artificial
  Oligomer
uugccuccauccuuucucu

SEQ ID NO: 1379 - RNA, 19 nt, artificial
  Oligomer
uucuugaaacgugauuuuu

SEQ ID NO: 1380 - RNA, 19 nt, artificial
  Oligomer
auaacauacuagacaacag

SEQ ID NO: 1381 - RNA, 19 nt, artificial
  Oligomer
aaaagaaggccggaccaca

SEQ ID NO: 1382 - RNA, 19 nt, artificial
  Oligomer
ucucccuuuaaaaaauauu

SEQ ID NO: 1383 - RNA, 19 nt, artificial
  Oligomer
ugucacagagagaggcucu

SEQ ID NO: 1384 - RNA, 19 nt, artificial
  Oligomer
acaaggaacaucagcaagc

SEQ ID NO: 1385 - RNA, 19 nt, artificial
  Oligomer
auauggauacaguuacagu

SEQ ID NO: 1386 - RNA, 19 nt, artificial
  Oligomer
agaagaaggagccguacuc

SEQ ID NO: 1387 - RNA, 19 nt, artificial
  Oligomer
ucuucuguggauuuuguaa

SEQ ID NO: 1388 - RNA, 19 nt, artificial
  Oligomer
aagucuuucuaucugcugu

SEQ ID NO: 1389 - RNA, 19 nt, artificial
  Oligomer
augaugcccagcgucuuga

SEQ ID NO: 1390 - RNA, 19 nt, artificial
  Oligomer
ugaaauuucucuggaaagc

SEQ ID NO: 1391 - RNA, 19 nt, artificial
  Oligomer
ucugcugugcaaaugcaca

SEQ ID NO: 1392 - RNA, 19 nt, artificial
  Oligomer
aaucauuagcucaauaaca

SEQ ID NO: 1393 - RNA, 19 nt, artificial
  Oligomer
ucuuuuugugcaaguaaca

SEQ ID NO: 1394 - RNA, 19 nt, artificial
  Oligomer
ucuuugcuuucauaacagc

SEQ ID NO: 1395 - RNA, 19 nt, artificial
  Oligomer
ugaaucauuagcucaauaa

SEQ ID NO: 1396 - RNA, 19 nt, artificial
  Oligomer
uuuucccaaugaaucauua

SEQ ID NO: 1397 - RNA, 19 nt, artificial
  Oligomer
aguaccaugauaaaggagu

SEQ ID NO: 1398 - RNA, 19 nt, artificial
  Oligomer
uagacaacagaaguagagu

SEQ ID NO: 1399 - RNA, 19 nt, artificial
  Oligomer
aacccacccaucuuccacu

SEQ ID NO: 1400 - RNA, 19 nt, artificial
  Oligomer
agcaaaaggaaauaugucu

SEQ ID NO: 1401 - RNA, 19 nt, artificial
  Oligomer
ugguccuuccaacuaauau

SEQ ID NO: 1402 - RNA, 19 nt, artificial
  Oligomer
augucacagagagaggcuc

SEQ ID NO: 1403 - RNA, 19 nt, artificial
  Oligomer
auugugggcuucgaguuca

SEQ ID NO: 1404 - RNA, 19 nt, artificial
  Oligomer
guaaucugaacuguuucuc

SEQ ID NO: 1405 - RNA, 19 nt, artificial
  Oligomer
uauuuucccaaugaaucau

SEQ ID NO: 1406 - RNA, 19 nt, artificial
  Oligomer
ugcaaaugcacagugugag

SEQ ID NO: 1407 - RNA, 19 nt, artificial
  Oligomer
auaacagcagaaaucauua

SEQ ID NO: 1408 - RNA, 19 nt, artificial
  Oligomer
guaauuccuaacacugugc

SEQ ID NO: 1409 - RNA, 19 nt, artificial
  Oligomer
aagcuguuuaauauaaaca

SEQ ID NO: 1410 - RNA, 19 nt, artificial
  Oligomer
uaagcuguuuaauauaaac

SEQ ID NO: 1411 - RNA, 19 nt, artificial
  Oligomer
cacaaggaaagcaaggugg

SEQ ID NO: 1412 - RNA, 19 nt, artificial
  Oligomer
guuuaauauaaacaagucu

SEQ ID NO: 1413 - RNA, 19 nt, artificial
  Oligomer
ccaaacuuuccuuuuugug

SEQ ID NO: 1414 - RNA, 19 nt, artificial
  Oligomer
ugauaaaggaguauaaaaa

SEQ ID NO: 1415 - RNA, 19 nt, artificial
  Oligomer
cucaauaacauacuagaca

SEQ ID NO: 1416 - RNA, 19 nt, artificial
  Oligomer
guccuuccaacuaauauug

SEQ ID NO: 1417 - RNA, 19 nt, artificial
  Oligomer
gguauuuucccaaugaauc

SEQ ID NO: 1418 - RNA, 19 nt, artificial
  Oligomer
uauugcacauggaccaauu

SEQ ID NO: 1419 - RNA, 19 nt, artificial
  Oligomer
ugucgaucuucuucaccug

SEQ ID NO: 1420 - RNA, 19 nt, artificial
  Oligomer
auggauacaguuacaguac

SEQ ID NO: 1421 - RNA, 19 nt, artificial
  Oligomer
agugcuaacuuucaccagc

SEQ ID NO: 1422 - RNA, 19 nt, artificial
  Oligomer
auaugucuugacaaacugu

SEQ ID NO: 1423 - RNA, 19 nt, artificial
  Oligomer
uugcuuucauaacagcaga

SEQ ID NO: 1424 - RNA, 19 nt, artificial
  Oligomer
uaauuucuuuuugugcaag

SEQ ID NO: 1425 - RNA, 19 nt, artificial
  Oligomer
caucccuucccaaacuuuc

SEQ ID NO: 1426 - RNA, 19 nt, artificial
  Oligomer
uucuaucugcugugcaaau

SEQ ID NO: 1427 - RNA, 19 nt, artificial
  Oligomer
accagaguauaaauacuug

SEQ ID NO: 1428 - RNA, 19 nt, artificial
  Oligomer
aagaagacgaagaggcggu

SEQ ID NO: 1429 - RNA, 19 nt, artificial
  Oligomer
cauaacagcagaaaucauu

SEQ ID NO: 1430 - RNA, 19 nt, artificial
  Oligomer
agguagaaaucccucagcc

SEQ ID NO: 1431 - RNA, 19 nt, artificial
  Oligomer
ccuuuuugugcaacggucc

SEQ ID NO: 1432 - RNA, 19 nt, artificial
  Oligomer
uuucuugaaacgugauuuu

SEQ ID NO: 1433 - RNA, 19 nt, artificial
  Oligomer
uguccugucuucaauugac

SEQ ID NO: 1434 - RNA, 19 nt, artificial
  Oligomer
gauuuuuuuuuauuuugcc

SEQ ID NO: 1435 - RNA, 19 nt, artificial
  Oligomer
auugguauuuauugcacau

SEQ ID NO: 1436 - RNA, 19 nt, artificial
  Oligomer
uccugucuucaauugacag

SEQ ID NO: 1437 - RNA, 19 nt, artificial
  Oligomer
uaucggucuuaaguaaaca

SEQ ID NO: 1438 - RNA, 19 nt, artificial
  Oligomer
aagaagagcuuaacauuuc

SEQ ID NO: 1439 - RNA, 19 nt, artificial
  Oligomer
uuccuaacacugugcaaaa

SEQ ID NO: 1440 - RNA, 19 nt, artificial
  Oligomer
ugaugaugcccagcgucuu

SEQ ID NO: 1441 - RNA, 19 nt, artificial
  Oligomer
auuccuaacacugugcaaa

SEQ ID NO: 1442 - RNA, 19 nt, artificial
  Oligomer
cuuugcuuucauaacagca

SEQ ID NO: 1443 - RNA, 19 nt, artificial
  Oligomer
cacaguaguuaguugcacc

SEQ ID NO: 1444 - RNA, 19 nt, artificial
  Oligomer
aaaagguauuuucccaaug

SEQ ID NO: 1445 - RNA, 19 nt, artificial
  Oligomer
cacaugugcaguaaucuga

SEQ ID NO: 1446 - RNA, 19 nt, artificial
  Oligomer
agugugagguagaaauccc

SEQ ID NO: 1447 - RNA, 19 nt, artificial
  Oligomer
ucaauaacauacuagacaa

SEQ ID NO: 1448 - RNA, 19 nt, artificial
  Oligomer
ucucucucucgcucucuuu

SEQ ID NO: 1449 - RNA, 19 nt, artificial
  Oligomer
cuucaauugacagagucac

SEQ ID NO: 1450 - RNA, 19 nt, artificial
  Oligomer
agagugucaaaaaccaccu

SEQ ID NO: 1451 - RNA, 19 nt, artificial
  Oligomer
cugucgaucuucuucaccu

SEQ ID NO: 1452 - RNA, 19 nt, artificial
  Oligomer
aguuacaguaccaugauaa

SEQ ID NO: 1453 - RNA, 19 nt, artificial
  Oligomer
uuaguugcaccagaguaua

SEQ ID NO: 1454 - RNA, 19 nt, artificial
  Oligomer
aaauaugucuugacaaacu

SEQ ID NO: 1455 - RNA, 19 nt, artificial
  Oligomer
uuuauugcacauggaccaa

SEQ ID NO: 1456 - RNA, 19 nt, artificial
  Oligomer
cuguuucucucucucgcuc

SEQ ID NO: 1457 - RNA, 19 nt, artificial
  Oligomer
cuuaacauuucuugaaacg

SEQ ID NO: 1458 - RNA, 19 nt, artificial
  Oligomer
ucaccagcaaauucacgug

SEQ ID NO: 1459 - RNA, 19 nt, artificial
  Oligomer
aggauugugggcuucgagu

SEQ ID NO: 1460 - RNA, 19 nt, artificial
  Oligomer
aaaaucuaaagaugcauca

SEQ ID NO: 1461 - RNA, 19 nt, artificial
  Oligomer
acauggaccaauuccucac

SEQ ID NO: 1462 - RNA, 19 nt, artificial
  Oligomer
aucuucuguggauuuugua

SEQ ID NO: 1463 - RNA, 19 nt, artificial
  Oligomer
ucuucaauugacagaguca

SEQ ID NO: 1464 - RNA, 19 nt, artificial
  Oligomer
acauacuagacaacagaag

SEQ ID NO: 1465 - RNA, 19 nt, artificial
  Oligomer
acguagaaggagacuacgg

SEQ ID NO: 1466 - RNA, 19 nt, artificial
  Oligomer
aagagguuggugagcgucu

SEQ ID NO: 1467 - RNA, 19 nt, artificial
  Oligomer
agaugcaucacacgcacac

SEQ ID NO: 1468 - RNA, 19 nt, artificial
  Oligomer
ugucuugacaaacugucau

SEQ ID NO: 1469 - RNA, 19 nt, artificial
  Oligomer
cuuuuaauguccugucuuc

SEQ ID NO: 1470 - RNA, 19 nt, artificial
  Oligomer
acaagucuuucuaucugcu

SEQ ID NO: 1471 - RNA, 19 nt, artificial
  Oligomer
ucuguggauuuuguaauuc

SEQ ID NO: 1472 - RNA, 19 nt, artificial
  Oligomer
caagucuuucuaucugcug

SEQ ID NO: 1473 - RNA, 19 nt, artificial
  Oligomer
cuucuucaccugcuucugg

SEQ ID NO: 1474 - RNA, 19 nt, artificial
  Oligomer
cuaaugcuucucccuuccc

SEQ ID NO: 1475 - RNA, 19 nt, artificial
  Oligomer
ugccucggaugauucagac

SEQ ID NO: 1476 - RNA, 19 nt, artificial
  Oligomer
acgaugagcagcacgauga

SEQ ID NO: 1477 - RNA, 19 nt, artificial
  Oligomer
aacagcagaaaucauuacu

SEQ ID NO: 1478 - RNA, 19 nt, artificial
  Oligomer
acaucuucuguggauuuug

SEQ ID NO: 1479 - RNA, 19 nt, artificial
  Oligomer
ucgcagcugucgaucuucu

SEQ ID NO: 1480 - RNA, 19 nt, artificial
  Oligomer
acuguuucucucucucgcu

SEQ ID NO: 1481 - RNA, 19 nt, artificial
  Oligomer
aaaaaaucuaaagaugcau

SEQ ID NO: 1482 - RNA, 19 nt, artificial
  Oligomer
uaguuaguugcaccagagu

SEQ ID NO: 1483 - RNA, 19 nt, artificial
  Oligomer
cuguggauuuuguaauucc

SEQ ID NO: 1484 - RNA, 19 nt, artificial
  Oligomer
ucucccaucccuucccaaa

SEQ ID NO: 1485 - RNA, 19 nt, artificial
  Oligomer
acaguaguuaguugcacca

SEQ ID NO: 1486 - RNA, 19 nt, artificial
  Oligomer
uggauacaguuacaguacc

SEQ ID NO: 1487 - RNA, 19 nt, artificial
  Oligomer
cuagacaacagaaguagag

SEQ ID NO: 1488 - RNA, 19 nt, artificial
  Oligomer
cuaucugcugugcaaaugc

SEQ ID NO: 1489 - RNA, 19 nt, artificial
  Oligomer
cucuuugcuuucauaacag

SEQ ID NO: 1490 - RNA, 19 nt, artificial
  Oligomer
aacauuucuugaaacguga

SEQ ID NO: 1491 - RNA, 19 nt, artificial
  Oligomer
aaacugucauucuccucuc

SEQ ID NO: 1492 - RNA, 19 nt, artificial
  Oligomer
acuuuccuuuuugugcaac

SEQ ID NO: 1493 - RNA, 19 nt, artificial
  Oligomer
aaagaugcaucacacgcac

SEQ ID NO: 1494 - RNA, 19 nt, artificial
  Oligomer
ugcaccagaguauaaauac

SEQ ID NO: 1495 - RNA, 19 nt, artificial
  Oligomer
ccagaguauaaauacuugg

SEQ ID NO: 1496 - RNA, 19 nt, artificial
  Oligomer
augauaaaggaguauaaaa

SEQ ID NO: 1497 - RNA, 19 nt, artificial
  Oligomer
cagaaguagaguuugaauu

SEQ ID NO: 1498 - RNA, 19 nt, artificial
  Oligomer
uugcaccagaguauaaaua

SEQ ID NO: 1499 - RNA, 19 nt, artificial
  Oligomer
cuguuuaauauaaacaagu

SEQ ID NO: 1500 - RNA, 19 nt, artificial
  Oligomer
gcuucauugguauuuauug

SEQ ID NO: 1501 - RNA, 19 nt, artificial
  Oligomer
aauucacgugggcacuugg

SEQ ID NO: 1502 - RNA, 19 nt, artificial
  Oligomer
aauugacagagucacaugu

SEQ ID NO: 1503 - RNA, 19 nt, artificial
  Oligomer
gucauucuccucucucugg

SEQ ID NO: 1504 - RNA, 19 nt, artificial
  Oligomer
acagagucacaugucacag

SEQ ID NO: 1505 - RNA, 19 nt, artificial
  Oligomer
ucucucucgcucucuuuua

SEQ ID NO: 1506 - RNA, 19 nt, artificial
  Oligomer
aguaguuaguugcaccaga

SEQ ID NO: 1507 - RNA, 19 nt, artificial
  Oligomer
acaugucacagagagaggc

SEQ ID NO: 1508 - RNA, 19 nt, artificial
  Oligomer
aguucaccugcuaucgguc

SEQ ID NO: 1509 - RNA, 19 nt, artificial
  Oligomer
gcuuguuccaagaagagcu

SEQ ID NO: 1510 - RNA, 19 nt, artificial
  Oligomer
aacuuucaccagcaaauuc

SEQ ID NO: 1511 - RNA, 19 nt, artificial
  Oligomer
gucgaucuucuucaccugc

SEQ ID NO: 1512 - RNA, 19 nt, artificial
  Oligomer
augucuugacaaacuguca

SEQ ID NO: 1513 - RNA, 19 nt, artificial
  Oligomer
gaaaaaaaucuaaagaugc

SEQ ID NO: 1514 - RNA, 19 nt, artificial
  Oligomer
cucucuuuuaauguccugu

SEQ ID NO: 1515 - RNA, 19 nt, artificial
  Oligomer
uuguuccaagaagagcuua

SEQ ID NO: 1516 - RNA, 19 nt, artificial
  Oligomer
ccuaaugcuucucccuucc

SEQ ID NO: 1517 - RNA, 19 nt, artificial
  Oligomer
aaggaaauaugucuugaca

SEQ ID NO: 1518 - RNA, 19 nt, artificial
  Oligomer
uucuguggauuuuguaauu

SEQ ID NO: 1519 - RNA, 19 nt, artificial
  Oligomer
cauuagcucaauaacauac

SEQ ID NO: 1520 - RNA, 19 nt, artificial
  Oligomer
agagagugucaaaaaccac

SEQ ID NO: 1521 - RNA, 19 nt, artificial
  Oligomer
ucccaucccuucccaaacu

SEQ ID NO: 1522 - RNA, 19 nt, artificial
  Oligomer
aguugaagaagacgaagag

SEQ ID NO: 1523 - RNA, 19 nt, artificial
  Oligomer
aagugcuaacuuucaccag

SEQ ID NO: 1524 - RNA, 19 nt, artificial
  Oligomer
agguauuuucccaaugaau

SEQ ID NO: 1525 - RNA, 19 nt, artificial
  Oligomer
ugcaaguaacaucuucugu

SEQ ID NO: 1526 - RNA, 19 nt, artificial
  Oligomer
guggauuuuguaauuccua

SEQ ID NO: 1527 - RNA, 19 nt, artificial
  Oligomer
aaauucacgugggcacuug

SEQ ID NO: 1528 - RNA, 19 nt, artificial
  Oligomer
aagcaaaaggaaauauguc

SEQ ID NO: 1529 - RNA, 19 nt, artificial
  Oligomer
aaaggaaauaugucuugac

SEQ ID NO: 1530 - RNA, 19 nt, artificial
  Oligomer
agcagaaaucauuacuuag

SEQ ID NO: 1531 - RNA, 19 nt, artificial
  Oligomer
auguccugucuucaauuga

SEQ ID NO: 1532 - RNA, 19 nt, artificial
  Oligomer
cuaacuuucaccagcaaau

SEQ ID NO: 1533 - RNA, 19 nt, artificial
  Oligomer
auacuagacaacagaagua

SEQ ID NO: 1534 - RNA, 19 nt, artificial
  Oligomer
ugugcaaaugcacagugug

SEQ ID NO: 1535 - RNA, 19 nt, artificial
  Oligomer
ggcuuuucucuuugccucg

SEQ ID NO: 1536 - RNA, 19 nt, artificial
  Oligomer
agggacaugaugaagaggu

SEQ ID NO: 1537 - RNA, 19 nt, artificial
  Oligomer
ucauuagcucaauaacaua

SEQ ID NO: 1538 - RNA, 19 nt, artificial
  Oligomer
augaaucauuagcucaaua

SEQ ID NO: 1539 - RNA, 19 nt, artificial
  Oligomer
ucucucgcucucuuuuaau

SEQ ID NO: 1540 - RNA, 19 nt, artificial
  Oligomer
aauguccugucuucaauug

SEQ ID NO: 1541 - RNA, 19 nt, artificial
  Oligomer
uaauauggauacaguuaca

SEQ ID NO: 1542 - RNA, 19 nt, artificial
  Oligomer
gaacuguuucucucucucg

SEQ ID NO: 1543 - RNA, 19 nt, artificial
  Oligomer
aauuucuuuuugugcaagu

SEQ ID NO: 1544 - RNA, 19 nt, artificial
  Oligomer
ccacaugugcaguaaucug

SEQ ID NO: 1545 - RNA, 19 nt, artificial
  Oligomer
ugacgaagucgcagcacuu

SEQ ID NO: 1546 - RNA, 19 nt, artificial
  Oligomer
uuugugcaaguaacaucuu

SEQ ID NO: 1547 - RNA, 19 nt, artificial
  Oligomer
aaagaaggccggaccacaa

SEQ ID NO: 1548 - RNA, 19 nt, artificial
  Oligomer
gugugagguagaaaucccu

SEQ ID NO: 1549 - RNA, 19 nt, artificial
  Oligomer
guauuuauugcacauggac

SEQ ID NO: 1550 - RNA, 19 nt, artificial
  Oligomer
aaguagaguuugaauuuua

SEQ ID NO: 1551 - RNA, 19 nt, artificial
  Oligomer
uaacuuucaccagcaaauu

SEQ ID NO: 1552 - RNA, 19 nt, artificial
  Oligomer
ugauucagacgaggauugu

SEQ ID NO: 1553 - RNA, 19 nt, artificial
  Oligomer
auucacgugggcacuugga

SEQ ID NO: 1554 - RNA, 19 nt, artificial
  Oligomer
aguuaguugcaccagagua

SEQ ID NO: 1555 - RNA, 19 nt, artificial
  Oligomer
ucucuggaaagcaaaagga

SEQ ID NO: 1556 - RNA, 19 nt, artificial
  Oligomer
acaaggaaagcaagguggg

SEQ ID NO: 1557 - RNA, 19 nt, artificial
  Oligomer
cugucuucaauugacagag

SEQ ID NO: 1558 - RNA, 19 nt, artificial
  Oligomer
uuagcucaauaacauacua

SEQ ID NO: 1559 - RNA, 19 nt, artificial
  Oligomer
acaacagaaguagaguuug

SEQ ID NO: 1560 - RNA, 19 nt, artificial
  Oligomer
acagaaguagaguuugaau

SEQ ID NO: 1561 - RNA, 19 nt, artificial
  Oligomer
cucccuuuaaaaaauauuu

SEQ ID NO: 1562 - RNA, 19 nt, artificial
  Oligomer
guugaagaagacgaagagg

SEQ ID NO: 1563 - RNA, 19 nt, artificial
  Oligomer
uaacagcagaaaucauuac

SEQ ID NO: 1564 - RNA, 19 nt, artificial
  Oligomer
gugaagacgcccaugauga

SEQ ID NO: 1565 - RNA, 19 nt, artificial
  Oligomer
uccauccuuucucuuugcu

SEQ ID NO: 1566 - RNA, 19 nt, artificial
  Oligomer
caguaaucugaacuguuuc

SEQ ID NO: 1567 - RNA, 19 nt, artificial
  Oligomer
cuacaccuuggauuccgag

SEQ ID NO: 1568 - RNA, 19 nt, artificial
  Oligomer
ucaccugcuaucggucuua

SEQ ID NO: 1569 - RNA, 19 nt, artificial
  Oligomer
uaucugcugugcaaaugca

SEQ ID NO: 1570 - RNA, 19 nt, artificial
  Oligomer
cuuccaacuaauauugaua

SEQ ID NO: 1571 - RNA, 19 nt, artificial
  Oligomer
uguuccaagaagagcuuaa

SEQ ID NO: 1572 - RNA, 19 nt, artificial
  Oligomer
aggaaauaugucuugacaa

SEQ ID NO: 1573 - RNA, 19 nt, artificial
  Oligomer
aguaaucugaacuguuucu

SEQ ID NO: 1574 - RNA, 19 nt, artificial
  Oligomer
ucucuuugccucggaugau

SEQ ID NO: 1575 - RNA, 19 nt, artificial
  Oligomer
gcaaguaacaucuucugug

SEQ ID NO: 1576 - RNA, 19 nt, artificial
  Oligomer
ugccuccauccuuucucuu

SEQ ID NO: 1577 - RNA, 19 nt, artificial
  Oligomer
uaacaucuucuguggauuu

SEQ ID NO: 1578 - RNA, 19 nt, artificial
  Oligomer
uccuuucucuuugcuuuca

SEQ ID NO: 1579 - RNA, 19 nt, artificial
  Oligomer
gaaauaugucuugacaaac

SEQ ID NO: 1580 - RNA, 19 nt, artificial
  Oligomer
guagaaggagacuacggac

SEQ ID NO: 1581 - RNA, 19 nt, artificial
  Oligomer
ugugcuucauugguauuua

SEQ ID NO: 1582 - RNA, 19 nt, artificial
  Oligomer
agaaguagaguuugaauuu

SEQ ID NO: 1583 - RNA, 19 nt, artificial
  Oligomer
ucuggaaagcaaaaggaaa

SEQ ID NO: 1584 - RNA, 19 nt, artificial
  Oligomer
acagcagaaaucauuacuu

SEQ ID NO: 1585 - RNA, 19 nt, artificial
  Oligomer
ucauaacagcagaaaucau

SEQ ID NO: 1586 - RNA, 19 nt, artificial
  Oligomer
cagcugucgaucuucuuca

SEQ ID NO: 1587 - RNA, 19 nt, artificial
  Oligomer
agaguauaaauacuuggua

SEQ ID NO: 1588 - RNA, 19 nt, artificial
  Oligomer
aagaggaaguagaauuuac

SEQ ID NO: 1589 - RNA, 19 nt, artificial
  Oligomer
uccuuccaacuaauauuga

SEQ ID NO: 1590 - RNA, 19 nt, artificial
  Oligomer
agucacaugucacagagag

SEQ ID NO: 1591 - RNA, 19 nt, artificial
  Oligomer
caccagaguauaaauacuu

SEQ ID NO: 1592 - RNA, 19 nt, artificial
  Oligomer
agaggaaguagaauuuaca

SEQ ID NO: 1593 - RNA, 19 nt, artificial
  Oligomer
cuaacacugugcaaaaaug

SEQ ID NO: 1594 - RNA, 19 nt, artificial
  Oligomer
aaugaaauuucucuggaaa

SEQ ID NO: 1595 - RNA, 19 nt, artificial
  Oligomer
aaggaguauaaaaagguau

SEQ ID NO: 1596 - RNA, 19 nt, artificial
  Oligomer
aacagaaguagaguuugaa

SEQ ID NO: 1597 - RNA, 19 nt, artificial
  Oligomer
auggaccaauuccucacac

SEQ ID NO: 1598 - RNA, 19 nt, artificial
  Oligomer
aaaaugaaauuucucugga

SEQ ID NO: 1599 - RNA, 19 nt, artificial
  Oligomer
agcuguuuaauauaaacaa

SEQ ID NO: 1600 - RNA, 19 nt, artificial
  Oligomer
aauuucucuggaaagcaaa

SEQ ID NO: 1601 - RNA, 19 nt, artificial
  Oligomer
aaaaaaaucuaaagaugca

SEQ ID NO: 1602 - RNA, 19 nt, artificial
  Oligomer
ucucagagagugucaaaaa

SEQ ID NO: 1603 - RNA, 19 nt, artificial
  Oligomer
cugcugugcaaaugcacag

SEQ ID NO: 1604 - RNA, 19 nt, artificial
  Oligomer
cugaacuguuucucucucu

SEQ ID NO: 1605 - RNA, 19 nt, artificial
  Oligomer
guauuuucccaaugaauca

SEQ ID NO: 1606 - RNA, 19 nt, artificial
  Oligomer
auacauaaauaagcuguuu

SEQ ID NO: 1607 - RNA, 19 nt, artificial
  Oligomer
cacguagaaggagacuacg

SEQ ID NO: 1608 - RNA, 19 nt, artificial
  Oligomer
gauuuuguaauuccuaaca

SEQ ID NO: 1609 - RNA, 19 nt, artificial
  Oligomer
auuucuuuuugugcaagua

SEQ ID NO: 1610 - RNA, 19 nt, artificial
  Oligomer
guaguuaguugcaccagag

SEQ ID NO: 1611 - RNA, 19 nt, artificial
  Oligomer
ccucggaugauucagacga

SEQ ID NO: 1612 - RNA, 19 nt, artificial
  Oligomer
cuucccaaacuuuccuuuu

SEQ ID NO: 1613 - RNA, 19 nt, artificial
  Oligomer
cuucuguggauuuuguaau

SEQ ID NO: 1614 - RNA, 19 nt, artificial
  Oligomer
cuuucuaucugcugugcaa

SEQ ID NO: 1615 - RNA, 19 nt, artificial
  Oligomer
cacaagugcuaacuuucac

SEQ ID NO: 1616 - RNA, 19 nt, artificial
  Oligomer
aacaaggaacaucagcaag

SEQ ID NO: 1617 - RNA, 19 nt, artificial
  Oligomer
cauugguauuuauugcaca

SEQ ID NO: 1618 - RNA, 19 nt, artificial
  Oligomer
guagaguuugaauuuuauu

SEQ ID NO: 1619 - RNA, 19 nt, artificial
  Oligomer
gugagguagaaaucccuca

SEQ ID NO: 1620 - RNA, 19 nt, artificial
  Oligomer
cucuuugccucggaugauu

SEQ ID NO: 1621 - RNA, 19 nt, artificial
  Oligomer
agagucacaugucacagag

SEQ ID NO: 1622 - RNA, 19 nt, artificial
  Oligomer
uccaacuaauauugauaca

SEQ ID NO: 1623 - RNA, 19 nt, artificial
  Oligomer
aaagguauuuucccaauga

SEQ ID NO: 1624 - RNA, 19 nt, artificial
  Oligomer
aguagaguuugaauuuuau

SEQ ID NO: 1625 - RNA, 19 nt, artificial
  Oligomer
agaagagcuuaacauuucu

SEQ ID NO: 1626 - RNA, 19 nt, artificial
  Oligomer
ugaugaagagguuggugag

SEQ ID NO: 1627 - RNA, 19 nt, artificial
  Oligomer
aaaucuaaagaugcaucac

SEQ ID NO: 1628 - RNA, 19 nt, artificial
  Oligomer
caaaaggaaauaugucuug

SEQ ID NO: 1629 - RNA, 19 nt, artificial
  Oligomer
gaucuucuucaccugcuuc

SEQ ID NO: 1630 - RNA, 19 nt, artificial
  Oligomer
aaaaagguauuuucccaau

SEQ ID NO: 1631 - RNA, 19 nt, artificial
  Oligomer
cugucauucuccucucucu

SEQ ID NO: 1632 - RNA, 19 nt, artificial
  Oligomer
acaugugcaguaaucugaa

SEQ ID NO: 1633 - RNA, 19 nt, artificial
  Oligomer
agaaaucccucagccugac

SEQ ID NO: 1634 - RNA, 19 nt, artificial
  Oligomer
gauucagacgaggauugug

SEQ ID NO: 1635 - RNA, 19 nt, artificial
  Oligomer
cugcuaucggucuuaagua

SEQ ID NO: 1636 - RNA, 19 nt, artificial
  Oligomer
aaaaggaaauaugucuuga

SEQ ID NO: 1637 - RNA, 19 nt, artificial
  Oligomer
gcugucgaucuucuucacc

SEQ ID NO: 1638 - RNA, 19 nt, artificial
  Oligomer
caagaagagcuuaacauuu

SEQ ID NO: 1639 - RNA, 19 nt, artificial
  Oligomer
cagugugagguagaaaucc

SEQ ID NO: 1640 - RNA, 19 nt, artificial
  Oligomer
agagcuuaacauuucuuga

SEQ ID NO: 1641 - RNA, 19 nt, artificial
  Oligomer
cucucgcucucuuuuaaug

SEQ ID NO: 1642 - RNA, 19 nt, artificial
  Oligomer
caguugaagaagacgaaga

SEQ ID NO: 1643 - RNA, 19 nt, artificial
  Oligomer
cuuuucucuuugccucgga

SEQ ID NO: 1644 - RNA, 19 nt, artificial
  Oligomer
auugcacauggaccaauuc

SEQ ID NO: 1645 - RNA, 19 nt, artificial
  Oligomer
accaugauaaaggaguaua

SEQ ID NO: 1646 - RNA, 19 nt, artificial
  Oligomer
auugugcuucauugguauu

SEQ ID NO: 1647 - RNA, 19 nt, artificial
  Oligomer
caagugcuaacuuucacca

SEQ ID NO: 1648 - RNA, 19 nt, artificial
  Oligomer
guuaguugcaccagaguau

SEQ ID NO: 1649 - RNA, 19 nt, artificial
  Oligomer
cggugagcagcaugaagau

SEQ ID NO: 1650 - RNA, 19 nt, artificial
  Oligomer
gcaugaagaucucaaugaa

SEQ ID NO: 1651 - RNA, 19 nt, artificial
  Oligomer
ggguuaaggugaugcccaa

SEQ ID NO: 1652 - RNA, 19 nt, artificial
  Oligomer
caacauucaugaagacuga

SEQ ID NO: 1653 - RNA, 19 nt, artificial
  Oligomer
gguagaaacugaccacaua

SEQ ID NO: 1654 - RNA, 19 nt, artificial
  Oligomer
gcaggaagguagaaacuga

SEQ ID NO: 1655 - RNA, 19 nt, artificial
  Oligomer
cgggugcuuugaagcagaa

SEQ ID NO: 1656 - RNA, 19 nt, artificial
  Oligomer
gcaacuggaccauggaaaa

SEQ ID NO: 1657 - RNA, 19 nt, artificial
  Oligomer
caugcuucuacgauauaaa

SEQ ID NO: 1658 - RNA, 19 nt, artificial
  Oligomer
ggaacaucuuuaaccgaau

SEQ ID NO: 1659 - RNA, 19 nt, artificial
  Oligomer
ucugauucuucuaaauuaa

SEQ ID NO: 1660 - RNA, 19 nt, artificial
  Oligomer
gcagcaugaagaucucaau

SEQ ID NO: 1661 - RNA, 19 nt, artificial
  Oligomer
cugauucuucuaaauuaaa

SEQ ID NO: 1662 - RNA, 19 nt, artificial
  Oligomer
caaggaagaucauuaagga

SEQ ID NO: 1663 - RNA, 19 nt, artificial
  Oligomer
cgcuguugugaguggaaga

SEQ ID NO: 1664 - RNA, 19 nt, artificial
  Oligomer
gguguuuuugcaaaagcaa

SEQ ID NO: 1665 - RNA, 19 nt, artificial
  Oligomer
cgagaaaggaaauauggga

SEQ ID NO: 1666 - RNA, 19 nt, artificial
  Oligomer
cuauguagguaaauucuua

SEQ ID NO: 1667 - RNA, 19 nt, artificial
  Oligomer
ccggguaaaugcagagcua

SEQ ID NO: 1668 - RNA, 19 nt, artificial
  Oligomer
gguaaauucuuaauguuca

SEQ ID NO: 1669 - RNA, 19 nt, artificial
  Oligomer
gcaaaggugucaucuucua

SEQ ID NO: 1670 - RNA, 19 nt, artificial
  Oligomer
gcccaaugcuauugugcaa

SEQ ID NO: 1671 - RNA, 19 nt, artificial
  Oligomer
guaugagugugaaugauca

SEQ ID NO: 1672 - RNA, 19 nt, artificial
  Oligomer
ugcuauggaacaucuuuaa

SEQ ID NO: 1673 - RNA, 19 nt, artificial
  Oligomer
agaggaaagggaaggagga

SEQ ID NO: 1674 - RNA, 19 nt, artificial
  Oligomer
gggcacagaagugauucaa

SEQ ID NO: 1675 - RNA, 19 nt, artificial
  Oligomer
gcugcaugcuucuacgaua

SEQ ID NO: 1676 - RNA, 19 nt, artificial
  Oligomer
gaggccucagaaauuacua

SEQ ID NO: 1677 - RNA, 19 nt, artificial
  Oligomer
ugaagaucucaaugaagua

SEQ ID NO: 1678 - RNA, 19 nt, artificial
  Oligomer
gcaugcuucuacgauauaa

SEQ ID NO: 1679 - RNA, 19 nt, artificial
  Oligomer
cagcaacuggaccauggaa

SEQ ID NO: 1680 - RNA, 19 nt, artificial
  Oligomer
aaauucugauucuucuaaa

SEQ ID NO: 1681 - RNA, 19 nt, artificial
  Oligomer
gccuggaaauagacucaga

SEQ ID NO: 1682 - RNA, 19 nt, artificial
  Oligomer
ggguaaaugcagagcuaca

SEQ ID NO: 1683 - RNA, 19 nt, artificial
  Oligomer
gugcuauggaacaucuuua

SEQ ID NO: 1684 - RNA, 19 nt, artificial
  Oligomer
gcacagaagugauucaacu

SEQ ID NO: 1685 - RNA, 19 nt, artificial
  Oligomer
ggguaaaggagcauuuuuu

SEQ ID NO: 1686 - RNA, 19 nt, artificial
  Oligomer
uagcaaggaagaucauuaa

SEQ ID NO: 1687 - RNA, 19 nt, artificial
  Oligomer
aguugguguuuuugcaaaa

SEQ ID NO: 1688 - RNA, 19 nt, artificial
  Oligomer
ugaucaaguccuuugugaa

SEQ ID NO: 1689 - RNA, 19 nt, artificial
  Oligomer
cacaguugguguuuuugca

SEQ ID NO: 1690 - RNA, 19 nt, artificial
  Oligomer
cacgcuguugugaguggaa

SEQ ID NO: 1691 - RNA, 19 nt, artificial
  Oligomer
aguuacuuaucaagcugaa

SEQ ID NO: 1692 - RNA, 19 nt, artificial
  Oligomer
guccgaggccucagaaauu

SEQ ID NO: 1693 - RNA, 19 nt, artificial
  Oligomer
ugguguuuuugcaaaagca

SEQ ID NO: 1694 - RNA, 19 nt, artificial
  Oligomer
aaggaaauaugggaaagau

SEQ ID NO: 1695 - RNA, 19 nt, artificial
  Oligomer
gggauugugcuauggaaca

SEQ ID NO: 1696 - RNA, 19 nt, artificial
  Oligomer
ugcguaaugugcgugugaa

SEQ ID NO: 1697 - RNA, 19 nt, artificial
  Oligomer
aauucuuaauguucacaua

SEQ ID NO: 1698 - RNA, 19 nt, artificial
  Oligomer
gagaaaggaaauaugggaa

SEQ ID NO: 1699 - RNA, 19 nt, artificial
  Oligomer
ccuggaaauagacucagau

SEQ ID NO: 1700 - RNA, 19 nt, artificial
  Oligomer
ugcgugagaggaaagggaa

SEQ ID NO: 1701 - RNA, 19 nt, artificial
  Oligomer
ggaaauagacucagauuuu

SEQ ID NO: 1702 - RNA, 19 nt, artificial
  Oligomer
gagcagucaggaacuggua

SEQ ID NO: 1703 - RNA, 19 nt, artificial
  Oligomer
acuggaccauggaaaaagu

SEQ ID NO: 1704 - RNA, 19 nt, artificial
  Oligomer
cggcaggaagguagaaacu

SEQ ID NO: 1705 - RNA, 19 nt, artificial
  Oligomer
uaugagugugaaugaucaa

SEQ ID NO: 1706 - RNA, 19 nt, artificial
  Oligomer
uucugauucuucuaaauua

SEQ ID NO: 1707 - RNA, 19 nt, artificial
  Oligomer
gguaaaggagcauuuuuuu

SEQ ID NO: 1708 - RNA, 19 nt, artificial
  Oligomer
guucacauagugaaauaaa

SEQ ID NO: 1709 - RNA, 19 nt, artificial
  Oligomer
uaauguucacauagugaaa

SEQ ID NO: 1710 - RNA, 19 nt, artificial
  Oligomer
ccuugggcacagaagugau

SEQ ID NO: 1711 - RNA, 19 nt, artificial
  Oligomer
aggugaugcccaaugcuau

SEQ ID NO: 1712 - RNA, 19 nt, artificial
  Oligomer
cgaggccucagaaauuacu

SEQ ID NO: 1713 - RNA, 19 nt, artificial
  Oligomer
aagcaacugcacaagacaa

SEQ ID NO: 1714 - RNA, 19 nt, artificial
  Oligomer
gaccauggaaaaagucaga

SEQ ID NO: 1715 - RNA, 19 nt, artificial
  Oligomer
aauucugauucuucuaaau

SEQ ID NO: 1716 - RNA, 19 nt, artificial
  Oligomer
gguaaaugcagagcuacaa

SEQ ID NO: 1717 - RNA, 19 nt, artificial
  Oligomer
cuacaagcacgcucuaaca

SEQ ID NO: 1718 - RNA, 19 nt, artificial
  Oligomer
gaauauuuucaacuaugua

SEQ ID NO: 1719 - RNA, 19 nt, artificial
  Oligomer
guguaugagugugaaugau

SEQ ID NO: 1720 - RNA, 19 nt, artificial
  Oligomer
gcguaaugugcgugugaag

SEQ ID NO: 1721 - RNA, 19 nt, artificial
  Oligomer
gaggaggucgaauggguaa

SEQ ID NO: 1722 - RNA, 19 nt, artificial
  Oligomer
guagguaaauucuuaaugu

SEQ ID NO: 1723 - RNA, 19 nt, artificial
  Oligomer
agacggcaggaagguagaa

SEQ ID NO: 1724 - RNA, 19 nt, artificial
  Oligomer
ccuuugugaauauuuucaa

SEQ ID NO: 1725 - RNA, 19 nt, artificial
  Oligomer
gucaggaacugguauccga

SEQ ID NO: 1726 - RNA, 19 nt, artificial
  Oligomer
gaauagcggucgccgaaau

SEQ ID NO: 1727 - RNA, 19 nt, artificial
  Oligomer
cggcaaaggugucaucuuc

SEQ ID NO: 1728 - RNA, 19 nt, artificial
  Oligomer
caauagcaaggaagaucau

SEQ ID NO: 1729 - RNA, 19 nt, artificial
  Oligomer
aggucgaauggguaaagga

SEQ ID NO: 1730 - RNA, 19 nt, artificial
  Oligomer
caguugguguuuuugcaaa

SEQ ID NO: 1731 - RNA, 19 nt, artificial
  Oligomer
ggaggagucugcguaaugu

SEQ ID NO: 1732 - RNA, 19 nt, artificial
  Oligomer
uggaacaucuuuaaccgaa

SEQ ID NO: 1733 - RNA, 19 nt, artificial
  Oligomer
ggugaugcccaaugcuauu

SEQ ID NO: 1734 - RNA, 19 nt, artificial
  Oligomer
cugcguaaugugcguguga

SEQ ID NO: 1735 - RNA, 19 nt, artificial
  Oligomer
agaggaggucgaaugggua

SEQ ID NO: 1736 - RNA, 19 nt, artificial
  Oligomer
gacggcaggaagguagaaa

SEQ ID NO: 1737 - RNA, 19 nt, artificial
  Oligomer
ggagcauuuuuuuauucag

SEQ ID NO: 1738 - RNA, 19 nt, artificial
  Oligomer
gcaccaugaucacgcuguu

SEQ ID NO: 1739 - RNA, 19 nt, artificial
  Oligomer
uauguagguaaauucuuaa

SEQ ID NO: 1740 - RNA, 19 nt, artificial
  Oligomer
ggauugugcuauggaacau

SEQ ID NO: 1741 - RNA, 19 nt, artificial
  Oligomer
caacuggaccauggaaaaa

SEQ ID NO: 1742 - RNA, 19 nt, artificial
  Oligomer
cguaaugugcgugugaaga

SEQ ID NO: 1743 - RNA, 19 nt, artificial
  Oligomer
aguccgaggccucagaaau

SEQ ID NO: 1744 - RNA, 19 nt, artificial
  Oligomer
uucacauagugaaauaaau

SEQ ID NO: 1745 - RNA, 19 nt, artificial
  Oligomer
agcagcaugaagaucucaa

SEQ ID NO: 1746 - RNA, 19 nt, artificial
  Oligomer
acugguauccgaucagaga

SEQ ID NO: 1747 - RNA, 19 nt, artificial
  Oligomer
aagacggcaggaagguaga

SEQ ID NO: 1748 - RNA, 19 nt, artificial
  Oligomer
ggagaugcugcaugcuucu

SEQ ID NO: 1749 - RNA, 19 nt, artificial
  Oligomer
agaaaggaaauaugggaaa

SEQ ID NO: 1750 - RNA, 19 nt, artificial
  Oligomer
gaucagagagugagacaga

SEQ ID NO: 1751 - RNA, 19 nt, artificial
  Oligomer
ugggcacagaagugauuca

SEQ ID NO: 1752 - RNA, 19 nt, artificial
  Oligomer
uggagaaaauaugacugga

SEQ ID NO: 1753 - RNA, 19 nt, artificial
  Oligomer
cagaagugauucaacucuu

SEQ ID NO: 1754 - RNA, 19 nt, artificial
  Oligomer
ggaccauggaaaaagucag

SEQ ID NO: 1755 - RNA, 19 nt, artificial
  Oligomer
aaagcaacugcacaagaca

SEQ ID NO: 1756 - RNA, 19 nt, artificial
  Oligomer
aguccuuugugaauauuuu

SEQ ID NO: 1757 - RNA, 19 nt, artificial
  Oligomer
ggaagguagaaacugacca

SEQ ID NO: 1758 - RNA, 19 nt, artificial
  Oligomer
caggaagguagaaacugac

SEQ ID NO: 1759 - RNA, 19 nt, artificial
  Oligomer
acggcaaaggugucaucuu

SEQ ID NO: 1760 - RNA, 19 nt, artificial
  Oligomer
uuucaacuauguagguaaa

SEQ ID NO: 1761 - RNA, 19 nt, artificial
  Oligomer
ugcaaaagcaacugcacaa

SEQ ID NO: 1762 - RNA, 19 nt, artificial
  Oligomer
uccgaggccucagaaauua

SEQ ID NO: 1763 - RNA, 19 nt, artificial
  Oligomer
acggugagcagcaugaaga

SEQ ID NO: 1764 - RNA, 19 nt, artificial
  Oligomer
gagcuacaagcacgcucua

SEQ ID NO: 1765 - RNA, 19 nt, artificial
  Oligomer
agcugaaagacggcaggaa

SEQ ID NO: 1766 - RNA, 19 nt, artificial
  Oligomer
cuaugaagcuauuggucuu

SEQ ID NO: 1767 - RNA, 19 nt, artificial
  Oligomer
gaacugguauccgaucaga

SEQ ID NO: 1768 - RNA, 19 nt, artificial
  Oligomer
caaaagcaacugcacaaga

SEQ ID NO: 1769 - RNA, 19 nt, artificial
  Oligomer
cgaaauguuccggugugga

SEQ ID NO: 1770 - RNA, 19 nt, artificial
  Oligomer
cauggaaaaagucagacga

SEQ ID NO: 1771 - RNA, 19 nt, artificial
  Oligomer
ggugucaucuucuaccuca

SEQ ID NO: 1772 - RNA, 19 nt, artificial
  Oligomer
auccgaucagagagugaga

SEQ ID NO: 1773 - RNA, 19 nt, artificial
  Oligomer
aggccucagaaauuacuau

SEQ ID NO: 1774 - RNA, 19 nt, artificial
  Oligomer
gaaagacggcaggaaggua

SEQ ID NO: 1775 - RNA, 19 nt, artificial
  Oligomer
cugcaugcuucuacgauau

SEQ ID NO: 1776 - RNA, 19 nt, artificial
  Oligomer
aaaggagcauuuuuuuauu

SEQ ID NO: 1777 - RNA, 19 nt, artificial
  Oligomer
ggucuuguggacaguaguu

SEQ ID NO: 1778 - RNA, 19 nt, artificial
  Oligomer
agaucauuaaggacgguga

SEQ ID NO: 1779 - RNA, 19 nt, artificial
  Oligomer
uagguaaauucuuaauguu

SEQ ID NO: 1780 - RNA, 19 nt, artificial
  Oligomer
guuacuuaucaagcugaaa

SEQ ID NO: 1781 - RNA, 19 nt, artificial
  Oligomer
gaucaaguccuuugugaau

SEQ ID NO: 1782 - RNA, 19 nt, artificial
  Oligomer
ccaaacuauucaacauuca

SEQ ID NO: 1783 - RNA, 19 nt, artificial
  Oligomer
gcaaguuacuuaucaagcu

SEQ ID NO: 1784 - RNA, 19 nt, artificial
  Oligomer
uauucaacauucaugaaga

SEQ ID NO: 1785 - RNA, 19 nt, artificial
  Oligomer
gcccacaguugguguuuuu

SEQ ID NO: 1786 - RNA, 19 nt, artificial
  Oligomer
ccgaucagagagugagaca

SEQ ID NO: 1787 - RNA, 19 nt, artificial
  Oligomer
cccgaauaccucagcaacu

SEQ ID NO: 1788 - RNA, 19 nt, artificial
  Oligomer
caaacuauucaacauucau

SEQ ID NO: 1789 - RNA, 19 nt, artificial
  Oligomer
uggaaaaagucagacgaga

SEQ ID NO: 1790 - RNA, 19 nt, artificial
  Oligomer
agagugagacagaguccga

SEQ ID NO: 1791 - RNA, 19 nt, artificial
  Oligomer
cuggaaauagacucagauu

SEQ ID NO: 1792 - RNA, 19 nt, artificial
  Oligomer
uggucuuguggacaguagu

SEQ ID NO: 1793 - RNA, 19 nt, artificial
  Oligomer
acuauucaacauucaugaa

SEQ ID NO: 1794 - RNA, 19 nt, artificial
  Oligomer
ggucgaauggguaaaggag

SEQ ID NO: 1795 - RNA, 19 nt, artificial
  Oligomer
ccgaggccucagaaauuac

SEQ ID NO: 1796 - RNA, 19 nt, artificial
  Oligomer
ucagcaacuggaccaugga

SEQ ID NO: 1797 - RNA, 19 nt, artificial
  Oligomer
aaaggaaauaugggaaaga

SEQ ID NO: 1798 - RNA, 19 nt, artificial
  Oligomer
ggcacagaagugauucaac

SEQ ID NO: 1799 - RNA, 19 nt, artificial
  Oligomer
aacauucaugaagacugaa

SEQ ID NO: 1800 - RNA, 19 nt, artificial
  Oligomer
ugugaaugaucaaguccuu

SEQ ID NO: 1801 - RNA, 19 nt, artificial
  Oligomer
agguagaaacugaccacau

SEQ ID NO: 1802 - RNA, 19 nt, artificial
  Oligomer
caugaagaucucaaugaag

SEQ ID NO: 1803 - RNA, 19 nt, artificial
  Oligomer
gagucugcguaaugugcgu

SEQ ID NO: 1804 - RNA, 19 nt, artificial
  Oligomer
caagcacgcucuaacaucu

SEQ ID NO: 1805 - RNA, 19 nt, artificial
  Oligomer
ucaggaacugguauccgau

SEQ ID NO: 1806 - RNA, 19 nt, artificial
  Oligomer
ggcaaaggugucaucuucu

SEQ ID NO: 1807 - RNA, 19 nt, artificial
  Oligomer
gaauaccucagcaacugga

SEQ ID NO: 1808 - RNA, 19 nt, artificial
  Oligomer
gaaauaugggaaagauccu

SEQ ID NO: 1809 - RNA, 19 nt, artificial
  Oligomer
uaaugugcgugugaagaga

SEQ ID NO: 1810 - RNA, 19 nt, artificial
  Oligomer
aacuauucaacauucauga

SEQ ID NO: 1811 - RNA, 19 nt, artificial
  Oligomer
ucaaguccuuugugaauau

SEQ ID NO: 1812 - RNA, 19 nt, artificial
  Oligomer
gaaugaucaaguccuuugu

SEQ ID NO: 1813 - RNA, 19 nt, artificial
  Oligomer
gugucaucuucuaccucag

SEQ ID NO: 1814 - RNA, 19 nt, artificial
  Oligomer
ccaauagcaaggaagauca

SEQ ID NO: 1815 - RNA, 19 nt, artificial
  Oligomer
gauauaaaguugggaagga

SEQ ID NO: 1816 - RNA, 19 nt, artificial
  Oligomer
gagugugaaugaucaaguc

SEQ ID NO: 1817 - RNA, 19 nt, artificial
  Oligomer
ggguagagcaccaugauca

SEQ ID NO: 1818 - RNA, 19 nt, artificial
  Oligomer
uagugaaauaaauucugau

SEQ ID NO: 1819 - RNA, 19 nt, artificial
  Oligomer
ggccucagaaauuacuauu

SEQ ID NO: 1820 - RNA, 19 nt, artificial
  Oligomer
guaaaggagcauuuuuuua

SEQ ID NO: 1821 - RNA, 19 nt, artificial
  Oligomer
cuucuaccucagggacaaa

SEQ ID NO: 1822 - RNA, 19 nt, artificial
  Oligomer
gaucauuaaggacggugag

SEQ ID NO: 1823 - RNA, 19 nt, artificial
  Oligomer
ggagaaaauaugacuggag

SEQ ID NO: 1824 - RNA, 19 nt, artificial
  Oligomer
ugaaauaaauucugauucu

SEQ ID NO: 1825 - RNA, 19 nt, artificial
  Oligomer
ggcuggagaaaauaugacu

SEQ ID NO: 1826 - RNA, 19 nt, artificial
  Oligomer
uacuuaucaagcugaaaga

SEQ ID NO: 1827 - RNA, 19 nt, artificial
  Oligomer
uguucacauagugaaauaa

SEQ ID NO: 1828 - RNA, 19 nt, artificial
  Oligomer
ugagcagcaugaagaucuc

SEQ ID NO: 1829 - RNA, 19 nt, artificial
  Oligomer
cucagaaauuacuauuccu

SEQ ID NO: 1830 - RNA, 19 nt, artificial
  Oligomer
gugagaggaaagggaagga

SEQ ID NO: 1831 - RNA, 19 nt, artificial
  Oligomer
gguagagcaccaugaucac

SEQ ID NO: 1832 - RNA, 19 nt, artificial
  Oligomer
cccgagaaaggaaauaugg

SEQ ID NO: 1833 - RNA, 19 nt, artificial
  Oligomer
cauuaaggacggugagcag

SEQ ID NO: 1834 - RNA, 19 nt, artificial
  Oligomer
uggguaaaggagcauuuuu

SEQ ID NO: 1835 - RNA, 19 nt, artificial
  Oligomer
caauccguuggagucagca

SEQ ID NO: 1836 - RNA, 19 nt, artificial
  Oligomer
ucgaauggguaaaggagca

SEQ ID NO: 1837 - RNA, 19 nt, artificial
  Oligomer
aaggaggaggucccgaaua

SEQ ID NO: 1838 - RNA, 19 nt, artificial
  Oligomer
gagcagcaugaagaucuca

SEQ ID NO: 1839 - RNA, 19 nt, artificial
  Oligomer
gaaauaaauucugauucuu

SEQ ID NO: 1840 - RNA, 19 nt, artificial
  Oligomer
cuacgauauaaaguuggga

SEQ ID NO: 1841 - RNA, 19 nt, artificial
  Oligomer
ggaaaaagucagacgagag

SEQ ID NO: 1842 - RNA, 19 nt, artificial
  Oligomer
ugugcuauggaacaucuuu

SEQ ID NO: 1843 - RNA, 19 nt, artificial
  Oligomer
guaaauucuuaauguucac

SEQ ID NO: 1844 - RNA, 19 nt, artificial
  Oligomer
ccaugaucacgcuguugug

SEQ ID NO: 1845 - RNA, 19 nt, artificial
  Oligomer
ucuucuaccucagggacaa

SEQ ID NO: 1846 - RNA, 19 nt, artificial
  Oligomer
gaggaggagucugcguaau

SEQ ID NO: 1847 - RNA, 19 nt, artificial
  Oligomer
uacgauauaaaguugggaa

SEQ ID NO: 1848 - RNA, 19 nt, artificial
  Oligomer
uaaggacggugagcagcau

SEQ ID NO: 1849 - RNA, 19 nt, artificial
  Oligomer
auaaauucugauucuucua

SEQ ID NO: 1850 - RNA, 19 nt, artificial
  Oligomer
aagcuauuggucuugugga

SEQ ID NO: 1851 - RNA, 19 nt, artificial
  Oligomer
agcaacuggaccauggaaa

SEQ ID NO: 1852 - RNA, 19 nt, artificial
  Oligomer
auguucacauagugaaaua

SEQ ID NO: 1853 - RNA, 19 nt, artificial
  Oligomer
gguuaaggugaugcccaau

SEQ ID NO: 1854 - RNA, 19 nt, artificial
  Oligomer
uugugaauauuuucaacua

SEQ ID NO: 1855 - RNA, 19 nt, artificial
  Oligomer
ggacaguaguuugcccaca

SEQ ID NO: 1856 - RNA, 19 nt, artificial
  Oligomer
acaguugguguuuuugcaa

SEQ ID NO: 1857 - RNA, 19 nt, artificial
  Oligomer
gcuuccggguaaaugcaga

SEQ ID NO: 1858 - RNA, 19 nt, artificial
  Oligomer
ccgagaaaggaaauauggg

SEQ ID NO: 1859 - RNA, 19 nt, artificial
  Oligomer
ugugaauauuuucaacuau

SEQ ID NO: 1860 - RNA, 19 nt, artificial
  Oligomer
ucaucuucuaccucaggga

SEQ ID NO: 1861 - RNA, 19 nt, artificial
  Oligomer
aauaaauucugauucuucu

SEQ ID NO: 1862 - RNA, 19 nt, artificial
  Oligomer
aaggugaugcccaaugcua

SEQ ID NO: 1863 - RNA, 19 nt, artificial
  Oligomer
aggagcauuuuuuuauuca

SEQ ID NO: 1864 - RNA, 19 nt, artificial
  Oligomer
aggacuacggcaaaggugu

SEQ ID NO: 1865 - RNA, 19 nt, artificial
  Oligomer
aggaggucgaauggguaaa

SEQ ID NO: 1866 - RNA, 19 nt, artificial
  Oligomer
agcauuuuuuuauucagca

SEQ ID NO: 1867 - RNA, 19 nt, artificial
  Oligomer
gugcaauccguuggaguca

SEQ ID NO: 1868 - RNA, 19 nt, artificial
  Oligomer
agugaaauaaauucugauu

SEQ ID NO: 1869 - RNA, 19 nt, artificial
  Oligomer
caguaguuugcccacaguu

SEQ ID NO: 1870 - RNA, 19 nt, artificial
  Oligomer
guauccgaucagagaguga

SEQ ID NO: 1871 - RNA, 19 nt, artificial
  Oligomer
gcuucuacgauauaaaguu

SEQ ID NO: 1872 - RNA, 19 nt, artificial
  Oligomer
cuuaauguucacauaguga

SEQ ID NO: 1873 - RNA, 19 nt, artificial
  Oligomer
uugugcuauggaacaucuu

SEQ ID NO: 1874 - RNA, 19 nt, artificial
  Oligomer
ucacauagugaaauaaauu

SEQ ID NO: 1875 - RNA, 19 nt, artificial
  Oligomer
gcuguugugaguggaagau

SEQ ID NO: 1876 - RNA, 19 nt, artificial
  Oligomer
aggaaauaugggaaagauc

SEQ ID NO: 1877 - RNA, 19 nt, artificial
  Oligomer
auaugacuggagcugcuaa

SEQ ID NO: 1878 - RNA, 19 nt, artificial
  Oligomer
ugaucacgcuguugugagu

SEQ ID NO: 1879 - RNA, 19 nt, artificial
  Oligomer
uagcggucgccgaaauguu

SEQ ID NO: 1880 - RNA, 19 nt, artificial
  Oligomer
auagugaaauaaauucuga

SEQ ID NO: 1881 - RNA, 19 nt, artificial
  Oligomer
ugcccaaugcuauugugca

SEQ ID NO: 1882 - RNA, 19 nt, artificial
  Oligomer
acggcaggaagguagaaac

SEQ ID NO: 1883 - RNA, 19 nt, artificial
  Oligomer
cuugggcacagaagugauu

SEQ ID NO: 1884 - RNA, 19 nt, artificial
  Oligomer
uggaccauggaaaaaguca

SEQ ID NO: 1885 - RNA, 19 nt, artificial
  Oligomer
auggaacaucuuuaaccga

SEQ ID NO: 1886 - RNA, 19 nt, artificial
  Oligomer
cgaauggguaaaggagcau

SEQ ID NO: 1887 - RNA, 19 nt, artificial
  Oligomer
cacagagcagucaggaacu

SEQ ID NO: 1888 - RNA, 19 nt, artificial
  Oligomer
uugcaaaagcaacugcaca

SEQ ID NO: 1889 - RNA, 19 nt, artificial
  Oligomer
auagcaaggaagaucauua

SEQ ID NO: 1890 - RNA, 19 nt, artificial
  Oligomer
uguugugaguggaagauug

SEQ ID NO: 1891 - RNA, 19 nt, artificial
  Oligomer
aaggugucaucuucuaccu

SEQ ID NO: 1892 - RNA, 19 nt, artificial
  Oligomer
ugcaugcuucuacgauaua

SEQ ID NO: 1893 - RNA, 19 nt, artificial
  Oligomer
acaguaguuugcccacagu

SEQ ID NO: 1894 - RNA, 19 nt, artificial
  Oligomer
gaagguagaaacugaccac

SEQ ID NO: 1895 - RNA, 19 nt, artificial
  Oligomer
cacgcucuaacaucugggu

SEQ ID NO: 1896 - RNA, 19 nt, artificial
  Oligomer
cagcaugaagaucucaaug

SEQ ID NO: 1897 - RNA, 19 nt, artificial
  Oligomer
ggaagaucauuaaggacgg

SEQ ID NO: 1898 - RNA, 19 nt, artificial
  Oligomer
agcaugaagaucucaauga

SEQ ID NO: 1899 - RNA, 19 nt, artificial
  Oligomer
gaggagucugcguaaugug

SEQ ID NO: 1900 - RNA, 19 nt, artificial
  Oligomer
aacuauguagguaaauucu

SEQ ID NO: 1901 - RNA, 19 nt, artificial
  Oligomer
gagaaaauaugacuggagc

SEQ ID NO: 1902 - RNA, 19 nt, artificial
  Oligomer
cuuugaagcagaagcuggu

SEQ ID NO: 1903 - RNA, 19 nt, artificial
  Oligomer
gaugcugcaugcuucuacg

SEQ ID NO: 1904 - RNA, 19 nt, artificial
  Oligomer
cgaucagagagugagacag

SEQ ID NO: 1905 - RNA, 19 nt, artificial
  Oligomer
uuaauguucacauagugaa

SEQ ID NO: 1906 - RNA, 19 nt, artificial
  Oligomer
caggagaugcugcaugcuu

SEQ ID NO: 1907 - RNA, 19 nt, artificial
  Oligomer
agagcagucaggaacuggu

SEQ ID NO: 1908 - RNA, 19 nt, artificial
  Oligomer
caacuauguagguaaauuc

SEQ ID NO: 1909 - RNA, 19 nt, artificial
  Oligomer
caucagucaauguucugga

SEQ ID NO: 1910 - RNA, 19 nt, artificial
  Oligomer
uggaaauagacucagauuu

SEQ ID NO: 1911 - RNA, 19 nt, artificial
  Oligomer
gaacaucuuuaaccgaaug

SEQ ID NO: 1912 - RNA, 19 nt, artificial
  Oligomer
caaaggugucaucuucuac

SEQ ID NO: 1913 - RNA, 19 nt, artificial
  Oligomer
ugaauauuuucaacuaugu

SEQ ID NO: 1914 - RNA, 19 nt, artificial
  Oligomer
ggaacugguauccgaucag

SEQ ID NO: 1915 - RNA, 19 nt, artificial
  Oligomer
caauguucuggagugauuu

SEQ ID NO: 1916 - RNA, 19 nt, artificial
  Oligomer
uaaauucugauucuucuaa

SEQ ID NO: 1917 - RNA, 19 nt, artificial
  Oligomer
uuuucaacuauguagguaa

SEQ ID NO: 1918 - RNA, 19 nt, artificial
  Oligomer
guagaaacugaccacauag

SEQ ID NO: 1919 - RNA, 19 nt, artificial
  Oligomer
auguagguaaauucuuaau

SEQ ID NO: 1920 - RNA, 19 nt, artificial
  Oligomer
ggaaauaugggaaagaucc

SEQ ID NO: 1921 - RNA, 19 nt, artificial
  Oligomer
gaaaggaaauaugggaaag

SEQ ID NO: 1922 - RNA, 19 nt, artificial
  Oligomer
ggaggucgaauggguaaag

SEQ ID NO: 1923 - RNA, 19 nt, artificial
  Oligomer
aauggguaaaggagcauuu

SEQ ID NO: 1924 - RNA, 19 nt, artificial
  Oligomer
aaauaugacuggagcugcu

SEQ ID NO: 1925 - RNA, 19 nt, artificial
  Oligomer
gacuacggcaaagguguca

SEQ ID NO: 1926 - RNA, 19 nt, artificial
  Oligomer
cauucaugaagacugaagc

SEQ ID NO: 1927 - RNA, 19 nt, artificial
  Oligomer
gaaauguuccgguguggag

SEQ ID NO: 1928 - RNA, 19 nt, artificial
  Oligomer
gcauuuuuuuauucagcag

SEQ ID NO: 1929 - RNA, 19 nt, artificial
  Oligomer
caaguccuuugugaauauu

SEQ ID NO: 1930 - RNA, 19 nt, artificial
  Oligomer
gacaguaguuugcccacag

SEQ ID NO: 1931 - RNA, 19 nt, artificial
  Oligomer
auggguaaaggagcauuuu

SEQ ID NO: 1932 - RNA, 19 nt, artificial
  Oligomer
gaaauuacuauuccuccca

SEQ ID NO: 1933 - RNA, 19 nt, artificial
  Oligomer
gaaauagacucagauuuug

SEQ ID NO: 1934 - RNA, 19 nt, artificial
  Oligomer
aggaacugguauccgauca

SEQ ID NO: 1935 - RNA, 19 nt, artificial
  Oligomer
agcagucaggaacugguau

SEQ ID NO: 1936 - RNA, 19 nt, artificial
  Oligomer
accucagggacaaaguggu

SEQ ID NO: 1937 - RNA, 19 nt, artificial
  Oligomer
cauuuuuuuauucagcaga

SEQ ID NO: 1938 - RNA, 19 nt, artificial
  Oligomer
gaagaucauuaaggacggu

SEQ ID NO: 1939 - RNA, 19 nt, artificial
  Oligomer
gugcuuugaagcagaagcu

SEQ ID NO: 1940 - RNA, 19 nt, artificial
  Oligomer
agcuauuggucuuguggac

SEQ ID NO: 1941 - RNA, 19 nt, artificial
  Oligomer
agucaauguucuggaguga

SEQ ID NO: 1942 - RNA, 19 nt, artificial
  Oligomer
gugugaaugaucaaguccu

SEQ ID NO: 1943 - RNA, 19 nt, artificial
  Oligomer
aauagacucagauuuuggu

SEQ ID NO: 1944 - RNA, 19 nt, artificial
  Oligomer
cuguugugaguggaagauu

SEQ ID NO: 1945 - RNA, 19 nt, artificial
  Oligomer
ucacgcuguugugagugga

SEQ ID NO: 1946 - RNA, 19 nt, artificial
  Oligomer
agcuacaagcacgcucuaa

SEQ ID NO: 1947 - RNA, 19 nt, artificial
  Oligomer
agagcaccaugaucacgcu

SEQ ID NO: 1948 - RNA, 19 nt, artificial
  Oligomer
cgaauaccucagcaacugg

SEQ ID NO: 1949 - RNA, 19 nt, artificial
  Oligomer
augugcgugugaagagacu

SEQ ID NO: 1950 - RNA, 19 nt, artificial
  Oligomer
gagaugcugcaugcuucua

SEQ ID NO: 1951 - RNA, 19 nt, artificial
  Oligomer
aacugguauccgaucagag

SEQ ID NO: 1952 - RNA, 19 nt, artificial
  Oligomer
augcuucuacgauauaaag

SEQ ID NO: 1953 - RNA, 19 nt, artificial
  Oligomer
uaaggugaugcccaaugcu

SEQ ID NO: 1954 - RNA, 19 nt, artificial
  Oligomer
agaagugauucaacucuuc

SEQ ID NO: 1955 - RNA, 19 nt, artificial
  Oligomer
augaagaucucaaugaagu

SEQ ID NO: 1956 - RNA, 19 nt, artificial
  Oligomer
cuuugugaauauuuucaac

SEQ ID NO: 1957 - RNA, 19 nt, artificial
  Oligomer
caugaucacgcuguuguga

SEQ ID NO: 1958 - RNA, 19 nt, artificial
  Oligomer
uucuuaauguucacauagu

SEQ ID NO: 1959 - RNA, 19 nt, artificial
  Oligomer
agaaaauaugacuggagcu

SEQ ID NO: 1960 - RNA, 19 nt, artificial
  Oligomer
acuauguagguaaauucuu

SEQ ID NO: 1961 - RNA, 19 nt, artificial
  Oligomer
uauugugcaauccguugga

SEQ ID NO: 1962 - RNA, 19 nt, artificial
  Oligomer
aagguagaaacugaccaca

SEQ ID NO: 1963 - RNA, 19 nt, artificial
  Oligomer
cuacggcaaaggugucauc

SEQ ID NO: 1964 - RNA, 19 nt, artificial
  Oligomer
guggacaguaguuugccca

SEQ ID NO: 1965 - RNA, 19 nt, artificial
  Oligomer
cuaccucagggacaaagug

SEQ ID NO: 1966 - RNA, 19 nt, artificial
  Oligomer
uaaaggagcauuuuuuuau

SEQ ID NO: 1967 - RNA, 19 nt, artificial
  Oligomer
auugugcuauggaacaucu

SEQ ID NO: 1968 - RNA, 19 nt, artificial
  Oligomer
aggagaugcugcaugcuuc

SEQ ID NO: 1969 - RNA, 19 nt, artificial
  Oligomer
gaauggguaaaggagcauu

SEQ ID NO: 1970 - RNA, 19 nt, artificial
  Oligomer
agaucucaaugaaguagcc

SEQ ID NO: 1971 - RNA, 19 nt, artificial
  Oligomer
gggugcuuugaagcagaag

SEQ ID NO: 1972 - RNA, 19 nt, artificial
  Oligomer
uuaaggacggugagcagca

SEQ ID NO: 1973 - RNA, 19 nt, artificial
  Oligomer
aaaugcagagcuacaagca

SEQ ID NO: 1974 - RNA, 19 nt, artificial
  Oligomer
ucuuaauguucacauagug

SEQ ID NO: 1975 - RNA, 19 nt, artificial
  Oligomer
gaugcccaaugcuauugug

SEQ ID NO: 1976 - RNA, 19 nt, artificial
  Oligomer
ugagugugaaugaucaagu

SEQ ID NO: 1977 - RNA, 19 nt, artificial
  Oligomer
gcuauggaacaucuuuaac

SEQ ID NO: 1978 - RNA, 19 nt, artificial
  Oligomer
aaaagcaacugcacaagac

SEQ ID NO: 1979 - RNA, 19 nt, artificial
  Oligomer
cacagaagugauucaacuc

SEQ ID NO: 1980 - RNA, 19 nt, artificial
  Oligomer
augaucaaguccuuuguga

SEQ ID NO: 1981 - RNA, 19 nt, artificial
  Oligomer
gcuacaagcacgcucuaac

SEQ ID NO: 1982 - RNA, 19 nt, artificial
  Oligomer
ccgaauaccucagcaacug

SEQ ID NO: 1983 - RNA, 19 nt, artificial
  Oligomer
guguuuuugcaaaagcaac

SEQ ID NO: 1984 - RNA, 19 nt, artificial
  Oligomer
cagagagugagacagaguc

SEQ ID NO: 1985 - RNA, 19 nt, artificial
  Oligomer
ucaacuauguagguaaauu

SEQ ID NO: 1986 - RNA, 19 nt, artificial
  Oligomer
aaguccuuugugaauauuu

SEQ ID NO: 1987 - RNA, 19 nt, artificial
  Oligomer
cggguaaaugcagagcuac

SEQ ID NO: 1988 - RNA, 19 nt, artificial
  Oligomer
cauagugaaauaaauucug

SEQ ID NO: 1989 - RNA, 19 nt, artificial
  Oligomer
guaaugugcgugugaagag

SEQ ID NO: 1990 - RNA, 19 nt, artificial
  Oligomer
gugagcagcaugaagaucu

SEQ ID NO: 1991 - RNA, 19 nt, artificial
  Oligomer
ugaagcuauuggucuugug

SEQ ID NO: 1992 - RNA, 19 nt, artificial
  Oligomer
uguuuuugcaaaagcaacu

SEQ ID NO: 1993 - RNA, 19 nt, artificial
  Oligomer
uauggaacaucuuuaaccg

SEQ ID NO: 1994 - RNA, 19 nt, artificial
  Oligomer
auuggucuuguggacagua

SEQ ID NO: 1995 - RNA, 19 nt, artificial
  Oligomer
ggagcccaauguugaguug

SEQ ID NO: 1996 - RNA, 19 nt, artificial
  Oligomer
auucaacauucaugaagac

SEQ ID NO: 1997 - RNA, 19 nt, artificial
  Oligomer
cugguauccgaucagagag

SEQ ID NO: 1998 - RNA, 19 nt, artificial
  Oligomer
ugcuauugugcaauccguu

SEQ ID NO: 1999 - RNA, 19 nt, artificial
  Oligomer
aaguuacuuaucaagcuga

SEQ ID NO: 2000 - RNA, 19 nt, artificial
  Oligomer
auccguuggagucagcagu

SEQ ID NO: 2001 - RNA, 19 nt, artificial
  Oligomer
cuucucuguccaaugccca

SEQ ID NO: 2002 - RNA, 19 nt, artificial
  Oligomer
ucuaccucagggacaaagu

SEQ ID NO: 2003 - RNA, 19 nt, artificial
  Oligomer
ucagagagugagacagagu

SEQ ID NO: 2004 - RNA, 19 nt, artificial
  Oligomer
acgauauaaaguugggaag

SEQ ID NO: 2005 - RNA, 19 nt, artificial
  Oligomer
cuauuggucuuguggacag

SEQ ID NO: 2006 - RNA, 19 nt, artificial
  Oligomer
ggcuaugaagcuauugguc

SEQ ID NO: 2007 - RNA, 19 nt, artificial
  Oligomer
cagaaauuacuauuccucc

SEQ ID NO: 2008 - RNA, 19 nt, artificial
  Oligomer
auggaaaaagucagacgag

SEQ ID NO: 2009 - RNA, 19 nt, artificial
  Oligomer
aagcugaaagacggcagga

SEQ ID NO: 2010 - RNA, 19 nt, artificial
  Oligomer
gagcauuuuuuuauucagc

SEQ ID NO: 2011 - RNA, 19 nt, artificial
  Oligomer
aaauucuuaauguucacau

SEQ ID NO: 2012 - RNA, 19 nt, artificial
  Oligomer
ucuuguggacaguaguuug

SEQ ID NO: 2013 - RNA, 19 nt, artificial
  Oligomer
guugugaguggaagauugg

SEQ ID NO: 2014 - RNA, 19 nt, artificial
  Oligomer
cgauauaaaguugggaagg

SEQ ID NO: 2015 - RNA, 19 nt, artificial
  Oligomer
accucagcaacuggaccau

SEQ ID NO: 2016 - RNA, 19 nt, artificial
  Oligomer
uuuugcaaaagcaacugca

SEQ ID NO: 2017 - RNA, 19 nt, artificial
  Oligomer
gugaauauuuucaacuaug

SEQ ID NO: 2018 - RNA, 19 nt, artificial
  Oligomer
gcuauuggucuuguggaca

SEQ ID NO: 2019 - RNA, 19 nt, artificial
  Oligomer
aauccguuggagucagcag

SEQ ID NO: 2020 - RNA, 19 nt, artificial
  Oligomer
augcuauugugcaauccgu

SEQ ID NO: 2021 - RNA, 19 nt, artificial
  Oligomer
gaaaaagucagacgagagg

SEQ ID NO: 2022 - RNA, 19 nt, artificial
  Oligomer
caggaacugguauccgauc

SEQ ID NO: 2023 - RNA, 19 nt, artificial
  Oligomer
aaggaagaucauuaaggac

SEQ ID NO: 2024 - RNA, 19 nt, artificial
  Oligomer
ugcccacaguugguguuuu

SEQ ID NO: 2025 - RNA, 19 nt, artificial
  Oligomer
ggcaggaagguagaaacug

SEQ ID NO: 2026 - RNA, 19 nt, artificial
  Oligomer
uaguuugcccacaguuggu

SEQ ID NO: 2027 - RNA, 19 nt, artificial
  Oligomer
gauugugcuauggaacauc

SEQ ID NO: 2028 - RNA, 19 nt, artificial
  Oligomer
caaguuacuuaucaagcug

SEQ ID NO: 2029 - RNA, 19 nt, artificial
  Oligomer
uagaaacugaccacauagu

SEQ ID NO: 2030 - RNA, 19 nt, artificial
  Oligomer
ucaauguucuggagugauu

SEQ ID NO: 2031 - RNA, 19 nt, artificial
  Oligomer
aggaggagucugcguaaug

SEQ ID NO: 2032 - RNA, 19 nt, artificial
  Oligomer
acauagugaaauaaauucu

SEQ ID NO: 2033 - RNA, 19 nt, artificial
  Oligomer
gcaaaagcaacugcacaag

SEQ ID NO: 2034 - RNA, 19 nt, artificial
  Oligomer
ccucagaaauuacuauucc

SEQ ID NO: 2035 - RNA, 19 nt, artificial
  Oligomer
acuacggcaaaggugucau

SEQ ID NO: 2036 - RNA, 19 nt, artificial
  Oligomer
guugguguuuuugcaaaag

SEQ ID NO: 2037 - RNA, 19 nt, artificial
  Oligomer
auauaaaguugggaaggag

SEQ ID NO: 2038 - RNA, 19 nt, artificial
  Oligomer
cuggaccauggaaaaaguc

SEQ ID NO: 2039 - RNA, 19 nt, artificial
  Oligomer
uauuggucuuguggacagu

SEQ ID NO: 2040 - RNA, 19 nt, artificial
  Oligomer
gccucagaaauuacuauuc

SEQ ID NO: 2041 - RNA, 19 nt, artificial
  Oligomer
ugguauccgaucagagagu

SEQ ID NO: 2042 - RNA, 19 nt, artificial
  Oligomer
cagucaauguucuggagug

SEQ ID NO: 2043 - RNA, 19 nt, artificial
  Oligomer
aucagagagugagacagag

SEQ ID NO: 2044 - RNA, 19 nt, artificial
  Oligomer
ugcugcaugcuucuacgau

SEQ ID NO: 2045 - RNA, 19 nt, artificial
  Oligomer
gugaaugaucaaguccuuu

SEQ ID NO: 2046 - RNA, 19 nt, artificial
  Oligomer
gaagcuauuggucuugugg

SEQ ID NO: 2047 - RNA, 19 nt, artificial
  Oligomer
agguaaauucuuaauguuc

SEQ ID NO: 2048 - RNA, 19 nt, artificial
  Oligomer
agcaaggaagaucauuaag

SEQ ID NO: 2049 - RNA, 19 nt, artificial
  Oligomer
aucaaguccuuugugaaua

SEQ ID NO: 2050 - RNA, 19 nt, artificial
  Oligomer
gcaacugcacaagacaacc

SEQ ID NO: 2051 - RNA, 19 nt, artificial
  Oligomer
gcuaugaagcuauuggucu

SEQ ID NO: 2052 - RNA, 19 nt, artificial
  Oligomer
ugaaagacggcaggaaggu

SEQ ID NO: 2053 - RNA, 19 nt, artificial
  Oligomer
ugcuucuacgauauaaagu

SEQ ID NO: 2054 - RNA, 19 nt, artificial
  Oligomer
gcuggagaaaauaugacug

SEQ ID NO: 2055 - RNA, 19 nt, artificial
  Oligomer
aacuggaccauggaaaaag

SEQ ID NO: 2056 - RNA, 19 nt, artificial
  Oligomer
guaguuugcccacaguugg

SEQ ID NO: 2057 - RNA, 19 nt, artificial
  Oligomer
guaaaugcagagcuacaag

SEQ ID NO: 2058 - RNA, 19 nt, artificial
  Oligomer
guccuuugugaauauuuuc

SEQ ID NO: 2059 - RNA, 19 nt, artificial
  Oligomer
ggccuggaaauagacucag

SEQ ID NO: 2060 - RNA, 19 nt, artificial
  Oligomer
uuggucuuguggacaguag

SEQ ID NO: 2061 - RNA, 19 nt, artificial
  Oligomer
caucuucuaccucagggac

SEQ ID NO: 2062 - RNA, 19 nt, artificial
  Oligomer
uccuuugugaauauuuuca

SEQ ID NO: 2063 - RNA, 19 nt, artificial
  Oligomer
gaagaucucaaugaaguag

SEQ ID NO: 2064 - RNA, 19 nt, artificial
  Oligomer
auuacuauuccucccagca

SEQ ID NO: 2065 - RNA, 19 nt, artificial
  Oligomer
augcugcaugcuucuacga

SEQ ID NO: 2066 - RNA, 19 nt, artificial
  Oligomer
ucauuaaggacggugagca

SEQ ID NO: 2067 - RNA, 19 nt, artificial
  Oligomer
uugugcaauccguuggagu

SEQ ID NO: 2068 - RNA, 19 nt, artificial
  Oligomer
ccauggaaaaagucagacg

SEQ ID NO: 2069 - RNA, 19 nt, artificial
  Oligomer
ggugcuuugaagcagaagc

SEQ ID NO: 2070 - RNA, 19 nt, artificial
  Oligomer
gaaacugaccacauagugg

SEQ ID NO: 2071 - RNA, 19 nt, artificial
  Oligomer
gaggucgaauggguaaagg

SEQ ID NO: 2072 - RNA, 19 nt, artificial
  Oligomer
acagaagugauucaacucu

SEQ ID NO: 2073 - RNA, 19 nt, artificial
  Oligomer
agcaacugcacaagacaac

SEQ ID NO: 2074 - RNA, 19 nt, artificial
  Oligomer
aaauuacuauuccucccag

SEQ ID NO: 2075 - RNA, 19 nt, artificial
  Oligomer
cuucuacgauauaaaguug

SEQ ID NO: 2076 - RNA, 19 nt, artificial
  Oligomer
aauaugacuggagcugcua

SEQ ID NO: 2077 - RNA, 19 nt, artificial
  Oligomer
ugugcaauccguuggaguc

SEQ ID NO: 2078 - RNA, 19 nt, artificial
  Oligomer
auucugauucuucuaaauu

SEQ ID NO: 2079 - RNA, 19 nt, artificial
  Oligomer
ugcaauccguuggagucag

SEQ ID NO: 2080 - RNA, 19 nt, artificial
  Oligomer
agaaacugaccacauagug

SEQ ID NO: 2081 - RNA, 19 nt, artificial
  Oligomer
aucuucuaccucagggaca

SEQ ID NO: 2082 - RNA, 19 nt, artificial
  Oligomer
uuaucaagcugaaagacgg

SEQ ID NO: 2083 - RNA, 19 nt, artificial
  Oligomer
aguaguuugcccacaguug

SEQ ID NO: 2084 - RNA, 19 nt, artificial
  Oligomer
agaaauuacuauuccuccc

SEQ ID NO: 2085 - RNA, 19 nt, artificial
  Oligomer
aaacuauucaacauucaug

SEQ ID NO: 2086 - RNA, 19 nt, artificial
  Oligomer
gucaauguucuggagugau

SEQ ID NO: 2087 - RNA, 19 nt, artificial
  Oligomer
aagugauucaacucuuccc

SEQ ID NO: 2088 - RNA, 19 nt, artificial
  Oligomer
gaagugauucaacucuucc

SEQ ID NO: 2089 - RNA, 19 nt, artificial
  Oligomer
cacauagugaaauaaauuc

SEQ ID NO: 2090 - RNA, 19 nt, artificial
  Oligomer
aaauagacucagauuuugg

SEQ ID NO: 2091 - RNA, 19 nt, artificial
  Oligomer
gucgaauggguaaaggagc

SEQ ID NO: 2092 - RNA, 19 nt, artificial
  Oligomer
aaaggugucaucuucuacc

SEQ ID NO: 2093 - RNA, 19 nt, artificial
  Oligomer
cuggagaaaauaugacugg

SEQ ID NO: 2094 - RNA, 19 nt, artificial
  Oligomer
agagcuacaagcacgcucu

SEQ ID NO: 2095 - RNA, 19 nt, artificial
  Oligomer
gcaaggaagaucauuaagg

SEQ ID NO: 2096 - RNA, 19 nt, artificial
  Oligomer
cuauggaacaucuuuaacc

SEQ ID NO: 2097 - RNA, 19 nt, artificial
  Oligomer
aaagacggcaggaagguag

SEQ ID NO: 2098 - RNA, 19 nt, artificial
  Oligomer
ggcaaguuacuuaucaagc

SEQ ID NO: 2099 - RNA, 19 nt, artificial
  Oligomer
ugaugcccaaugcuauugu

SEQ ID NO: 2100 - RNA, 19 nt, artificial
  Oligomer
cuuccggguaaaugcagag

SEQ ID NO: 2101 - RNA, 19 nt, artificial
  Oligomer
uacaagcacgcucuaacau

SEQ ID NO: 2102 - RNA, 19 nt, artificial
  Oligomer
ucagggacaaaguggucgu

SEQ ID NO: 2103 - RNA, 19 nt, artificial
  Oligomer
acgcuguugugaguggaag

SEQ ID NO: 2104 - RNA, 19 nt, artificial
  Oligomer
uauuuucaacuauguaggu

SEQ ID NO: 2105 - RNA, 19 nt, artificial
  Oligomer
aaauaaauucugauucuuc

SEQ ID NO: 2106 - RNA, 19 nt, artificial
  Oligomer
gucuuguggacaguaguuu

SEQ ID NO: 2107 - RNA, 19 nt, artificial
  Oligomer
ccacaguugguguuuuugc

SEQ ID NO: 2108 - RNA, 19 nt, artificial
  Oligomer
aauguucacauagugaaau

SEQ ID NO: 2109 - RNA, 19 nt, artificial
  Oligomer
ggugagcagcaugaagauc

SEQ ID NO: 2110 - RNA, 19 nt, artificial
  Oligomer
uaccucagcaacuggacca

SEQ ID NO: 2111 - RNA, 19 nt, artificial
  Oligomer
aggugucaucuucuaccuc

SEQ ID NO: 2112 - RNA, 19 nt, artificial
  Oligomer
aaugcagagcuacaagcac

SEQ ID NO: 2113 - RNA, 19 nt, artificial
  Oligomer
uacggcaaaggugucaucu

SEQ ID NO: 2114 - RNA, 19 nt, artificial
  Oligomer
uggacaguaguuugcccac

SEQ ID NO: 2115 - RNA, 19 nt, artificial
  Oligomer
uuugcaaaagcaacugcac

SEQ ID NO: 2116 - RNA, 19 nt, artificial
  Oligomer
ugagaggaaagggaaggag

SEQ ID NO: 2117 - RNA, 19 nt, artificial
  Oligomer
cccaaugcuauugugcaau

SEQ ID NO: 2118 - RNA, 19 nt, artificial
  Oligomer
uaugacuggagcugcuaag

SEQ ID NO: 2119 - RNA, 19 nt, artificial
  Oligomer
acauucaugaagacugaag

SEQ ID NO: 2120 - RNA, 19 nt, artificial
  Oligomer
uguagguaaauucuuaaug

SEQ ID NO: 2121 - RNA, 19 nt, artificial
  Oligomer
aggaagguagaaacugacc

SEQ ID NO: 2122 - RNA, 19 nt, artificial
  Oligomer
uggagcccaauguugaguu

SEQ ID NO: 2123 - RNA, 19 nt, artificial
  Oligomer
uguggacaguaguuugccc

SEQ ID NO: 2124 - RNA, 19 nt, artificial
  Oligomer
agagagugagacagagucc

SEQ ID NO: 2125 - RNA, 19 nt, artificial
  Oligomer
ccaaugcuauugugcaauc

SEQ ID NO: 2126 - RNA, 19 nt, artificial
  Oligomer
agaugcugcaugcuucuac

SEQ ID NO: 2127 - RNA, 19 nt, artificial
  Oligomer
uguucuggagugauuuggg

SEQ ID NO: 2128 - RNA, 19 nt, artificial
  Oligomer
gucugcguaaugugcgugu

SEQ ID NO: 2129 - RNA, 19 nt, artificial
  Oligomer
gugaaauaaauucugauuc

SEQ ID NO: 2130 - RNA, 19 nt, artificial
  Oligomer
uauucagcagacuuucucu

SEQ ID NO: 2131 - RNA, 19 nt, artificial
  Oligomer
aggagucugcguaaugugc

SEQ ID NO: 2132 - RNA, 19 nt, artificial
  Oligomer
cuauucaacauucaugaag

SEQ ID NO: 2133 - RNA, 19 nt, artificial
  Oligomer
ucuacgauauaaaguuggg

SEQ ID NO: 2134 - RNA, 19 nt, artificial
  Oligomer
aauagcaaggaagaucauu

SEQ ID NO: 2135 - RNA, 19 nt, artificial
  Oligomer
gcagucaggaacugguauc

SEQ ID NO: 2136 - RNA, 19 nt, artificial
  Oligomer
aagcacgcucuaacaucug

SEQ ID NO: 2137 - RNA, 19 nt, artificial
  Oligomer
aauaccucagcaacuggac

SEQ ID NO: 2138 - RNA, 19 nt, artificial
  Oligomer
uucaacuauguagguaaau

SEQ ID NO: 2139 - RNA, 19 nt, artificial
  Oligomer
ucaacauucaugaagacug

SEQ ID NO: 2140 - RNA, 19 nt, artificial
  Oligomer
ugucaucuucuaccucagg

SEQ ID NO: 2141 - RNA, 19 nt, artificial
  Oligomer
agcacgcucuaacaucugg

SEQ ID NO: 2142 - RNA, 19 nt, artificial
  Oligomer
ggcaucagucaauguucug

SEQ ID NO: 2143 - RNA, 19 nt, artificial
  Oligomer
guuugcccacaguuggugu

SEQ ID NO: 2144 - RNA, 19 nt, artificial
  Oligomer
aaauguuccgguguggagg

SEQ ID NO: 2145 - RNA, 19 nt, artificial
  Oligomer
guucuggagugauuugggc

SEQ ID NO: 2146 - RNA, 19 nt, artificial
  Oligomer
cccacaguugguguuuuug

SEQ ID NO: 2147 - RNA, 19 nt, artificial
  Oligomer
auagcggucgccgaaaugu

SEQ ID NO: 2148 - RNA, 19 nt, artificial
  Oligomer
uuuuuauucagcagacuuu

SEQ ID NO: 2149 - RNA, 19 nt, artificial
  Oligomer
cggugagcagcaugaagau

SEQ ID NO: 2150 - RNA, 19 nt, artificial
  Oligomer
gcaugaagaucucaaugaa

SEQ ID NO: 2151 - RNA, 19 nt, artificial
  Oligomer
ggguuaaggugaugcccaa

SEQ ID NO: 2152 - RNA, 19 nt, artificial
  Oligomer
caacauucaugaagacuga

SEQ ID NO: 2153 - RNA, 19 nt, artificial
  Oligomer
gguagaaacugaccacaua

SEQ ID NO: 2154 - RNA, 19 nt, artificial
  Oligomer
gcaggaagguagaaacuga

SEQ ID NO: 2155 - RNA, 19 nt, artificial
  Oligomer
cgggugcuuugaagcagaa

SEQ ID NO: 2156 - RNA, 19 nt, artificial
  Oligomer
gcaacuggaccauggaaaa

SEQ ID NO: 2157 - RNA, 19 nt, artificial
  Oligomer
caugcuucuacgauauaaa

SEQ ID NO: 2158 - RNA, 19 nt, artificial
  Oligomer
ggaacaucuuuaaccgaau

SEQ ID NO: 2159 - RNA, 19 nt, artificial
  Oligomer
ucugauucuucuaaauuaa

SEQ ID NO: 2160 - RNA, 19 nt, artificial
  Oligomer
gcagcaugaagaucucaau

SEQ ID NO: 2161 - RNA, 19 nt, artificial
  Oligomer
cugauucuucuaaauuaaa

SEQ ID NO: 2162 - RNA, 19 nt, artificial
  Oligomer
caaggaagaucauuaagga

SEQ ID NO: 2163 - RNA, 19 nt, artificial
  Oligomer
cgcuguugugaguggaaga

SEQ ID NO: 2164 - RNA, 19 nt, artificial
  Oligomer
gguguuuuugcaaaagcaa

SEQ ID NO: 2165 - RNA, 19 nt, artificial
  Oligomer
cgagaaaggaaauauggga

SEQ ID NO: 2166 - RNA, 19 nt, artificial
  Oligomer
cuauguagguaaauucuua

SEQ ID NO: 2167 - RNA, 19 nt, artificial
  Oligomer
ccggguaaaugcagagcua

SEQ ID NO: 2168 - RNA, 19 nt, artificial
  Oligomer
gguaaauucuuaauguuca

SEQ ID NO: 2169 - RNA, 19 nt, artificial
  Oligomer
gcaaaggugucaucuucua

SEQ ID NO: 2170 - RNA, 19 nt, artificial
  Oligomer
gcccaaugcuauugugcaa

SEQ ID NO: 2171 - RNA, 19 nt, artificial
  Oligomer
guaugagugugaaugauca

SEQ ID NO: 2172 - RNA, 19 nt, artificial
  Oligomer
ugcuauggaacaucuuuaa

SEQ ID NO: 2173 - RNA, 19 nt, artificial
  Oligomer
agaggaaagggaaggagga

SEQ ID NO: 2174 - RNA, 19 nt, artificial
  Oligomer
gggcacagaagugauucaa

SEQ ID NO: 2175 - RNA, 19 nt, artificial
  Oligomer
gcugcaugcuucuacgaua

SEQ ID NO: 2176 - RNA, 19 nt, artificial
  Oligomer
gaggccucagaaauuacua

SEQ ID NO: 2177 - RNA, 19 nt, artificial
  Oligomer
ugaagaucucaaugaagua

SEQ ID NO: 2178 - RNA, 19 nt, artificial
  Oligomer
gcaugcuucuacgauauaa

SEQ ID NO: 2179 - RNA, 19 nt, artificial
  Oligomer
cagcaacuggaccauggaa

SEQ ID NO: 2180 - RNA, 19 nt, artificial
  Oligomer
aaauucugauucuucuaaa

SEQ ID NO: 2181 - RNA, 19 nt, artificial
  Oligomer
gccuggaaauagacucaga

SEQ ID NO: 2182 - RNA, 19 nt, artificial
  Oligomer
ggguaaaugcagagcuaca

SEQ ID NO: 2183 - RNA, 19 nt, artificial
  Oligomer
gugcuauggaacaucuuua

SEQ ID NO: 2184 - RNA, 19 nt, artificial
  Oligomer
gcacagaagugauucaacu

SEQ ID NO: 2185 - RNA, 19 nt, artificial
  Oligomer
ggguaaaggagcauuuuuu

SEQ ID NO: 2186 - RNA, 19 nt, artificial
  Oligomer
uagcaaggaagaucauuaa

SEQ ID NO: 2187 - RNA, 19 nt, artificial
  Oligomer
aguugguguuuuugcaaaa

SEQ ID NO: 2188 - RNA, 19 nt, artificial
  Oligomer
ugaucaaguccuuugugaa

SEQ ID NO: 2189 - RNA, 19 nt, artificial
  Oligomer
cacaguugguguuuuugca

SEQ ID NO: 2190 - RNA, 19 nt, artificial
  Oligomer
cacgcuguugugaguggaa

SEQ ID NO: 2191 - RNA, 19 nt, artificial
  Oligomer
aguuacuuaucaagcugaa

SEQ ID NO: 2192 - RNA, 19 nt, artificial
  Oligomer
guccgaggccucagaaauu

SEQ ID NO: 2193 - RNA, 19 nt, artificial
  Oligomer
ugguguuuuugcaaaagca

SEQ ID NO: 2194 - RNA, 19 nt, artificial
  Oligomer
aaggaaauaugggaaagau

SEQ ID NO: 2195 - RNA, 19 nt, artificial
  Oligomer
gggauugugcuauggaaca

SEQ ID NO: 2196 - RNA, 19 nt, artificial
  Oligomer
ugcguaaugugcgugugaa

SEQ ID NO: 2197 - RNA, 19 nt, artificial
  Oligomer
aauucuuaauguucacaua

SEQ ID NO: 2198 - RNA, 19 nt, artificial
  Oligomer
gagaaaggaaauaugggaa

SEQ ID NO: 2199 - RNA, 19 nt, artificial
  Oligomer
ccuggaaauagacucagau

SEQ ID NO: 2200 - RNA, 19 nt, artificial
  Oligomer
ugcgugagaggaaagggaa

SEQ ID NO: 2201 - RNA, 19 nt, artificial
  Oligomer
ggaaauagacucagauuuu

SEQ ID NO: 2202 - RNA, 19 nt, artificial
  Oligomer
gagcagucaggaacuggua

SEQ ID NO: 2203 - RNA, 19 nt, artificial
  Oligomer
acuggaccauggaaaaagu

SEQ ID NO: 2204 - RNA, 19 nt, artificial
  Oligomer
cggcaggaagguagaaacu

SEQ ID NO: 2205 - RNA, 19 nt, artificial
  Oligomer
uaugagugugaaugaucaa

SEQ ID NO: 2206 - RNA, 19 nt, artificial
  Oligomer
uucugauucuucuaaauua

SEQ ID NO: 2207 - RNA, 19 nt, artificial
  Oligomer
gguaaaggagcauuuuuuu

SEQ ID NO: 2208 - RNA, 19 nt, artificial
  Oligomer
guucacauagugaaauaaa

SEQ ID NO: 2209 - RNA, 19 nt, artificial
  Oligomer
uaauguucacauagugaaa

SEQ ID NO: 2210 - RNA, 19 nt, artificial
  Oligomer
ccuugggcacagaagugau

SEQ ID NO: 2211 - RNA, 19 nt, artificial
  Oligomer
aggugaugcccaaugcuau

SEQ ID NO: 2212 - RNA, 19 nt, artificial
  Oligomer
cgaggccucagaaauuacu

SEQ ID NO: 2213 - RNA, 19 nt, artificial
  Oligomer
aagcaacugcacaagacaa

SEQ ID NO: 2214 - RNA, 19 nt, artificial
  Oligomer
gaccauggaaaaagucaga

SEQ ID NO: 2215 - RNA, 19 nt, artificial
  Oligomer
aauucugauucuucuaaau

SEQ ID NO: 2216 - RNA, 19 nt, artificial
  Oligomer
gguaaaugcagagcuacaa

SEQ ID NO: 2217 - RNA, 19 nt, artificial
  Oligomer
cuacaagcacgcucuaaca

SEQ ID NO: 2218 - RNA, 19 nt, artificial
  Oligomer
gaauauuuucaacuaugua

SEQ ID NO: 2219 - RNA, 19 nt, artificial
  Oligomer
guguaugagugugaaugau

SEQ ID NO: 2220 - RNA, 19 nt, artificial
  Oligomer
gcguaaugugcgugugaag

SEQ ID NO: 2221 - RNA, 19 nt, artificial
  Oligomer
gaggaggucgaauggguaa

SEQ ID NO: 2222 - RNA, 19 nt, artificial
  Oligomer
guagguaaauucuuaaugu

SEQ ID NO: 2223 - RNA, 19 nt, artificial
  Oligomer
agacggcaggaagguagaa

SEQ ID NO: 2224 - RNA, 19 nt, artificial
  Oligomer
ccuuugugaauauuuucaa

SEQ ID NO: 2225 - RNA, 19 nt, artificial
  Oligomer
gucaggaacugguauccga

SEQ ID NO: 2226 - RNA, 19 nt, artificial
  Oligomer
gaauagcggucgccgaaau

SEQ ID NO: 2227 - RNA, 19 nt, artificial
  Oligomer
cggcaaaggugucaucuuc

SEQ ID NO: 2228 - RNA, 19 nt, artificial
  Oligomer
caauagcaaggaagaucau

SEQ ID NO: 2229 - RNA, 19 nt, artificial
  Oligomer
aggucgaauggguaaagga

SEQ ID NO: 2230 - RNA, 19 nt, artificial
  Oligomer
caguugguguuuuugcaaa

SEQ ID NO: 2231 - RNA, 19 nt, artificial
  Oligomer
ggaggagucugcguaaugu

SEQ ID NO: 2232 - RNA, 19 nt, artificial
  Oligomer
uggaacaucuuuaaccgaa

SEQ ID NO: 2233 - RNA, 19 nt, artificial
  Oligomer
ggugaugcccaaugcuauu

SEQ ID NO: 2234 - RNA, 19 nt, artificial
  Oligomer
cugcguaaugugcguguga

SEQ ID NO: 2235 - RNA, 19 nt, artificial
  Oligomer
agaggaggucgaaugggua

SEQ ID NO: 2236 - RNA, 19 nt, artificial
  Oligomer
gacggcaggaagguagaaa

SEQ ID NO: 2237 - RNA, 19 nt, artificial
  Oligomer
ggagcauuuuuuuauucag

SEQ ID NO: 2238 - RNA, 19 nt, artificial
  Oligomer
gcaccaugaucacgcuguu

SEQ ID NO: 2239 - RNA, 19 nt, artificial
  Oligomer
uauguagguaaauucuuaa

SEQ ID NO: 2240 - RNA, 19 nt, artificial
  Oligomer
ggauugugcuauggaacau

SEQ ID NO: 2241 - RNA, 19 nt, artificial
  Oligomer
caacuggaccauggaaaaa

SEQ ID NO: 2242 - RNA, 19 nt, artificial
  Oligomer
cguaaugugcgugugaaga

SEQ ID NO: 2243 - RNA, 19 nt, artificial
  Oligomer
aguccgaggccucagaaau

SEQ ID NO: 2244 - RNA, 19 nt, artificial
  Oligomer
uucacauagugaaauaaau

SEQ ID NO: 2245 - RNA, 19 nt, artificial
  Oligomer
agcagcaugaagaucucaa

SEQ ID NO: 2246 - RNA, 19 nt, artificial
  Oligomer
acugguauccgaucagaga

SEQ ID NO: 2247 - RNA, 19 nt, artificial
  Oligomer
aagacggcaggaagguaga

SEQ ID NO: 2248 - RNA, 19 nt, artificial
  Oligomer
ggagaugcugcaugcuucu

SEQ ID NO: 2249 - RNA, 19 nt, artificial
  Oligomer
agaaaggaaauaugggaaa

SEQ ID NO: 2250 - RNA, 19 nt, artificial
  Oligomer
gaucagagagugagacaga

SEQ ID NO: 2251 - RNA, 19 nt, artificial
  Oligomer
ugggcacagaagugauuca

SEQ ID NO: 2252 - RNA, 19 nt, artificial
  Oligomer
uggagaaaauaugacugga

SEQ ID NO: 2253 - RNA, 19 nt, artificial
  Oligomer
cagaagugauucaacucuu

SEQ ID NO: 2254 - RNA, 19 nt, artificial
  Oligomer
ggaccauggaaaaagucag

SEQ ID NO: 2255 - RNA, 19 nt, artificial
  Oligomer
aaagcaacugcacaagaca

SEQ ID NO: 2256 - RNA, 19 nt, artificial
  Oligomer
aguccuuugugaauauuuu

SEQ ID NO: 2257 - RNA, 19 nt, artificial
  Oligomer
ggaagguagaaacugacca

SEQ ID NO: 2258 - RNA, 19 nt, artificial
  Oligomer
caggaagguagaaacugac

SEQ ID NO: 2259 - RNA, 19 nt, artificial
  Oligomer
acggcaaaggugucaucuu

SEQ ID NO: 2260 - RNA, 19 nt, artificial
  Oligomer
uuucaacuauguagguaaa

SEQ ID NO: 2261 - RNA, 19 nt, artificial
  Oligomer
ugcaaaagcaacugcacaa

SEQ ID NO: 2262 - RNA, 19 nt, artificial
  Oligomer
uccgaggccucagaaauua

SEQ ID NO: 2263 - RNA, 19 nt, artificial
  Oligomer
acggugagcagcaugaaga

SEQ ID NO: 2264 - RNA, 19 nt, artificial
  Oligomer
gagcuacaagcacgcucua

SEQ ID NO: 2265 - RNA, 19 nt, artificial
  Oligomer
agcugaaagacggcaggaa

SEQ ID NO: 2266 - RNA, 19 nt, artificial
  Oligomer
cuaugaagcuauuggucuu

SEQ ID NO: 2267 - RNA, 19 nt, artificial
  Oligomer
gaacugguauccgaucaga

SEQ ID NO: 2268 - RNA, 19 nt, artificial
  Oligomer
caaaagcaacugcacaaga

SEQ ID NO: 2269 - RNA, 19 nt, artificial
  Oligomer
cgaaauguuccggugugga

SEQ ID NO: 2270 - RNA, 19 nt, artificial
  Oligomer
cauggaaaaagucagacga

SEQ ID NO: 2271 - RNA, 19 nt, artificial
  Oligomer
ggugucaucuucuaccuca

SEQ ID NO: 2272 - RNA, 19 nt, artificial
  Oligomer
auccgaucagagagugaga

SEQ ID NO: 2273 - RNA, 19 nt, artificial
  Oligomer
aggccucagaaauuacuau

SEQ ID NO: 2274 - RNA, 19 nt, artificial
  Oligomer
gaaagacggcaggaaggua

SEQ ID NO: 2275 - RNA, 19 nt, artificial
  Oligomer
cugcaugcuucuacgauau

SEQ ID NO: 2276 - RNA, 19 nt, artificial
  Oligomer
aaaggagcauuuuuuuauu

SEQ ID NO: 2277 - RNA, 19 nt, artificial
  Oligomer
ggucuuguggacaguaguu

SEQ ID NO: 2278 - RNA, 19 nt, artificial
  Oligomer
agaucauuaaggacgguga

SEQ ID NO: 2279 - RNA, 19 nt, artificial
  Oligomer
uagguaaauucuuaauguu

SEQ ID NO: 2280 - RNA, 19 nt, artificial
  Oligomer
guuacuuaucaagcugaaa

SEQ ID NO: 2281 - RNA, 19 nt, artificial
  Oligomer
gaucaaguccuuugugaau

SEQ ID NO: 2282 - RNA, 19 nt, artificial
  Oligomer
ccaaacuauucaacauuca

SEQ ID NO: 2283 - RNA, 19 nt, artificial
  Oligomer
gcaaguuacuuaucaagcu

SEQ ID NO: 2284 - RNA, 19 nt, artificial
  Oligomer
uauucaacauucaugaaga

SEQ ID NO: 2285 - RNA, 19 nt, artificial
  Oligomer
gcccacaguugguguuuuu

SEQ ID NO: 2286 - RNA, 19 nt, artificial
  Oligomer
ccgaucagagagugagaca

SEQ ID NO: 2287 - RNA, 19 nt, artificial
  Oligomer
cccgaauaccucagcaacu

SEQ ID NO: 2288 - RNA, 19 nt, artificial
  Oligomer
caaacuauucaacauucau

SEQ ID NO: 2289 - RNA, 19 nt, artificial
  Oligomer
uggaaaaagucagacgaga

SEQ ID NO: 2290 - RNA, 19 nt, artificial
  Oligomer
agagugagacagaguccga

SEQ ID NO: 2291 - RNA, 19 nt, artificial
  Oligomer
cuggaaauagacucagauu

SEQ ID NO: 2292 - RNA, 19 nt, artificial
  Oligomer
uggucuuguggacaguagu

SEQ ID NO: 2293 - RNA, 19 nt, artificial
  Oligomer
acuauucaacauucaugaa

SEQ ID NO: 2294 - RNA, 19 nt, artificial
  Oligomer
ggucgaauggguaaaggag

SEQ ID NO: 2295 - RNA, 19 nt, artificial
  Oligomer
ccgaggccucagaaauuac

SEQ ID NO: 2296 - RNA, 19 nt, artificial
  Oligomer
ucagcaacuggaccaugga

SEQ ID NO: 2297 - RNA, 19 nt, artificial
  Oligomer
aaaggaaauaugggaaaga

SEQ ID NO: 2298 - RNA, 19 nt, artificial
  Oligomer
ggcacagaagugauucaac

SEQ ID NO: 2299 - RNA, 19 nt, artificial
  Oligomer
aacauucaugaagacugaa

SEQ ID NO: 2300 - RNA, 19 nt, artificial
  Oligomer
ugugaaugaucaaguccuu

SEQ ID NO: 2301 - RNA, 19 nt, artificial
  Oligomer
agguagaaacugaccacau

SEQ ID NO: 2302 - RNA, 19 nt, artificial
  Oligomer
caugaagaucucaaugaag

SEQ ID NO: 2303 - RNA, 19 nt, artificial
  Oligomer
gagucugcguaaugugcgu

SEQ ID NO: 2304 - RNA, 19 nt, artificial
  Oligomer
caagcacgcucuaacaucu

SEQ ID NO: 2305 - RNA, 19 nt, artificial
  Oligomer
ucaggaacugguauccgau

SEQ ID NO: 2306 - RNA, 19 nt, artificial
  Oligomer
ggcaaaggugucaucuucu

SEQ ID NO: 2307 - RNA, 19 nt, artificial
  Oligomer
gaauaccucagcaacugga

SEQ ID NO: 2308 - RNA, 19 nt, artificial
  Oligomer
gaaauaugggaaagauccu

SEQ ID NO: 2309 - RNA, 19 nt, artificial
  Oligomer
uaaugugcgugugaagaga

SEQ ID NO: 2310 - RNA, 19 nt, artificial
  Oligomer
aacuauucaacauucauga

SEQ ID NO: 2311 - RNA, 19 nt, artificial
  Oligomer
ucaaguccuuugugaauau

SEQ ID NO: 2312 - RNA, 19 nt, artificial
  Oligomer
gaaugaucaaguccuuugu

SEQ ID NO: 2313 - RNA, 19 nt, artificial
  Oligomer
gugucaucuucuaccucag

SEQ ID NO: 2314 - RNA, 19 nt, artificial
  Oligomer
ccaauagcaaggaagauca

SEQ ID NO: 2315 - RNA, 19 nt, artificial
  Oligomer
gauauaaaguugggaagga

SEQ ID NO: 2316 - RNA, 19 nt, artificial
  Oligomer
gagugugaaugaucaaguc

SEQ ID NO: 2317 - RNA, 19 nt, artificial
  Oligomer
ggguagagcaccaugauca

SEQ ID NO: 2318 - RNA, 19 nt, artificial
  Oligomer
uagugaaauaaauucugau

SEQ ID NO: 2319 - RNA, 19 nt, artificial
  Oligomer
ggccucagaaauuacuauu

SEQ ID NO: 2320 - RNA, 19 nt, artificial
  Oligomer
guaaaggagcauuuuuuua

SEQ ID NO: 2321 - RNA, 19 nt, artificial
  Oligomer
cuucuaccucagggacaaa

SEQ ID NO: 2322 - RNA, 19 nt, artificial
  Oligomer
gaucauuaaggacggugag

SEQ ID NO: 2323 - RNA, 19 nt, artificial
  Oligomer
ggagaaaauaugacuggag

SEQ ID NO: 2324 - RNA, 19 nt, artificial
  Oligomer
ugaaauaaauucugauucu

SEQ ID NO: 2325 - RNA, 19 nt, artificial
  Oligomer
ggcuggagaaaauaugacu

SEQ ID NO: 2326 - RNA, 19 nt, artificial
  Oligomer
uacuuaucaagcugaaaga

SEQ ID NO: 2327 - RNA, 19 nt, artificial
  Oligomer
uguucacauagugaaauaa

SEQ ID NO: 2328 - RNA, 19 nt, artificial
  Oligomer
ugagcagcaugaagaucuc

SEQ ID NO: 2329 - RNA, 19 nt, artificial
  Oligomer
cucagaaauuacuauuccu

SEQ ID NO: 2330 - RNA, 19 nt, artificial
  Oligomer
gugagaggaaagggaagga

SEQ ID NO: 2331 - RNA, 19 nt, artificial
  Oligomer
gguagagcaccaugaucac

SEQ ID NO: 2332 - RNA, 19 nt, artificial
  Oligomer
cccgagaaaggaaauaugg

SEQ ID NO: 2333 - RNA, 19 nt, artificial
  Oligomer
cauuaaggacggugagcag

SEQ ID NO: 2334 - RNA, 19 nt, artificial
  Oligomer
uggguaaaggagcauuuuu

SEQ ID NO: 2335 - RNA, 19 nt, artificial
  Oligomer
caauccguuggagucagca

SEQ ID NO: 2336 - RNA, 19 nt, artificial
  Oligomer
ucgaauggguaaaggagca

SEQ ID NO: 2337 - RNA, 19 nt, artificial
  Oligomer
aaggaggaggucccgaaua

SEQ ID NO: 2338 - RNA, 19 nt, artificial
  Oligomer
gagcagcaugaagaucuca

SEQ ID NO: 2339 - RNA, 19 nt, artificial
  Oligomer
gaaauaaauucugauucuu

SEQ ID NO: 2340 - RNA, 19 nt, artificial
  Oligomer
cuacgauauaaaguuggga

SEQ ID NO: 2341 - RNA, 19 nt, artificial
  Oligomer
ggaaaaagucagacgagag

SEQ ID NO: 2342 - RNA, 19 nt, artificial
  Oligomer
ugugcuauggaacaucuuu

SEQ ID NO: 2343 - RNA, 19 nt, artificial
  Oligomer
guaaauucuuaauguucac

SEQ ID NO: 2344 - RNA, 19 nt, artificial
  Oligomer
ccaugaucacgcuguugug

SEQ ID NO: 2345 - RNA, 19 nt, artificial
  Oligomer
ucuucuaccucagggacaa

SEQ ID NO: 2346 - RNA, 19 nt, artificial
  Oligomer
gaggaggagucugcguaau

SEQ ID NO: 2347 - RNA, 19 nt, artificial
  Oligomer
uacgauauaaaguugggaa

SEQ ID NO: 2348 - RNA, 19 nt, artificial
  Oligomer
uaaggacggugagcagcau

SEQ ID NO: 2349 - RNA, 19 nt, artificial
  Oligomer
auaaauucugauucuucua

SEQ ID NO: 2350 - RNA, 19 nt, artificial
  Oligomer
aagcuauuggucuugugga

SEQ ID NO: 2351 - RNA, 19 nt, artificial
  Oligomer
agcaacuggaccauggaaa

SEQ ID NO: 2352 - RNA, 19 nt, artificial
  Oligomer
auguucacauagugaaaua

SEQ ID NO: 2353 - RNA, 19 nt, artificial
  Oligomer
gguuaaggugaugcccaau

SEQ ID NO: 2354 - RNA, 19 nt, artificial
  Oligomer
uugugaauauuuucaacua

SEQ ID NO: 2355 - RNA, 19 nt, artificial
  Oligomer
ggacaguaguuugcccaca

SEQ ID NO: 2356 - RNA, 19 nt, artificial
  Oligomer
acaguugguguuuuugcaa

SEQ ID NO: 2357 - RNA, 19 nt, artificial
  Oligomer
gcuuccggguaaaugcaga

SEQ ID NO: 2358 - RNA, 19 nt, artificial
  Oligomer
ccgagaaaggaaauauggg

SEQ ID NO: 2359 - RNA, 19 nt, artificial
  Oligomer
ugugaauauuuucaacuau

SEQ ID NO: 2360 - RNA, 19 nt, artificial
  Oligomer
ucaucuucuaccucaggga

SEQ ID NO: 2361 - RNA, 19 nt, artificial
  Oligomer
aauaaauucugauucuucu

SEQ ID NO: 2362 - RNA, 19 nt, artificial
  Oligomer
aaggugaugcccaaugcua

SEQ ID NO: 2363 - RNA, 19 nt, artificial
  Oligomer
aggagcauuuuuuuauuca

SEQ ID NO: 2364 - RNA, 19 nt, artificial
  Oligomer
aggacuacggcaaaggugu

SEQ ID NO: 2365 - RNA, 19 nt, artificial
  Oligomer
aggaggucgaauggguaaa

SEQ ID NO: 2366 - RNA, 19 nt, artificial
  Oligomer
agcauuuuuuuauucagca

SEQ ID NO: 2367 - RNA, 19 nt, artificial
  Oligomer
gugcaauccguuggaguca

SEQ ID NO: 2368 - RNA, 19 nt, artificial
  Oligomer
agugaaauaaauucugauu

SEQ ID NO: 2369 - RNA, 19 nt, artificial
  Oligomer
caguaguuugcccacaguu

SEQ ID NO: 2370 - RNA, 19 nt, artificial
  Oligomer
guauccgaucagagaguga

SEQ ID NO: 2371 - RNA, 19 nt, artificial
  Oligomer
gcuucuacgauauaaaguu

SEQ ID NO: 2372 - RNA, 19 nt, artificial
  Oligomer
cuuaauguucacauaguga

SEQ ID NO: 2373 - RNA, 19 nt, artificial
  Oligomer
uugugcuauggaacaucuu

SEQ ID NO: 2374 - RNA, 19 nt, artificial
  Oligomer
ucacauagugaaauaaauu

SEQ ID NO: 2375 - RNA, 19 nt, artificial
  Oligomer
gcuguugugaguggaagau

SEQ ID NO: 2376 - RNA, 19 nt, artificial
  Oligomer
aggaaauaugggaaagauc

SEQ ID NO: 2377 - RNA, 19 nt, artificial
  Oligomer
auaugacuggagcugcuaa

SEQ ID NO: 2378 - RNA, 19 nt, artificial
  Oligomer
ugaucacgcuguugugagu

SEQ ID NO: 2379 - RNA, 19 nt, artificial
  Oligomer
uagcggucgccgaaauguu

SEQ ID NO: 2380 - RNA, 19 nt, artificial
  Oligomer
auagugaaauaaauucuga

SEQ ID NO: 2381 - RNA, 19 nt, artificial
  Oligomer
ugcccaaugcuauugugca

SEQ ID NO: 2382 - RNA, 19 nt, artificial
  Oligomer
acggcaggaagguagaaac

SEQ ID NO: 2383 - RNA, 19 nt, artificial
  Oligomer
cuugggcacagaagugauu

SEQ ID NO: 2384 - RNA, 19 nt, artificial
  Oligomer
uggaccauggaaaaaguca

SEQ ID NO: 2385 - RNA, 19 nt, artificial
  Oligomer
auggaacaucuuuaaccga

SEQ ID NO: 2386 - RNA, 19 nt, artificial
  Oligomer
cgaauggguaaaggagcau

SEQ ID NO: 2387 - RNA, 19 nt, artificial
  Oligomer
cacagagcagucaggaacu

SEQ ID NO: 2388 - RNA, 19 nt, artificial
  Oligomer
uugcaaaagcaacugcaca

SEQ ID NO: 2389 - RNA, 19 nt, artificial
  Oligomer
auagcaaggaagaucauua

SEQ ID NO: 2390 - RNA, 19 nt, artificial
  Oligomer
uguugugaguggaagauug

SEQ ID NO: 2391 - RNA, 19 nt, artificial
  Oligomer
aaggugucaucuucuaccu

SEQ ID NO: 2392 - RNA, 19 nt, artificial
  Oligomer
ugcaugcuucuacgauaua

SEQ ID NO: 2393 - RNA, 19 nt, artificial
  Oligomer
acaguaguuugcccacagu

SEQ ID NO: 2394 - RNA, 19 nt, artificial
  Oligomer
gaagguagaaacugaccac

SEQ ID NO: 2395 - RNA, 19 nt, artificial
  Oligomer
cacgcucuaacaucugggu

SEQ ID NO: 2396 - RNA, 19 nt, artificial
  Oligomer
cagcaugaagaucucaaug

SEQ ID NO: 2397 - RNA, 19 nt, artificial
  Oligomer
ggaagaucauuaaggacgg

SEQ ID NO: 2398 - RNA, 19 nt, artificial
  Oligomer
agcaugaagaucucaauga

SEQ ID NO: 2399 - RNA, 19 nt, artificial
  Oligomer
gaggagucugcguaaugug

SEQ ID NO: 2400 - RNA, 19 nt, artificial
  Oligomer
aacuauguagguaaauucu

SEQ ID NO: 2401 - RNA, 19 nt, artificial
  Oligomer
gagaaaauaugacuggagc

SEQ ID NO: 2402 - RNA, 19 nt, artificial
  Oligomer
cuuugaagcagaagcuggu

SEQ ID NO: 2403 - RNA, 19 nt, artificial
  Oligomer
gaugcugcaugcuucuacg

SEQ ID NO: 2404 - RNA, 19 nt, artificial
  Oligomer
cgaucagagagugagacag

SEQ ID NO: 2405 - RNA, 19 nt, artificial
  Oligomer
uuaauguucacauagugaa

SEQ ID NO: 2406 - RNA, 19 nt, artificial
  Oligomer
caggagaugcugcaugcuu

SEQ ID NO: 2407 - RNA, 19 nt, artificial
  Oligomer
agagcagucaggaacuggu

SEQ ID NO: 2408 - RNA, 19 nt, artificial
  Oligomer
caacuauguagguaaauuc

SEQ ID NO: 2409 - RNA, 19 nt, artificial
  Oligomer
caucagucaauguucugga

SEQ ID NO: 2410 - RNA, 19 nt, artificial
  Oligomer
uggaaauagacucagauuu

SEQ ID NO: 2411 - RNA, 19 nt, artificial
  Oligomer
gaacaucuuuaaccgaaug

SEQ ID NO: 2412 - RNA, 19 nt, artificial
  Oligomer
caaaggugucaucuucuac

SEQ ID NO: 2413 - RNA, 19 nt, artificial
  Oligomer
ugaauauuuucaacuaugu

SEQ ID NO: 2414 - RNA, 19 nt, artificial
  Oligomer
ggaacugguauccgaucag

SEQ ID NO: 2415 - RNA, 19 nt, artificial
  Oligomer
caauguucuggagugauuu

SEQ ID NO: 2416 - RNA, 19 nt, artificial
  Oligomer
uaaauucugauucuucuaa

SEQ ID NO: 2417 - RNA, 19 nt, artificial
  Oligomer
uuuucaacuauguagguaa

SEQ ID NO: 2418 - RNA, 19 nt, artificial
  Oligomer
guagaaacugaccacauag

SEQ ID NO: 2419 - RNA, 19 nt, artificial
  Oligomer
auguagguaaauucuuaau

SEQ ID NO: 2420 - RNA, 19 nt, artificial
  Oligomer
ggaaauaugggaaagaucc

SEQ ID NO: 2421 - RNA, 19 nt, artificial
  Oligomer
gaaaggaaauaugggaaag

SEQ ID NO: 2422 - RNA, 19 nt, artificial
  Oligomer
ggaggucgaauggguaaag

SEQ ID NO: 2423 - RNA, 19 nt, artificial
  Oligomer
aauggguaaaggagcauuu

SEQ ID NO: 2424 - RNA, 19 nt, artificial
  Oligomer
aaauaugacuggagcugcu

SEQ ID NO: 2425 - RNA, 19 nt, artificial
  Oligomer
gacuacggcaaagguguca

SEQ ID NO: 2426 - RNA, 19 nt, artificial
  Oligomer
cauucaugaagacugaagc

SEQ ID NO: 2427 - RNA, 19 nt, artificial
  Oligomer
gaaauguuccgguguggag

SEQ ID NO: 2428 - RNA, 19 nt, artificial
  Oligomer
gcauuuuuuuauucagcag

SEQ ID NO: 2429 - RNA, 19 nt, artificial
  Oligomer
caaguccuuugugaauauu

SEQ ID NO: 2430 - RNA, 19 nt, artificial
  Oligomer
gacaguaguuugcccacag

SEQ ID NO: 2431 - RNA, 19 nt, artificial
  Oligomer
auggguaaaggagcauuuu

SEQ ID NO: 2432 - RNA, 19 nt, artificial
  Oligomer
gaaauuacuauuccuccca

SEQ ID NO: 2433 - RNA, 19 nt, artificial
  Oligomer
gaaauagacucagauuuug

SEQ ID NO: 2434 - RNA, 19 nt, artificial
  Oligomer
aggaacugguauccgauca

SEQ ID NO: 2435 - RNA, 19 nt, artificial
  Oligomer
agcagucaggaacugguau

SEQ ID NO: 2436 - RNA, 19 nt, artificial
  Oligomer
accucagggacaaaguggu

SEQ ID NO: 2437 - RNA, 19 nt, artificial
  Oligomer
cauuuuuuuauucagcaga

SEQ ID NO: 2438 - RNA, 19 nt, artificial
  Oligomer
gaagaucauuaaggacggu

SEQ ID NO: 2439 - RNA, 19 nt, artificial
  Oligomer
gugcuuugaagcagaagcu

SEQ ID NO: 2440 - RNA, 19 nt, artificial
  Oligomer
agcuauuggucuuguggac

SEQ ID NO: 2441 - RNA, 19 nt, artificial
  Oligomer
agucaauguucuggaguga

SEQ ID NO: 2442 - RNA, 19 nt, artificial
  Oligomer
gugugaaugaucaaguccu

SEQ ID NO: 2443 - RNA, 19 nt, artificial
  Oligomer
aauagacucagauuuuggu

SEQ ID NO: 2444 - RNA, 19 nt, artificial
  Oligomer
cuguugugaguggaagauu

SEQ ID NO: 2445 - RNA, 19 nt, artificial
  Oligomer
ucacgcuguugugagugga

SEQ ID NO: 2446 - RNA, 19 nt, artificial
  Oligomer
agcuacaagcacgcucuaa

SEQ ID NO: 2447 - RNA, 19 nt, artificial
  Oligomer
agagcaccaugaucacgcu

SEQ ID NO: 2448 - RNA, 19 nt, artificial
  Oligomer
cgaauaccucagcaacugg

SEQ ID NO: 2449 - RNA, 19 nt, artificial
  Oligomer
augugcgugugaagagacu

SEQ ID NO: 2450 - RNA, 19 nt, artificial
  Oligomer
gagaugcugcaugcuucua

SEQ ID NO: 2451 - RNA, 19 nt, artificial
  Oligomer
aacugguauccgaucagag

SEQ ID NO: 2452 - RNA, 19 nt, artificial
  Oligomer
augcuucuacgauauaaag

SEQ ID NO: 2453 - RNA, 19 nt, artificial
  Oligomer
uaaggugaugcccaaugcu

SEQ ID NO: 2454 - RNA, 19 nt, artificial
  Oligomer
agaagugauucaacucuuc

SEQ ID NO: 2455 - RNA, 19 nt, artificial
  Oligomer
augaagaucucaaugaagu

SEQ ID NO: 2456 - RNA, 19 nt, artificial
  Oligomer
cuuugugaauauuuucaac

SEQ ID NO: 2457 - RNA, 19 nt, artificial
  Oligomer
caugaucacgcuguuguga

SEQ ID NO: 2458 - RNA, 19 nt, artificial
  Oligomer
uucuuaauguucacauagu

SEQ ID NO: 2459 - RNA, 19 nt, artificial
  Oligomer
agaaaauaugacuggagcu

SEQ ID NO: 2460 - RNA, 19 nt, artificial
  Oligomer
acuauguagguaaauucuu

SEQ ID NO: 2461 - RNA, 19 nt, artificial
  Oligomer
uauugugcaauccguugga

SEQ ID NO: 2462 - RNA, 19 nt, artificial
  Oligomer
aagguagaaacugaccaca

SEQ ID NO: 2463 - RNA, 19 nt, artificial
  Oligomer
cuacggcaaaggugucauc

SEQ ID NO: 2464 - RNA, 19 nt, artificial
  Oligomer
guggacaguaguuugccca

SEQ ID NO: 2465 - RNA, 19 nt, artificial
  Oligomer
cuaccucagggacaaagug

SEQ ID NO: 2466 - RNA, 19 nt, artificial
  Oligomer
uaaaggagcauuuuuuuau

SEQ ID NO: 2467 - RNA, 19 nt, artificial
  Oligomer
auugugcuauggaacaucu

SEQ ID NO: 2468 - RNA, 19 nt, artificial
  Oligomer
aggagaugcugcaugcuuc

SEQ ID NO: 2469 - RNA, 19 nt, artificial
  Oligomer
gaauggguaaaggagcauu

SEQ ID NO: 2470 - RNA, 19 nt, artificial
  Oligomer
agaucucaaugaaguagcc

SEQ ID NO: 2471 - RNA, 19 nt, artificial
  Oligomer
gggugcuuugaagcagaag

SEQ ID NO: 2472 - RNA, 19 nt, artificial
  Oligomer
uuaaggacggugagcagca

SEQ ID NO: 2473 - RNA, 19 nt, artificial
  Oligomer
aaaugcagagcuacaagca

SEQ ID NO: 2474 - RNA, 19 nt, artificial
  Oligomer
ucuuaauguucacauagug

SEQ ID NO: 2475 - RNA, 19 nt, artificial
  Oligomer
gaugcccaaugcuauugug

SEQ ID NO: 2476 - RNA, 19 nt, artificial
  Oligomer
ugagugugaaugaucaagu

SEQ ID NO: 2477 - RNA, 19 nt, artificial
  Oligomer
gcuauggaacaucuuuaac

SEQ ID NO: 2478 - RNA, 19 nt, artificial
  Oligomer
aaaagcaacugcacaagac

SEQ ID NO: 2479 - RNA, 19 nt, artificial
  Oligomer
cacagaagugauucaacuc

SEQ ID NO: 2480 - RNA, 19 nt, artificial
  Oligomer
augaucaaguccuuuguga

SEQ ID NO: 2481 - RNA, 19 nt, artificial
  Oligomer
gcuacaagcacgcucuaac

SEQ ID NO: 2482 - RNA, 19 nt, artificial
  Oligomer
ccgaauaccucagcaacug

SEQ ID NO: 2483 - RNA, 19 nt, artificial
  Oligomer
guguuuuugcaaaagcaac

SEQ ID NO: 2484 - RNA, 19 nt, artificial
  Oligomer
cagagagugagacagaguc

SEQ ID NO: 2485 - RNA, 19 nt, artificial
  Oligomer
ucaacuauguagguaaauu

SEQ ID NO: 2486 - RNA, 19 nt, artificial
  Oligomer
aaguccuuugugaauauuu

SEQ ID NO: 2487 - RNA, 19 nt, artificial
  Oligomer
cggguaaaugcagagcuac

SEQ ID NO: 2488 - RNA, 19 nt, artificial
  Oligomer
cauagugaaauaaauucug

SEQ ID NO: 2489 - RNA, 19 nt, artificial
  Oligomer
guaaugugcgugugaagag

SEQ ID NO: 2490 - RNA, 19 nt, artificial
  Oligomer
gugagcagcaugaagaucu

SEQ ID NO: 2491 - RNA, 19 nt, artificial
  Oligomer
ugaagcuauuggucuugug

SEQ ID NO: 2492 - RNA, 19 nt, artificial
  Oligomer
uguuuuugcaaaagcaacu

SEQ ID NO: 2493 - RNA, 19 nt, artificial
  Oligomer
uauggaacaucuuuaaccg

SEQ ID NO: 2494 - RNA, 19 nt, artificial
  Oligomer
auuggucuuguggacagua

SEQ ID NO: 2495 - RNA, 19 nt, artificial
  Oligomer
ggagcccaauguugaguug

SEQ ID NO: 2496 - RNA, 19 nt, artificial
  Oligomer
auucaacauucaugaagac

SEQ ID NO: 2497 - RNA, 19 nt, artificial
  Oligomer
cugguauccgaucagagag

SEQ ID NO: 2498 - RNA, 19 nt, artificial
  Oligomer
ugcuauugugcaauccguu

SEQ ID NO: 2499 - RNA, 19 nt, artificial
  Oligomer
aaguuacuuaucaagcuga

SEQ ID NO: 2500 - RNA, 19 nt, artificial
  Oligomer
auccguuggagucagcagu

SEQ ID NO: 2501 - RNA, 19 nt, artificial
  Oligomer
cuucucuguccaaugccca

SEQ ID NO: 2502 - RNA, 19 nt, artificial
  Oligomer
ucuaccucagggacaaagu

SEQ ID NO: 2503 - RNA, 19 nt, artificial
  Oligomer
ucagagagugagacagagu

SEQ ID NO: 2504 - RNA, 19 nt, artificial
  Oligomer
acgauauaaaguugggaag

SEQ ID NO: 2505 - RNA, 19 nt, artificial
  Oligomer
cuauuggucuuguggacag

SEQ ID NO: 2506 - RNA, 19 nt, artificial
  Oligomer
ggcuaugaagcuauugguc

SEQ ID NO: 2507 - RNA, 19 nt, artificial
  Oligomer
cagaaauuacuauuccucc

SEQ ID NO: 2508 - RNA, 19 nt, artificial
  Oligomer
auggaaaaagucagacgag

SEQ ID NO: 2509 - RNA, 19 nt, artificial
  Oligomer
aagcugaaagacggcagga

SEQ ID NO: 2510 - RNA, 19 nt, artificial
  Oligomer
gagcauuuuuuuauucagc

SEQ ID NO: 2511 - RNA, 19 nt, artificial
  Oligomer
aaauucuuaauguucacau

SEQ ID NO: 2512 - RNA, 19 nt, artificial
  Oligomer
ucuuguggacaguaguuug

SEQ ID NO: 2513 - RNA, 19 nt, artificial
  Oligomer
guugugaguggaagauugg

SEQ ID NO: 2514 - RNA, 19 nt, artificial
  Oligomer
cgauauaaaguugggaagg

SEQ ID NO: 2515 - RNA, 19 nt, artificial
  Oligomer
accucagcaacuggaccau

SEQ ID NO: 2516 - RNA, 19 nt, artificial
  Oligomer
uuuugcaaaagcaacugca

SEQ ID NO: 2517 - RNA, 19 nt, artificial
  Oligomer
gugaauauuuucaacuaug

SEQ ID NO: 2518 - RNA, 19 nt, artificial
  Oligomer
gcuauuggucuuguggaca

SEQ ID NO: 2519 - RNA, 19 nt, artificial
  Oligomer
aauccguuggagucagcag

SEQ ID NO: 2520 - RNA, 19 nt, artificial
  Oligomer
augcuauugugcaauccgu

SEQ ID NO: 2521 - RNA, 19 nt, artificial
  Oligomer
gaaaaagucagacgagagg

SEQ ID NO: 2522 - RNA, 19 nt, artificial
  Oligomer
caggaacugguauccgauc

SEQ ID NO: 2523 - RNA, 19 nt, artificial
  Oligomer
aaggaagaucauuaaggac

SEQ ID NO: 2524 - RNA, 19 nt, artificial
  Oligomer
ugcccacaguugguguuuu

SEQ ID NO: 2525 - RNA, 19 nt, artificial
  Oligomer
ggcaggaagguagaaacug

SEQ ID NO: 2526 - RNA, 19 nt, artificial
  Oligomer
uaguuugcccacaguuggu

SEQ ID NO: 2527 - RNA, 19 nt, artificial
  Oligomer
gauugugcuauggaacauc

SEQ ID NO: 2528 - RNA, 19 nt, artificial
  Oligomer
caaguuacuuaucaagcug

SEQ ID NO: 2529 - RNA, 19 nt, artificial
  Oligomer
uagaaacugaccacauagu

SEQ ID NO: 2530 - RNA, 19 nt, artificial
  Oligomer
ucaauguucuggagugauu

SEQ ID NO: 2531 - RNA, 19 nt, artificial
  Oligomer
aggaggagucugcguaaug

SEQ ID NO: 2532 - RNA, 19 nt, artificial
  Oligomer
acauagugaaauaaauucu

SEQ ID NO: 2533 - RNA, 19 nt, artificial
  Oligomer
gcaaaagcaacugcacaag

SEQ ID NO: 2534 - RNA, 19 nt, artificial
  Oligomer
ccucagaaauuacuauucc

SEQ ID NO: 2535 - RNA, 19 nt, artificial
  Oligomer
acuacggcaaaggugucau

SEQ ID NO: 2536 - RNA, 19 nt, artificial
  Oligomer
guugguguuuuugcaaaag

SEQ ID NO: 2537 - RNA, 19 nt, artificial
  Oligomer
auauaaaguugggaaggag

SEQ ID NO: 2538 - RNA, 19 nt, artificial
  Oligomer
cuggaccauggaaaaaguc

SEQ ID NO: 2539 - RNA, 19 nt, artificial
  Oligomer
uauuggucuuguggacagu

SEQ ID NO: 2540 - RNA, 19 nt, artificial
  Oligomer
gccucagaaauuacuauuc

SEQ ID NO: 2541 - RNA, 19 nt, artificial
  Oligomer
ugguauccgaucagagagu

SEQ ID NO: 2542 - RNA, 19 nt, artificial
  Oligomer
cagucaauguucuggagug

SEQ ID NO: 2543 - RNA, 19 nt, artificial
  Oligomer
aucagagagugagacagag

SEQ ID NO: 2544 - RNA, 19 nt, artificial
  Oligomer
ugcugcaugcuucuacgau

SEQ ID NO: 2545 - RNA, 19 nt, artificial
  Oligomer
gugaaugaucaaguccuuu

SEQ ID NO: 2546 - RNA, 19 nt, artificial
  Oligomer
gaagcuauuggucuugugg

SEQ ID NO: 2547 - RNA, 19 nt, artificial
  Oligomer
agguaaauucuuaauguuc

SEQ ID NO: 2548 - RNA, 19 nt, artificial
  Oligomer
agcaaggaagaucauuaag

SEQ ID NO: 2549 - RNA, 19 nt, artificial
  Oligomer
aucaaguccuuugugaaua

SEQ ID NO: 2550 - RNA, 19 nt, artificial
  Oligomer
gcaacugcacaagacaacc

SEQ ID NO: 2551 - RNA, 19 nt, artificial
  Oligomer
gcuaugaagcuauuggucu

SEQ ID NO: 2552 - RNA, 19 nt, artificial
  Oligomer
ugaaagacggcaggaaggu

SEQ ID NO: 2553 - RNA, 19 nt, artificial
  Oligomer
ugcuucuacgauauaaagu

SEQ ID NO: 2554 - RNA, 19 nt, artificial
  Oligomer
gcuggagaaaauaugacug

SEQ ID NO: 2555 - RNA, 19 nt, artificial
  Oligomer
aacuggaccauggaaaaag

SEQ ID NO: 2556 - RNA, 19 nt, artificial
  Oligomer
guaguuugcccacaguugg

SEQ ID NO: 2557 - RNA, 19 nt, artificial
  Oligomer
guaaaugcagagcuacaag

SEQ ID NO: 2558 - RNA, 19 nt, artificial
  Oligomer
guccuuugugaauauuuuc

SEQ ID NO: 2559 - RNA, 19 nt, artificial
  Oligomer
ggccuggaaauagacucag

SEQ ID NO: 2560 - RNA, 19 nt, artificial
  Oligomer
uuggucuuguggacaguag

SEQ ID NO: 2561 - RNA, 19 nt, artificial
  Oligomer
caucuucuaccucagggac

SEQ ID NO: 2562 - RNA, 19 nt, artificial
  Oligomer
uccuuugugaauauuuuca

SEQ ID NO: 2563 - RNA, 19 nt, artificial
  Oligomer
gaagaucucaaugaaguag

SEQ ID NO: 2564 - RNA, 19 nt, artificial
  Oligomer
auuacuauuccucccagca

SEQ ID NO: 2565 - RNA, 19 nt, artificial
  Oligomer
augcugcaugcuucuacga

SEQ ID NO: 2566 - RNA, 19 nt, artificial
  Oligomer
ucauuaaggacggugagca

SEQ ID NO: 2567 - RNA, 19 nt, artificial
  Oligomer
uugugcaauccguuggagu

SEQ ID NO: 2568 - RNA, 19 nt, artificial
  Oligomer
ccauggaaaaagucagacg

SEQ ID NO: 2569 - RNA, 19 nt, artificial
  Oligomer
ggugcuuugaagcagaagc

SEQ ID NO: 2570 - RNA, 19 nt, artificial
  Oligomer
gaaacugaccacauagugg

SEQ ID NO: 2571 - RNA, 19 nt, artificial
  Oligomer
gaggucgaauggguaaagg

SEQ ID NO: 2572 - RNA, 19 nt, artificial
  Oligomer
acagaagugauucaacucu

SEQ ID NO: 2573 - RNA, 19 nt, artificial
  Oligomer
agcaacugcacaagacaac

SEQ ID NO: 2574 - RNA, 19 nt, artificial
  Oligomer
aaauuacuauuccucccag

SEQ ID NO: 2575 - RNA, 19 nt, artificial
  Oligomer
cuucuacgauauaaaguug

SEQ ID NO: 2576 - RNA, 19 nt, artificial
  Oligomer
aauaugacuggagcugcua

SEQ ID NO: 2577 - RNA, 19 nt, artificial
  Oligomer
ugugcaauccguuggaguc

SEQ ID NO: 2578 - RNA, 19 nt, artificial
  Oligomer
auucugauucuucuaaauu

SEQ ID NO: 2579 - RNA, 19 nt, artificial
  Oligomer
ugcaauccguuggagucag

SEQ ID NO: 2580 - RNA, 19 nt, artificial
  Oligomer
agaaacugaccacauagug

SEQ ID NO: 2581 - RNA, 19 nt, artificial
  Oligomer
aucuucuaccucagggaca

SEQ ID NO: 2582 - RNA, 19 nt, artificial
  Oligomer
uuaucaagcugaaagacgg

SEQ ID NO: 2583 - RNA, 19 nt, artificial
  Oligomer
aguaguuugcccacaguug

SEQ ID NO: 2584 - RNA, 19 nt, artificial
  Oligomer
agaaauuacuauuccuccc

SEQ ID NO: 2585 - RNA, 19 nt, artificial
  Oligomer
aaacuauucaacauucaug

SEQ ID NO: 2586 - RNA, 19 nt, artificial
  Oligomer
gucaauguucuggagugau

SEQ ID NO: 2587 - RNA, 19 nt, artificial
  Oligomer
aagugauucaacucuuccc

SEQ ID NO: 2588 - RNA, 19 nt, artificial
  Oligomer
gaagugauucaacucuucc

SEQ ID NO: 2589 - RNA, 19 nt, artificial
  Oligomer
cacauagugaaauaaauuc

SEQ ID NO: 2590 - RNA, 19 nt, artificial
  Oligomer
aaauagacucagauuuugg

SEQ ID NO: 2591 - RNA, 19 nt, artificial
  Oligomer
gucgaauggguaaaggagc

SEQ ID NO: 2592 - RNA, 19 nt, artificial
  Oligomer
aaaggugucaucuucuacc

SEQ ID NO: 2593 - RNA, 19 nt, artificial
  Oligomer
cuggagaaaauaugacugg

SEQ ID NO: 2594 - RNA, 19 nt, artificial
  Oligomer
agagcuacaagcacgcucu

SEQ ID NO: 2595 - RNA, 19 nt, artificial
  Oligomer
gcaaggaagaucauuaagg

SEQ ID NO: 2596 - RNA, 19 nt, artificial
  Oligomer
cuauggaacaucuuuaacc

SEQ ID NO: 2597 - RNA, 19 nt, artificial
  Oligomer
aaagacggcaggaagguag

SEQ ID NO: 2598 - RNA, 19 nt, artificial
  Oligomer
ggcaaguuacuuaucaagc

SEQ ID NO: 2599 - RNA, 19 nt, artificial
  Oligomer
ugaugcccaaugcuauugu

SEQ ID NO: 2600 - RNA, 19 nt, artificial
  Oligomer
cuuccggguaaaugcagag

SEQ ID NO: 2601 - RNA, 19 nt, artificial
  Oligomer
uacaagcacgcucuaacau

SEQ ID NO: 2602 - RNA, 19 nt, artificial
  Oligomer
ucagggacaaaguggucgu

SEQ ID NO: 2603 - RNA, 19 nt, artificial
  Oligomer
acgcuguugugaguggaag

SEQ ID NO: 2604 - RNA, 19 nt, artificial
  Oligomer
uauuuucaacuauguaggu

SEQ ID NO: 2605 - RNA, 19 nt, artificial
  Oligomer
aaauaaauucugauucuuc

SEQ ID NO: 2606 - RNA, 19 nt, artificial
  Oligomer
gucuuguggacaguaguuu

SEQ ID NO: 2607 - RNA, 19 nt, artificial
  Oligomer
ccacaguugguguuuuugc

SEQ ID NO: 2608 - RNA, 19 nt, artificial
  Oligomer
aauguucacauagugaaau

SEQ ID NO: 2609 - RNA, 19 nt, artificial
  Oligomer
ggugagcagcaugaagauc

SEQ ID NO: 2610 - RNA, 19 nt, artificial
  Oligomer
uaccucagcaacuggacca

SEQ ID NO: 2611 - RNA, 19 nt, artificial
  Oligomer
aggugucaucuucuaccuc

SEQ ID NO: 2612 - RNA, 19 nt, artificial
  Oligomer
aaugcagagcuacaagcac

SEQ ID NO: 2613 - RNA, 19 nt, artificial
  Oligomer
uacggcaaaggugucaucu

SEQ ID NO: 2614 - RNA, 19 nt, artificial
  Oligomer
uggacaguaguuugcccac

SEQ ID NO: 2615 - RNA, 19 nt, artificial
  Oligomer
uuugcaaaagcaacugcac

SEQ ID NO: 2616 - RNA, 19 nt, artificial
  Oligomer
ugagaggaaagggaaggag

SEQ ID NO: 2617 - RNA, 19 nt, artificial
  Oligomer
cccaaugcuauugugcaau

SEQ ID NO: 2618 - RNA, 19 nt, artificial
  Oligomer
uaugacuggagcugcuaag

SEQ ID NO: 2619 - RNA, 19 nt, artificial
  Oligomer
acauucaugaagacugaag

SEQ ID NO: 2620 - RNA, 19 nt, artificial
  Oligomer
uguagguaaauucuuaaug

SEQ ID NO: 2621 - RNA, 19 nt, artificial
  Oligomer
aggaagguagaaacugacc

SEQ ID NO: 2622 - RNA, 19 nt, artificial
  Oligomer
uggagcccaauguugaguu

SEQ ID NO: 2623 - RNA, 19 nt, artificial
  Oligomer
uguggacaguaguuugccc

SEQ ID NO: 2624 - RNA, 19 nt, artificial
  Oligomer
agagagugagacagagucc

SEQ ID NO: 2625 - RNA, 19 nt, artificial
  Oligomer
ccaaugcuauugugcaauc

SEQ ID NO: 2626 - RNA, 19 nt, artificial
  Oligomer
agaugcugcaugcuucuac

SEQ ID NO: 2627 - RNA, 19 nt, artificial
  Oligomer
uguucuggagugauuuggg

SEQ ID NO: 2628 - RNA, 19 nt, artificial
  Oligomer
gucugcguaaugugcgugu

SEQ ID NO: 2629 - RNA, 19 nt, artificial
  Oligomer
gugaaauaaauucugauuc

SEQ ID NO: 2630 - RNA, 19 nt, artificial
  Oligomer
uauucagcagacuuucucu

SEQ ID NO: 2631 - RNA, 19 nt, artificial
  Oligomer
aggagucugcguaaugugc

SEQ ID NO: 2632 - RNA, 19 nt, artificial
  Oligomer
cuauucaacauucaugaag

SEQ ID NO: 2633 - RNA, 19 nt, artificial
  Oligomer
ucuacgauauaaaguuggg

SEQ ID NO: 2634 - RNA, 19 nt, artificial
  Oligomer
aauagcaaggaagaucauu

SEQ ID NO: 2635 - RNA, 19 nt, artificial
  Oligomer
gcagucaggaacugguauc

SEQ ID NO: 2636 - RNA, 19 nt, artificial
  Oligomer
aagcacgcucuaacaucug

SEQ ID NO: 2637 - RNA, 19 nt, artificial
  Oligomer
aauaccucagcaacuggac

SEQ ID NO: 2638 - RNA, 19 nt, artificial
  Oligomer
uucaacuauguagguaaau

SEQ ID NO: 2639 - RNA, 19 nt, artificial
  Oligomer
ucaacauucaugaagacug

SEQ ID NO: 2640 - RNA, 19 nt, artificial
  Oligomer
ugucaucuucuaccucagg

SEQ ID NO: 2641 - RNA, 19 nt, artificial
  Oligomer
agcacgcucuaacaucugg

SEQ ID NO: 2642 - RNA, 19 nt, artificial
  Oligomer
ggcaucagucaauguucug

SEQ ID NO: 2643 - RNA, 19 nt, artificial
  Oligomer
guuugcccacaguuggugu

SEQ ID NO: 2644 - RNA, 19 nt, artificial
  Oligomer
aaauguuccgguguggagg

SEQ ID NO: 2645 - RNA, 19 nt, artificial
  Oligomer
guucuggagugauuugggc

SEQ ID NO: 2646 - RNA, 19 nt, artificial
  Oligomer
cccacaguugguguuuuug

SEQ ID NO: 2647 - RNA, 19 nt, artificial
  Oligomer
auagcggucgccgaaaugu

SEQ ID NO: 2648 - RNA, 19 nt, artificial
  Oligomer
uuuuuauucagcagacuuu

SEQ ID NO: 2649 - RNA, 19 nt, artificial
  Oligomer
gcuugauguuggaucucaa

SEQ ID NO: 2650 - RNA, 19 nt, artificial
  Oligomer
agguggagaugaucuuaaa

SEQ ID NO: 2651 - RNA, 19 nt, artificial
  Oligomer
caagcacaauaaaacuaca

SEQ ID NO: 2652 - RNA, 19 nt, artificial
  Oligomer
uggagaugaucuuaaacaa

SEQ ID NO: 2653 - RNA, 19 nt, artificial
  Oligomer
ggagaugaucuuaaacaaa

SEQ ID NO: 2654 - RNA, 19 nt, artificial
  Oligomer
caaagagaagcaaaaucua

SEQ ID NO: 2655 - RNA, 19 nt, artificial
  Oligomer
ggugcacguaccaugagaa

SEQ ID NO: 2656 - RNA, 19 nt, artificial
  Oligomer
ugaccaaagagaagcaaaa

SEQ ID NO: 2657 - RNA, 19 nt, artificial
  Oligomer
ggaagagcugguggaugaa

SEQ ID NO: 2658 - RNA, 19 nt, artificial
  Oligomer
cccugucaguagaguagaa

SEQ ID NO: 2659 - RNA, 19 nt, artificial
  Oligomer
ggaugaagggcuggugaaa

SEQ ID NO: 2660 - RNA, 19 nt, artificial
  Oligomer
aggagaaguuaauccagua

SEQ ID NO: 2661 - RNA, 19 nt, artificial
  Oligomer
cgcauugcugagaacuuua

SEQ ID NO: 2662 - RNA, 19 nt, artificial
  Oligomer
ccaggauaugaccaccuua

SEQ ID NO: 2663 - RNA, 19 nt, artificial
  Oligomer
ccaagucugugacaccaga

SEQ ID NO: 2664 - RNA, 19 nt, artificial
  Oligomer
agcucuucaucgucagcaa

SEQ ID NO: 2665 - RNA, 19 nt, artificial
  Oligomer
gcauugcugagaacuuuaa

SEQ ID NO: 2666 - RNA, 19 nt, artificial
  Oligomer
agugggacagcaaccugua

SEQ ID NO: 2667 - RNA, 19 nt, artificial
  Oligomer
gaguuuugacugcuuggaa

SEQ ID NO: 2668 - RNA, 19 nt, artificial
  Oligomer
ccaccuuacucagcuacaa

SEQ ID NO: 2669 - RNA, 19 nt, artificial
  Oligomer
gcaaaaucuaccaggucaa

SEQ ID NO: 2670 - RNA, 19 nt, artificial
  Oligomer
agacacucagcgaccugaa

SEQ ID NO: 2671 - RNA, 19 nt, artificial
  Oligomer
cagguggagaugaucuuaa

SEQ ID NO: 2672 - RNA, 19 nt, artificial
  Oligomer
caagucugugacaccagaa

SEQ ID NO: 2673 - RNA, 19 nt, artificial
  Oligomer
augagaagggccuggugaa

SEQ ID NO: 2674 - RNA, 19 nt, artificial
  Oligomer
gggaaaguacaaccugaau

SEQ ID NO: 2675 - RNA, 19 nt, artificial
  Oligomer
ccugaauacccuuuucuga

SEQ ID NO: 2676 - RNA, 19 nt, artificial
  Oligomer
agaggaacuugguggugau

SEQ ID NO: 2677 - RNA, 19 nt, artificial
  Oligomer
uggacuaccuggaccucua

SEQ ID NO: 2678 - RNA, 19 nt, artificial
  Oligomer
uguggugcacguaccauga

SEQ ID NO: 2679 - RNA, 19 nt, artificial
  Oligomer
aguauaagccugcaguuaa

SEQ ID NO: 2680 - RNA, 19 nt, artificial
  Oligomer
aggaauuuuucccauugga

SEQ ID NO: 2681 - RNA, 19 nt, artificial
  Oligomer
uggugcacguaccaugaga

SEQ ID NO: 2682 - RNA, 19 nt, artificial
  Oligomer
cagaacgcauugcugagaa

SEQ ID NO: 2683 - RNA, 19 nt, artificial
  Oligomer
ccaacuucaaccaucucca

SEQ ID NO: 2684 - RNA, 19 nt, artificial
  Oligomer
uaaggucuuugacuuugaa

SEQ ID NO: 2685 - RNA, 19 nt, artificial
  Oligomer
cucacucaggagaaguuaa

SEQ ID NO: 2686 - RNA, 19 nt, artificial
  Oligomer
acuggaauccuuucagcaa

SEQ ID NO: 2687 - RNA, 19 nt, artificial
  Oligomer
caagagcccugucaguaga

SEQ ID NO: 2688 - RNA, 19 nt, artificial
  Oligomer
ugagaagggccuggugaaa

SEQ ID NO: 2689 - RNA, 19 nt, artificial
  Oligomer
ugucuagcuugauguugga

SEQ ID NO: 2690 - RNA, 19 nt, artificial
  Oligomer
cuuuaagccugggaaggaa

SEQ ID NO: 2691 - RNA, 19 nt, artificial
  Oligomer
cugaccaaagagaagcaaa

SEQ ID NO: 2692 - RNA, 19 nt, artificial
  Oligomer
caaaaucuaccaggucaaa

SEQ ID NO: 2693 - RNA, 19 nt, artificial
  Oligomer
ugagcuguaccucccacaa

SEQ ID NO: 2694 - RNA, 19 nt, artificial
  Oligomer
ggaaaguacaaccugaaua

SEQ ID NO: 2695 - RNA, 19 nt, artificial
  Oligomer
guauaagccugcaguuaac

SEQ ID NO: 2696 - RNA, 19 nt, artificial
  Oligomer
ggaauuuuucccauuggau

SEQ ID NO: 2697 - RNA, 19 nt, artificial
  Oligomer
gaaguauaagccugcaguu

SEQ ID NO: 2698 - RNA, 19 nt, artificial
  Oligomer
uggaauccuuucagcaaga

SEQ ID NO: 2699 - RNA, 19 nt, artificial
  Oligomer
cugugacaccagaacgcau

SEQ ID NO: 2700 - RNA, 19 nt, artificial
  Oligomer
uuccaugaagaguuuugaa

SEQ ID NO: 2701 - RNA, 19 nt, artificial
  Oligomer
ucauuuuuuuccuugcaaa

SEQ ID NO: 2702 - RNA, 19 nt, artificial
  Oligomer
acccuuuucugaccaaaga

SEQ ID NO: 2703 - RNA, 19 nt, artificial
  Oligomer
uggaggaucccaggaucaa

SEQ ID NO: 2704 - RNA, 19 nt, artificial
  Oligomer
gaccaaagagaagcaaaau

SEQ ID NO: 2705 - RNA, 19 nt, artificial
  Oligomer
ccagguggagaugaucuua

SEQ ID NO: 2706 - RNA, 19 nt, artificial
  Oligomer
gcuuggaacuggaauccuu

SEQ ID NO: 2707 - RNA, 19 nt, artificial
  Oligomer
gcaucuccaacuucaacca

SEQ ID NO: 2708 - RNA, 19 nt, artificial
  Oligomer
gaagggcuggugaaagcua

SEQ ID NO: 2709 - RNA, 19 nt, artificial
  Oligomer
aagggcuggugaaagcuau

SEQ ID NO: 2710 - RNA, 19 nt, artificial
  Oligomer
gagcccugucaguagagua

SEQ ID NO: 2711 - RNA, 19 nt, artificial
  Oligomer
acccauaucucacucagga

SEQ ID NO: 2712 - RNA, 19 nt, artificial
  Oligomer
gguugaguuuugacugcuu

SEQ ID NO: 2713 - RNA, 19 nt, artificial
  Oligomer
agaacuuuaaggucuuuga

SEQ ID NO: 2714 - RNA, 19 nt, artificial
  Oligomer
cuuuucugaccaaagagaa

SEQ ID NO: 2715 - RNA, 19 nt, artificial
  Oligomer
uggaugaagggcuggugaa

SEQ ID NO: 2716 - RNA, 19 nt, artificial
  Oligomer
cuuccaugaagaguuuuga

SEQ ID NO: 2717 - RNA, 19 nt, artificial
  Oligomer
cauuggaugagucgggcaa

SEQ ID NO: 2718 - RNA, 19 nt, artificial
  Oligomer
guaccucccacaaggauua

SEQ ID NO: 2719 - RNA, 19 nt, artificial
  Oligomer
cauuuuuuuccuugcaaau

SEQ ID NO: 2720 - RNA, 19 nt, artificial
  Oligomer
caggagaaguuaauccagu

SEQ ID NO: 2721 - RNA, 19 nt, artificial
  Oligomer
gcgugucuagcuugauguu

SEQ ID NO: 2722 - RNA, 19 nt, artificial
  Oligomer
uggaagagcugguggauga

SEQ ID NO: 2723 - RNA, 19 nt, artificial
  Oligomer
cauaucucacucaggagaa

SEQ ID NO: 2724 - RNA, 19 nt, artificial
  Oligomer
agggcuggugaaagcuauu

SEQ ID NO: 2725 - RNA, 19 nt, artificial
  Oligomer
agagaagcaaaaucuacca

SEQ ID NO: 2726 - RNA, 19 nt, artificial
  Oligomer
aagcgugaggagcucuuca

SEQ ID NO: 2727 - RNA, 19 nt, artificial
  Oligomer
aagccugcaguuaaccaga

SEQ ID NO: 2728 - RNA, 19 nt, artificial
  Oligomer
cgggcuauuuaaagguacg

SEQ ID NO: 2729 - RNA, 19 nt, artificial
  Oligomer
cauggaagagcugguggau

SEQ ID NO: 2730 - RNA, 19 nt, artificial
  Oligomer
cugagaacuuuaaggucuu

SEQ ID NO: 2731 - RNA, 19 nt, artificial
  Oligomer
gcaaugugguucccaguga

SEQ ID NO: 2732 - RNA, 19 nt, artificial
  Oligomer
cugcaguuaaccagauuga

SEQ ID NO: 2733 - RNA, 19 nt, artificial
  Oligomer
aaaucuaccaggucaaaau

SEQ ID NO: 2734 - RNA, 19 nt, artificial
  Oligomer
aaucuaccaggucaaaaua

SEQ ID NO: 2735 - RNA, 19 nt, artificial
  Oligomer
caaugugguucccagugac

SEQ ID NO: 2736 - RNA, 19 nt, artificial
  Oligomer
caccagaacgcauugcuga

SEQ ID NO: 2737 - RNA, 19 nt, artificial
  Oligomer
cucaggagaaguuaaucca

SEQ ID NO: 2738 - RNA, 19 nt, artificial
  Oligomer
gaagcaaaaucuaccaggu

SEQ ID NO: 2739 - RNA, 19 nt, artificial
  Oligomer
gaggagcucuucaucguca

SEQ ID NO: 2740 - RNA, 19 nt, artificial
  Oligomer
ccaugcagaggaacuuggu

SEQ ID NO: 2741 - RNA, 19 nt, artificial
  Oligomer
ccagugacaccaacauucu

SEQ ID NO: 2742 - RNA, 19 nt, artificial
  Oligomer
gguggagaugaucuuaaac

SEQ ID NO: 2743 - RNA, 19 nt, artificial
  Oligomer
gugacaccaacauucugga

SEQ ID NO: 2744 - RNA, 19 nt, artificial
  Oligomer
uuuccuugcaaauguagua

SEQ ID NO: 2745 - RNA, 19 nt, artificial
  Oligomer
ccacccauaucucacucag

SEQ ID NO: 2746 - RNA, 19 nt, artificial
  Oligomer
cuugaaguauaagccugca

SEQ ID NO: 2747 - RNA, 19 nt, artificial
  Oligomer
gccugcaguuaaccagauu

SEQ ID NO: 2748 - RNA, 19 nt, artificial
  Oligomer
cucauuuuuuuccuugcaa

SEQ ID NO: 2749 - RNA, 19 nt, artificial
  Oligomer
ccuuuucugaccaaagaga

SEQ ID NO: 2750 - RNA, 19 nt, artificial
  Oligomer
cauugcugagaacuuuaag

SEQ ID NO: 2751 - RNA, 19 nt, artificial
  Oligomer
agaguagaagucucuucca

SEQ ID NO: 2752 - RNA, 19 nt, artificial
  Oligomer
guuucuugccucauuuuuu

SEQ ID NO: 2753 - RNA, 19 nt, artificial
  Oligomer
gggaaggaauuuuucccau

SEQ ID NO: 2754 - RNA, 19 nt, artificial
  Oligomer
caacuucaaccaucuccag

SEQ ID NO: 2755 - RNA, 19 nt, artificial
  Oligomer
cuuggaacuggaauccuuu

SEQ ID NO: 2756 - RNA, 19 nt, artificial
  Oligomer
acgcauugcugagaacuuu

SEQ ID NO: 2757 - RNA, 19 nt, artificial
  Oligomer
aggauaugaccaccuuacu

SEQ ID NO: 2758 - RNA, 19 nt, artificial
  Oligomer
guucccagugacaccaaca

SEQ ID NO: 2759 - RNA, 19 nt, artificial
  Oligomer
accugaagcuggacuaccu

SEQ ID NO: 2760 - RNA, 19 nt, artificial
  Oligomer
agcgugaggagcucuucau

SEQ ID NO: 2761 - RNA, 19 nt, artificial
  Oligomer
ccucauuuuuuuccuugca

SEQ ID NO: 2762 - RNA, 19 nt, artificial
  Oligomer
ugguucccagugacaccaa

SEQ ID NO: 2763 - RNA, 19 nt, artificial
  Oligomer
ccuggaccucuaccuuauu

SEQ ID NO: 2764 - RNA, 19 nt, artificial
  Oligomer
agccugcaguuaaccagau

SEQ ID NO: 2765 - RNA, 19 nt, artificial
  Oligomer
guggagaugaucuuaaaca

SEQ ID NO: 2766 - RNA, 19 nt, artificial
  Oligomer
aguacaaccugaauacccu

SEQ ID NO: 2767 - RNA, 19 nt, artificial
  Oligomer
uacucagcuacaacaggaa

SEQ ID NO: 2768 - RNA, 19 nt, artificial
  Oligomer
gaaaguacaaccugaauac

SEQ ID NO: 2769 - RNA, 19 nt, artificial
  Oligomer
ccauaucucacucaggaga

SEQ ID NO: 2770 - RNA, 19 nt, artificial
  Oligomer
uuuuuuccuugcaaaugua

SEQ ID NO: 2771 - RNA, 19 nt, artificial
  Oligomer
ugggacagcaaccuguaga

SEQ ID NO: 2772 - RNA, 19 nt, artificial
  Oligomer
ggaaggaauuuuucccauu

SEQ ID NO: 2773 - RNA, 19 nt, artificial
  Oligomer
cuugauguuggaucucaag

SEQ ID NO: 2774 - RNA, 19 nt, artificial
  Oligomer
cuggaauccuuucagcaag

SEQ ID NO: 2775 - RNA, 19 nt, artificial
  Oligomer
ugaccaccuuacucagcua

SEQ ID NO: 2776 - RNA, 19 nt, artificial
  Oligomer
caugaagaguuuugaagcu

SEQ ID NO: 2777 - RNA, 19 nt, artificial
  Oligomer
caauaaaacuacagcccag

SEQ ID NO: 2778 - RNA, 19 nt, artificial
  Oligomer
gcuacaacaggaacuggag

SEQ ID NO: 2779 - RNA, 19 nt, artificial
  Oligomer
aucccaggaucaaggcgau

SEQ ID NO: 2780 - RNA, 19 nt, artificial
  Oligomer
cuagcuugauguuggaucu

SEQ ID NO: 2781 - RNA, 19 nt, artificial
  Oligomer
ccaagugaccuauaccugu

SEQ ID NO: 2782 - RNA, 19 nt, artificial
  Oligomer
ugacugcuuggaacuggaa

SEQ ID NO: 2783 - RNA, 19 nt, artificial
  Oligomer
ugcuuugcccuucuuucua

SEQ ID NO: 2784 - RNA, 19 nt, artificial
  Oligomer
agggucugugccuuguuga

SEQ ID NO: 2785 - RNA, 19 nt, artificial
  Oligomer
cagugacaccaacauucug

SEQ ID NO: 2786 - RNA, 19 nt, artificial
  Oligomer
gaguuuugaagcugugguu

SEQ ID NO: 2787 - RNA, 19 nt, artificial
  Oligomer
aaguauaagccugcaguua

SEQ ID NO: 2788 - RNA, 19 nt, artificial
  Oligomer
gugcacguaccaugagaag

SEQ ID NO: 2789 - RNA, 19 nt, artificial
  Oligomer
agaaguuaauccaguacug

SEQ ID NO: 2790 - RNA, 19 nt, artificial
  Oligomer
gcccugucaguagaguaga

SEQ ID NO: 2791 - RNA, 19 nt, artificial
  Oligomer
caggauaugaccaccuuac

SEQ ID NO: 2792 - RNA, 19 nt, artificial
  Oligomer
gcaguuaaccagauugagu

SEQ ID NO: 2793 - RNA, 19 nt, artificial
  Oligomer
guguuucuugccucauuuu

SEQ ID NO: 2794 - RNA, 19 nt, artificial
  Oligomer
agggcgugucuagcuugau

SEQ ID NO: 2795 - RNA, 19 nt, artificial
  Oligomer
aauuuuucccauuggauga

SEQ ID NO: 2796 - RNA, 19 nt, artificial
  Oligomer
guacaaccugaauacccuu

SEQ ID NO: 2797 - RNA, 19 nt, artificial
  Oligomer
cacuaacgguugaguuuug

SEQ ID NO: 2798 - RNA, 19 nt, artificial
  Oligomer
accuggaccucuaccuuau

SEQ ID NO: 2799 - RNA, 19 nt, artificial
  Oligomer
aaugugguucccagugaca

SEQ ID NO: 2800 - RNA, 19 nt, artificial
  Oligomer
agcuacaacaggaacugga

SEQ ID NO: 2801 - RNA, 19 nt, artificial
  Oligomer
ccaaagagaagcaaaaucu

SEQ ID NO: 2802 - RNA, 19 nt, artificial
  Oligomer
caguagaguagaagucucu

SEQ ID NO: 2803 - RNA, 19 nt, artificial
  Oligomer
gugaggagcucuucaucgu

SEQ ID NO: 2804 - RNA, 19 nt, artificial
  Oligomer
ucacucaggagaaguuaau

SEQ ID NO: 2805 - RNA, 19 nt, artificial
  Oligomer
aacgcauugcugagaacuu

SEQ ID NO: 2806 - RNA, 19 nt, artificial
  Oligomer
ccagaacgcauugcugaga

SEQ ID NO: 2807 - RNA, 19 nt, artificial
  Oligomer
guagaagucucuuccaguu

SEQ ID NO: 2808 - RNA, 19 nt, artificial
  Oligomer
cugucaguagaguagaagu

SEQ ID NO: 2809 - RNA, 19 nt, artificial
  Oligomer
aauacccuuuucugaccaa

SEQ ID NO: 2810 - RNA, 19 nt, artificial
  Oligomer
cacccauaucucacucagg

SEQ ID NO: 2811 - RNA, 19 nt, artificial
  Oligomer
gaagaguuuugaagcugug

SEQ ID NO: 2812 - RNA, 19 nt, artificial
  Oligomer
ccuugcaaauguaguaugg

SEQ ID NO: 2813 - RNA, 19 nt, artificial
  Oligomer
uugacugcuuggaacugga

SEQ ID NO: 2814 - RNA, 19 nt, artificial
  Oligomer
uguugagcuguaccuccca

SEQ ID NO: 2815 - RNA, 19 nt, artificial
  Oligomer
aguccaaaggcaucguggu

SEQ ID NO: 2816 - RNA, 19 nt, artificial
  Oligomer
cuguaccucccacaaggau

SEQ ID NO: 2817 - RNA, 19 nt, artificial
  Oligomer
gcuuuaagccugggaagga

SEQ ID NO: 2818 - RNA, 19 nt, artificial
  Oligomer
agcaaaaucuaccagguca

SEQ ID NO: 2819 - RNA, 19 nt, artificial
  Oligomer
ugugccuuguugagcugua

SEQ ID NO: 2820 - RNA, 19 nt, artificial
  Oligomer
auacccuuuucugaccaaa

SEQ ID NO: 2821 - RNA, 19 nt, artificial
  Oligomer
ugaagcuggacuaccugga

SEQ ID NO: 2822 - RNA, 19 nt, artificial
  Oligomer
aggagcucuucaucgucag

SEQ ID NO: 2823 - RNA, 19 nt, artificial
  Oligomer
ugauguuggaucucaagag

SEQ ID NO: 2824 - RNA, 19 nt, artificial
  Oligomer
cccuuuucugaccaaagag

SEQ ID NO: 2825 - RNA, 19 nt, artificial
  Oligomer
ucuccaacuucaaccaucu

SEQ ID NO: 2826 - RNA, 19 nt, artificial
  Oligomer
cccauaucucacucaggag

SEQ ID NO: 2827 - RNA, 19 nt, artificial
  Oligomer
cuuucagcaagacuucucu

SEQ ID NO: 2828 - RNA, 19 nt, artificial
  Oligomer
ugaagaguuuugaagcugu

SEQ ID NO: 2829 - RNA, 19 nt, artificial
  Oligomer
guaccagaaugagaaugag

SEQ ID NO: 2830 - RNA, 19 nt, artificial
  Oligomer
ggcgugucuagcuugaugu

SEQ ID NO: 2831 - RNA, 19 nt, artificial
  Oligomer
caaccugaauacccuuuuc

SEQ ID NO: 2832 - RNA, 19 nt, artificial
  Oligomer
cagcaagacuucucuuugc

SEQ ID NO: 2833 - RNA, 19 nt, artificial
  Oligomer
uuucuugccucauuuuuuu

SEQ ID NO: 2834 - RNA, 19 nt, artificial
  Oligomer
gaacuuuaaggucuuugac

SEQ ID NO: 2835 - RNA, 19 nt, artificial
  Oligomer
ucucaagagcccugucagu

SEQ ID NO: 2836 - RNA, 19 nt, artificial
  Oligomer
caucuccaacuucaaccau

SEQ ID NO: 2837 - RNA, 19 nt, artificial
  Oligomer
caguuugcuuugcccuucu

SEQ ID NO: 2838 - RNA, 19 nt, artificial
  Oligomer
uucccagugacaccaacau

SEQ ID NO: 2839 - RNA, 19 nt, artificial
  Oligomer
gagaugaucuuaaacaaac

SEQ ID NO: 2840 - RNA, 19 nt, artificial
  Oligomer
ccuucuuucuacccugcug

SEQ ID NO: 2841 - RNA, 19 nt, artificial
  Oligomer
cuaccaggucaaaauagug

SEQ ID NO: 2842 - RNA, 19 nt, artificial
  Oligomer
ggagaaguuaauccaguac

SEQ ID NO: 2843 - RNA, 19 nt, artificial
  Oligomer
agaugaucuuaaacaaacc

SEQ ID NO: 2844 - RNA, 19 nt, artificial
  Oligomer
agccugggaaggaauuuuu

SEQ ID NO: 2845 - RNA, 19 nt, artificial
  Oligomer
ggaccucuaccuuauucac

SEQ ID NO: 2846 - RNA, 19 nt, artificial
  Oligomer
gaauccuuucagcaagacu

SEQ ID NO: 2847 - RNA, 19 nt, artificial
  Oligomer
aauccuuucagcaagacuu

SEQ ID NO: 2848 - RNA, 19 nt, artificial
  Oligomer
acuaacgguugaguuuuga

SEQ ID NO: 2849 - RNA, 19 nt, artificial
  Oligomer
ucuaccaggucaaaauagu

SEQ ID NO: 2850 - RNA, 19 nt, artificial
  Oligomer
ucccagugacaccaacauu

SEQ ID NO: 2851 - RNA, 19 nt, artificial
  Oligomer
ugaaguauaagccugcagu

SEQ ID NO: 2852 - RNA, 19 nt, artificial
  Oligomer
aacuggaauccuuucagca

SEQ ID NO: 2853 - RNA, 19 nt, artificial
  Oligomer
ggaacuggaauccuuucag

SEQ ID NO: 2854 - RNA, 19 nt, artificial
  Oligomer
accuuacucagcuacaaca

SEQ ID NO: 2855 - RNA, 19 nt, artificial
  Oligomer
ccacuaacgguugaguuuu

SEQ ID NO: 2856 - RNA, 19 nt, artificial
  Oligomer
agcuugauguuggaucuca

SEQ ID NO: 2857 - RNA, 19 nt, artificial
  Oligomer
gcaagacuucucuuugccu

SEQ ID NO: 2858 - RNA, 19 nt, artificial
  Oligomer
cagaggaacuuggugguga

SEQ ID NO: 2859 - RNA, 19 nt, artificial
  Oligomer
ggacagcaaccuguagagu

SEQ ID NO: 2860 - RNA, 19 nt, artificial
  Oligomer
ucaggagaaguuaauccag

SEQ ID NO: 2861 - RNA, 19 nt, artificial
  Oligomer
gaauacccuuuucugacca

SEQ ID NO: 2862 - RNA, 19 nt, artificial
  Oligomer
ugggaaggaauuuuuccca

SEQ ID NO: 2863 - RNA, 19 nt, artificial
  Oligomer
uuaaggucuuugacuuuga

SEQ ID NO: 2864 - RNA, 19 nt, artificial
  Oligomer
gacugcuuggaacuggaau

SEQ ID NO: 2865 - RNA, 19 nt, artificial
  Oligomer
gaucucaagagcccuguca

SEQ ID NO: 2866 - RNA, 19 nt, artificial
  Oligomer
auuggaugagucgggcaau

SEQ ID NO: 2867 - RNA, 19 nt, artificial
  Oligomer
gucuuugacuuugaacuga

SEQ ID NO: 2868 - RNA, 19 nt, artificial
  Oligomer
aaaaucuaccaggucaaaa

SEQ ID NO: 2869 - RNA, 19 nt, artificial
  Oligomer
cgguugaguuuugacugcu

SEQ ID NO: 2870 - RNA, 19 nt, artificial
  Oligomer
cucaagagcccugucagua

SEQ ID NO: 2871 - RNA, 19 nt, artificial
  Oligomer
ccaagcacaauaaaacuac

SEQ ID NO: 2872 - RNA, 19 nt, artificial
  Oligomer
aucuccagguggagaugau

SEQ ID NO: 2873 - RNA, 19 nt, artificial
  Oligomer
acaauaaaacuacagccca

SEQ ID NO: 2874 - RNA, 19 nt, artificial
  Oligomer
ugagaacuuuaaggucuuu

SEQ ID NO: 2875 - RNA, 19 nt, artificial
  Oligomer
agaacgcauugcugagaac

SEQ ID NO: 2876 - RNA, 19 nt, artificial
  Oligomer
ucucacucaggagaaguua

SEQ ID NO: 2877 - RNA, 19 nt, artificial
  Oligomer
gccugggaaggaauuuuuc

SEQ ID NO: 2878 - RNA, 19 nt, artificial
  Oligomer
ggauaugaccaccuuacuc

SEQ ID NO: 2879 - RNA, 19 nt, artificial
  Oligomer
cuugccucauuuuuuuccu

SEQ ID NO: 2880 - RNA, 19 nt, artificial
  Oligomer
gaguagaagucucuuccag

SEQ ID NO: 2881 - RNA, 19 nt, artificial
  Oligomer
aguagaagucucuuccagu

SEQ ID NO: 2882 - RNA, 19 nt, artificial
  Oligomer
accugaauacccuuuucug

SEQ ID NO: 2883 - RNA, 19 nt, artificial
  Oligomer
uucugaccaaagagaagca

SEQ ID NO: 2884 - RNA, 19 nt, artificial
  Oligomer
gauaugaccaccuuacuca

SEQ ID NO: 2885 - RNA, 19 nt, artificial
  Oligomer
ugaguuuugacugcuugga

SEQ ID NO: 2886 - RNA, 19 nt, artificial
  Oligomer
accagaacgcauugcugag

SEQ ID NO: 2887 - RNA, 19 nt, artificial
  Oligomer
ucaaccaucuccaggugga

SEQ ID NO: 2888 - RNA, 19 nt, artificial
  Oligomer
cuaccuggaccucuaccuu

SEQ ID NO: 2889 - RNA, 19 nt, artificial
  Oligomer
ggcuugaaguauaagccug

SEQ ID NO: 2890 - RNA, 19 nt, artificial
  Oligomer
cccagugacaccaacauuc

SEQ ID NO: 2891 - RNA, 19 nt, artificial
  Oligomer
ccaugaagaguuuugaagc

SEQ ID NO: 2892 - RNA, 19 nt, artificial
  Oligomer
ucugaccaaagagaagcaa

SEQ ID NO: 2893 - RNA, 19 nt, artificial
  Oligomer
ggcuggugaaagcuauugg

SEQ ID NO: 2894 - RNA, 19 nt, artificial
  Oligomer
ugcccuucuuucuacccug

SEQ ID NO: 2895 - RNA, 19 nt, artificial
  Oligomer
ccaacauucuggacacgug

SEQ ID NO: 2896 - RNA, 19 nt, artificial
  Oligomer
uccagguggagaugaucuu

SEQ ID NO: 2897 - RNA, 19 nt, artificial
  Oligomer
gagaaguuaauccaguacu

SEQ ID NO: 2898 - RNA, 19 nt, artificial
  Oligomer
gaaggaauuuuucccauug

SEQ ID NO: 2899 - RNA, 19 nt, artificial
  Oligomer
aagacacucagcgaccuga

SEQ ID NO: 2900 - RNA, 19 nt, artificial
  Oligomer
gaauuuuucccauuggaug

SEQ ID NO: 2901 - RNA, 19 nt, artificial
  Oligomer
gcugagaacuuuaaggucu

SEQ ID NO: 2902 - RNA, 19 nt, artificial
  Oligomer
aguuugcuuugcccuucuu

SEQ ID NO: 2903 - RNA, 19 nt, artificial
  Oligomer
ugaagcgugaggagcucuu

SEQ ID NO: 2904 - RNA, 19 nt, artificial
  Oligomer
uugauguuggaucucaaga

SEQ ID NO: 2905 - RNA, 19 nt, artificial
  Oligomer
augagucgggcaauguggu

SEQ ID NO: 2906 - RNA, 19 nt, artificial
  Oligomer
gaugaucuuaaacaaaccu

SEQ ID NO: 2907 - RNA, 19 nt, artificial
  Oligomer
gugucuagcuugauguugg

SEQ ID NO: 2908 - RNA, 19 nt, artificial
  Oligomer
aguagaguagaagucucuu

SEQ ID NO: 2909 - RNA, 19 nt, artificial
  Oligomer
ugcaguuaaccagauugag

SEQ ID NO: 2910 - RNA, 19 nt, artificial
  Oligomer
ccauucaggagaagcucag

SEQ ID NO: 2911 - RNA, 19 nt, artificial
  Oligomer
ggucuuugacuuugaacug

SEQ ID NO: 2912 - RNA, 19 nt, artificial
  Oligomer
aguuuugacugcuuggaac

SEQ ID NO: 2913 - RNA, 19 nt, artificial
  Oligomer
aagcacaauaaaacuacag

SEQ ID NO: 2914 - RNA, 19 nt, artificial
  Oligomer
aaagagaagcaaaaucuac

SEQ ID NO: 2915 - RNA, 19 nt, artificial
  Oligomer
gcuuugcccuucuuucuac

SEQ ID NO: 2916 - RNA, 19 nt, artificial
  Oligomer
acgggcuauuuaaagguac

SEQ ID NO: 2917 - RNA, 19 nt, artificial
  Oligomer
cccuucuuucuacccugcu

SEQ ID NO: 2918 - RNA, 19 nt, artificial
  Oligomer
uggaccucuaccuuauuca

SEQ ID NO: 2919 - RNA, 19 nt, artificial
  Oligomer
gauguuggaucucaagagc

SEQ ID NO: 2920 - RNA, 19 nt, artificial
  Oligomer
ccagaaugagaaugaggug

SEQ ID NO: 2921 - RNA, 19 nt, artificial
  Oligomer
gugccuuguugagcuguac

SEQ ID NO: 2922 - RNA, 19 nt, artificial
  Oligomer
aggucuuugacuuugaacu

SEQ ID NO: 2923 - RNA, 19 nt, artificial
  Oligomer
auaagccugcaguuaacca

SEQ ID NO: 2924 - RNA, 19 nt, artificial
  Oligomer
uguaccucccacaaggauu

SEQ ID NO: 2925 - RNA, 19 nt, artificial
  Oligomer
ugugacaccagaacgcauu

SEQ ID NO: 2926 - RNA, 19 nt, artificial
  Oligomer
cugaauacccuuuucugac

SEQ ID NO: 2927 - RNA, 19 nt, artificial
  Oligomer
ucaagagcccugucaguag

SEQ ID NO: 2928 - RNA, 19 nt, artificial
  Oligomer
uggaacuggaauccuuuca

SEQ ID NO: 2929 - RNA, 19 nt, artificial
  Oligomer
gcacaauaaaacuacagcc

SEQ ID NO: 2930 - RNA, 19 nt, artificial
  Oligomer
aacaggaacuggagggucu

SEQ ID NO: 2931 - RNA, 19 nt, artificial
  Oligomer
gacaccagaacgcauugcu

SEQ ID NO: 2932 - RNA, 19 nt, artificial
  Oligomer
ugagucgggcaaugugguu

SEQ ID NO: 2933 - RNA, 19 nt, artificial
  Oligomer
uguuucuugccucauuuuu

SEQ ID NO: 2934 - RNA, 19 nt, artificial
  Oligomer
uuacucagcuacaacagga

SEQ ID NO: 2935 - RNA, 19 nt, artificial
  Oligomer
caccuuacucagcuacaac

SEQ ID NO: 2936 - RNA, 19 nt, artificial
  Oligomer
agaagacacucagcgaccu

SEQ ID NO: 2937 - RNA, 19 nt, artificial
  Oligomer
caagugaccuauaccugug

SEQ ID NO: 2938 - RNA, 19 nt, artificial
  Oligomer
guuugcuuugcccuucuuu

SEQ ID NO: 2939 - RNA, 19 nt, artificial
  Oligomer
gaugaagggcuggugaaag

SEQ ID NO: 2940 - RNA, 19 nt, artificial
  Oligomer
acaccagaacgcauugcug

SEQ ID NO: 2941 - RNA, 19 nt, artificial
  Oligomer
ccuuacucagcuacaacag

SEQ ID NO: 2942 - RNA, 19 nt, artificial
  Oligomer
gcucuucaucgucagcaag

SEQ ID NO: 2943 - RNA, 19 nt, artificial
  Oligomer
ucugugacaccagaacgca

SEQ ID NO: 2944 - RNA, 19 nt, artificial
  Oligomer
gucaguagaguagaagucu

SEQ ID NO: 2945 - RNA, 19 nt, artificial
  Oligomer
cuuugacuuugaacugagc

SEQ ID NO: 2946 - RNA, 19 nt, artificial
  Oligomer
cuuuaaggucuuugacuuu

SEQ ID NO: 2947 - RNA, 19 nt, artificial
  Oligomer
uggaugagucgggcaaugu

SEQ ID NO: 2948 - RNA, 19 nt, artificial
  Oligomer
gccucauuuuuuuccuugc

SEQ ID NO: 2949 - RNA, 19 nt, artificial
  Oligomer
acuuuaaggucuuugacuu

SEQ ID NO: 2950 - RNA, 19 nt, artificial
  Oligomer
gcuugaaguauaagccugc

SEQ ID NO: 2951 - RNA, 19 nt, artificial
  Oligomer
gucugugccuuguugagcu

SEQ ID NO: 2952 - RNA, 19 nt, artificial
  Oligomer
gaacgcauugcugagaacu

SEQ ID NO: 2953 - RNA, 19 nt, artificial
  Oligomer
cacucaggagaaguuaauc

SEQ ID NO: 2954 - RNA, 19 nt, artificial
  Oligomer
aagccugggaaggaauuuu

SEQ ID NO: 2955 - RNA, 19 nt, artificial
  Oligomer
uacccuuuucugaccaaag

SEQ ID NO: 2956 - RNA, 19 nt, artificial
  Oligomer
accaccuuacucagcuaca

SEQ ID NO: 2957 - RNA, 19 nt, artificial
  Oligomer
acagcaaccuguagagugg

SEQ ID NO: 2958 - RNA, 19 nt, artificial
  Oligomer
caguuaaccagauugagug

SEQ ID NO: 2959 - RNA, 19 nt, artificial
  Oligomer
uguaccagaaugagaauga

SEQ ID NO: 2960 - RNA, 19 nt, artificial
  Oligomer
uugcuuugcccuucuuucu

SEQ ID NO: 2961 - RNA, 19 nt, artificial
  Oligomer
aucucacucaggagaaguu

SEQ ID NO: 2962 - RNA, 19 nt, artificial
  Oligomer
gaacuggaauccuuucagc

SEQ ID NO: 2963 - RNA, 19 nt, artificial
  Oligomer
gucucuuccaguuugcuuu

SEQ ID NO: 2964 - RNA, 19 nt, artificial
  Oligomer
uucaggagaagcucaggga

SEQ ID NO: 2965 - RNA, 19 nt, artificial
  Oligomer
cuaacgguugaguuuugac

SEQ ID NO: 2966 - RNA, 19 nt, artificial
  Oligomer
uugccucauuuuuuuccuu

SEQ ID NO: 2967 - RNA, 19 nt, artificial
  Oligomer
ggaauccuuucagcaagac

SEQ ID NO: 2968 - RNA, 19 nt, artificial
  Oligomer
aaggaauuuuucccauugg

SEQ ID NO: 2969 - RNA, 19 nt, artificial
  Oligomer
ugaucuuaaacaaaccugg

SEQ ID NO: 2970 - RNA, 19 nt, artificial
  Oligomer
gugacaccagaacgcauug

SEQ ID NO: 2971 - RNA, 19 nt, artificial
  Oligomer
uaccuggaccucuaccuua

SEQ ID NO: 2972 - RNA, 19 nt, artificial
  Oligomer
auaugaccaccuuacucag

SEQ ID NO: 2973 - RNA, 19 nt, artificial
  Oligomer
caugcagaggaacuuggug

SEQ ID NO: 2974 - RNA, 19 nt, artificial
  Oligomer
cccuuccaugaagaguuuu

SEQ ID NO: 2975 - RNA, 19 nt, artificial
  Oligomer
agcccugucaguagaguag

SEQ ID NO: 2976 - RNA, 19 nt, artificial
  Oligomer
agagcccugucaguagagu

SEQ ID NO: 2977 - RNA, 19 nt, artificial
  Oligomer
uugagcuguaccucccaca

SEQ ID NO: 2978 - RNA, 19 nt, artificial
  Oligomer
uuuuccuugcaaauguagu

SEQ ID NO: 2979 - RNA, 19 nt, artificial
  Oligomer
gagcucuucaucgucagca

SEQ ID NO: 2980 - RNA, 19 nt, artificial
  Oligomer
acaccaacauucuggacac

SEQ ID NO: 2981 - RNA, 19 nt, artificial
  Oligomer
aagagcugguggaugaagg

SEQ ID NO: 2982 - RNA, 19 nt, artificial
  Oligomer
agaguuuugaagcuguggu

SEQ ID NO: 2983 - RNA, 19 nt, artificial
  Oligomer
aagucugugacaccagaac

SEQ ID NO: 2984 - RNA, 19 nt, artificial
  Oligomer
ccuuccaugaagaguuuug

SEQ ID NO: 2985 - RNA, 19 nt, artificial
  Oligomer
guuggaucucaagagcccu

SEQ ID NO: 2986 - RNA, 19 nt, artificial
  Oligomer
ugcagaggaacuugguggu

SEQ ID NO: 2987 - RNA, 19 nt, artificial
  Oligomer
gccuuguugagcuguaccu

SEQ ID NO: 2988 - RNA, 19 nt, artificial
  Oligomer
ccugcaguuaaccagauug

SEQ ID NO: 2989 - RNA, 19 nt, artificial
  Oligomer
acuucaaccaucuccaggu

SEQ ID NO: 2990 - RNA, 19 nt, artificial
  Oligomer
ugaagggcuggugaaagcu

SEQ ID NO: 2991 - RNA, 19 nt, artificial
  Oligomer
ucuuugacuuugaacugag

SEQ ID NO: 2992 - RNA, 19 nt, artificial
  Oligomer
aucucaagagcccugucag

SEQ ID NO: 2993 - RNA, 19 nt, artificial
  Oligomer
uuuuuuuccuugcaaaugu

SEQ ID NO: 2994 - RNA, 19 nt, artificial
  Oligomer
acaaccugaauacccuuuu

SEQ ID NO: 2995 - RNA, 19 nt, artificial
  Oligomer
ucuucaucgucagcaagcu

SEQ ID NO: 2996 - RNA, 19 nt, artificial
  Oligomer
auaucucacucaggagaag

SEQ ID NO: 2997 - RNA, 19 nt, artificial
  Oligomer
gaagagcugguggaugaag

SEQ ID NO: 2998 - RNA, 19 nt, artificial
  Oligomer
ugaggagcucuucaucguc

SEQ ID NO: 2999 - RNA, 19 nt, artificial
  Oligomer
cuccagguggagaugaucu

SEQ ID NO: 3000 - RNA, 19 nt, artificial
  Oligomer
accagaaugagaaugaggu

SEQ ID NO: 3001 - RNA, 19 nt, artificial
  Oligomer
ccugggaaggaauuuuucc

SEQ ID NO: 3002 - RNA, 19 nt, artificial
  Oligomer
uuuaagccugggaaggaau

SEQ ID NO: 3003 - RNA, 19 nt, artificial
  Oligomer
uaacgguugaguuuugacu

SEQ ID NO: 3004 - RNA, 19 nt, artificial
  Oligomer
uuggaugagucgggcaaug

SEQ ID NO: 3005 - RNA, 19 nt, artificial
  Oligomer
cccaagugaccuauaccug

SEQ ID NO: 3006 - RNA, 19 nt, artificial
  Oligomer
gcuauuuaaagguacgcgc

SEQ ID NO: 3007 - RNA, 19 nt, artificial
  Oligomer
caacauucuggacacgugg

SEQ ID NO: 3008 - RNA, 19 nt, artificial
  Oligomer
aaacuacagcccagguccu

SEQ ID NO: 3009 - RNA, 19 nt, artificial
  Oligomer
cauucaggagaagcucagg

SEQ ID NO: 3010 - RNA, 19 nt, artificial
  Oligomer
aaccugaauacccuuuucu

SEQ ID NO: 3011 - RNA, 19 nt, artificial
  Oligomer
ucagcaagacuucucuuug

SEQ ID NO: 3012 - RNA, 19 nt, artificial
  Oligomer
guuuugacugcuuggaacu

SEQ ID NO: 3013 - RNA, 19 nt, artificial
  Oligomer
uuucagcaagacuucucuu

SEQ ID NO: 3014 - RNA, 19 nt, artificial
  Oligomer
aagagaagcaaaaucuacc

SEQ ID NO: 3015 - RNA, 19 nt, artificial
  Oligomer
acaucgacugugcccaugu

SEQ ID NO: 3016 - RNA, 19 nt, artificial
  Oligomer
ucaguagaguagaagucuc

SEQ ID NO: 3017 - RNA, 19 nt, artificial
  Oligomer
cuccaacuucaaccaucuc

SEQ ID NO: 3018 - RNA, 19 nt, artificial
  Oligomer
uaagccugcaguuaaccag

SEQ ID NO: 3019 - RNA, 19 nt, artificial
  Oligomer
gacagcaaccuguagagug

SEQ ID NO: 3020 - RNA, 19 nt, artificial
  Oligomer
uuccuugcaaauguaguau

SEQ ID NO: 3021 - RNA, 19 nt, artificial
  Oligomer
uuuucugaccaaagagaag

SEQ ID NO: 3022 - RNA, 19 nt, artificial
  Oligomer
ccuuucagcaagacuucuc

SEQ ID NO: 3023 - RNA, 19 nt, artificial
  Oligomer
gaagucucuuccaguuugc

SEQ ID NO: 3024 - RNA, 19 nt, artificial
  Oligomer
guugaguuuugacugcuug

SEQ ID NO: 3025 - RNA, 19 nt, artificial
  Oligomer
gggcuauuuaaagguacgc

SEQ ID NO: 3026 - RNA, 19 nt, artificial
  Oligomer
cuucaaccaucuccaggug

SEQ ID NO: 3027 - RNA, 19 nt, artificial
  Oligomer
cucagcuacaacaggaacu

SEQ ID NO: 3028 - RNA, 19 nt, artificial
  Oligomer
uccuuucagcaagacuucu

SEQ ID NO: 3029 - RNA, 19 nt, artificial
  Oligomer
cuauuuaaagguacgcgcc

SEQ ID NO: 3030 - RNA, 19 nt, artificial
  Oligomer
agcacaauaaaacuacagc

SEQ ID NO: 3031 - RNA, 19 nt, artificial
  Oligomer
aacuuuaaggucuuugacu

SEQ ID NO: 3032 - RNA, 19 nt, artificial
  Oligomer
ggcaucuccaacuucaacc

SEQ ID NO: 3033 - RNA, 19 nt, artificial
  Oligomer
ucaucgucagcaagcugug

SEQ ID NO: 3034 - RNA, 19 nt, artificial
  Oligomer
ggcuauuuaaagguacgcg

SEQ ID NO: 3035 - RNA, 19 nt, artificial
  Oligomer
gucuagcuugauguuggau

SEQ ID NO: 3036 - RNA, 19 nt, artificial
  Oligomer
uuaagccugggaaggaauu

SEQ ID NO: 3037 - RNA, 19 nt, artificial
  Oligomer
gacaccaacauucuggaca

SEQ ID NO: 3038 - RNA, 19 nt, artificial
  Oligomer
cuacaacaggaacuggagg

SEQ ID NO: 3039 - RNA, 19 nt, artificial
  Oligomer
gagaagcaaaaucuaccag

SEQ ID NO: 3040 - RNA, 19 nt, artificial
  Oligomer
accaucuccagguggagau

SEQ ID NO: 3041 - RNA, 19 nt, artificial
  Oligomer
caucuccagguggagauga

SEQ ID NO: 3042 - RNA, 19 nt, artificial
  Oligomer
gaccucuaccuuauucacu

SEQ ID NO: 3043 - RNA, 19 nt, artificial
  Oligomer
agucucuuccaguuugcuu

SEQ ID NO: 3044 - RNA, 19 nt, artificial
  Oligomer
gaaguuaauccaguacugc

SEQ ID NO: 3045 - RNA, 19 nt, artificial
  Oligomer
aagagcccugucaguagag

SEQ ID NO: 3046 - RNA, 19 nt, artificial
  Oligomer
caagacuucucuuugccuc

SEQ ID NO: 3047 - RNA, 19 nt, artificial
  Oligomer
uccaaaggcaucgugguga

SEQ ID NO: 3048 - RNA, 19 nt, artificial
  Oligomer
aaccaucuccagguggaga

SEQ ID NO: 3049 - RNA, 19 nt, artificial
  Oligomer
gggcuggugaaagcuauug

SEQ ID NO: 3050 - RNA, 19 nt, artificial
  Oligomer
uaagccugggaaggaauuu

SEQ ID NO: 3051 - RNA, 19 nt, artificial
  Oligomer
auccuuucagcaagacuuc

SEQ ID NO: 3052 - RNA, 19 nt, artificial
  Oligomer
cagcuacaacaggaacugg

SEQ ID NO: 3053 - RNA, 19 nt, artificial
  Oligomer
acaacaggaacuggagggu

SEQ ID NO: 3054 - RNA, 19 nt, artificial
  Oligomer
ugcugagaacuuuaagguc

SEQ ID NO: 3055 - RNA, 19 nt, artificial
  Oligomer
augaagggcuggugaaagc

SEQ ID NO: 3056 - RNA, 19 nt, artificial
  Oligomer
agaagucucuuccaguuug

SEQ ID NO: 3057 - RNA, 19 nt, artificial
  Oligomer
accucuaccuuauucacug

SEQ ID NO: 3058 - RNA, 19 nt, artificial
  Oligomer
aagucucuuccaguuugcu

SEQ ID NO: 3059 - RNA, 19 nt, artificial
  Oligomer
cgugucuagcuugauguug

SEQ ID NO: 3060 - RNA, 19 nt, artificial
  Oligomer
cuuugcccuucuuucuacc

SEQ ID NO: 3061 - RNA, 19 nt, artificial
  Oligomer
aaguuaauccaguacugcc

SEQ ID NO: 3062 - RNA, 19 nt, artificial
  Oligomer
uccaugaagaguuuugaag

SEQ ID NO: 3063 - RNA, 19 nt, artificial
  Oligomer
aacgguugaguuuugacug

SEQ ID NO: 3064 - RNA, 19 nt, artificial
  Oligomer
cuucuuucuacccugcugg

SEQ ID NO: 3065 - RNA, 19 nt, artificial
  Oligomer
accaaagagaagcaaaauc

SEQ ID NO: 3066 - RNA, 19 nt, artificial
  Oligomer
ccugucaguagaguagaag

SEQ ID NO: 3067 - RNA, 19 nt, artificial
  Oligomer
cuucaucgucagcaagcug

SEQ ID NO: 3068 - RNA, 19 nt, artificial
  Oligomer
aaggucuuugacuuugaac

SEQ ID NO: 3069 - RNA, 19 nt, artificial
  Oligomer
augugguucccagugacac

SEQ ID NO: 3070 - RNA, 19 nt, artificial
  Oligomer
uccaguuugcuuugcccuu

SEQ ID NO: 3071 - RNA, 19 nt, artificial
  Oligomer
cugggaaggaauuuuuccc

SEQ ID NO: 3072 - RNA, 19 nt, artificial
  Oligomer
uuugacuuugaacugagca

SEQ ID NO: 3073 - RNA, 19 nt, artificial
  Oligomer
gaggaacuugguggugauc

SEQ ID NO: 3074 - RNA, 19 nt, artificial
  Oligomer
uugcccuucuuucuacccu

SEQ ID NO: 3075 - RNA, 19 nt, artificial
  Oligomer
uguuggaucucaagagccc

SEQ ID NO: 3076 - RNA, 19 nt, artificial
  Oligomer
ugcuuggaacuggaauccu

SEQ ID NO: 3077 - RNA, 19 nt, artificial
  Oligomer
uccuugcaaauguaguaug

SEQ ID NO: 3078 - RNA, 19 nt, artificial
  Oligomer
gacuuugaacugagcagcc

SEQ ID NO: 3079 - RNA, 19 nt, artificial
  Oligomer
agucugugacaccagaacg

SEQ ID NO: 3080 - RNA, 19 nt, artificial
  Oligomer
caccaacauucuggacacg

SEQ ID NO: 3081 - RNA, 19 nt, artificial
  Oligomer
ccuuguugagcuguaccuc

SEQ ID NO: 3082 - RNA, 19 nt, artificial
  Oligomer
acgguugaguuuugacugc

SEQ ID NO: 3083 - RNA, 19 nt, artificial
  Oligomer
uugcugagaacuuuaaggu

SEQ ID NO: 3084 - RNA, 19 nt, artificial
  Oligomer
uugaguuuugacugcuugg

SEQ ID NO: 3085 - RNA, 19 nt, artificial
  Oligomer
ccucuaccuuauucacugg

SEQ ID NO: 3086 - RNA, 19 nt, artificial
  Oligomer
cuuacucagcuacaacagg

SEQ ID NO: 3087 - RNA, 19 nt, artificial
  Oligomer
uugacuuugaacugagcag

SEQ ID NO: 3088 - RNA, 19 nt, artificial
  Oligomer
aagcaaaaucuaccagguc

SEQ ID NO: 3089 - RNA, 19 nt, artificial
  Oligomer
aucuaccaggucaaaauag

SEQ ID NO: 3090 - RNA, 19 nt, artificial
  Oligomer
cuuccaguuugcuuugccc

SEQ ID NO: 3091 - RNA, 19 nt, artificial
  Oligomer
auaaaacuacagcccaggu

SEQ ID NO: 3092 - RNA, 19 nt, artificial
  Oligomer
agcaagacuucucuuugcc

SEQ ID NO: 3093 - RNA, 19 nt, artificial
  Oligomer
uggaucucaagagcccugu

SEQ ID NO: 3094 - RNA, 19 nt, artificial
  Oligomer
aaaguacaaccugaauacc

SEQ ID NO: 3095 - RNA, 19 nt, artificial
  Oligomer
uucagcaagacuucucuuu

SEQ ID NO: 3096 - RNA, 19 nt, artificial
  Oligomer
uuugcuuugcccuucuuuc

SEQ ID NO: 3097 - RNA, 19 nt, artificial
  Oligomer
agaagcaaaaucuaccagg

SEQ ID NO: 3098 - RNA, 19 nt, artificial
  Oligomer
guagaguagaagucucuuc

SEQ ID NO: 3099 - RNA, 19 nt, artificial
  Oligomer
ugcacguaccaugagaagg

SEQ ID NO: 3100 - RNA, 19 nt, artificial
  Oligomer
auugcugagaacuuuaagg

SEQ ID NO: 3101 - RNA, 19 nt, artificial
  Oligomer
acuaccuggaccucuaccu

SEQ ID NO: 3102 - RNA, 19 nt, artificial
  Oligomer
uagaagucucuuccaguuu

SEQ ID NO: 3103 - RNA, 19 nt, artificial
  Oligomer
aaguacaaccugaauaccc

SEQ ID NO: 3104 - RNA, 19 nt, artificial
  Oligomer
aucuccaacuucaaccauc

SEQ ID NO: 3105 - RNA, 19 nt, artificial
  Oligomer
ugaauacccuuuucugacc

SEQ ID NO: 3106 - RNA, 19 nt, artificial
  Oligomer
cacaauaaaacuacagccc

SEQ ID NO: 3107 - RNA, 19 nt, artificial
  Oligomer
acugcuuggaacuggaauc

SEQ ID NO: 3108 - RNA, 19 nt, artificial
  Oligomer
ccaguuugcuuugcccuuc

SEQ ID NO: 3109 - RNA, 19 nt, artificial
  Oligomer
uuggaacuggaauccuuuc

SEQ ID NO: 3110 - RNA, 19 nt, artificial
  Oligomer
ugucaguagaguagaaguc

SEQ ID NO: 3111 - RNA, 19 nt, artificial
  Oligomer
uugaaguauaagccugcag

SEQ ID NO: 3112 - RNA, 19 nt, artificial
  Oligomer
ucagcuacaacaggaacug

SEQ ID NO: 3113 - RNA, 19 nt, artificial
  Oligomer
ucuccagguggagaugauc

SEQ ID NO: 3114 - RNA, 19 nt, artificial
  Oligomer
ugacaccaacauucuggac

SEQ ID NO: 3115 - RNA, 19 nt, artificial
  Oligomer
uaucucacucaggagaagu

SEQ ID NO: 3116 - RNA, 19 nt, artificial
  Oligomer
augaccaccuuacucagcu

SEQ ID NO: 3117 - RNA, 19 nt, artificial
  Oligomer
gagaacuuuaaggucuuug

SEQ ID NO: 3118 - RNA, 19 nt, artificial
  Oligomer
uucuuucuacccugcuggg

SEQ ID NO: 3119 - RNA, 19 nt, artificial
  Oligomer
aguuaaccagauugagugc

SEQ ID NO: 3120 - RNA, 19 nt, artificial
  Oligomer
cuuguugagcuguaccucc

SEQ ID NO: 3121 - RNA, 19 nt, artificial
  Oligomer
auggaagagcugguggaug

SEQ ID NO: 3122 - RNA, 19 nt, artificial
  Oligomer
aagaguuuugaagcugugg

SEQ ID NO: 3123 - RNA, 19 nt, artificial
  Oligomer
ugccucauuuuuuuccuug

SEQ ID NO: 3124 - RNA, 19 nt, artificial
  Oligomer
acucagcuacaacaggaac

SEQ ID NO: 3125 - RNA, 19 nt, artificial
  Oligomer
uuuuuccuugcaaauguag

SEQ ID NO: 3126 - RNA, 19 nt, artificial
  Oligomer
accaggucaaaauagugcc

SEQ ID NO: 3127 - RNA, 19 nt, artificial
  Oligomer
uaccucccacaaggauuac

SEQ ID NO: 3128 - RNA, 19 nt, artificial
  Oligomer
uaccagaaugagaaugagg

SEQ ID NO: 3129 - RNA, 19 nt, artificial
  Oligomer
agugacaccaacauucugg

SEQ ID NO: 3130 - RNA, 19 nt, artificial
  Oligomer
ucucuuccaguuugcuuug

SEQ ID NO: 3131 - RNA, 19 nt, artificial
  Oligomer
uuuuucccauuggaugagu

SEQ ID NO: 3132 - RNA, 19 nt, artificial
  Oligomer
uagaguagaagucucuucc

SEQ ID NO: 3133 - RNA, 19 nt, artificial
  Oligomer
cuggaccucuaccuuauuc

SEQ ID NO: 3134 - RNA, 19 nt, artificial
  Oligomer
guuuugaagcugugguugc

SEQ ID NO: 3135 - RNA, 19 nt, artificial
  Oligomer
acucaggagaaguuaaucc

SEQ ID NO: 3136 - RNA, 19 nt, artificial
  Oligomer
uuguugagcuguaccuccc

SEQ ID NO: 3137 - RNA, 19 nt, artificial
  Oligomer
uuuugaagcugugguugcc

SEQ ID NO: 3138 - RNA, 19 nt, artificial
  Oligomer
uuggaucucaagagcccug

SEQ ID NO: 3139 - RNA, 19 nt, artificial
  Oligomer
uagcuugauguuggaucuc

SEQ ID NO: 3140 - RNA, 19 nt, artificial
  Oligomer
uacaaccugaauacccuuu

SEQ ID NO: 3141 - RNA, 19 nt, artificial
  Oligomer
uauuuaaagguacgcgccg

SEQ ID NO: 3142 - RNA, 19 nt, artificial
  Oligomer
cucuucaucgucagcaagc

SEQ ID NO: 3143 - RNA, 19 nt, artificial
  Oligomer
gaccaccuuacucagcuac

SEQ ID NO: 3144 - RNA, 19 nt, artificial
  Oligomer
uuugaagcugugguugccu

SEQ ID NO: 3145 - RNA, 19 nt, artificial
  Oligomer
aaaacuacagcccaggucc

SEQ ID NO: 3146 - RNA, 19 nt, artificial
  Oligomer
aucgucagcaagcuguggu

SEQ ID NO: 3147 - RNA, 19 nt, artificial
  Oligomer
cugugccuuguugagcugu

SEQ ID NO: 3148 - RNA, 19 nt, artificial
  Oligomer
cugcuuggaacuggaaucc

SEQ ID NO: 3149 - RNA, 19 nt, artificial
  Oligomer
uugagauccaacaucaagc

SEQ ID NO: 3150 - RNA, 19 nt, artificial
  Oligomer
uuuaagaucaucuccaccu

SEQ ID NO: 3151 - RNA, 19 nt, artificial
  Oligomer
uguaguuuuauugugcuug

SEQ ID NO: 3152 - RNA, 19 nt, artificial
  Oligomer
uuguuuaagaucaucucca

SEQ ID NO: 3153 - RNA, 19 nt, artificial
  Oligomer
uuuguuuaagaucaucucc

SEQ ID NO: 3154 - RNA, 19 nt, artificial
  Oligomer
uagauuuugcuucucuuug

SEQ ID NO: 3155 - RNA, 19 nt, artificial
  Oligomer
uucucaugguacgugcacc

SEQ ID NO: 3156 - RNA, 19 nt, artificial
  Oligomer
uuuugcuucucuuugguca

SEQ ID NO: 3157 - RNA, 19 nt, artificial
  Oligomer
uucauccaccagcucuucc

SEQ ID NO: 3158 - RNA, 19 nt, artificial
  Oligomer
uucuacucuacugacaggg

SEQ ID NO: 3159 - RNA, 19 nt, artificial
  Oligomer
uuucaccagcccuucaucc

SEQ ID NO: 3160 - RNA, 19 nt, artificial
  Oligomer
uacuggauuaacuucuccu

SEQ ID NO: 3161 - RNA, 19 nt, artificial
  Oligomer
uaaaguucucagcaaugcg

SEQ ID NO: 3162 - RNA, 19 nt, artificial
  Oligomer
uaagguggucauauccugg

SEQ ID NO: 3163 - RNA, 19 nt, artificial
  Oligomer
ucuggugucacagacuugg

SEQ ID NO: 3164 - RNA, 19 nt, artificial
  Oligomer
uugcugacgaugaagagcu

SEQ ID NO: 3165 - RNA, 19 nt, artificial
  Oligomer
uuaaaguucucagcaaugc

SEQ ID NO: 3166 - RNA, 19 nt, artificial
  Oligomer
uacagguugcugucccacu

SEQ ID NO: 3167 - RNA, 19 nt, artificial
  Oligomer
uuccaagcagucaaaacuc

SEQ ID NO: 3168 - RNA, 19 nt, artificial
  Oligomer
uuguagcugaguaaggugg

SEQ ID NO: 3169 - RNA, 19 nt, artificial
  Oligomer
uugaccugguagauuuugc

SEQ ID NO: 3170 - RNA, 19 nt, artificial
  Oligomer
uucaggucgcugagugucu

SEQ ID NO: 3171 - RNA, 19 nt, artificial
  Oligomer
uuaagaucaucuccaccug

SEQ ID NO: 3172 - RNA, 19 nt, artificial
  Oligomer
uucuggugucacagacuug

SEQ ID NO: 3173 - RNA, 19 nt, artificial
  Oligomer
uucaccaggcccuucucau

SEQ ID NO: 3174 - RNA, 19 nt, artificial
  Oligomer
auucagguuguacuuuccc

SEQ ID NO: 3175 - RNA, 19 nt, artificial
  Oligomer
ucagaaaaggguauucagg

SEQ ID NO: 3176 - RNA, 19 nt, artificial
  Oligomer
aucaccaccaaguuccucu

SEQ ID NO: 3177 - RNA, 19 nt, artificial
  Oligomer
uagagguccagguagucca

SEQ ID NO: 3178 - RNA, 19 nt, artificial
  Oligomer
ucaugguacgugcaccaca

SEQ ID NO: 3179 - RNA, 19 nt, artificial
  Oligomer
uuaacugcaggcuuauacu

SEQ ID NO: 3180 - RNA, 19 nt, artificial
  Oligomer
uccaaugggaaaaauuccu

SEQ ID NO: 3181 - RNA, 19 nt, artificial
  Oligomer
ucucaugguacgugcacca

SEQ ID NO: 3182 - RNA, 19 nt, artificial
  Oligomer
uucucagcaaugcguucug

SEQ ID NO: 3183 - RNA, 19 nt, artificial
  Oligomer
uggagaugguugaaguugg

SEQ ID NO: 3184 - RNA, 19 nt, artificial
  Oligomer
uucaaagucaaagaccuua

SEQ ID NO: 3185 - RNA, 19 nt, artificial
  Oligomer
uuaacuucuccugagugag

SEQ ID NO: 3186 - RNA, 19 nt, artificial
  Oligomer
uugcugaaaggauuccagu

SEQ ID NO: 3187 - RNA, 19 nt, artificial
  Oligomer
ucuacugacagggcucuug

SEQ ID NO: 3188 - RNA, 19 nt, artificial
  Oligomer
uuucaccaggcccuucuca

SEQ ID NO: 3189 - RNA, 19 nt, artificial
  Oligomer
uccaacaucaagcuagaca

SEQ ID NO: 3190 - RNA, 19 nt, artificial
  Oligomer
uuccuucccaggcuuaaag

SEQ ID NO: 3191 - RNA, 19 nt, artificial
  Oligomer
uuugcuucucuuuggucag

SEQ ID NO: 3192 - RNA, 19 nt, artificial
  Oligomer
uuugaccugguagauuuug

SEQ ID NO: 3193 - RNA, 19 nt, artificial
  Oligomer
uugugggagguacagcuca

SEQ ID NO: 3194 - RNA, 19 nt, artificial
  Oligomer
uauucagguuguacuuucc

SEQ ID NO: 3195 - RNA, 19 nt, artificial
  Oligomer
guuaacugcaggcuuauac

SEQ ID NO: 3196 - RNA, 19 nt, artificial
  Oligomer
auccaaugggaaaaauucc

SEQ ID NO: 3197 - RNA, 19 nt, artificial
  Oligomer
aacugcaggcuuauacuuc

SEQ ID NO: 3198 - RNA, 19 nt, artificial
  Oligomer
ucuugcugaaaggauucca

SEQ ID NO: 3199 - RNA, 19 nt, artificial
  Oligomer
augcguucuggugucacag

SEQ ID NO: 3200 - RNA, 19 nt, artificial
  Oligomer
uucaaaacucuucauggaa

SEQ ID NO: 3201 - RNA, 19 nt, artificial
  Oligomer
uuugcaaggaaaaaaauga

SEQ ID NO: 3202 - RNA, 19 nt, artificial
  Oligomer
ucuuuggucagaaaagggu

SEQ ID NO: 3203 - RNA, 19 nt, artificial
  Oligomer
uugauccugggauccucca

SEQ ID NO: 3204 - RNA, 19 nt, artificial
  Oligomer
auuuugcuucucuuugguc

SEQ ID NO: 3205 - RNA, 19 nt, artificial
  Oligomer
uaagaucaucuccaccugg

SEQ ID NO: 3206 - RNA, 19 nt, artificial
  Oligomer
aaggauuccaguuccaagc

SEQ ID NO: 3207 - RNA, 19 nt, artificial
  Oligomer
ugguugaaguuggagaugc

SEQ ID NO: 3208 - RNA, 19 nt, artificial
  Oligomer
uagcuuucaccagcccuuc

SEQ ID NO: 3209 - RNA, 19 nt, artificial
  Oligomer
auagcuuucaccagcccuu

SEQ ID NO: 3210 - RNA, 19 nt, artificial
  Oligomer
uacucuacugacagggcuc

SEQ ID NO: 3211 - RNA, 19 nt, artificial
  Oligomer
uccugagugagauaugggu

SEQ ID NO: 3212 - RNA, 19 nt, artificial
  Oligomer
aagcagucaaaacucaacc

SEQ ID NO: 3213 - RNA, 19 nt, artificial
  Oligomer
ucaaagaccuuaaaguucu

SEQ ID NO: 3214 - RNA, 19 nt, artificial
  Oligomer
uucucuuuggucagaaaag

SEQ ID NO: 3215 - RNA, 19 nt, artificial
  Oligomer
uucaccagcccuucaucca

SEQ ID NO: 3216 - RNA, 19 nt, artificial
  Oligomer
ucaaaacucuucauggaag

SEQ ID NO: 3217 - RNA, 19 nt, artificial
  Oligomer
uugcccgacucauccaaug

SEQ ID NO: 3218 - RNA, 19 nt, artificial
  Oligomer
uaauccuugugggagguac

SEQ ID NO: 3219 - RNA, 19 nt, artificial
  Oligomer
auuugcaaggaaaaaaaug

SEQ ID NO: 3220 - RNA, 19 nt, artificial
  Oligomer
acuggauuaacuucuccug

SEQ ID NO: 3221 - RNA, 19 nt, artificial
  Oligomer
aacaucaagcuagacacgc

SEQ ID NO: 3222 - RNA, 19 nt, artificial
  Oligomer
ucauccaccagcucuucca

SEQ ID NO: 3223 - RNA, 19 nt, artificial
  Oligomer
uucuccugagugagauaug

SEQ ID NO: 3224 - RNA, 19 nt, artificial
  Oligomer
aauagcuuucaccagcccu

SEQ ID NO: 3225 - RNA, 19 nt, artificial
  Oligomer
ugguagauuuugcuucucu

SEQ ID NO: 3226 - RNA, 19 nt, artificial
  Oligomer
ugaagagcuccucacgcuu

SEQ ID NO: 3227 - RNA, 19 nt, artificial
  Oligomer
ucugguuaacugcaggcuu

SEQ ID NO: 3228 - RNA, 19 nt, artificial
  Oligomer
cguaccuuuaaauagcccg

SEQ ID NO: 3229 - RNA, 19 nt, artificial
  Oligomer
auccaccagcucuuccaug

SEQ ID NO: 3230 - RNA, 19 nt, artificial
  Oligomer
aagaccuuaaaguucucag

SEQ ID NO: 3231 - RNA, 19 nt, artificial
  Oligomer
ucacugggaaccacauugc

SEQ ID NO: 3232 - RNA, 19 nt, artificial
  Oligomer
ucaaucugguuaacugcag

SEQ ID NO: 3233 - RNA, 19 nt, artificial
  Oligomer
auuuugaccugguagauuu

SEQ ID NO: 3234 - RNA, 19 nt, artificial
  Oligomer
uauuuugaccugguagauu

SEQ ID NO: 3235 - RNA, 19 nt, artificial
  Oligomer
gucacugggaaccacauug

SEQ ID NO: 3236 - RNA, 19 nt, artificial
  Oligomer
ucagcaaugcguucuggug

SEQ ID NO: 3237 - RNA, 19 nt, artificial
  Oligomer
uggauuaacuucuccugag

SEQ ID NO: 3238 - RNA, 19 nt, artificial
  Oligomer
accugguagauuuugcuuc

SEQ ID NO: 3239 - RNA, 19 nt, artificial
  Oligomer
ugacgaugaagagcuccuc

SEQ ID NO: 3240 - RNA, 19 nt, artificial
  Oligomer
accaaguuccucugcaugg

SEQ ID NO: 3241 - RNA, 19 nt, artificial
  Oligomer
agaauguuggugucacugg

SEQ ID NO: 3242 - RNA, 19 nt, artificial
  Oligomer
guuuaagaucaucuccacc

SEQ ID NO: 3243 - RNA, 19 nt, artificial
  Oligomer
uccagaauguuggugucac

SEQ ID NO: 3244 - RNA, 19 nt, artificial
  Oligomer
uacuacauuugcaaggaaa

SEQ ID NO: 3245 - RNA, 19 nt, artificial
  Oligomer
cugagugagauaugggugg

SEQ ID NO: 3246 - RNA, 19 nt, artificial
  Oligomer
ugcaggcuuauacuucaag

SEQ ID NO: 3247 - RNA, 19 nt, artificial
  Oligomer
aaucugguuaacugcaggc

SEQ ID NO: 3248 - RNA, 19 nt, artificial
  Oligomer
uugcaaggaaaaaaaugag

SEQ ID NO: 3249 - RNA, 19 nt, artificial
  Oligomer
ucucuuuggucagaaaagg

SEQ ID NO: 3250 - RNA, 19 nt, artificial
  Oligomer
cuuaaaguucucagcaaug

SEQ ID NO: 3251 - RNA, 19 nt, artificial
  Oligomer
uggaagagacuucuacucu

SEQ ID NO: 3252 - RNA, 19 nt, artificial
  Oligomer
aaaaaaugaggcaagaaac

SEQ ID NO: 3253 - RNA, 19 nt, artificial
  Oligomer
augggaaaaauuccuuccc

SEQ ID NO: 3254 - RNA, 19 nt, artificial
  Oligomer
cuggagaugguugaaguug

SEQ ID NO: 3255 - RNA, 19 nt, artificial
  Oligomer
aaaggauuccaguuccaag

SEQ ID NO: 3256 - RNA, 19 nt, artificial
  Oligomer
aaaguucucagcaaugcgu

SEQ ID NO: 3257 - RNA, 19 nt, artificial
  Oligomer
aguaagguggucauauccu

SEQ ID NO: 3258 - RNA, 19 nt, artificial
  Oligomer
uguuggugucacugggaac

SEQ ID NO: 3259 - RNA, 19 nt, artificial
  Oligomer
agguaguccagcuucaggu

SEQ ID NO: 3260 - RNA, 19 nt, artificial
  Oligomer
augaagagcuccucacgcu

SEQ ID NO: 3261 - RNA, 19 nt, artificial
  Oligomer
ugcaaggaaaaaaaugagg

SEQ ID NO: 3262 - RNA, 19 nt, artificial
  Oligomer
uuggugucacugggaacca

SEQ ID NO: 3263 - RNA, 19 nt, artificial
  Oligomer
aauaagguagagguccagg

SEQ ID NO: 3264 - RNA, 19 nt, artificial
  Oligomer
aucugguuaacugcaggcu

SEQ ID NO: 3265 - RNA, 19 nt, artificial
  Oligomer
uguuuaagaucaucuccac

SEQ ID NO: 3266 - RNA, 19 nt, artificial
  Oligomer
aggguauucagguuguacu

SEQ ID NO: 3267 - RNA, 19 nt, artificial
  Oligomer
uuccuguuguagcugagua

SEQ ID NO: 3268 - RNA, 19 nt, artificial
  Oligomer
guauucagguuguacuuuc

SEQ ID NO: 3269 - RNA, 19 nt, artificial
  Oligomer
ucuccugagugagauaugg

SEQ ID NO: 3270 - RNA, 19 nt, artificial
  Oligomer
uacauuugcaaggaaaaaa

SEQ ID NO: 3271 - RNA, 19 nt, artificial
  Oligomer
ucuacagguugcuguccca

SEQ ID NO: 3272 - RNA, 19 nt, artificial
  Oligomer
aaugggaaaaauuccuucc

SEQ ID NO: 3273 - RNA, 19 nt, artificial
  Oligomer
cuugagauccaacaucaag

SEQ ID NO: 3274 - RNA, 19 nt, artificial
  Oligomer
cuugcugaaaggauuccag

SEQ ID NO: 3275 - RNA, 19 nt, artificial
  Oligomer
uagcugaguaaggugguca

SEQ ID NO: 3276 - RNA, 19 nt, artificial
  Oligomer
agcuucaaaacucuucaug

SEQ ID NO: 3277 - RNA, 19 nt, artificial
  Oligomer
cugggcuguaguuuuauug

SEQ ID NO: 3278 - RNA, 19 nt, artificial
  Oligomer
cuccaguuccuguuguagc

SEQ ID NO: 3279 - RNA, 19 nt, artificial
  Oligomer
aucgccuugauccugggau

SEQ ID NO: 3280 - RNA, 19 nt, artificial
  Oligomer
agauccaacaucaagcuag

SEQ ID NO: 3281 - RNA, 19 nt, artificial
  Oligomer
acagguauaggucacuugg

SEQ ID NO: 3282 - RNA, 19 nt, artificial
  Oligomer
uuccaguuccaagcaguca

SEQ ID NO: 3283 - RNA, 19 nt, artificial
  Oligomer
uagaaagaagggcaaagca

SEQ ID NO: 3284 - RNA, 19 nt, artificial
  Oligomer
ucaacaaggcacagacccu

SEQ ID NO: 3285 - RNA, 19 nt, artificial
  Oligomer
cagaauguuggugucacug

SEQ ID NO: 3286 - RNA, 19 nt, artificial
  Oligomer
aaccacagcuucaaaacuc

SEQ ID NO: 3287 - RNA, 19 nt, artificial
  Oligomer
uaacugcaggcuuauacuu

SEQ ID NO: 3288 - RNA, 19 nt, artificial
  Oligomer
cuucucaugguacgugcac

SEQ ID NO: 3289 - RNA, 19 nt, artificial
  Oligomer
caguacuggauuaacuucu

SEQ ID NO: 3290 - RNA, 19 nt, artificial
  Oligomer
ucuacucuacugacagggc

SEQ ID NO: 3291 - RNA, 19 nt, artificial
  Oligomer
guaagguggucauauccug

SEQ ID NO: 3292 - RNA, 19 nt, artificial
  Oligomer
acucaaucugguuaacugc

SEQ ID NO: 3293 - RNA, 19 nt, artificial
  Oligomer
aaaaugaggcaagaaacac

SEQ ID NO: 3294 - RNA, 19 nt, artificial
  Oligomer
aucaagcuagacacgcccu

SEQ ID NO: 3295 - RNA, 19 nt, artificial
  Oligomer
ucauccaaugggaaaaauu

SEQ ID NO: 3296 - RNA, 19 nt, artificial
  Oligomer
aaggguauucagguuguac

SEQ ID NO: 3297 - RNA, 19 nt, artificial
  Oligomer
caaaacucaaccguuagug

SEQ ID NO: 3298 - RNA, 19 nt, artificial
  Oligomer
auaagguagagguccaggu

SEQ ID NO: 3299 - RNA, 19 nt, artificial
  Oligomer
ugucacugggaaccacauu

SEQ ID NO: 3300 - RNA, 19 nt, artificial
  Oligomer
uccaguuccuguuguagcu

SEQ ID NO: 3301 - RNA, 19 nt, artificial
  Oligomer
agauuuugcuucucuuugg

SEQ ID NO: 3302 - RNA, 19 nt, artificial
  Oligomer
agagacuucuacucuacug

SEQ ID NO: 3303 - RNA, 19 nt, artificial
  Oligomer
acgaugaagagcuccucac

SEQ ID NO: 3304 - RNA, 19 nt, artificial
  Oligomer
auuaacuucuccugaguga

SEQ ID NO: 3305 - RNA, 19 nt, artificial
  Oligomer
aaguucucagcaaugcguu

SEQ ID NO: 3306 - RNA, 19 nt, artificial
  Oligomer
ucucagcaaugcguucugg

SEQ ID NO: 3307 - RNA, 19 nt, artificial
  Oligomer
aacuggaagagacuucuac

SEQ ID NO: 3308 - RNA, 19 nt, artificial
  Oligomer
acuucuacucuacugacag

SEQ ID NO: 3309 - RNA, 19 nt, artificial
  Oligomer
uuggucagaaaaggguauu

SEQ ID NO: 3310 - RNA, 19 nt, artificial
  Oligomer
ccugagugagauaugggug

SEQ ID NO: 3311 - RNA, 19 nt, artificial
  Oligomer
cacagcuucaaaacucuuc

SEQ ID NO: 3312 - RNA, 19 nt, artificial
  Oligomer
ccauacuacauuugcaagg

SEQ ID NO: 3313 - RNA, 19 nt, artificial
  Oligomer
uccaguuccaagcagucaa

SEQ ID NO: 3314 - RNA, 19 nt, artificial
  Oligomer
ugggagguacagcucaaca

SEQ ID NO: 3315 - RNA, 19 nt, artificial
  Oligomer
accacgaugccuuuggacu

SEQ ID NO: 3316 - RNA, 19 nt, artificial
  Oligomer
auccuugugggagguacag

SEQ ID NO: 3317 - RNA, 19 nt, artificial
  Oligomer
uccuucccaggcuuaaagc

SEQ ID NO: 3318 - RNA, 19 nt, artificial
  Oligomer
ugaccugguagauuuugcu

SEQ ID NO: 3319 - RNA, 19 nt, artificial
  Oligomer
uacagcucaacaaggcaca

SEQ ID NO: 3320 - RNA, 19 nt, artificial
  Oligomer
uuuggucagaaaaggguau

SEQ ID NO: 3321 - RNA, 19 nt, artificial
  Oligomer
uccagguaguccagcuuca

SEQ ID NO: 3322 - RNA, 19 nt, artificial
  Oligomer
cugacgaugaagagcuccu

SEQ ID NO: 3323 - RNA, 19 nt, artificial
  Oligomer
cucuugagauccaacauca

SEQ ID NO: 3324 - RNA, 19 nt, artificial
  Oligomer
cucuuuggucagaaaaggg

SEQ ID NO: 3325 - RNA, 19 nt, artificial
  Oligomer
agaugguugaaguuggaga

SEQ ID NO: 3326 - RNA, 19 nt, artificial
  Oligomer
cuccugagugagauauggg

SEQ ID NO: 3327 - RNA, 19 nt, artificial
  Oligomer
agagaagucuugcugaaag

SEQ ID NO: 3328 - RNA, 19 nt, artificial
  Oligomer
acagcuucaaaacucuuca

SEQ ID NO: 3329 - RNA, 19 nt, artificial
  Oligomer
cucauucucauucugguac

SEQ ID NO: 3330 - RNA, 19 nt, artificial
  Oligomer
acaucaagcuagacacgcc

SEQ ID NO: 3331 - RNA, 19 nt, artificial
  Oligomer
gaaaaggguauucagguug

SEQ ID NO: 3332 - RNA, 19 nt, artificial
  Oligomer
gcaaagagaagucuugcug

SEQ ID NO: 3333 - RNA, 19 nt, artificial
  Oligomer
aaaaaaaugaggcaagaaa

SEQ ID NO: 3334 - RNA, 19 nt, artificial
  Oligomer
gucaaagaccuuaaaguuc

SEQ ID NO: 3335 - RNA, 19 nt, artificial
  Oligomer
acugacagggcucuugaga

SEQ ID NO: 3336 - RNA, 19 nt, artificial
  Oligomer
augguugaaguuggagaug

SEQ ID NO: 3337 - RNA, 19 nt, artificial
  Oligomer
agaagggcaaagcaaacug

SEQ ID NO: 3338 - RNA, 19 nt, artificial
  Oligomer
auguuggugucacugggaa

SEQ ID NO: 3339 - RNA, 19 nt, artificial
  Oligomer
guuuguuuaagaucaucuc

SEQ ID NO: 3340 - RNA, 19 nt, artificial
  Oligomer
cagcaggguagaaagaagg

SEQ ID NO: 3341 - RNA, 19 nt, artificial
  Oligomer
cacuauuuugaccugguag

SEQ ID NO: 3342 - RNA, 19 nt, artificial
  Oligomer
guacuggauuaacuucucc

SEQ ID NO: 3343 - RNA, 19 nt, artificial
  Oligomer
gguuuguuuaagaucaucu

SEQ ID NO: 3344 - RNA, 19 nt, artificial
  Oligomer
aaaaauuccuucccaggcu

SEQ ID NO: 3345 - RNA, 19 nt, artificial
  Oligomer
gugaauaagguagaggucc

SEQ ID NO: 3346 - RNA, 19 nt, artificial
  Oligomer
agucuugcugaaaggauuc

SEQ ID NO: 3347 - RNA, 19 nt, artificial
  Oligomer
aagucuugcugaaaggauu

SEQ ID NO: 3348 - RNA, 19 nt, artificial
  Oligomer
ucaaaacucaaccguuagu

SEQ ID NO: 3349 - RNA, 19 nt, artificial
  Oligomer
acuauuuugaccugguaga

SEQ ID NO: 3350 - RNA, 19 nt, artificial
  Oligomer
aauguuggugucacuggga

SEQ ID NO: 3351 - RNA, 19 nt, artificial
  Oligomer
acugcaggcuuauacuuca

SEQ ID NO: 3352 - RNA, 19 nt, artificial
  Oligomer
ugcugaaaggauuccaguu

SEQ ID NO: 3353 - RNA, 19 nt, artificial
  Oligomer
cugaaaggauuccaguucc

SEQ ID NO: 3354 - RNA, 19 nt, artificial
  Oligomer
uguuguagcugaguaaggu

SEQ ID NO: 3355 - RNA, 19 nt, artificial
  Oligomer
aaaacucaaccguuagugg

SEQ ID NO: 3356 - RNA, 19 nt, artificial
  Oligomer
ugagauccaacaucaagcu

SEQ ID NO: 3357 - RNA, 19 nt, artificial
  Oligomer
aggcaaagagaagucuugc

SEQ ID NO: 3358 - RNA, 19 nt, artificial
  Oligomer
ucaccaccaaguuccucug

SEQ ID NO: 3359 - RNA, 19 nt, artificial
  Oligomer
acucuacagguugcugucc

SEQ ID NO: 3360 - RNA, 19 nt, artificial
  Oligomer
cuggauuaacuucuccuga

SEQ ID NO: 3361 - RNA, 19 nt, artificial
  Oligomer
uggucagaaaaggguauuc

SEQ ID NO: 3362 - RNA, 19 nt, artificial
  Oligomer
ugggaaaaauuccuuccca

SEQ ID NO: 3363 - RNA, 19 nt, artificial
  Oligomer
ucaaagucaaagaccuuaa

SEQ ID NO: 3364 - RNA, 19 nt, artificial
  Oligomer
auuccaguuccaagcaguc

SEQ ID NO: 3365 - RNA, 19 nt, artificial
  Oligomer
ugacagggcucuugagauc

SEQ ID NO: 3366 - RNA, 19 nt, artificial
  Oligomer
auugcccgacucauccaau

SEQ ID NO: 3367 - RNA, 19 nt, artificial
  Oligomer
ucaguucaaagucaaagac

SEQ ID NO: 3368 - RNA, 19 nt, artificial
  Oligomer
uuuugaccugguagauuuu

SEQ ID NO: 3369 - RNA, 19 nt, artificial
  Oligomer
agcagucaaaacucaaccg

SEQ ID NO: 3370 - RNA, 19 nt, artificial
  Oligomer
uacugacagggcucuugag

SEQ ID NO: 3371 - RNA, 19 nt, artificial
  Oligomer
guaguuuuauugugcuugg

SEQ ID NO: 3372 - RNA, 19 nt, artificial
  Oligomer
aucaucuccaccuggagau

SEQ ID NO: 3373 - RNA, 19 nt, artificial
  Oligomer
ugggcuguaguuuuauugu

SEQ ID NO: 3374 - RNA, 19 nt, artificial
  Oligomer
aaagaccuuaaaguucuca

SEQ ID NO: 3375 - RNA, 19 nt, artificial
  Oligomer
guucucagcaaugcguucu

SEQ ID NO: 3376 - RNA, 19 nt, artificial
  Oligomer
uaacuucuccugagugaga

SEQ ID NO: 3377 - RNA, 19 nt, artificial
  Oligomer
gaaaaauuccuucccaggc

SEQ ID NO: 3378 - RNA, 19 nt, artificial
  Oligomer
gaguaagguggucauaucc

SEQ ID NO: 3379 - RNA, 19 nt, artificial
  Oligomer
aggaaaaaaaugaggcaag

SEQ ID NO: 3380 - RNA, 19 nt, artificial
  Oligomer
cuggaagagacuucuacuc

SEQ ID NO: 3381 - RNA, 19 nt, artificial
  Oligomer
acuggaagagacuucuacu

SEQ ID NO: 3382 - RNA, 19 nt, artificial
  Oligomer
cagaaaaggguauucaggu

SEQ ID NO: 3383 - RNA, 19 nt, artificial
  Oligomer
ugcuucucuuuggucagaa

SEQ ID NO: 3384 - RNA, 19 nt, artificial
  Oligomer
ugaguaagguggucauauc

SEQ ID NO: 3385 - RNA, 19 nt, artificial
  Oligomer
uccaagcagucaaaacuca

SEQ ID NO: 3386 - RNA, 19 nt, artificial
  Oligomer
cucagcaaugcguucuggu

SEQ ID NO: 3387 - RNA, 19 nt, artificial
  Oligomer
uccaccuggagaugguuga

SEQ ID NO: 3388 - RNA, 19 nt, artificial
  Oligomer
aagguagagguccagguag

SEQ ID NO: 3389 - RNA, 19 nt, artificial
  Oligomer
caggcuuauacuucaagcc

SEQ ID NO: 3390 - RNA, 19 nt, artificial
  Oligomer
gaauguuggugucacuggg

SEQ ID NO: 3391 - RNA, 19 nt, artificial
  Oligomer
gcuucaaaacucuucaugg

SEQ ID NO: 3392 - RNA, 19 nt, artificial
  Oligomer
uugcuucucuuuggucaga

SEQ ID NO: 3393 - RNA, 19 nt, artificial
  Oligomer
ccaauagcuuucaccagcc

SEQ ID NO: 3394 - RNA, 19 nt, artificial
  Oligomer
caggguagaaagaagggca

SEQ ID NO: 3395 - RNA, 19 nt, artificial
  Oligomer
cacguguccagaauguugg

SEQ ID NO: 3396 - RNA, 19 nt, artificial
  Oligomer
aagaucaucuccaccugga

SEQ ID NO: 3397 - RNA, 19 nt, artificial
  Oligomer
aguacuggauuaacuucuc

SEQ ID NO: 3398 - RNA, 19 nt, artificial
  Oligomer
caaugggaaaaauuccuuc

SEQ ID NO: 3399 - RNA, 19 nt, artificial
  Oligomer
ucaggucgcugagugucuu

SEQ ID NO: 3400 - RNA, 19 nt, artificial
  Oligomer
cauccaaugggaaaaauuc

SEQ ID NO: 3401 - RNA, 19 nt, artificial
  Oligomer
agaccuuaaaguucucagc

SEQ ID NO: 3402 - RNA, 19 nt, artificial
  Oligomer
aagaagggcaaagcaaacu

SEQ ID NO: 3403 - RNA, 19 nt, artificial
  Oligomer
aagagcuccucacgcuuca

SEQ ID NO: 3404 - RNA, 19 nt, artificial
  Oligomer
ucuugagauccaacaucaa

SEQ ID NO: 3405 - RNA, 19 nt, artificial
  Oligomer
accacauugcccgacucau

SEQ ID NO: 3406 - RNA, 19 nt, artificial
  Oligomer
agguuuguuuaagaucauc

SEQ ID NO: 3407 - RNA, 19 nt, artificial
  Oligomer
ccaacaucaagcuagacac

SEQ ID NO: 3408 - RNA, 19 nt, artificial
  Oligomer
aagagacuucuacucuacu

SEQ ID NO: 3409 - RNA, 19 nt, artificial
  Oligomer
cucaaucugguuaacugca

SEQ ID NO: 3410 - RNA, 19 nt, artificial
  Oligomer
cugagcuucuccugaaugg

SEQ ID NO: 3411 - RNA, 19 nt, artificial
  Oligomer
caguucaaagucaaagacc

SEQ ID NO: 3412 - RNA, 19 nt, artificial
  Oligomer
guuccaagcagucaaaacu

SEQ ID NO: 3413 - RNA, 19 nt, artificial
  Oligomer
cuguaguuuuauugugcuu

SEQ ID NO: 3414 - RNA, 19 nt, artificial
  Oligomer
guagauuuugcuucucuuu

SEQ ID NO: 3415 - RNA, 19 nt, artificial
  Oligomer
guagaaagaagggcaaagc

SEQ ID NO: 3416 - RNA, 19 nt, artificial
  Oligomer
guaccuuuaaauagcccgu

SEQ ID NO: 3417 - RNA, 19 nt, artificial
  Oligomer
agcaggguagaaagaaggg

SEQ ID NO: 3418 - RNA, 19 nt, artificial
  Oligomer
ugaauaagguagaggucca

SEQ ID NO: 3419 - RNA, 19 nt, artificial
  Oligomer
gcucuugagauccaacauc

SEQ ID NO: 3420 - RNA, 19 nt, artificial
  Oligomer
caccucauucucauucugg

SEQ ID NO: 3421 - RNA, 19 nt, artificial
  Oligomer
guacagcucaacaaggcac

SEQ ID NO: 3422 - RNA, 19 nt, artificial
  Oligomer
aguucaaagucaaagaccu

SEQ ID NO: 3423 - RNA, 19 nt, artificial
  Oligomer
ugguuaacugcaggcuuau

SEQ ID NO: 3424 - RNA, 19 nt, artificial
  Oligomer
aauccuugugggagguaca

SEQ ID NO: 3425 - RNA, 19 nt, artificial
  Oligomer
aaugcguucuggugucaca

SEQ ID NO: 3426 - RNA, 19 nt, artificial
  Oligomer
gucagaaaaggguauucag

SEQ ID NO: 3427 - RNA, 19 nt, artificial
  Oligomer
cuacugacagggcucuuga

SEQ ID NO: 3428 - RNA, 19 nt, artificial
  Oligomer
ugaaaggauuccaguucca

SEQ ID NO: 3429 - RNA, 19 nt, artificial
  Oligomer
ggcuguaguuuuauugugc

SEQ ID NO: 3430 - RNA, 19 nt, artificial
  Oligomer
agacccuccaguuccuguu

SEQ ID NO: 3431 - RNA, 19 nt, artificial
  Oligomer
agcaaugcguucugguguc

SEQ ID NO: 3432 - RNA, 19 nt, artificial
  Oligomer
aaccacauugcccgacuca

SEQ ID NO: 3433 - RNA, 19 nt, artificial
  Oligomer
aaaaaugaggcaagaaaca

SEQ ID NO: 3434 - RNA, 19 nt, artificial
  Oligomer
uccuguuguagcugaguaa

SEQ ID NO: 3435 - RNA, 19 nt, artificial
  Oligomer
guuguagcugaguaaggug

SEQ ID NO: 3436 - RNA, 19 nt, artificial
  Oligomer
aggucgcugagugucuucu

SEQ ID NO: 3437 - RNA, 19 nt, artificial
  Oligomer
cacagguauaggucacuug

SEQ ID NO: 3438 - RNA, 19 nt, artificial
  Oligomer
aaagaagggcaaagcaaac

SEQ ID NO: 3439 - RNA, 19 nt, artificial
  Oligomer
cuuucaccagcccuucauc

SEQ ID NO: 3440 - RNA, 19 nt, artificial
  Oligomer
cagcaaugcguucuggugu

SEQ ID NO: 3441 - RNA, 19 nt, artificial
  Oligomer
cuguuguagcugaguaagg

SEQ ID NO: 3442 - RNA, 19 nt, artificial
  Oligomer
cuugcugacgaugaagagc

SEQ ID NO: 3443 - RNA, 19 nt, artificial
  Oligomer
ugcguucuggugucacaga

SEQ ID NO: 3444 - RNA, 19 nt, artificial
  Oligomer
agacuucuacucuacugac

SEQ ID NO: 3445 - RNA, 19 nt, artificial
  Oligomer
gcucaguucaaagucaaag

SEQ ID NO: 3446 - RNA, 19 nt, artificial
  Oligomer
aaagucaaagaccuuaaag

SEQ ID NO: 3447 - RNA, 19 nt, artificial
  Oligomer
acauugcccgacucaucca

SEQ ID NO: 3448 - RNA, 19 nt, artificial
  Oligomer
gcaaggaaaaaaaugaggc

SEQ ID NO: 3449 - RNA, 19 nt, artificial
  Oligomer
aagucaaagaccuuaaagu

SEQ ID NO: 3450 - RNA, 19 nt, artificial
  Oligomer
gcaggcuuauacuucaagc

SEQ ID NO: 3451 - RNA, 19 nt, artificial
  Oligomer
agcucaacaaggcacagac

SEQ ID NO: 3452 - RNA, 19 nt, artificial
  Oligomer
aguucucagcaaugcguuc

SEQ ID NO: 3453 - RNA, 19 nt, artificial
  Oligomer
gauuaacuucuccugagug

SEQ ID NO: 3454 - RNA, 19 nt, artificial
  Oligomer
aaaauuccuucccaggcuu

SEQ ID NO: 3455 - RNA, 19 nt, artificial
  Oligomer
cuuuggucagaaaagggua

SEQ ID NO: 3456 - RNA, 19 nt, artificial
  Oligomer
uguagcugaguaagguggu

SEQ ID NO: 3457 - RNA, 19 nt, artificial
  Oligomer
ccacucuacagguugcugu

SEQ ID NO: 3458 - RNA, 19 nt, artificial
  Oligomer
cacucaaucugguuaacug

SEQ ID NO: 3459 - RNA, 19 nt, artificial
  Oligomer
ucauucucauucugguaca

SEQ ID NO: 3460 - RNA, 19 nt, artificial
  Oligomer
agaaagaagggcaaagcaa

SEQ ID NO: 3461 - RNA, 19 nt, artificial
  Oligomer
aacuucuccugagugagau

SEQ ID NO: 3462 - RNA, 19 nt, artificial
  Oligomer
gcugaaaggauuccaguuc

SEQ ID NO: 3463 - RNA, 19 nt, artificial
  Oligomer
aaagcaaacuggaagagac

SEQ ID NO: 3464 - RNA, 19 nt, artificial
  Oligomer
ucccugagcuucuccugaa

SEQ ID NO: 3465 - RNA, 19 nt, artificial
  Oligomer
gucaaaacucaaccguuag

SEQ ID NO: 3466 - RNA, 19 nt, artificial
  Oligomer
aaggaaaaaaaugaggcaa

SEQ ID NO: 3467 - RNA, 19 nt, artificial
  Oligomer
gucuugcugaaaggauucc

SEQ ID NO: 3468 - RNA, 19 nt, artificial
  Oligomer
ccaaugggaaaaauuccuu

SEQ ID NO: 3469 - RNA, 19 nt, artificial
  Oligomer
ccagguuuguuuaagauca

SEQ ID NO: 3470 - RNA, 19 nt, artificial
  Oligomer
caaugcguucuggugucac

SEQ ID NO: 3471 - RNA, 19 nt, artificial
  Oligomer
uaagguagagguccaggua

SEQ ID NO: 3472 - RNA, 19 nt, artificial
  Oligomer
cugaguaagguggucauau

SEQ ID NO: 3473 - RNA, 19 nt, artificial
  Oligomer
caccaaguuccucugcaug

SEQ ID NO: 3474 - RNA, 19 nt, artificial
  Oligomer
aaaacucuucauggaaggg

SEQ ID NO: 3475 - RNA, 19 nt, artificial
  Oligomer
cuacucuacugacagggcu

SEQ ID NO: 3476 - RNA, 19 nt, artificial
  Oligomer
acucuacugacagggcucu

SEQ ID NO: 3477 - RNA, 19 nt, artificial
  Oligomer
ugugggagguacagcucaa

SEQ ID NO: 3478 - RNA, 19 nt, artificial
  Oligomer
acuacauuugcaaggaaaa

SEQ ID NO: 3479 - RNA, 19 nt, artificial
  Oligomer
ugcugacgaugaagagcuc

SEQ ID NO: 3480 - RNA, 19 nt, artificial
  Oligomer
guguccagaauguuggugu

SEQ ID NO: 3481 - RNA, 19 nt, artificial
  Oligomer
ccuucauccaccagcucuu

SEQ ID NO: 3482 - RNA, 19 nt, artificial
  Oligomer
accacagcuucaaaacucu

SEQ ID NO: 3483 - RNA, 19 nt, artificial
  Oligomer
guucuggugucacagacuu

SEQ ID NO: 3484 - RNA, 19 nt, artificial
  Oligomer
caaaacucuucauggaagg

SEQ ID NO: 3485 - RNA, 19 nt, artificial
  Oligomer
agggcucuugagauccaac

SEQ ID NO: 3486 - RNA, 19 nt, artificial
  Oligomer
accaccaaguuccucugca

SEQ ID NO: 3487 - RNA, 19 nt, artificial
  Oligomer
agguacagcucaacaaggc

SEQ ID NO: 3488 - RNA, 19 nt, artificial
  Oligomer
caaucugguuaacugcagg

SEQ ID NO: 3489 - RNA, 19 nt, artificial
  Oligomer
accuggagaugguugaagu

SEQ ID NO: 3490 - RNA, 19 nt, artificial
  Oligomer
agcuuucaccagcccuuca

SEQ ID NO: 3491 - RNA, 19 nt, artificial
  Oligomer
cucaguucaaagucaaaga

SEQ ID NO: 3492 - RNA, 19 nt, artificial
  Oligomer
cugacagggcucuugagau

SEQ ID NO: 3493 - RNA, 19 nt, artificial
  Oligomer
acauuugcaaggaaaaaaa

SEQ ID NO: 3494 - RNA, 19 nt, artificial
  Oligomer
aaaaggguauucagguugu

SEQ ID NO: 3495 - RNA, 19 nt, artificial
  Oligomer
agcuugcugacgaugaaga

SEQ ID NO: 3496 - RNA, 19 nt, artificial
  Oligomer
cuucuccugagugagauau

SEQ ID NO: 3497 - RNA, 19 nt, artificial
  Oligomer
cuucauccaccagcucuuc

SEQ ID NO: 3498 - RNA, 19 nt, artificial
  Oligomer
gacgaugaagagcuccuca

SEQ ID NO: 3499 - RNA, 19 nt, artificial
  Oligomer
agaucaucuccaccuggag

SEQ ID NO: 3500 - RNA, 19 nt, artificial
  Oligomer
accucauucucauucuggu

SEQ ID NO: 3501 - RNA, 19 nt, artificial
  Oligomer
ggaaaaauuccuucccagg

SEQ ID NO: 3502 - RNA, 19 nt, artificial
  Oligomer
auuccuucccaggcuuaaa

SEQ ID NO: 3503 - RNA, 19 nt, artificial
  Oligomer
agucaaaacucaaccguua

SEQ ID NO: 3504 - RNA, 19 nt, artificial
  Oligomer
cauugcccgacucauccaa

SEQ ID NO: 3505 - RNA, 19 nt, artificial
  Oligomer
cagguauaggucacuuggg

SEQ ID NO: 3506 - RNA, 19 nt, artificial
  Oligomer
gcgcguaccuuuaaauagc

SEQ ID NO: 3507 - RNA, 19 nt, artificial
  Oligomer
ccacguguccagaauguug

SEQ ID NO: 3508 - RNA, 19 nt, artificial
  Oligomer
aggaccugggcuguaguuu

SEQ ID NO: 3509 - RNA, 19 nt, artificial
  Oligomer
ccugagcuucuccugaaug

SEQ ID NO: 3510 - RNA, 19 nt, artificial
  Oligomer
agaaaaggguauucagguu

SEQ ID NO: 3511 - RNA, 19 nt, artificial
  Oligomer
caaagagaagucuugcuga

SEQ ID NO: 3512 - RNA, 19 nt, artificial
  Oligomer
aguuccaagcagucaaaac

SEQ ID NO: 3513 - RNA, 19 nt, artificial
  Oligomer
aagagaagucuugcugaaa

SEQ ID NO: 3514 - RNA, 19 nt, artificial
  Oligomer
gguagauuuugcuucucuu

SEQ ID NO: 3515 - RNA, 19 nt, artificial
  Oligomer
acaugggcacagucgaugu

SEQ ID NO: 3516 - RNA, 19 nt, artificial
  Oligomer
gagacuucuacucuacuga

SEQ ID NO: 3517 - RNA, 19 nt, artificial
  Oligomer
gagaugguugaaguuggag

SEQ ID NO: 3518 - RNA, 19 nt, artificial
  Oligomer
cugguuaacugcaggcuua

SEQ ID NO: 3519 - RNA, 19 nt, artificial
  Oligomer
cacucuacagguugcuguc

SEQ ID NO: 3520 - RNA, 19 nt, artificial
  Oligomer
auacuacauuugcaaggaa

SEQ ID NO: 3521 - RNA, 19 nt, artificial
  Oligomer
cuucucuuuggucagaaaa

SEQ ID NO: 3522 - RNA, 19 nt, artificial
  Oligomer
gagaagucuugcugaaagg

SEQ ID NO: 3523 - RNA, 19 nt, artificial
  Oligomer
gcaaacuggaagagacuuc

SEQ ID NO: 3524 - RNA, 19 nt, artificial
  Oligomer
caagcagucaaaacucaac

SEQ ID NO: 3525 - RNA, 19 nt, artificial
  Oligomer
gcguaccuuuaaauagccc

SEQ ID NO: 3526 - RNA, 19 nt, artificial
  Oligomer
caccuggagaugguugaag

SEQ ID NO: 3527 - RNA, 19 nt, artificial
  Oligomer
aguuccuguuguagcugag

SEQ ID NO: 3528 - RNA, 19 nt, artificial
  Oligomer
agaagucuugcugaaagga

SEQ ID NO: 3529 - RNA, 19 nt, artificial
  Oligomer
ggcgcguaccuuuaaauag

SEQ ID NO: 3530 - RNA, 19 nt, artificial
  Oligomer
gcuguaguuuuauugugcu

SEQ ID NO: 3531 - RNA, 19 nt, artificial
  Oligomer
agucaaagaccuuaaaguu

SEQ ID NO: 3532 - RNA, 19 nt, artificial
  Oligomer
gguugaaguuggagaugcc

SEQ ID NO: 3533 - RNA, 19 nt, artificial
  Oligomer
cacagcuugcugacgauga

SEQ ID NO: 3534 - RNA, 19 nt, artificial
  Oligomer
cgcguaccuuuaaauagcc

SEQ ID NO: 3535 - RNA, 19 nt, artificial
  Oligomer
auccaacaucaagcuagac

SEQ ID NO: 3536 - RNA, 19 nt, artificial
  Oligomer
aauuccuucccaggcuuaa

SEQ ID NO: 3537 - RNA, 19 nt, artificial
  Oligomer
uguccagaauguugguguc

SEQ ID NO: 3538 - RNA, 19 nt, artificial
  Oligomer
ccuccaguuccuguuguag

SEQ ID NO: 3539 - RNA, 19 nt, artificial
  Oligomer
cugguagauuuugcuucuc

SEQ ID NO: 3540 - RNA, 19 nt, artificial
  Oligomer
aucuccaccuggagauggu

SEQ ID NO: 3541 - RNA, 19 nt, artificial
  Oligomer
ucaucuccaccuggagaug

SEQ ID NO: 3542 - RNA, 19 nt, artificial
  Oligomer
agugaauaagguagagguc

SEQ ID NO: 3543 - RNA, 19 nt, artificial
  Oligomer
aagcaaacuggaagagacu

SEQ ID NO: 3544 - RNA, 19 nt, artificial
  Oligomer
gcaguacuggauuaacuuc

SEQ ID NO: 3545 - RNA, 19 nt, artificial
  Oligomer
cucuacugacagggcucuu

SEQ ID NO: 3546 - RNA, 19 nt, artificial
  Oligomer
gaggcaaagagaagucuug

SEQ ID NO: 3547 - RNA, 19 nt, artificial
  Oligomer
ucaccacgaugccuuugga

SEQ ID NO: 3548 - RNA, 19 nt, artificial
  Oligomer
ucuccaccuggagaugguu

SEQ ID NO: 3549 - RNA, 19 nt, artificial
  Oligomer
caauagcuuucaccagccc

SEQ ID NO: 3550 - RNA, 19 nt, artificial
  Oligomer
aaauuccuucccaggcuua

SEQ ID NO: 3551 - RNA, 19 nt, artificial
  Oligomer
gaagucuugcugaaaggau

SEQ ID NO: 3552 - RNA, 19 nt, artificial
  Oligomer
ccaguuccuguuguagcug

SEQ ID NO: 3553 - RNA, 19 nt, artificial
  Oligomer
acccuccaguuccuguugu

SEQ ID NO: 3554 - RNA, 19 nt, artificial
  Oligomer
gaccuuaaaguucucagca

SEQ ID NO: 3555 - RNA, 19 nt, artificial
  Oligomer
gcuuucaccagcccuucau

SEQ ID NO: 3556 - RNA, 19 nt, artificial
  Oligomer
caaacuggaagagacuucu

SEQ ID NO: 3557 - RNA, 19 nt, artificial
  Oligomer
cagugaauaagguagaggu

SEQ ID NO: 3558 - RNA, 19 nt, artificial
  Oligomer
agcaaacuggaagagacuu

SEQ ID NO: 3559 - RNA, 19 nt, artificial
  Oligomer
caacaucaagcuagacacg

SEQ ID NO: 3560 - RNA, 19 nt, artificial
  Oligomer
gguagaaagaagggcaaag

SEQ ID NO: 3561 - RNA, 19 nt, artificial
  Oligomer
ggcaguacuggauuaacuu

SEQ ID NO: 3562 - RNA, 19 nt, artificial
  Oligomer
cuucaaaacucuucaugga

SEQ ID NO: 3563 - RNA, 19 nt, artificial
  Oligomer
cagucaaaacucaaccguu

SEQ ID NO: 3564 - RNA, 19 nt, artificial
  Oligomer
ccagcaggguagaaagaag

SEQ ID NO: 3565 - RNA, 19 nt, artificial
  Oligomer
gauuuugcuucucuuuggu

SEQ ID NO: 3566 - RNA, 19 nt, artificial
  Oligomer
cuucuacucuacugacagg

SEQ ID NO: 3567 - RNA, 19 nt, artificial
  Oligomer
cagcuugcugacgaugaag

SEQ ID NO: 3568 - RNA, 19 nt, artificial
  Oligomer
guucaaagucaaagaccuu

SEQ ID NO: 3569 - RNA, 19 nt, artificial
  Oligomer
gugucacugggaaccacau

SEQ ID NO: 3570 - RNA, 19 nt, artificial
  Oligomer
aagggcaaagcaaacugga

SEQ ID NO: 3571 - RNA, 19 nt, artificial
  Oligomer
gggaaaaauuccuucccag

SEQ ID NO: 3572 - RNA, 19 nt, artificial
  Oligomer
ugcucaguucaaagucaaa

SEQ ID NO: 3573 - RNA, 19 nt, artificial
  Oligomer
gaucaccaccaaguuccuc

SEQ ID NO: 3574 - RNA, 19 nt, artificial
  Oligomer
aggguagaaagaagggcaa

SEQ ID NO: 3575 - RNA, 19 nt, artificial
  Oligomer
gggcucuugagauccaaca

SEQ ID NO: 3576 - RNA, 19 nt, artificial
  Oligomer
aggauuccaguuccaagca

SEQ ID NO: 3577 - RNA, 19 nt, artificial
  Oligomer
cauacuacauuugcaagga

SEQ ID NO: 3578 - RNA, 19 nt, artificial
  Oligomer
ggcugcucaguucaaaguc

SEQ ID NO: 3579 - RNA, 19 nt, artificial
  Oligomer
cguucuggugucacagacu

SEQ ID NO: 3580 - RNA, 19 nt, artificial
  Oligomer
cguguccagaauguuggug

SEQ ID NO: 3581 - RNA, 19 nt, artificial
  Oligomer
gagguacagcucaacaagg

SEQ ID NO: 3582 - RNA, 19 nt, artificial
  Oligomer
gcagucaaaacucaaccgu

SEQ ID NO: 3583 - RNA, 19 nt, artificial
  Oligomer
accuuaaaguucucagcaa

SEQ ID NO: 3584 - RNA, 19 nt, artificial
  Oligomer
ccaagcagucaaaacucaa

SEQ ID NO: 3585 - RNA, 19 nt, artificial
  Oligomer
ccagugaauaagguagagg

SEQ ID NO: 3586 - RNA, 19 nt, artificial
  Oligomer
ccuguuguagcugaguaag

SEQ ID NO: 3587 - RNA, 19 nt, artificial
  Oligomer
cugcucaguucaaagucaa

SEQ ID NO: 3588 - RNA, 19 nt, artificial
  Oligomer
gaccugguagauuuugcuu

SEQ ID NO: 3589 - RNA, 19 nt, artificial
  Oligomer
cuauuuugaccugguagau

SEQ ID NO: 3590 - RNA, 19 nt, artificial
  Oligomer
gggcaaagcaaacuggaag

SEQ ID NO: 3591 - RNA, 19 nt, artificial
  Oligomer
accugggcuguaguuuuau

SEQ ID NO: 3592 - RNA, 19 nt, artificial
  Oligomer
ggcaaagagaagucuugcu

SEQ ID NO: 3593 - RNA, 19 nt, artificial
  Oligomer
acagggcucuugagaucca

SEQ ID NO: 3594 - RNA, 19 nt, artificial
  Oligomer
gguauucagguuguacuuu

SEQ ID NO: 3595 - RNA, 19 nt, artificial
  Oligomer
aaagagaagucuugcugaa

SEQ ID NO: 3596 - RNA, 19 nt, artificial
  Oligomer
gaaagaagggcaaagcaaa

SEQ ID NO: 3597 - RNA, 19 nt, artificial
  Oligomer
ccugguagauuuugcuucu

SEQ ID NO: 3598 - RNA, 19 nt, artificial
  Oligomer
gaagagacuucuacucuac

SEQ ID NO: 3599 - RNA, 19 nt, artificial
  Oligomer
ccuucucaugguacgugca

SEQ ID NO: 3600 - RNA, 19 nt, artificial
  Oligomer
ccuuaaaguucucagcaau

SEQ ID NO: 3601 - RNA, 19 nt, artificial
  Oligomer
agguagagguccagguagu

SEQ ID NO: 3602 - RNA, 19 nt, artificial
  Oligomer
aaacuggaagagacuucua

SEQ ID NO: 3603 - RNA, 19 nt, artificial
  Oligomer
ggguauucagguuguacuu

SEQ ID NO: 3604 - RNA, 19 nt, artificial
  Oligomer
gaugguugaaguuggagau

SEQ ID NO: 3605 - RNA, 19 nt, artificial
  Oligomer
ggucagaaaaggguauuca

SEQ ID NO: 3606 - RNA, 19 nt, artificial
  Oligomer
gggcuguaguuuuauugug

SEQ ID NO: 3607 - RNA, 19 nt, artificial
  Oligomer
gauuccaguuccaagcagu

SEQ ID NO: 3608 - RNA, 19 nt, artificial
  Oligomer
gaagggcaaagcaaacugg

SEQ ID NO: 3609 - RNA, 19 nt, artificial
  Oligomer
gaaaggauuccaguuccaa

SEQ ID NO: 3610 - RNA, 19 nt, artificial
  Oligomer
gacuucuacucuacugaca

SEQ ID NO: 3611 - RNA, 19 nt, artificial
  Oligomer
cugcaggcuuauacuucaa

SEQ ID NO: 3612 - RNA, 19 nt, artificial
  Oligomer
caguuccuguuguagcuga

SEQ ID NO: 3613 - RNA, 19 nt, artificial
  Oligomer
gaucaucuccaccuggaga

SEQ ID NO: 3614 - RNA, 19 nt, artificial
  Oligomer
guccagaauguugguguca

SEQ ID NO: 3615 - RNA, 19 nt, artificial
  Oligomer
acuucuccugagugagaua

SEQ ID NO: 3616 - RNA, 19 nt, artificial
  Oligomer
agcugaguaagguggucau

SEQ ID NO: 3617 - RNA, 19 nt, artificial
  Oligomer
caaagaccuuaaaguucuc

SEQ ID NO: 3618 - RNA, 19 nt, artificial
  Oligomer
cccagcaggguagaaagaa

SEQ ID NO: 3619 - RNA, 19 nt, artificial
  Oligomer
gcacucaaucugguuaacu

SEQ ID NO: 3620 - RNA, 19 nt, artificial
  Oligomer
ggagguacagcucaacaag

SEQ ID NO: 3621 - RNA, 19 nt, artificial
  Oligomer
cauccaccagcucuuccau

SEQ ID NO: 3622 - RNA, 19 nt, artificial
  Oligomer
ccacagcuucaaaacucuu

SEQ ID NO: 3623 - RNA, 19 nt, artificial
  Oligomer
caaggaaaaaaaugaggca

SEQ ID NO: 3624 - RNA, 19 nt, artificial
  Oligomer
guuccuguuguagcugagu

SEQ ID NO: 3625 - RNA, 19 nt, artificial
  Oligomer
cuacauuugcaaggaaaaa

SEQ ID NO: 3626 - RNA, 19 nt, artificial
  Oligomer
ggcacuauuuugaccuggu

SEQ ID NO: 3627 - RNA, 19 nt, artificial
  Oligomer
guaauccuugugggaggua

SEQ ID NO: 3628 - RNA, 19 nt, artificial
  Oligomer
ccucauucucauucuggua

SEQ ID NO: 3629 - RNA, 19 nt, artificial
  Oligomer
ccagaauguuggugucacu

SEQ ID NO: 3630 - RNA, 19 nt, artificial
  Oligomer
caaagcaaacuggaagaga

SEQ ID NO: 3631 - RNA, 19 nt, artificial
  Oligomer
acucauccaaugggaaaaa

SEQ ID NO: 3632 - RNA, 19 nt, artificial
  Oligomer
ggaagagacuucuacucua

SEQ ID NO: 3633 - RNA, 19 nt, artificial
  Oligomer
gaauaagguagagguccag

SEQ ID NO: 3634 - RNA, 19 nt, artificial
  Oligomer
gcaaccacagcuucaaaac

SEQ ID NO: 3635 - RNA, 19 nt, artificial
  Oligomer
ggauuaacuucuccugagu

SEQ ID NO: 3636 - RNA, 19 nt, artificial
  Oligomer
gggagguacagcucaacaa

SEQ ID NO: 3637 - RNA, 19 nt, artificial
  Oligomer
ggcaaccacagcuucaaaa

SEQ ID NO: 3638 - RNA, 19 nt, artificial
  Oligomer
cagggcucuugagauccaa

SEQ ID NO: 3639 - RNA, 19 nt, artificial
  Oligomer
gagauccaacaucaagcua

SEQ ID NO: 3640 - RNA, 19 nt, artificial
  Oligomer
aaaggguauucagguugua

SEQ ID NO: 3641 - RNA, 19 nt, artificial
  Oligomer
cggcgcguaccuuuaaaua

SEQ ID NO: 3642 - RNA, 19 nt, artificial
  Oligomer
gcuugcugacgaugaagag

SEQ ID NO: 3643 - RNA, 19 nt, artificial
  Oligomer
guagcugaguaaggugguc

SEQ ID NO: 3644 - RNA, 19 nt, artificial
  Oligomer
aggcaaccacagcuucaaa

SEQ ID NO: 3645 - RNA, 19 nt, artificial
  Oligomer
ggaccugggcuguaguuuu

SEQ ID NO: 3646 - RNA, 19 nt, artificial
  Oligomer
accacagcuugcugacgau

SEQ ID NO: 3647 - RNA, 19 nt, artificial
  Oligomer
acagcucaacaaggcacag

SEQ ID NO: 3648 - RNA, 19 nt, Artificial
  Oligomer
ggauuccaguuccaagcag

SEQ ID NO: 3649 - RNA, 19 nt, artificial
  Oligomer
ggaaaaaaauucagcugaa

SEQ ID NO: 3650 - RNA, 19 nt, artificial
  Oligomer
cgaugaugccgaugauauu

SEQ ID NO: 3651 - RNA, 19 nt, artificial
  Oligomer
ccaggaacaaaauucaaaa

SEQ ID NO: 3652 - RNA, 19 nt, artificial
  Oligomer
caacgugaaugcugcugau

SEQ ID NO: 3653 - RNA, 19 nt, artificial
  Oligomer
ggagaaaaacguacugaaa

SEQ ID NO: 3654 - RNA, 19 nt, artificial
  Oligomer
cgugaaugcugcugauagu

SEQ ID NO: 3655 - RNA, 19 nt, artificial
  Oligomer
cgggcaucgagauugguaa

SEQ ID NO: 3656 - RNA, 19 nt, artificial
  Oligomer
caggaaagcugcagcuaga

SEQ ID NO: 3657 - RNA, 19 nt, artificial
  Oligomer
ggcuuuuuauauaccaaaa

SEQ ID NO: 3658 - RNA, 19 nt, artificial
  Oligomer
aaauguaccuggagaaaaa

SEQ ID NO: 3659 - RNA, 19 nt, artificial
  Oligomer
caggcuuuuuauauaccaa

SEQ ID NO: 3660 - RNA, 19 nt, artificial
  Oligomer
cggcagaggacaauaacaa

SEQ ID NO: 3661 - RNA, 19 nt, artificial
  Oligomer
cggcaaucugucugcugaa

SEQ ID NO: 3662 - RNA, 19 nt, artificial
  Oligomer
caauuacuauaaauccaaa

SEQ ID NO: 3663 - RNA, 19 nt, artificial
  Oligomer
cgaacucagagaaauguaa

SEQ ID NO: 3664 - RNA, 19 nt, artificial
  Oligomer
cguacaggcuuuuuauaua

SEQ ID NO: 3665 - RNA, 19 nt, artificial
  Oligomer
cauaguguggugaagaaaa

SEQ ID NO: 3666 - RNA, 19 nt, artificial
  Oligomer
guguaaaugugcacaauaa

SEQ ID NO: 3667 - RNA, 19 nt, artificial
  Oligomer
cgucucuaugggaaaaaaa

SEQ ID NO: 3668 - RNA, 19 nt, artificial
  Oligomer
ggcugagaguccgguuuaa

SEQ ID NO: 3669 - RNA, 19 nt, artificial
  Oligomer
caggaaguacagacugcaa

SEQ ID NO: 3670 - RNA, 19 nt, artificial
  Oligomer
cugucgagauguuguagaa

SEQ ID NO: 3671 - RNA, 19 nt, artificial
  Oligomer
cagcguuuacauuuucuaa

SEQ ID NO: 3672 - RNA, 19 nt, artificial
  Oligomer
gcagcagaaggaacucuua

SEQ ID NO: 3673 - RNA, 19 nt, artificial
  Oligomer
uguggugaagaaaagugaa

SEQ ID NO: 3674 - RNA, 19 nt, artificial
  Oligomer
ccaacuuaaccaggaacaa

SEQ ID NO: 3675 - RNA, 19 nt, artificial
  Oligomer
gggcaucgagauugguaaa

SEQ ID NO: 3676 - RNA, 19 nt, artificial
  Oligomer
ccauguuccaggaaaagaa

SEQ ID NO: 3677 - RNA, 19 nt, artificial
  Oligomer
aggagaacaagcugaagaa

SEQ ID NO: 3678 - RNA, 19 nt, artificial
  Oligomer
gucuauuucugaaaaugaa

SEQ ID NO: 3679 - RNA, 19 nt, artificial
  Oligomer
gcagcagucuauuucugaa

SEQ ID NO: 3680 - RNA, 19 nt, artificial
  Oligomer
caaucugucugcugaaaua

SEQ ID NO: 3681 - RNA, 19 nt, artificial
  Oligomer
caaccauaagcgacauuga

SEQ ID NO: 3682 - RNA, 19 nt, artificial
  Oligomer
cagcagaaggaacucuuaa

SEQ ID NO: 3683 - RNA, 19 nt, artificial
  Oligomer
cacugaggugugaauugua

SEQ ID NO: 3684 - RNA, 19 nt, artificial
  Oligomer
gggagagccucagcauaua

SEQ ID NO: 3685 - RNA, 19 nt, artificial
  Oligomer
cacggagggaagaagugaa

SEQ ID NO: 3686 - RNA, 19 nt, artificial
  Oligomer
agaaggaacucuuaaauaa

SEQ ID NO: 3687 - RNA, 19 nt, artificial
  Oligomer
agcugggugugaugaacaa

SEQ ID NO: 3688 - RNA, 19 nt, artificial
  Oligomer
gcuagaaaauggucuuaau

SEQ ID NO: 3689 - RNA, 19 nt, artificial
  Oligomer
cgaugauauuaacuguuuu

SEQ ID NO: 3690 - RNA, 19 nt, artificial
  Oligomer
agggcuaugugcccaaaaa

SEQ ID NO: 3691 - RNA, 19 nt, artificial
  Oligomer
agcagaaggaacucuuaaa

SEQ ID NO: 3692 - RNA, 19 nt, artificial
  Oligomer
ccggcagaggacaauaaca

SEQ ID NO: 3693 - RNA, 19 nt, artificial
  Oligomer
guacgaacaucuucagaaa

SEQ ID NO: 3694 - RNA, 19 nt, artificial
  Oligomer
ggcuguauccacggaucaa

SEQ ID NO: 3695 - RNA, 19 nt, artificial
  Oligomer
cucagagaaauguaauaaa

SEQ ID NO: 3696 - RNA, 19 nt, artificial
  Oligomer
caaggaacagcguuuacau

SEQ ID NO: 3697 - RNA, 19 nt, artificial
  Oligomer
gcaacagcagcagauugaa

SEQ ID NO: 3698 - RNA, 19 nt, artificial
  Oligomer
cccaggagaacaagcugaa

SEQ ID NO: 3699 - RNA, 19 nt, artificial
  Oligomer
gaaugcugcugauagugau

SEQ ID NO: 3700 - RNA, 19 nt, artificial
  Oligomer
cagcaauuggaagauuuaa

SEQ ID NO: 3701 - RNA, 19 nt, artificial
  Oligomer
gcaaaaucaugaacggcaa

SEQ ID NO: 3702 - RNA, 19 nt, artificial
  Oligomer
cuuaaauaagucaguuaaa

SEQ ID NO: 3703 - RNA, 19 nt, artificial
  Oligomer
cugucugcugaaauagaaa

SEQ ID NO: 3704 - RNA, 19 nt, artificial
  Oligomer
ggagaacaagcugaagaaa

SEQ ID NO: 3705 - RNA, 19 nt, artificial
  Oligomer
caccgaaucggacacucau

SEQ ID NO: 3706 - RNA, 19 nt, artificial
  Oligomer
ccaugauggacaagcgaau

SEQ ID NO: 3707 - RNA, 19 nt, artificial
  Oligomer
ggacaagcgaaucagugaa

SEQ ID NO: 3708 - RNA, 19 nt, artificial
  Oligomer
gauccaaauccgcuaauga

SEQ ID NO: 3709 - RNA, 19 nt, artificial
  Oligomer
gcggcgguggaguuaaaaa

SEQ ID NO: 3710 - RNA, 19 nt, artificial
  Oligomer
cagcguccacaaugugaau

SEQ ID NO: 3711 - RNA, 19 nt, artificial
  Oligomer
ccauuaagaagucccauaa

SEQ ID NO: 3712 - RNA, 19 nt, artificial
  Oligomer
guacagacugcaauuuuaa

SEQ ID NO: 3713 - RNA, 19 nt, artificial
  Oligomer
caacuuaaccaggaacaaa

SEQ ID NO: 3714 - RNA, 19 nt, artificial
  Oligomer
ccaacuugaagaagcccaa

SEQ ID NO: 3715 - RNA, 19 nt, artificial
  Oligomer
agaacaagcugaagaaaau

SEQ ID NO: 3716 - RNA, 19 nt, artificial
  Oligomer
caagucgacuacagcaaaa

SEQ ID NO: 3717 - RNA, 19 nt, artificial
  Oligomer
aaccaggaacaaaauucaa

SEQ ID NO: 3718 - RNA, 19 nt, artificial
  Oligomer
gggaaaugaacgucccaua

SEQ ID NO: 3719 - RNA, 19 nt, artificial
  Oligomer
aaccauaagcgacauugaa

SEQ ID NO: 3720 - RNA, 19 nt, artificial
  Oligomer
ggcgguggaguuaaaaaga

SEQ ID NO: 3721 - RNA, 19 nt, artificial
  Oligomer
gccugaacuuccuuuugga

SEQ ID NO: 3722 - RNA, 19 nt, artificial
  Oligomer
gaaaauucgugcaaugaga

SEQ ID NO: 3723 - RNA, 19 nt, artificial
  Oligomer
cgcgaugaugccgaugaua

SEQ ID NO: 3724 - RNA, 19 nt, artificial
  Oligomer
gagcaacaaugaacagauu

SEQ ID NO: 3725 - RNA, 19 nt, artificial
  Oligomer
aacugagaacagugaacaa

SEQ ID NO: 3726 - RNA, 19 nt, artificial
  Oligomer
aguacagacugcaauuuua

SEQ ID NO: 3727 - RNA, 19 nt, artificial
  Oligomer
gagaaaaacguacugaaaa

SEQ ID NO: 3728 - RNA, 19 nt, artificial
  Oligomer
cagaggacaauaacaacaa

SEQ ID NO: 3729 - RNA, 19 nt, artificial
  Oligomer
uguaaaugugcacaauaaa

SEQ ID NO: 3730 - RNA, 19 nt, artificial
  Oligomer
ccacaaugugaauccuaca

SEQ ID NO: 3731 - RNA, 19 nt, artificial
  Oligomer
ggaagauccaaauccgcua

SEQ ID NO: 3732 - RNA, 19 nt, artificial
  Oligomer
acuacagauucguaaccaa

SEQ ID NO: 3733 - RNA, 19 nt, artificial
  Oligomer
gaaagcugcagcuagaaaa

SEQ ID NO: 3734 - RNA, 19 nt, artificial
  Oligomer
gccgauguggacaauggaa

SEQ ID NO: 3735 - RNA, 19 nt, artificial
  Oligomer
aacuuaaccaggaacaaaa

SEQ ID NO: 3736 - RNA, 19 nt, artificial
  Oligomer
ccaauuacuauaaauccaa

SEQ ID NO: 3737 - RNA, 19 nt, artificial
  Oligomer
caacagcagcagauugaaa

SEQ ID NO: 3738 - RNA, 19 nt, artificial
  Oligomer
ggaaaagaagcaggaagua

SEQ ID NO: 3739 - RNA, 19 nt, artificial
  Oligomer
gaguugaagcccaggagaa

SEQ ID NO: 3740 - RNA, 19 nt, artificial
  Oligomer
gcuguauccacggaucaaa

SEQ ID NO: 3741 - RNA, 19 nt, artificial
  Oligomer
gggacauacccaaguccua

SEQ ID NO: 3742 - RNA, 19 nt, artificial
  Oligomer
aggcuuuuuauauaccaaa

SEQ ID NO: 3743 - RNA, 19 nt, artificial
  Oligomer
agcggaccaacuugaagaa

SEQ ID NO: 3744 - RNA, 19 nt, artificial
  Oligomer
cgacauugaaacugcugca

SEQ ID NO: 3745 - RNA, 19 nt, artificial
  Oligomer
uggagaaaaacguacugaa

SEQ ID NO: 3746 - RNA, 19 nt, artificial
  Oligomer
cucucaguauugccucaaa

SEQ ID NO: 3747 - RNA, 19 nt, artificial
  Oligomer
caagagcaacgaacucaga

SEQ ID NO: 3748 - RNA, 19 nt, artificial
  Oligomer
cagaaaguacugagaaaga

SEQ ID NO: 3749 - RNA, 19 nt, artificial
  Oligomer
ccaggaaaagaagcaggaa

SEQ ID NO: 3750 - RNA, 19 nt, artificial
  Oligomer
ugggaauccacguguugaa

SEQ ID NO: 3751 - RNA, 19 nt, artificial
  Oligomer
aagugaacgcccuuguaga

SEQ ID NO: 3752 - RNA, 19 nt, artificial
  Oligomer
aaaugaaaagcuucagaaa

SEQ ID NO: 3753 - RNA, 19 nt, artificial
  Oligomer
gcuuagucagcaauuggaa

SEQ ID NO: 3754 - RNA, 19 nt, artificial
  Oligomer
gagcaacgaacucagagaa

SEQ ID NO: 3755 - RNA, 19 nt, artificial
  Oligomer
ugaacagauuuuaacagaa

SEQ ID NO: 3756 - RNA, 19 nt, artificial
  Oligomer
caacaaugaacagauuuua

SEQ ID NO: 3757 - RNA, 19 nt, artificial
  Oligomer
ggaaagcugcagcuagaaa

SEQ ID NO: 3758 - RNA, 19 nt, artificial
  Oligomer
caaugaacagauuuuaaca

SEQ ID NO: 3759 - RNA, 19 nt, artificial
  Oligomer
gagaaauguaauaaaugua

SEQ ID NO: 3760 - RNA, 19 nt, artificial
  Oligomer
ccuuaaauaagucaguuaa

SEQ ID NO: 3761 - RNA, 19 nt, artificial
  Oligomer
gcugaaauagaaagguuca

SEQ ID NO: 3762 - RNA, 19 nt, artificial
  Oligomer
cagaaggaacucuuaaaua

SEQ ID NO: 3763 - RNA, 19 nt, artificial
  Oligomer
guguggugaagaaaaguga

SEQ ID NO: 3764 - RNA, 19 nt, artificial
  Oligomer
cagcguucaccucugcaaa

SEQ ID NO: 3765 - RNA, 19 nt, artificial
  Oligomer
cuguuuucuugagcaacaa

SEQ ID NO: 3766 - RNA, 19 nt, artificial
  Oligomer
gagguacuuucgccuccaa

SEQ ID NO: 3767 - RNA, 19 nt, artificial
  Oligomer
aaagcuucagaaauugaaa

SEQ ID NO: 3768 - RNA, 19 nt, artificial
  Oligomer
aacaaugaacagauuuuaa

SEQ ID NO: 3769 - RNA, 19 nt, artificial
  Oligomer
cgaacaagcggaccaacuu

SEQ ID NO: 3770 - RNA, 19 nt, artificial
  Oligomer
cagacccaagagcaacgaa

SEQ ID NO: 3771 - RNA, 19 nt, artificial
  Oligomer
gacuguaccaagaacuaca

SEQ ID NO: 3772 - RNA, 19 nt, artificial
  Oligomer
agauuuaaagaaaggaaaa

SEQ ID NO: 3773 - RNA, 19 nt, artificial
  Oligomer
gagaacaagcugaagaaaa

SEQ ID NO: 3774 - RNA, 19 nt, artificial
  Oligomer
uaaccaacuuaaccaggaa

SEQ ID NO: 3775 - RNA, 19 nt, artificial
  Oligomer
gaagauuuaaagaaaggaa

SEQ ID NO: 3776 - RNA, 19 nt, artificial
  Oligomer
acgucucuaugggaaaaaa

SEQ ID NO: 3777 - RNA, 19 nt, artificial
  Oligomer
acggagggaagaagugaaa

SEQ ID NO: 3778 - RNA, 19 nt, artificial
  Oligomer
ccuggaaaggaggaaggaa

SEQ ID NO: 3779 - RNA, 19 nt, artificial
  Oligomer
ucuccaguuugcccauuaa

SEQ ID NO: 3780 - RNA, 19 nt, artificial
  Oligomer
uaaagaaaggaaaacugaa

SEQ ID NO: 3781 - RNA, 19 nt, artificial
  Oligomer
gggaagaagugaaauuuuu

SEQ ID NO: 3782 - RNA, 19 nt, artificial
  Oligomer
caagaacuacagauucgua

SEQ ID NO: 3783 - RNA, 19 nt, artificial
  Oligomer
guacguacaggcuuuuuau

SEQ ID NO: 3784 - RNA, 19 nt, artificial
  Oligomer
agcaauuggaagauuuaaa

SEQ ID NO: 3785 - RNA, 19 nt, artificial
  Oligomer
gcagaaggaacucuuaaau

SEQ ID NO: 3786 - RNA, 19 nt, artificial
  Oligomer
ccuaaaggcugauugugca

SEQ ID NO: 3787 - RNA, 19 nt, artificial
  Oligomer
gcagcagauugaaaaucag

SEQ ID NO: 3788 - RNA, 19 nt, artificial
  Oligomer
cgguggaguuaaaaagacu

SEQ ID NO: 3789 - RNA, 19 nt, artificial
  Oligomer
caaugugaauccuacaguu

SEQ ID NO: 3790 - RNA, 19 nt, artificial
  Oligomer
ugaucagcuuagucagcaa

SEQ ID NO: 3791 - RNA, 19 nt, artificial
  Oligomer
ggacaauggaaacaccaau

SEQ ID NO: 3792 - RNA, 19 nt, artificial
  Oligomer
agccggcagaggacaauaa

SEQ ID NO: 3793 - RNA, 19 nt, artificial
  Oligomer
auuggaagauuuaaagaaa

SEQ ID NO: 3794 - RNA, 19 nt, artificial
  Oligomer
gcugggugugaugaacaaa

SEQ ID NO: 3795 - RNA, 19 nt, artificial
  Oligomer
ccuauaacaccggaaacaa

SEQ ID NO: 3796 - RNA, 19 nt, artificial
  Oligomer
gaaagagccugagcaggau

SEQ ID NO: 3797 - RNA, 19 nt, artificial
  Oligomer
ucugucugcugaaauagaa

SEQ ID NO: 3798 - RNA, 19 nt, artificial
  Oligomer
agaaaaacguacugaaaau

SEQ ID NO: 3799 - RNA, 19 nt, artificial
  Oligomer
caccaaaggagccucugua

SEQ ID NO: 3800 - RNA, 19 nt, artificial
  Oligomer
acaagcggaccaacuugaa

SEQ ID NO: 3801 - RNA, 19 nt, artificial
  Oligomer
cagugaagacagaagcucu

SEQ ID NO: 3802 - RNA, 19 nt, artificial
  Oligomer
cucuauuuuucauguauga

SEQ ID NO: 3803 - RNA, 19 nt, artificial
  Oligomer
ggacaagucgacuacagca

SEQ ID NO: 3804 - RNA, 19 nt, artificial
  Oligomer
gaucaucuaugagguggaa

SEQ ID NO: 3805 - RNA, 19 nt, artificial
  Oligomer
gcucauggaagauccaaau

SEQ ID NO: 3806 - RNA, 19 nt, artificial
  Oligomer
uguagaauuuugcaaggaa

SEQ ID NO: 3807 - RNA, 19 nt, artificial
  Oligomer
acagcguccacaaugugaa

SEQ ID NO: 3808 - RNA, 19 nt, artificial
  Oligomer
cucucagagcuccaagaua

SEQ ID NO: 3809 - RNA, 19 nt, artificial
  Oligomer
cgugaacgucucuauggga

SEQ ID NO: 3810 - RNA, 19 nt, artificial
  Oligomer
auggguuccagucuuacaa

SEQ ID NO: 3811 - RNA, 19 nt, artificial
  Oligomer
ucgacaagcucccuggaaa

SEQ ID NO: 3812 - RNA, 19 nt, artificial
  Oligomer
cagacucacugaugcagca

SEQ ID NO: 3813 - RNA, 19 nt, artificial
  Oligomer
cccagacagugaauucaag

SEQ ID NO: 3814 - RNA, 19 nt, artificial
  Oligomer
cagugcucccaguuucuau

SEQ ID NO: 3815 - RNA, 19 nt, artificial
  Oligomer
cccaacugagaacagugaa

SEQ ID NO: 3816 - RNA, 19 nt, artificial
  Oligomer
gauggacaagcgaaucagu

SEQ ID NO: 3817 - RNA, 19 nt, artificial
  Oligomer
aacagaaguuccuauaaca

SEQ ID NO: 3818 - RNA, 19 nt, artificial
  Oligomer
ugcagaggaucaucuauga

SEQ ID NO: 3819 - RNA, 19 nt, artificial
  Oligomer
cagcagucuauuucugaaa

SEQ ID NO: 3820 - RNA, 19 nt, artificial
  Oligomer
aaaagugaacgcccuugua

SEQ ID NO: 3821 - RNA, 19 nt, artificial
  Oligomer
ggugugaauuguacguaca

SEQ ID NO: 3822 - RNA, 19 nt, artificial
  Oligomer
uacauaguguggugaagaa

SEQ ID NO: 3823 - RNA, 19 nt, artificial
  Oligomer
gaacgucucuaugggaaaa

SEQ ID NO: 3824 - RNA, 19 nt, artificial
  Oligomer
cauuuuugccucaaccaua

SEQ ID NO: 3825 - RNA, 19 nt, artificial
  Oligomer
ugcucauggaagauccaaa

SEQ ID NO: 3826 - RNA, 19 nt, artificial
  Oligomer
ccgauguggacaauggaaa

SEQ ID NO: 3827 - RNA, 19 nt, artificial
  Oligomer
gcaggaaguacagacugca

SEQ ID NO: 3828 - RNA, 19 nt, artificial
  Oligomer
agcuaugggacauacccaa

SEQ ID NO: 3829 - RNA, 19 nt, artificial
  Oligomer
aggaaagcugcagcuagaa

SEQ ID NO: 3830 - RNA, 19 nt, artificial
  Oligomer
ggaacaaaauucaaaacuu

SEQ ID NO: 3831 - RNA, 19 nt, artificial
  Oligomer
ucgugaaguuccugcugga

SEQ ID NO: 3832 - RNA, 19 nt, artificial
  Oligomer
ggacacucauccuuucuca

SEQ ID NO: 3833 - RNA, 19 nt, artificial
  Oligomer
cgaacacucgccugaacuu

SEQ ID NO: 3834 - RNA, 19 nt, artificial
  Oligomer
cagacagcguccacaaugu

SEQ ID NO: 3835 - RNA, 19 nt, artificial
  Oligomer
gucucuaugggaaaaaaau

SEQ ID NO: 3836 - RNA, 19 nt, artificial
  Oligomer
ggaaguacagacugcaauu

SEQ ID NO: 3837 - RNA, 19 nt, artificial
  Oligomer
aaaagaagcaggaaguaca

SEQ ID NO: 3838 - RNA, 19 nt, artificial
  Oligomer
guaccuggagaaaaacgua

SEQ ID NO: 3839 - RNA, 19 nt, artificial
  Oligomer
aauaaauacccacuuucaa

SEQ ID NO: 3840 - RNA, 19 nt, artificial
  Oligomer
aguuaaaaagacuguacca

SEQ ID NO: 3841 - RNA, 19 nt, artificial
  Oligomer
accauaagcgacauugaaa

SEQ ID NO: 3842 - RNA, 19 nt, artificial
  Oligomer
cuguuccaguucaccuaaa

SEQ ID NO: 3843 - RNA, 19 nt, artificial
  Oligomer
guaugguaagcccguuuua

SEQ ID NO: 3844 - RNA, 19 nt, artificial
  Oligomer
acuuaaccaggaacaaaau

SEQ ID NO: 3845 - RNA, 19 nt, artificial
  Oligomer
ggaacagcguuuacauuuu

SEQ ID NO: 3846 - RNA, 19 nt, artificial
  Oligomer
aagacuguaccaagaacua

SEQ ID NO: 3847 - RNA, 19 nt, artificial
  Oligomer
gagggcuaugugcccaaaa

SEQ ID NO: 3848 - RNA, 19 nt, artificial
  Oligomer
auuuuugccucaaccauaa

SEQ ID NO: 3849 - RNA, 19 nt, artificial
  Oligomer
cccuaagaccaagugacaa

SEQ ID NO: 3850 - RNA, 19 nt, artificial
  Oligomer
ggaucaucuaugaggugga

SEQ ID NO: 3851 - RNA, 19 nt, artificial
  Oligomer
gcugcucauggaagaucca

SEQ ID NO: 3852 - RNA, 19 nt, artificial
  Oligomer
ggcccuuaggcucuauuuu

SEQ ID NO: 3853 - RNA, 19 nt, artificial
  Oligomer
uaaccaggaacaaaauuca

SEQ ID NO: 3854 - RNA, 19 nt, artificial
  Oligomer
uggacaauggaaacaccaa

SEQ ID NO: 3855 - RNA, 19 nt, artificial
  Oligomer
gaaggaacucuuaaauaag

SEQ ID NO: 3856 - RNA, 19 nt, artificial
  Oligomer
ugcugcugauagugaugga

SEQ ID NO: 3857 - RNA, 19 nt, artificial
  Oligomer
agauucguaaccaacuuaa

SEQ ID NO: 3858 - RNA, 19 nt, artificial
  Oligomer
gggugugaugaacaaaggu

SEQ ID NO: 3859 - RNA, 19 nt, artificial
  Oligomer
auccaaauccgcuaaugau

SEQ ID NO: 3860 - RNA, 19 nt, artificial
  Oligomer
ggagggaagaagugaaauu

SEQ ID NO: 3861 - RNA, 19 nt, artificial
  Oligomer
gaagauccaaauccgcuaa

SEQ ID NO: 3862 - RNA, 19 nt, artificial
  Oligomer
acuacagcaaaaucaugaa

SEQ ID NO: 3863 - RNA, 19 nt, artificial
  Oligomer
cggcgguggaguuaaaaag

SEQ ID NO: 3864 - RNA, 19 nt, artificial
  Oligomer
ccauuaacugggagaggua

SEQ ID NO: 3865 - RNA, 19 nt, artificial
  Oligomer
auugaaagaacgaguugaa

SEQ ID NO: 3866 - RNA, 19 nt, artificial
  Oligomer
gacagaagcucuuacugac

SEQ ID NO: 3867 - RNA, 19 nt, artificial
  Oligomer
ggcaacagcagcagauuga

SEQ ID NO: 3868 - RNA, 19 nt, artificial
  Oligomer
caaaacuucagcagcagaa

SEQ ID NO: 3869 - RNA, 19 nt, artificial
  Oligomer
ucagcaauuggaagauuua

SEQ ID NO: 3870 - RNA, 19 nt, artificial
  Oligomer
cgauguggacaauggaaac

SEQ ID NO: 3871 - RNA, 19 nt, artificial
  Oligomer
caggcuccucacaacagau

SEQ ID NO: 3872 - RNA, 19 nt, artificial
  Oligomer
acauuaaaacagaauucua

SEQ ID NO: 3873 - RNA, 19 nt, artificial
  Oligomer
acccgaacuauguuggaaa

SEQ ID NO: 3874 - RNA, 19 nt, artificial
  Oligomer
cggagggaagaagugaaau

SEQ ID NO: 3875 - RNA, 19 nt, artificial
  Oligomer
ucagcugaaccgugugaau

SEQ ID NO: 3876 - RNA, 19 nt, artificial
  Oligomer
accaggaacaaaauucaaa

SEQ ID NO: 3877 - RNA, 19 nt, artificial
  Oligomer
ccauucaaagcuacccgaa

SEQ ID NO: 3878 - RNA, 19 nt, artificial
  Oligomer
gccucaaccauaagcgaca

SEQ ID NO: 3879 - RNA, 19 nt, artificial
  Oligomer
uagcagacagcguccacaa

SEQ ID NO: 3880 - RNA, 19 nt, artificial
  Oligomer
guuuuaccuucggguucaa

SEQ ID NO: 3881 - RNA, 19 nt, artificial
  Oligomer
cagugaacugcgugaacgu

SEQ ID NO: 3882 - RNA, 19 nt, artificial
  Oligomer
acaagucgacuacagcaaa

SEQ ID NO: 3883 - RNA, 19 nt, artificial
  Oligomer
gacccaagagcaacgaacu

SEQ ID NO: 3884 - RNA, 19 nt, artificial
  Oligomer
gcgaugaugccgaugauau

SEQ ID NO: 3885 - RNA, 19 nt, artificial
  Oligomer
uaccaaaaguauuuuuuga

SEQ ID NO: 3886 - RNA, 19 nt, artificial
  Oligomer
agacagaagcucuuacuga

SEQ ID NO: 3887 - RNA, 19 nt, artificial
  Oligomer
ggugcagaggaucaucuau

SEQ ID NO: 3888 - RNA, 19 nt, artificial
  Oligomer
aggagauggaggaaggcua

SEQ ID NO: 3889 - RNA, 19 nt, artificial
  Oligomer
caaugagaggacaagucga

SEQ ID NO: 3890 - RNA, 19 nt, artificial
  Oligomer
agagaaauguaauaaaugu

SEQ ID NO: 3891 - RNA, 19 nt, artificial
  Oligomer
cgagauguuguagaauuuu

SEQ ID NO: 3892 - RNA, 19 nt, artificial
  Oligomer
aacucagagaaauguaaua

SEQ ID NO: 3893 - RNA, 19 nt, artificial
  Oligomer
agcguuuacauuuucuaaa

SEQ ID NO: 3894 - RNA, 19 nt, artificial
  Oligomer
ucagagaaauguaauaaau

SEQ ID NO: 3895 - RNA, 19 nt, artificial
  Oligomer
uggugcagaggaucaucua

SEQ ID NO: 3896 - RNA, 19 nt, artificial
  Oligomer
agagcaacgaacucagaga

SEQ ID NO: 3897 - RNA, 19 nt, artificial
  Oligomer
aggagccucuguauggaaa

SEQ ID NO: 3898 - RNA, 19 nt, artificial
  Oligomer
ccgucagcagcagucuauu

SEQ ID NO: 3899 - RNA, 19 nt, artificial
  Oligomer
caaguuccauauacuccau

SEQ ID NO: 3900 - RNA, 19 nt, artificial
  Oligomer
acuagaccauucaaagcua

SEQ ID NO: 3901 - RNA, 19 nt, artificial
  Oligomer
gauguuguagaauuuugca

SEQ ID NO: 3902 - RNA, 19 nt, artificial
  Oligomer
cacuguagcccaucaccuu

SEQ ID NO: 3903 - RNA, 19 nt, artificial
  Oligomer
gaugaugccgaugauauua

SEQ ID NO: 3904 - RNA, 19 nt, artificial
  Oligomer
gcaacgaacucagagaaau

SEQ ID NO: 3905 - RNA, 19 nt, artificial
  Oligomer
ugcgcugccucuuguaaca

SEQ ID NO: 3906 - RNA, 19 nt, artificial
  Oligomer
ccacaccaccuaagaauua

SEQ ID NO: 3907 - RNA, 19 nt, artificial
  Oligomer
ggcucuauuuuucauguau

SEQ ID NO: 3908 - RNA, 19 nt, artificial
  Oligomer
ugagcaacaaugaacagau

SEQ ID NO: 3909 - RNA, 19 nt, artificial
  Oligomer
aauggguuccagucuuaca

SEQ ID NO: 3910 - RNA, 19 nt, artificial
  Oligomer
gcucuuccgugaaaccagu

SEQ ID NO: 3911 - RNA, 19 nt, artificial
  Oligomer
aacucuuaaauaagcgcaa

SEQ ID NO: 3912 - RNA, 19 nt, artificial
  Oligomer
gcagucuauuucugaaaau

SEQ ID NO: 3913 - RNA, 19 nt, artificial
  Oligomer
ugugcuguuuuccaggaaa

SEQ ID NO: 3914 - RNA, 19 nt, artificial
  Oligomer
aaaagcuucagaaauugaa

SEQ ID NO: 3915 - RNA, 19 nt, artificial
  Oligomer
caauuuuaaggguugauca

SEQ ID NO: 3916 - RNA, 19 nt, artificial
  Oligomer
gcugcagcuagaaaauggu

SEQ ID NO: 3917 - RNA, 19 nt, artificial
  Oligomer
cgcuaaugauggaaacugg

SEQ ID NO: 3918 - RNA, 19 nt, artificial
  Oligomer
agugaagacagaagcucuu

SEQ ID NO: 3919 - RNA, 19 nt, artificial
  Oligomer
agugcucccaguuucuaua

SEQ ID NO: 3920 - RNA, 19 nt, artificial
  Oligomer
uucagaaaguacugagaaa

SEQ ID NO: 3921 - RNA, 19 nt, artificial
  Oligomer
gcuggauuuuggugucaac

SEQ ID NO: 3922 - RNA, 19 nt, artificial
  Oligomer
uuuugacuagaccauucaa

SEQ ID NO: 3923 - RNA, 19 nt, artificial
  Oligomer
agcagucuauuucugaaaa

SEQ ID NO: 3924 - RNA, 19 nt, artificial
  Oligomer
ucgagauguuguagaauuu

SEQ ID NO: 3925 - RNA, 19 nt, artificial
  Oligomer
ucgugcaaugagaggacaa

SEQ ID NO: 3926 - RNA, 19 nt, artificial
  Oligomer
ccuuaggcucuauuuuuca

SEQ ID NO: 3927 - RNA, 19 nt, artificial
  Oligomer
ccuguuccaguucaccuaa

SEQ ID NO: 3928 - RNA, 19 nt, artificial
  Oligomer
gaggaaggcuacauccagu

SEQ ID NO: 3929 - RNA, 19 nt, artificial
  Oligomer
acagcagcagauugaaaau

SEQ ID NO: 3930 - RNA, 19 nt, artificial
  Oligomer
cuacccgaacuauguugga

SEQ ID NO: 3931 - RNA, 19 nt, artificial
  Oligomer
ccuucagaaaguacugaga

SEQ ID NO: 3932 - RNA, 19 nt, artificial
  Oligomer
cagugaauucaaguuccau

SEQ ID NO: 3933 - RNA, 19 nt, artificial
  Oligomer
ucgacuacagcaaaaucau

SEQ ID NO: 3934 - RNA, 19 nt, artificial
  Oligomer
agcaacgaacucagagaaa

SEQ ID NO: 3935 - RNA, 19 nt, artificial
  Oligomer
ggcaaucugucugcugaaa

SEQ ID NO: 3936 - RNA, 19 nt, artificial
  Oligomer
ccauuuuugccucaaccau

SEQ ID NO: 3937 - RNA, 19 nt, artificial
  Oligomer
aagauuuaaagaaaggaaa

SEQ ID NO: 3938 - RNA, 19 nt, artificial
  Oligomer
gaagaaaagugaacgcccu

SEQ ID NO: 3939 - RNA, 19 nt, artificial
  Oligomer
cugaaaaagcgcagcucca

SEQ ID NO: 3940 - RNA, 19 nt, artificial
  Oligomer
gaacucagagaaauguaau

SEQ ID NO: 3941 - RNA, 19 nt, artificial
  Oligomer
ugaagaagcccaacucgga

SEQ ID NO: 3942 - RNA, 19 nt, artificial
  Oligomer
ugagaacagugaacaaggu

SEQ ID NO: 3943 - RNA, 19 nt, artificial
  Oligomer
gcccuuaggcucuauuuuu

SEQ ID NO: 3944 - RNA, 19 nt, artificial
  Oligomer
ugaucauaugauguacgaa

SEQ ID NO: 3945 - RNA, 19 nt, artificial
  Oligomer
uggacaagcgaaucaguga

SEQ ID NO: 3946 - RNA, 19 nt, artificial
  Oligomer
aacagcagcagauugaaaa

SEQ ID NO: 3947 - RNA, 19 nt, artificial
  Oligomer
gggaaaaaaauucagcuga

SEQ ID NO: 3948 - RNA, 19 nt, artificial
  Oligomer
ggcagaggacaauaacaac

SEQ ID NO: 3949 - RNA, 19 nt, artificial
  Oligomer
gaaucagugaacugcguga

SEQ ID NO: 3950 - RNA, 19 nt, artificial
  Oligomer
cucaaaugcugcucaugga

SEQ ID NO: 3951 - RNA, 19 nt, artificial
  Oligomer
acagugaauucaaguucca

SEQ ID NO: 3952 - RNA, 19 nt, artificial
  Oligomer
aaagcugcagcuagaaaau

SEQ ID NO: 3953 - RNA, 19 nt, artificial
  Oligomer
caauuggaagauuuaaaga

SEQ ID NO: 3954 - RNA, 19 nt, artificial
  Oligomer
cguccacaaugugaauccu

SEQ ID NO: 3955 - RNA, 19 nt, artificial
  Oligomer
cuccauguaccuccagcaa

SEQ ID NO: 3956 - RNA, 19 nt, artificial
  Oligomer
caggagaacaagcugaaga

SEQ ID NO: 3957 - RNA, 19 nt, artificial
  Oligomer
uggguuccagucuuacaau

SEQ ID NO: 3958 - RNA, 19 nt, artificial
  Oligomer
caguucaccuaaaggcuga

SEQ ID NO: 3959 - RNA, 19 nt, artificial
  Oligomer
aagcgacauugaaacugcu

SEQ ID NO: 3960 - RNA, 19 nt, artificial
  Oligomer
ccagacagugaauucaagu

SEQ ID NO: 3961 - RNA, 19 nt, artificial
  Oligomer
cuauuucugaaaaugaaaa

SEQ ID NO: 3962 - RNA, 19 nt, artificial
  Oligomer
gaagaaaauucgugcaaug

SEQ ID NO: 3963 - RNA, 19 nt, artificial
  Oligomer
guuccauauacuccaugua

SEQ ID NO: 3964 - RNA, 19 nt, artificial
  Oligomer
gcuucagaaauugaaagaa

SEQ ID NO: 3965 - RNA, 19 nt, artificial
  Oligomer
acaggcuuuuuauauacca

SEQ ID NO: 3966 - RNA, 19 nt, artificial
  Oligomer
acauaguguggugaagaaa

SEQ ID NO: 3967 - RNA, 19 nt, artificial
  Oligomer
agcagacagcguccacaau

SEQ ID NO: 3968 - RNA, 19 nt, artificial
  Oligomer
uaaaaagacuguaccaaga

SEQ ID NO: 3969 - RNA, 19 nt, artificial
  Oligomer
acuucagcagcagaaggaa

SEQ ID NO: 3970 - RNA, 19 nt, artificial
  Oligomer
agcggcgguggaguuaaaa

SEQ ID NO: 3971 - RNA, 19 nt, artificial
  Oligomer
gccuuaaauaagucaguua

SEQ ID NO: 3972 - RNA, 19 nt, artificial
  Oligomer
caagcugaagaaaauucgu

SEQ ID NO: 3973 - RNA, 19 nt, artificial
  Oligomer
aaggagccucuguauggaa

SEQ ID NO: 3974 - RNA, 19 nt, artificial
  Oligomer
uuucuugagcaacaaugaa

SEQ ID NO: 3975 - RNA, 19 nt, artificial
  Oligomer
ggaagauuuaaagaaagga

SEQ ID NO: 3976 - RNA, 19 nt, artificial
  Oligomer
ggagcacugacuguacaua

SEQ ID NO: 3977 - RNA, 19 nt, artificial
  Oligomer
cggaaacaaccugucgaga

SEQ ID NO: 3978 - RNA, 19 nt, artificial
  Oligomer
aaaaagacuguaccaagaa

SEQ ID NO: 3979 - RNA, 19 nt, artificial
  Oligomer
uguaauaaauguaccugga

SEQ ID NO: 3980 - RNA, 19 nt, artificial
  Oligomer
cuguacauaguguggugaa

SEQ ID NO: 3981 - RNA, 19 nt, artificial
  Oligomer
aaaagcugggugugaugaa

SEQ ID NO: 3982 - RNA, 19 nt, artificial
  Oligomer
cagauucguaaccaacuua

SEQ ID NO: 3983 - RNA, 19 nt, artificial
  Oligomer
gacagcguccacaauguga

SEQ ID NO: 3984 - RNA, 19 nt, artificial
  Oligomer
ccagugcucccaguuucua

SEQ ID NO: 3985 - RNA, 19 nt, artificial
  Oligomer
caucgagauugguaaagug

SEQ ID NO: 3986 - RNA, 19 nt, artificial
  Oligomer
cauuuagcugaagugugga

SEQ ID NO: 3987 - RNA, 19 nt, artificial
  Oligomer
gugaagacagaagcucuua

SEQ ID NO: 3988 - RNA, 19 nt, artificial
  Oligomer
guuaaagcaguguauggua

SEQ ID NO: 3989 - RNA, 19 nt, artificial
  Oligomer
ccacuuaagagauuauugu

SEQ ID NO: 3990 - RNA, 19 nt, artificial
  Oligomer
acgaacucagagaaaugua

SEQ ID NO: 3991 - RNA, 19 nt, artificial
  Oligomer
agaggacaauaacaacaac

SEQ ID NO: 3992 - RNA, 19 nt, artificial
  Oligomer
gcgccuuaaauaagucagu

SEQ ID NO: 3993 - RNA, 19 nt, artificial
  Oligomer
agcuuagucagcaauugga

SEQ ID NO: 3994 - RNA, 19 nt, artificial
  Oligomer
gaagacagaagcucuuacu

SEQ ID NO: 3995 - RNA, 19 nt, artificial
  Oligomer
gcagaggacaauaacaaca

SEQ ID NO: 3996 - RNA, 19 nt, artificial
  Oligomer
ucuauuucugaaaaugaaa

SEQ ID NO: 3997 - RNA, 19 nt, artificial
  Oligomer
caacgaacucagagaaaug

SEQ ID NO: 3998 - RNA, 19 nt, artificial
  Oligomer
ugccgaugauauuaacugu

SEQ ID NO: 3999 - RNA, 19 nt, artificial
  Oligomer
cauggaagauccaaauccg

SEQ ID NO: 4000 - RNA, 19 nt, artificial
  Oligomer
ugaugccgaugauauuaac

SEQ ID NO: 4001 - RNA, 19 nt, artificial
  Oligomer
cccugcaagcucaaauuca

SEQ ID NO: 4002 - RNA, 19 nt, artificial
  Oligomer
ccaagugacaacugggaga

SEQ ID NO: 4003 - RNA, 19 nt, artificial
  Oligomer
gucaguuaaagcaguguau

SEQ ID NO: 4004 - RNA, 19 nt, artificial
  Oligomer
cuaccagagugaugcagac

SEQ ID NO: 4005 - RNA, 19 nt, artificial
  Oligomer
aaagcuacccgaacuaugu

SEQ ID NO: 4006 - RNA, 19 nt, artificial
  Oligomer
caaauccgcuaaugaugga

SEQ ID NO: 4007 - RNA, 19 nt, artificial
  Oligomer
ucucagagcuccaagauau

SEQ ID NO: 4008 - RNA, 19 nt, artificial
  Oligomer
ugaacgucucuaugggaaa

SEQ ID NO: 4009 - RNA, 19 nt, artificial
  Oligomer
auaaauacccacuuucaaa

SEQ ID NO: 4010 - RNA, 19 nt, artificial
  Oligomer
ccaagagcaacgaacucag

SEQ ID NO: 4011 - RNA, 19 nt, artificial
  Oligomer
cgcuucacugaggugugaa

SEQ ID NO: 4012 - RNA, 19 nt, artificial
  Oligomer
ccaaggaacagcguuuaca

SEQ ID NO: 4013 - RNA, 19 nt, artificial
  Oligomer
ccugcaagcucaaauucag

SEQ ID NO: 4014 - RNA, 19 nt, artificial
  Oligomer
uuuucuugagcaacaauga

SEQ ID NO: 4015 - RNA, 19 nt, artificial
  Oligomer
ccuuugaucauaugaugua

SEQ ID NO: 4016 - RNA, 19 nt, artificial
  Oligomer
ugcuguaccagcgcuucaa

SEQ ID NO: 4017 - RNA, 19 nt, artificial
  Oligomer
ggacaauaacaacaacgug

SEQ ID NO: 4018 - RNA, 19 nt, artificial
  Oligomer
gaaaaugaaaagcuucaga

SEQ ID NO: 4019 - RNA, 19 nt, artificial
  Oligomer
caacagauucagcagagga

SEQ ID NO: 4020 - RNA, 19 nt, artificial
  Oligomer
gacaagucgacuacagcaa

SEQ ID NO: 4021 - RNA, 19 nt, artificial
  Oligomer
cacagcgccuuaaauaagu

SEQ ID NO: 4022 - RNA, 19 nt, artificial
  Oligomer
gaccaagugacaacuggga

SEQ ID NO: 4023 - RNA, 19 nt, artificial
  Oligomer
gcugaagaaaauucgugca

SEQ ID NO: 4024 - RNA, 19 nt, artificial
  Oligomer
guuccuauaacaccggaaa

SEQ ID NO: 4025 - RNA, 19 nt, artificial
  Oligomer
gggcuaugugcccaaaaac

SEQ ID NO: 4026 - RNA, 19 nt, artificial
  Oligomer
agggaagaagugaaauuuu

SEQ ID NO: 4027 - RNA, 19 nt, artificial
  Oligomer
acagcguuuacauuuucua

SEQ ID NO: 4028 - RNA, 19 nt, artificial
  Oligomer
ggguugaucagcuuaguca

SEQ ID NO: 4029 - RNA, 19 nt, artificial
  Oligomer
aaaggagccucuguaugga

SEQ ID NO: 4030 - RNA, 19 nt, artificial
  Oligomer
aaauaaauacccacuuuca

SEQ ID NO: 4031 - RNA, 19 nt, artificial
  Oligomer
gguugaucagcuuagucag

SEQ ID NO: 4032 - RNA, 19 nt, artificial
  Oligomer
ccauacccuuugaucauau

SEQ ID NO: 4033 - RNA, 19 nt, artificial
  Oligomer
agaggaucaucuaugaggu

SEQ ID NO: 4034 - RNA, 19 nt, artificial
  Oligomer
gauucguaaccaacuuaac

SEQ ID NO: 4035 - RNA, 19 nt, artificial
  Oligomer
agucuauuucugaaaauga

SEQ ID NO: 4036 - RNA, 19 nt, artificial
  Oligomer
guaccaagaacuacagauu

SEQ ID NO: 4037 - RNA, 19 nt, artificial
  Oligomer
caaaaguauuuuuugacua

SEQ ID NO: 4038 - RNA, 19 nt, artificial
  Oligomer
cgucagcagcagucuauuu

SEQ ID NO: 4039 - RNA, 19 nt, artificial
  Oligomer
cucuggaaggagaguucga

SEQ ID NO: 4040 - RNA, 19 nt, artificial
  Oligomer
aauuggaagauuuaaagaa

SEQ ID NO: 4041 - RNA, 19 nt, artificial
  Oligomer
guuaaaaagacuguaccaa

SEQ ID NO: 4042 - RNA, 19 nt, artificial
  Oligomer
cugcugaaauagaaagguu

SEQ ID NO: 4043 - RNA, 19 nt, artificial
  Oligomer
aaccugucgagauguugua

SEQ ID NO: 4044 - RNA, 19 nt, artificial
  Oligomer
guauuuuuugacuagacca

SEQ ID NO: 4045 - RNA, 19 nt, artificial
  Oligomer
cuucagaaaguacugagaa

SEQ ID NO: 4046 - RNA, 19 nt, artificial
  Oligomer
aaaugcugcucauggaaga

SEQ ID NO: 4047 - RNA, 19 nt, artificial
  Oligomer
gcuucacugaggugugaau

SEQ ID NO: 4048 - RNA, 19 nt, artificial
  Oligomer
auuuuggugucaacgugaa

SEQ ID NO: 4049 - RNA, 19 nt, artificial
  Oligomer
uggaguuaaaaagacugua

SEQ ID NO: 4050 - RNA, 19 nt, artificial
  Oligomer
gcuaccagagugaugcaga

SEQ ID NO: 4051 - RNA, 19 nt, artificial
  Oligomer
gaaaagcuucagaaauuga

SEQ ID NO: 4052 - RNA, 19 nt, artificial
  Oligomer
guaaccaacuuaaccagga

SEQ ID NO: 4053 - RNA, 19 nt, artificial
  Oligomer
cugagaaagagccugagca

SEQ ID NO: 4054 - RNA, 19 nt, artificial
  Oligomer
cuguaccaagaacuacaga

SEQ ID NO: 4055 - RNA, 19 nt, artificial
  Oligomer
agaaaauggucuuaauggu

SEQ ID NO: 4056 - RNA, 19 nt, artificial
  Oligomer
cucuuaaauaagcgcaaca

SEQ ID NO: 4057 - RNA, 19 nt, artificial
  Oligomer
uccagaagcugcuguacca

SEQ ID NO: 4058 - RNA, 19 nt, artificial
  Oligomer
ugaauggguuccagucuua

SEQ ID NO: 4059 - RNA, 19 nt, artificial
  Oligomer
cuuuuuauauaccaaaagu

SEQ ID NO: 4060 - RNA, 19 nt, artificial
  Oligomer
ccaggagaacaagcugaag

SEQ ID NO: 4061 - RNA, 19 nt, artificial
  Oligomer
uggaggaaggcuacaucca

SEQ ID NO: 4062 - RNA, 19 nt, artificial
  Oligomer
aagccugaacucccacuga

SEQ ID NO: 4063 - RNA, 19 nt, artificial
  Oligomer
gaacaagcugaagaaaauu

SEQ ID NO: 4064 - RNA, 19 nt, artificial
  Oligomer
guacuuucgccuccaagga

SEQ ID NO: 4065 - RNA, 19 nt, artificial
  Oligomer
aaggguugaucagcuuagu

SEQ ID NO: 4066 - RNA, 19 nt, artificial
  Oligomer
ccaauggaaaccuggaaga

SEQ ID NO: 4067 - RNA, 19 nt, artificial
  Oligomer
aaauaagucaguuaaagca

SEQ ID NO: 4068 - RNA, 19 nt, artificial
  Oligomer
agcagcagauugaaaauca

SEQ ID NO: 4069 - RNA, 19 nt, artificial
  Oligomer
gaagcaggaaguacagacu

SEQ ID NO: 4070 - RNA, 19 nt, artificial
  Oligomer
cugaaaaugaaaagcuuca

SEQ ID NO: 4071 - RNA, 19 nt, artificial
  Oligomer
ggaccaacuugaagaagcc

SEQ ID NO: 4072 - RNA, 19 nt, artificial
  Oligomer
aagaacuacagauucguaa

SEQ ID NO: 4073 - RNA, 19 nt, artificial
  Oligomer
cugcaauuuuaaggguuga

SEQ ID NO: 4074 - RNA, 19 nt, artificial
  Oligomer
ccgaugauauuaacuguuu

SEQ ID NO: 4075 - RNA, 19 nt, artificial
  Oligomer
aauggagucaggugcugga

SEQ ID NO: 4076 - RNA, 19 nt, artificial
  Oligomer
aauaaauguaccuggagaa

SEQ ID NO: 4077 - RNA, 19 nt, artificial
  Oligomer
cgccuuaaauaagucaguu

SEQ ID NO: 4078 - RNA, 19 nt, artificial
  Oligomer
cuguauggaaacaugucca

SEQ ID NO: 4079 - RNA, 19 nt, artificial
  Oligomer
ucagcagaggauuuccgua

SEQ ID NO: 4080 - RNA, 19 nt, artificial
  Oligomer
aaaaugaaaagcuucagaa

SEQ ID NO: 4081 - RNA, 19 nt, artificial
  Oligomer
gcacaauaaacccgucuca

SEQ ID NO: 4082 - RNA, 19 nt, artificial
  Oligomer
gagaguucgaucuggugca

SEQ ID NO: 4083 - RNA, 19 nt, artificial
  Oligomer
ccucaaccauaagcgacau

SEQ ID NO: 4084 - RNA, 19 nt, artificial
  Oligomer
agguggaagaucccagcaa

SEQ ID NO: 4085 - RNA, 19 nt, artificial
  Oligomer
agaaagagccugagcagga

SEQ ID NO: 4086 - RNA, 19 nt, artificial
  Oligomer
aagcggaccaacuugaaga

SEQ ID NO: 4087 - RNA, 19 nt, artificial
  Oligomer
gugugaugaacaaaggugu

SEQ ID NO: 4088 - RNA, 19 nt, artificial
  Oligomer
uaacuguuuucuugagcaa

SEQ ID NO: 4089 - RNA, 19 nt, artificial
  Oligomer
agcacugacuguacauagu

SEQ ID NO: 4090 - RNA, 19 nt, artificial
  Oligomer
uguacguacaggcuuuuua

SEQ ID NO: 4091 - RNA, 19 nt, artificial
  Oligomer
gugugaggagauggaggaa

SEQ ID NO: 4092 - RNA, 19 nt, artificial
  Oligomer
ucuugagcaacaaugaaca

SEQ ID NO: 4093 - RNA, 19 nt, artificial
  Oligomer
gauuuuggugucaacguga

SEQ ID NO: 4094 - RNA, 19 nt, artificial
  Oligomer
cagacagugaauucaaguu

SEQ ID NO: 4095 - RNA, 19 nt, artificial
  Oligomer
aaagaagcaggaaguacag

SEQ ID NO: 4096 - RNA, 19 nt, artificial
  Oligomer
uugccucaaccauaagcga

SEQ ID NO: 4097 - RNA, 19 nt, artificial
  Oligomer
cguuuuaccuucggguuca

SEQ ID NO: 4098 - RNA, 19 nt, artificial
  Oligomer
ugaagaaaauucgugcaau

SEQ ID NO: 4099 - RNA, 19 nt, artificial
  Oligomer
cgcuuccuguuccaguuca

SEQ ID NO: 4100 - RNA, 19 nt, artificial
  Oligomer
acuguuuucuugagcaaca

SEQ ID NO: 4101 - RNA, 19 nt, artificial
  Oligomer
gcaacaaugaacagauuuu

SEQ ID NO: 4102 - RNA, 19 nt, artificial
  Oligomer
aggcccuuaggcucuauuu

SEQ ID NO: 4103 - RNA, 19 nt, artificial
  Oligomer
gcgaaucagugaacugcgu

SEQ ID NO: 4104 - RNA, 19 nt, artificial
  Oligomer
cauugaaacugcugcagac

SEQ ID NO: 4105 - RNA, 19 nt, artificial
  Oligomer
aggcucuauuuuucaugua

SEQ ID NO: 4106 - RNA, 19 nt, artificial
  Oligomer
ccaccaucacaucgugaag

SEQ ID NO: 4107 - RNA, 19 nt, artificial
  Oligomer
uugcaaggaaccuggagaa

SEQ ID NO: 4108 - RNA, 19 nt, artificial
  Oligomer
cuguuuggugccugaagga

SEQ ID NO: 4109 - RNA, 19 nt, artificial
  Oligomer
cgugcaaugagaggacaag

SEQ ID NO: 4110 - RNA, 19 nt, artificial
  Oligomer
cuguaccagcgcuucaaca

SEQ ID NO: 4111 - RNA, 19 nt, artificial
  Oligomer
cagagaaauguaauaaaug

SEQ ID NO: 4112 - RNA, 19 nt, artificial
  Oligomer
caaugauaaugaguuaccu

SEQ ID NO: 4113 - RNA, 19 nt, artificial
  Oligomer
gcuccucacaacagauuca

SEQ ID NO: 4114 - RNA, 19 nt, artificial
  Oligomer
uuuacauuuucuaaagcaa

SEQ ID NO: 4115 - RNA, 19 nt, artificial
  Oligomer
cuaggcaacagcagcagau

SEQ ID NO: 4116 - RNA, 19 nt, artificial
  Oligomer
cgacuacagcaaaaucaug

SEQ ID NO: 4117 - RNA, 19 nt, artificial
  Oligomer
aaggaaaacugaauggguu

SEQ ID NO: 4118 - RNA, 19 nt, artificial
  Oligomer
gcugauagugauggaugga

SEQ ID NO: 4119 - RNA, 19 nt, artificial
  Oligomer
cuuaauggugcucacuuua

SEQ ID NO: 4120 - RNA, 19 nt, artificial
  Oligomer
auaguguggugaagaaaag

SEQ ID NO: 4121 - RNA, 19 nt, artificial
  Oligomer
caaccugucgagauguugu

SEQ ID NO: 4122 - RNA, 19 nt, artificial
  Oligomer
guggacaauggaaacacca

SEQ ID NO: 4123 - RNA, 19 nt, artificial
  Oligomer
aauggugcucacuuuagca

SEQ ID NO: 4124 - RNA, 19 nt, artificial
  Oligomer
aagcuaugggacauaccca

SEQ ID NO: 4125 - RNA, 19 nt, artificial
  Oligomer
aucugucugcugaaauaga

SEQ ID NO: 4126 - RNA, 19 nt, artificial
  Oligomer
uaaauaagcgcaacaugga

SEQ ID NO: 4127 - RNA, 19 nt, artificial
  Oligomer
aaagaaaggaaaacugaau

SEQ ID NO: 4128 - RNA, 19 nt, artificial
  Oligomer
caccaccuaagaauuacca

SEQ ID NO: 4129 - RNA, 19 nt, artificial
  Oligomer
caggaaaagcuggguguga

SEQ ID NO: 4130 - RNA, 19 nt, artificial
  Oligomer
caaagcuacccgaacuaug

SEQ ID NO: 4131 - RNA, 19 nt, artificial
  Oligomer
ucaccgaaucggacacuca

SEQ ID NO: 4132 - RNA, 19 nt, artificial
  Oligomer
cgugaaguuccugcuggau

SEQ ID NO: 4133 - RNA, 19 nt, artificial
  Oligomer
cagcgccuuaaauaaguca

SEQ ID NO: 4134 - RNA, 19 nt, artificial
  Oligomer
ccauauacuccauguaccu

SEQ ID NO: 4135 - RNA, 19 nt, artificial
  Oligomer
aggacgaaagcgagacuga

SEQ ID NO: 4136 - RNA, 19 nt, artificial
  Oligomer
augaugccgaugauauuaa

SEQ ID NO: 4137 - RNA, 19 nt, artificial
  Oligomer
agugaauucaaguuccaua

SEQ ID NO: 4138 - RNA, 19 nt, artificial
  Oligomer
aaggaacagcguuuacauu

SEQ ID NO: 4139 - RNA, 19 nt, artificial
  Oligomer
agaggacaagucgacuaca

SEQ ID NO: 4140 - RNA, 19 nt, artificial
  Oligomer
ugcuggauuuuggugucaa

SEQ ID NO: 4141 - RNA, 19 nt, artificial
  Oligomer
gucccauacccuuugauca

SEQ ID NO: 4142 - RNA, 19 nt, artificial
  Oligomer
cccauacccuuugaucaua

SEQ ID NO: 4143 - RNA, 19 nt, artificial
  Oligomer
gcaucgagauugguaaagu

SEQ ID NO: 4144 - RNA, 19 nt, artificial
  Oligomer
ugaaguuccugcuggauuu

SEQ ID NO: 4145 - RNA, 19 nt, artificial
  Oligomer
caguauugccucaaaugcu

SEQ ID NO: 4146 - RNA, 19 nt, artificial
  Oligomer
ugauauuaacuguuuucuu

SEQ ID NO: 4147 - RNA, 19 nt, artificial
  Oligomer
agagugaugcagaccugga

SEQ ID NO: 4148 - RNA, 19 nt, artificial
  Oligomer
aaaguauuuuuugacuaga

SEQ ID NO: 4149 - RNA, 19 nt, artificial
  Oligomer
uucagcugaauuuuuuucc

SEQ ID NO: 4150 - RNA, 19 nt, artificial
  Oligomer
aauaucaucggcaucaucg

SEQ ID NO: 4151 - RNA, 19 nt, artificial
  Oligomer
uuuugaauuuuguuccugg

SEQ ID NO: 4152 - RNA, 19 nt, artificial
  Oligomer
aucagcagcauucacguug

SEQ ID NO: 4153 - RNA, 19 nt, artificial
  Oligomer
uuucaguacguuuuucucc

SEQ ID NO: 4154 - RNA, 19 nt, artificial
  Oligomer
acuaucagcagcauucacg

SEQ ID NO: 4155 - RNA, 19 nt, artificial
  Oligomer
uuaccaaucucgaugcccg

SEQ ID NO: 4156 - RNA, 19 nt, artificial
  Oligomer
ucuagcugcagcuuuccug

SEQ ID NO: 4157 - RNA, 19 nt, artificial
  Oligomer
uuuugguauauaaaaagcc

SEQ ID NO: 4158 - RNA, 19 nt, artificial
  Oligomer
uuuuucuccagguacauuu

SEQ ID NO: 4159 - RNA, 19 nt, artificial
  Oligomer
uugguauauaaaaagccug

SEQ ID NO: 4160 - RNA, 19 nt, artificial
  Oligomer
uuguuauuguccucugccg

SEQ ID NO: 4161 - RNA, 19 nt, artificial
  Oligomer
uucagcagacagauugccg

SEQ ID NO: 4162 - RNA, 19 nt, artificial
  Oligomer
uuuggauuuauaguaauug

SEQ ID NO: 4163 - RNA, 19 nt, artificial
  Oligomer
uuacauuucucugaguucg

SEQ ID NO: 4164 - RNA, 19 nt, artificial
  Oligomer
uauauaaaaagccuguacg

SEQ ID NO: 4165 - RNA, 19 nt, artificial
  Oligomer
uuuucuucaccacacuaug

SEQ ID NO: 4166 - RNA, 19 nt, artificial
  Oligomer
uuauugugcacauuuacac

SEQ ID NO: 4167 - RNA, 19 nt, artificial
  Oligomer
uuuuuuucccauagagacg

SEQ ID NO: 4168 - RNA, 19 nt, artificial
  Oligomer
uuaaaccggacucucagcc

SEQ ID NO: 4169 - RNA, 19 nt, artificial
  Oligomer
uugcagucuguacuuccug

SEQ ID NO: 4170 - RNA, 19 nt, artificial
  Oligomer
uucuacaacaucucgacag

SEQ ID NO: 4171 - RNA, 19 nt, artificial
  Oligomer
uuagaaaauguaaacgcug

SEQ ID NO: 4172 - RNA, 19 nt, artificial
  Oligomer
uaagaguuccuucugcugc

SEQ ID NO: 4173 - RNA, 19 nt, artificial
  Oligomer
uucacuuuucuucaccaca

SEQ ID NO: 4174 - RNA, 19 nt, artificial
  Oligomer
uuguuccugguuaaguugg

SEQ ID NO: 4175 - RNA, 19 nt, artificial
  Oligomer
uuuaccaaucucgaugccc

SEQ ID NO: 4176 - RNA, 19 nt, artificial
  Oligomer
uucuuuuccuggaacaugg

SEQ ID NO: 4177 - RNA, 19 nt, artificial
  Oligomer
uucuucagcuuguucuccu

SEQ ID NO: 4178 - RNA, 19 nt, artificial
  Oligomer
uucauuuucagaaauagac

SEQ ID NO: 4179 - RNA, 19 nt, artificial
  Oligomer
uucagaaauagacugcugc

SEQ ID NO: 4180 - RNA, 19 nt, artificial
  Oligomer
uauuucagcagacagauug

SEQ ID NO: 4181 - RNA, 19 nt, artificial
  Oligomer
ucaaugucgcuuaugguug

SEQ ID NO: 4182 - RNA, 19 nt, artificial
  Oligomer
uuaagaguuccuucugcug

SEQ ID NO: 4183 - RNA, 19 nt, artificial
  Oligomer
uacaauucacaccucagug

SEQ ID NO: 4184 - RNA, 19 nt, artificial
  Oligomer
uauaugcugaggcucuccc

SEQ ID NO: 4185 - RNA, 19 nt, artificial
  Oligomer
uucacuucuucccuccgug

SEQ ID NO: 4186 - RNA, 19 nt, artificial
  Oligomer
uuauuuaagaguuccuucu

SEQ ID NO: 4187 - RNA, 19 nt, artificial
  Oligomer
uuguucaucacacccagcu

SEQ ID NO: 4188 - RNA, 19 nt, artificial
  Oligomer
auuaagaccauuuucuagc

SEQ ID NO: 4189 - RNA, 19 nt, artificial
  Oligomer
aaaacaguuaauaucaucg

SEQ ID NO: 4190 - RNA, 19 nt, artificial
  Oligomer
uuuuugggcacauagcccu

SEQ ID NO: 4191 - RNA, 19 nt, artificial
  Oligomer
uuuaagaguuccuucugcu

SEQ ID NO: 4192 - RNA, 19 nt, artificial
  Oligomer
uguuauuguccucugccgg

SEQ ID NO: 4193 - RNA, 19 nt, artificial
  Oligomer
uuucugaagauguucguac

SEQ ID NO: 4194 - RNA, 19 nt, artificial
  Oligomer
uugauccguggauacagcc

SEQ ID NO: 4195 - RNA, 19 nt, artificial
  Oligomer
uuuauuacauuucucugag

SEQ ID NO: 4196 - RNA, 19 nt, artificial
  Oligomer
auguaaacgcuguuccuug

SEQ ID NO: 4197 - RNA, 19 nt, artificial
  Oligomer
uucaaucugcugcuguugc

SEQ ID NO: 4198 - RNA, 19 nt, artificial
  Oligomer
uucagcuuguucuccuggg

SEQ ID NO: 4199 - RNA, 19 nt, artificial
  Oligomer
aucacuaucagcagcauuc

SEQ ID NO: 4200 - RNA, 19 nt, artificial
  Oligomer
uuaaaucuuccaauugcug

SEQ ID NO: 4201 - RNA, 19 nt, artificial
  Oligomer
uugccguucaugauuuugc

SEQ ID NO: 4202 - RNA, 19 nt, artificial
  Oligomer
uuuaacugacuuauuuaag

SEQ ID NO: 4203 - RNA, 19 nt, artificial
  Oligomer
uuucuauuucagcagacag

SEQ ID NO: 4204 - RNA, 19 nt, artificial
  Oligomer
uuucuucagcuuguucucc

SEQ ID NO: 4205 - RNA, 19 nt, artificial
  Oligomer
augaguguccgauucggug

SEQ ID NO: 4206 - RNA, 19 nt, artificial
  Oligomer
auucgcuuguccaucaugg

SEQ ID NO: 4207 - RNA, 19 nt, artificial
  Oligomer
uucacugauucgcuugucc

SEQ ID NO: 4208 - RNA, 19 nt, artificial
  Oligomer
ucauuagcggauuuggauc

SEQ ID NO: 4209 - RNA, 19 nt, artificial
  Oligomer
uuuuuaacuccaccgccgc

SEQ ID NO: 4210 - RNA, 19 nt, artificial
  Oligomer
auucacauuguggacgcug

SEQ ID NO: 4211 - RNA, 19 nt, artificial
  Oligomer
uuaugggacuucuuaaugg

SEQ ID NO: 4212 - RNA, 19 nt, artificial
  Oligomer
uuaaaauugcagucuguac

SEQ ID NO: 4213 - RNA, 19 nt, artificial
  Oligomer
uuuguuccugguuaaguug

SEQ ID NO: 4214 - RNA, 19 nt, artificial
  Oligomer
uugggcuucuucaaguugg

SEQ ID NO: 4215 - RNA, 19 nt, artificial
  Oligomer
auuuucuucagcuuguucu

SEQ ID NO: 4216 - RNA, 19 nt, artificial
  Oligomer
uuuugcuguagucgacuug

SEQ ID NO: 4217 - RNA, 19 nt, artificial
  Oligomer
uugaauuuuguuccugguu

SEQ ID NO: 4218 - RNA, 19 nt, artificial
  Oligomer
uaugggacguucauuuccc

SEQ ID NO: 4219 - RNA, 19 nt, artificial
  Oligomer
uucaaugucgcuuaugguu

SEQ ID NO: 4220 - RNA, 19 nt, artificial
  Oligomer
ucuuuuuaacuccaccgcc

SEQ ID NO: 4221 - RNA, 19 nt, artificial
  Oligomer
uccaaaaggaaguucaggc

SEQ ID NO: 4222 - RNA, 19 nt, artificial
  Oligomer
ucucauugcacgaauuuuc

SEQ ID NO: 4223 - RNA, 19 nt, artificial
  Oligomer
uaucaucggcaucaucgcg

SEQ ID NO: 4224 - RNA, 19 nt, artificial
  Oligomer
aaucuguucauuguugcuc

SEQ ID NO: 4225 - RNA, 19 nt, artificial
  Oligomer
uuguucacuguucucaguu

SEQ ID NO: 4226 - RNA, 19 nt, artificial
  Oligomer
uaaaauugcagucuguacu

SEQ ID NO: 4227 - RNA, 19 nt, artificial
  Oligomer
uuuucaguacguuuuucuc

SEQ ID NO: 4228 - RNA, 19 nt, artificial
  Oligomer
uuguuguuauuguccucug

SEQ ID NO: 4229 - RNA, 19 nt, artificial
  Oligomer
uuuauugugcacauuuaca

SEQ ID NO: 4230 - RNA, 19 nt, artificial
  Oligomer
uguaggauucacauugugg

SEQ ID NO: 4231 - RNA, 19 nt, artificial
  Oligomer
uagcggauuuggaucuucc

SEQ ID NO: 4232 - RNA, 19 nt, artificial
  Oligomer
uugguuacgaaucuguagu

SEQ ID NO: 4233 - RNA, 19 nt, artificial
  Oligomer
uuuucuagcugcagcuuuc

SEQ ID NO: 4234 - RNA, 19 nt, artificial
  Oligomer
uuccauuguccacaucggc

SEQ ID NO: 4235 - RNA, 19 nt, artificial
  Oligomer
uuuuguuccugguuaaguu

SEQ ID NO: 4236 - RNA, 19 nt, artificial
  Oligomer
uuggauuuauaguaauugg

SEQ ID NO: 4237 - RNA, 19 nt, artificial
  Oligomer
uuucaaucugcugcuguug

SEQ ID NO: 4238 - RNA, 19 nt, artificial
  Oligomer
uacuuccugcuucuuuucc

SEQ ID NO: 4239 - RNA, 19 nt, artificial
  Oligomer
uucuccugggcuucaacuc

SEQ ID NO: 4240 - RNA, 19 nt, artificial
  Oligomer
uuugauccguggauacagc

SEQ ID NO: 4241 - RNA, 19 nt, artificial
  Oligomer
uaggacuuggguauguccc

SEQ ID NO: 4242 - RNA, 19 nt, artificial
  Oligomer
uuugguauauaaaaagccu

SEQ ID NO: 4243 - RNA, 19 nt, artificial
  Oligomer
uucuucaaguugguccgcu

SEQ ID NO: 4244 - RNA, 19 nt, artificial
  Oligomer
ugcagcaguuucaaugucg

SEQ ID NO: 4245 - RNA, 19 nt, artificial
  Oligomer
uucaguacguuuuucucca

SEQ ID NO: 4246 - RNA, 19 nt, artificial
  Oligomer
uuugaggcaauacugagag

SEQ ID NO: 4247 - RNA, 19 nt, artificial
  Oligomer
ucugaguucguugcucuug

SEQ ID NO: 4248 - RNA, 19 nt, artificial
  Oligomer
ucuuucucaguacuuucug

SEQ ID NO: 4249 - RNA, 19 nt, artificial
  Oligomer
uuccugcuucuuuuccugg

SEQ ID NO: 4250 - RNA, 19 nt, artificial
  Oligomer
uucaacacguggauuccca

SEQ ID NO: 4251 - RNA, 19 nt, artificial
  Oligomer
ucuacaagggcguucacuu

SEQ ID NO: 4252 - RNA, 19 nt, artificial
  Oligomer
uuucugaagcuuuucauuu

SEQ ID NO: 4253 - RNA, 19 nt, artificial
  Oligomer
uuccaauugcugacuaagc

SEQ ID NO: 4254 - RNA, 19 nt, artificial
  Oligomer
uucucugaguucguugcuc

SEQ ID NO: 4255 - RNA, 19 nt, artificial
  Oligomer
uucuguuaaaaucuguuca

SEQ ID NO: 4256 - RNA, 19 nt, artificial
  Oligomer
uaaaaucuguucauuguug

SEQ ID NO: 4257 - RNA, 19 nt, artificial
  Oligomer
uuucuagcugcagcuuucc

SEQ ID NO: 4258 - RNA, 19 nt, artificial
  Oligomer
uguuaaaaucuguucauug

SEQ ID NO: 4259 - RNA, 19 nt, artificial
  Oligomer
uacauuuauuacauuucuc

SEQ ID NO: 4260 - RNA, 19 nt, artificial
  Oligomer
uuaacugacuuauuuaagg

SEQ ID NO: 4261 - RNA, 19 nt, artificial
  Oligomer
ugaaccuuucuauuucagc

SEQ ID NO: 4262 - RNA, 19 nt, artificial
  Oligomer
uauuuaagaguuccuucug

SEQ ID NO: 4263 - RNA, 19 nt, artificial
  Oligomer
ucacuuuucuucaccacac

SEQ ID NO: 4264 - RNA, 19 nt, artificial
  Oligomer
uuugcagaggugaacgcug

SEQ ID NO: 4265 - RNA, 19 nt, artificial
  Oligomer
uuguugcucaagaaaacag

SEQ ID NO: 4266 - RNA, 19 nt, artificial
  Oligomer
uuggaggcgaaaguaccuc

SEQ ID NO: 4267 - RNA, 19 nt, artificial
  Oligomer
uuucaauuucugaagcuuu

SEQ ID NO: 4268 - RNA, 19 nt, artificial
  Oligomer
uuaaaaucuguucauuguu

SEQ ID NO: 4269 - RNA, 19 nt, artificial
  Oligomer
aaguugguccgcuuguucg

SEQ ID NO: 4270 - RNA, 19 nt, artificial
  Oligomer
uucguugcucuugggucug

SEQ ID NO: 4271 - RNA, 19 nt, artificial
  Oligomer
uguaguucuugguacaguc

SEQ ID NO: 4272 - RNA, 19 nt, artificial
  Oligomer
uuuuccuuucuuuaaaucu

SEQ ID NO: 4273 - RNA, 19 nt, artificial
  Oligomer
uuuucuucagcuuguucuc

SEQ ID NO: 4274 - RNA, 19 nt, artificial
  Oligomer
uuccugguuaaguugguua

SEQ ID NO: 4275 - RNA, 19 nt, artificial
  Oligomer
uuccuuucuuuaaaucuuc

SEQ ID NO: 4276 - RNA, 19 nt, artificial
  Oligomer
uuuuuucccauagagacgu

SEQ ID NO: 4277 - RNA, 19 nt, artificial
  Oligomer
uuucacuucuucccuccgu

SEQ ID NO: 4278 - RNA, 19 nt, artificial
  Oligomer
uuccuuccuccuuuccagg

SEQ ID NO: 4279 - RNA, 19 nt, artificial
  Oligomer
uuaaugggcaaacuggaga

SEQ ID NO: 4280 - RNA, 19 nt, artificial
  Oligomer
uucaguuuuccuuucuuua

SEQ ID NO: 4281 - RNA, 19 nt, artificial
  Oligomer
aaaaauuucacuucuuccc

SEQ ID NO: 4282 - RNA, 19 nt, artificial
  Oligomer
uacgaaucuguaguucuug

SEQ ID NO: 4283 - RNA, 19 nt, artificial
  Oligomer
auaaaaagccuguacguac

SEQ ID NO: 4284 - RNA, 19 nt, artificial
  Oligomer
uuuaaaucuuccaauugcu

SEQ ID NO: 4285 - RNA, 19 nt, artificial
  Oligomer
auuuaagaguuccuucugc

SEQ ID NO: 4286 - RNA, 19 nt, artificial
  Oligomer
ugcacaaucagccuuuagg

SEQ ID NO: 4287 - RNA, 19 nt, artificial
  Oligomer
cugauuuucaaucugcugc

SEQ ID NO: 4288 - RNA, 19 nt, artificial
  Oligomer
agucuuuuuaacuccaccg

SEQ ID NO: 4289 - RNA, 19 nt, artificial
  Oligomer
aacuguaggauucacauug

SEQ ID NO: 4290 - RNA, 19 nt, artificial
  Oligomer
uugcugacuaagcugauca

SEQ ID NO: 4291 - RNA, 19 nt, artificial
  Oligomer
auugguguuuccauugucc

SEQ ID NO: 4292 - RNA, 19 nt, artificial
  Oligomer
uuauuguccucugccggcu

SEQ ID NO: 4293 - RNA, 19 nt, artificial
  Oligomer
uuucuuuaaaucuuccaau

SEQ ID NO: 4294 - RNA, 19 nt, artificial
  Oligomer
uuuguucaucacacccagc

SEQ ID NO: 4295 - RNA, 19 nt, artificial
  Oligomer
uuguuuccgguguuauagg

SEQ ID NO: 4296 - RNA, 19 nt, artificial
  Oligomer
auccugcucaggcucuuuc

SEQ ID NO: 4297 - RNA, 19 nt, artificial
  Oligomer
uucuauuucagcagacaga

SEQ ID NO: 4298 - RNA, 19 nt, artificial
  Oligomer
auuuucaguacguuuuucu

SEQ ID NO: 4299 - RNA, 19 nt, artificial
  Oligomer
uacagaggcuccuuuggug

SEQ ID NO: 4300 - RNA, 19 nt, artificial
  Oligomer
uucaaguugguccgcuugu

SEQ ID NO: 4301 - RNA, 19 nt, artificial
  Oligomer
agagcuucugucuucacug

SEQ ID NO: 4302 - RNA, 19 nt, artificial
  Oligomer
ucauacaugaaaaauagag

SEQ ID NO: 4303 - RNA, 19 nt, artificial
  Oligomer
ugcuguagucgacuugucc

SEQ ID NO: 4304 - RNA, 19 nt, artificial
  Oligomer
uuccaccucauagaugauc

SEQ ID NO: 4305 - RNA, 19 nt, artificial
  Oligomer
auuuggaucuuccaugagc

SEQ ID NO: 4306 - RNA, 19 nt, artificial
  Oligomer
uuccuugcaaaauucuaca

SEQ ID NO: 4307 - RNA, 19 nt, artificial
  Oligomer
uucacauuguggacgcugu

SEQ ID NO: 4308 - RNA, 19 nt, artificial
  Oligomer
uaucuuggagcucugagag

SEQ ID NO: 4309 - RNA, 19 nt, artificial
  Oligomer
ucccauagagacguucacg

SEQ ID NO: 4310 - RNA, 19 nt, artificial
  Oligomer
uuguaagacuggaacccau

SEQ ID NO: 4311 - RNA, 19 nt, artificial
  Oligomer
uuuccagggagcuugucga

SEQ ID NO: 4312 - RNA, 19 nt, artificial
  Oligomer
ugcugcaucagugagucug

SEQ ID NO: 4313 - RNA, 19 nt, artificial
  Oligomer
cuugaauucacugucuggg

SEQ ID NO: 4314 - RNA, 19 nt, artificial
  Oligomer
auagaaacugggagcacug

SEQ ID NO: 4315 - RNA, 19 nt, artificial
  Oligomer
uucacuguucucaguuggg

SEQ ID NO: 4316 - RNA, 19 nt, artificial
  Oligomer
acugauucgcuuguccauc

SEQ ID NO: 4317 - RNA, 19 nt, artificial
  Oligomer
uguuauaggaacuucuguu

SEQ ID NO: 4318 - RNA, 19 nt, artificial
  Oligomer
ucauagaugauccucugca

SEQ ID NO: 4319 - RNA, 19 nt, artificial
  Oligomer
uuucagaaauagacugcug

SEQ ID NO: 4320 - RNA, 19 nt, artificial
  Oligomer
uacaagggcguucacuuuu

SEQ ID NO: 4321 - RNA, 19 nt, artificial
  Oligomer
uguacguacaauucacacc

SEQ ID NO: 4322 - RNA, 19 nt, artificial
  Oligomer
uucuucaccacacuaugua

SEQ ID NO: 4323 - RNA, 19 nt, artificial
  Oligomer
uuuucccauagagacguuc

SEQ ID NO: 4324 - RNA, 19 nt, artificial
  Oligomer
uaugguugaggcaaaaaug

SEQ ID NO: 4325 - RNA, 19 nt, artificial
  Oligomer
uuuggaucuuccaugagca

SEQ ID NO: 4326 - RNA, 19 nt, artificial
  Oligomer
uuuccauuguccacaucgg

SEQ ID NO: 4327 - RNA, 19 nt, artificial
  Oligomer
ugcagucuguacuuccugc

SEQ ID NO: 4328 - RNA, 19 nt, artificial
  Oligomer
uuggguaugucccauagcu

SEQ ID NO: 4329 - RNA, 19 nt, artificial
  Oligomer
uucuagcugcagcuuuccu

SEQ ID NO: 4330 - RNA, 19 nt, artificial
  Oligomer
aaguuuugaauuuuguucc

SEQ ID NO: 4331 - RNA, 19 nt, artificial
  Oligomer
uccagcaggaacuucacga

SEQ ID NO: 4332 - RNA, 19 nt, artificial
  Oligomer
ugagaaaggaugagugucc

SEQ ID NO: 4333 - RNA, 19 nt, artificial
  Oligomer
aaguucaggcgaguguucg

SEQ ID NO: 4334 - RNA, 19 nt, artificial
  Oligomer
acauuguggacgcugucug

SEQ ID NO: 4335 - RNA, 19 nt, artificial
  Oligomer
auuuuuuucccauagagac

SEQ ID NO: 4336 - RNA, 19 nt, artificial
  Oligomer
aauugcagucuguacuucc

SEQ ID NO: 4337 - RNA, 19 nt, artificial
  Oligomer
uguacuuccugcuucuuuu

SEQ ID NO: 4338 - RNA, 19 nt, artificial
  Oligomer
uacguuuuucuccagguac

SEQ ID NO: 4339 - RNA, 19 nt, artificial
  Oligomer
uugaaaguggguauuuauu

SEQ ID NO: 4340 - RNA, 19 nt, artificial
  Oligomer
ugguacagucuuuuuaacu

SEQ ID NO: 4341 - RNA, 19 nt, artificial
  Oligomer
uuucaaugucgcuuauggu

SEQ ID NO: 4342 - RNA, 19 nt, artificial
  Oligomer
uuuaggugaacuggaacag

SEQ ID NO: 4343 - RNA, 19 nt, artificial
  Oligomer
uaaaacgggcuuaccauac

SEQ ID NO: 4344 - RNA, 19 nt, artificial
  Oligomer
auuuuguuccugguuaagu

SEQ ID NO: 4345 - RNA, 19 nt, artificial
  Oligomer
aaaauguaaacgcuguucc

SEQ ID NO: 4346 - RNA, 19 nt, artificial
  Oligomer
uaguucuugguacagucuu

SEQ ID NO: 4347 - RNA, 19 nt, artificial
  Oligomer
uuuugggcacauagcccuc

SEQ ID NO: 4348 - RNA, 19 nt, artificial
  Oligomer
uuaugguugaggcaaaaau

SEQ ID NO: 4349 - RNA, 19 nt, artificial
  Oligomer
uugucacuuggucuuaggg

SEQ ID NO: 4350 - RNA, 19 nt, artificial
  Oligomer
uccaccucauagaugaucc

SEQ ID NO: 4351 - RNA, 19 nt, artificial
  Oligomer
uggaucuuccaugagcagc

SEQ ID NO: 4352 - RNA, 19 nt, artificial
  Oligomer
aaaauagagccuaagggcc

SEQ ID NO: 4353 - RNA, 19 nt, artificial
  Oligomer
ugaauuuuguuccugguua

SEQ ID NO: 4354 - RNA, 19 nt, artificial
  Oligomer
uugguguuuccauugucca

SEQ ID NO: 4355 - RNA, 19 nt, artificial
  Oligomer
cuuauuuaagaguuccuuc

SEQ ID NO: 4356 - RNA, 19 nt, artificial
  Oligomer
uccaucacuaucagcagca

SEQ ID NO: 4357 - RNA, 19 nt, artificial
  Oligomer
uuaaguugguuacgaaucu

SEQ ID NO: 4358 - RNA, 19 nt, artificial
  Oligomer
accuuuguucaucacaccc

SEQ ID NO: 4359 - RNA, 19 nt, artificial
  Oligomer
aucauuagcggauuuggau

SEQ ID NO: 4360 - RNA, 19 nt, artificial
  Oligomer
aauuucacuucuucccucc

SEQ ID NO: 4361 - RNA, 19 nt, artificial
  Oligomer
uuagcggauuuggaucuuc

SEQ ID NO: 4362 - RNA, 19 nt, artificial
  Oligomer
uucaugauuuugcuguagu

SEQ ID NO: 4363 - RNA, 19 nt, artificial
  Oligomer
cuuuuuaacuccaccgccg

SEQ ID NO: 4364 - RNA, 19 nt, artificial
  Oligomer
uaccucucccaguuaaugg

SEQ ID NO: 4365 - RNA, 19 nt, artificial
  Oligomer
uucaacucguucuuucaau

SEQ ID NO: 4366 - RNA, 19 nt, artificial
  Oligomer
gucaguaagagcuucuguc

SEQ ID NO: 4367 - RNA, 19 nt, artificial
  Oligomer
ucaaucugcugcuguugcc

SEQ ID NO: 4368 - RNA, 19 nt, artificial
  Oligomer
uucugcugcugaaguuuug

SEQ ID NO: 4369 - RNA, 19 nt, artificial
  Oligomer
uaaaucuuccaauugcuga

SEQ ID NO: 4370 - RNA, 19 nt, artificial
  Oligomer
guuuccauuguccacaucg

SEQ ID NO: 4371 - RNA, 19 nt, artificial
  Oligomer
aucuguugugaggagccug

SEQ ID NO: 4372 - RNA, 19 nt, artificial
  Oligomer
uagaauucuguuuuaaugu

SEQ ID NO: 4373 - RNA, 19 nt, artificial
  Oligomer
uuuccaacauaguucgggu

SEQ ID NO: 4374 - RNA, 19 nt, artificial
  Oligomer
auuucacuucuucccuccg

SEQ ID NO: 4375 - RNA, 19 nt, artificial
  Oligomer
auucacacgguucagcuga

SEQ ID NO: 4376 - RNA, 19 nt, artificial
  Oligomer
uuugaauuuuguuccuggu

SEQ ID NO: 4377 - RNA, 19 nt, artificial
  Oligomer
uucggguagcuuugaaugg

SEQ ID NO: 4378 - RNA, 19 nt, artificial
  Oligomer
ugucgcuuaugguugaggc

SEQ ID NO: 4379 - RNA, 19 nt, artificial
  Oligomer
uuguggacgcugucugcua

SEQ ID NO: 4380 - RNA, 19 nt, artificial
  Oligomer
uugaacccgaagguaaaac

SEQ ID NO: 4381 - RNA, 19 nt, artificial
  Oligomer
acguucacgcaguucacug

SEQ ID NO: 4382 - RNA, 19 nt, artificial
  Oligomer
uuugcuguagucgacuugu

SEQ ID NO: 4383 - RNA, 19 nt, artificial
  Oligomer
aguucguugcucuuggguc

SEQ ID NO: 4384 - RNA, 19 nt, artificial
  Oligomer
auaucaucggcaucaucgc

SEQ ID NO: 4385 - RNA, 19 nt, artificial
  Oligomer
ucaaaaaauacuuuuggua

SEQ ID NO: 4386 - RNA, 19 nt, artificial
  Oligomer
ucaguaagagcuucugucu

SEQ ID NO: 4387 - RNA, 19 nt, artificial
  Oligomer
auagaugauccucugcacc

SEQ ID NO: 4388 - RNA, 19 nt, artificial
  Oligomer
uagccuuccuccaucuccu

SEQ ID NO: 4389 - RNA, 19 nt, artificial
  Oligomer
ucgacuuguccucucauug

SEQ ID NO: 4390 - RNA, 19 nt, artificial
  Oligomer
acauuuauuacauuucucu

SEQ ID NO: 4391 - RNA, 19 nt, artificial
  Oligomer
aaaauucuacaacaucucg

SEQ ID NO: 4392 - RNA, 19 nt, artificial
  Oligomer
uauuacauuucucugaguu

SEQ ID NO: 4393 - RNA, 19 nt, artificial
  Oligomer
uuuagaaaauguaaacgcu

SEQ ID NO: 4394 - RNA, 19 nt, artificial
  Oligomer
auuuauuacauuucucuga

SEQ ID NO: 4395 - RNA, 19 nt, artificial
  Oligomer
uagaugauccucugcacca

SEQ ID NO: 4396 - RNA, 19 nt, artificial
  Oligomer
ucucugaguucguugcucu

SEQ ID NO: 4397 - RNA, 19 nt, artificial
  Oligomer
uuuccauacagaggcuccu

SEQ ID NO: 4398 - RNA, 19 nt, artificial
  Oligomer
aauagacugcugcugacgg

SEQ ID NO: 4399 - RNA, 19 nt, artificial
  Oligomer
auggaguauauggaacuug

SEQ ID NO: 4400 - RNA, 19 nt, artificial
  Oligomer
uagcuuugaauggucuagu

SEQ ID NO: 4401 - RNA, 19 nt, artificial
  Oligomer
ugcaaaauucuacaacauc

SEQ ID NO: 4402 - RNA, 19 nt, artificial
  Oligomer
aaggugaugggcuacagug

SEQ ID NO: 4403 - RNA, 19 nt, artificial
  Oligomer
uaauaucaucggcaucauc

SEQ ID NO: 4404 - RNA, 19 nt, artificial
  Oligomer
auuucucugaguucguugc

SEQ ID NO: 4405 - RNA, 19 nt, artificial
  Oligomer
uguuacaagaggcagcgca

SEQ ID NO: 4406 - RNA, 19 nt, artificial
  Oligomer
uaauucuuagguggugugg

SEQ ID NO: 4407 - RNA, 19 nt, artificial
  Oligomer
auacaugaaaaauagagcc

SEQ ID NO: 4408 - RNA, 19 nt, artificial
  Oligomer
aucuguucauuguugcuca

SEQ ID NO: 4409 - RNA, 19 nt, artificial
  Oligomer
uguaagacuggaacccauu

SEQ ID NO: 4410 - RNA, 19 nt, artificial
  Oligomer
acugguuucacggaagagc

SEQ ID NO: 4411 - RNA, 19 nt, artificial
  Oligomer
uugcgcuuauuuaagaguu

SEQ ID NO: 4412 - RNA, 19 nt, artificial
  Oligomer
auuuucagaaauagacugc

SEQ ID NO: 4413 - RNA, 19 nt, artificial
  Oligomer
uuuccuggaaaacagcaca

SEQ ID NO: 4414 - RNA, 19 nt, artificial
  Oligomer
uucaauuucugaagcuuuu

SEQ ID NO: 4415 - RNA, 19 nt, artificial
  Oligomer
ugaucaacccuuaaaauug

SEQ ID NO: 4416 - RNA, 19 nt, artificial
  Oligomer
accauuuucuagcugcagc

SEQ ID NO: 4417 - RNA, 19 nt, artificial
  Oligomer
ccaguuuccaucauuagcg

SEQ ID NO: 4418 - RNA, 19 nt, artificial
  Oligomer
aagagcuucugucuucacu

SEQ ID NO: 4419 - RNA, 19 nt, artificial
  Oligomer
uauagaaacugggagcacu

SEQ ID NO: 4420 - RNA, 19 nt, artificial
  Oligomer
uuucucaguacuuucugaa

SEQ ID NO: 4421 - RNA, 19 nt, artificial
  Oligomer
guugacaccaaaauccagc

SEQ ID NO: 4422 - RNA, 19 nt, artificial
  Oligomer
uugaauggucuagucaaaa

SEQ ID NO: 4423 - RNA, 19 nt, artificial
  Oligomer
uuuucagaaauagacugcu

SEQ ID NO: 4424 - RNA, 19 nt, artificial
  Oligomer
aaauucuacaacaucucga

SEQ ID NO: 4425 - RNA, 19 nt, artificial
  Oligomer
uuguccucucauugcacga

SEQ ID NO: 4426 - RNA, 19 nt, artificial
  Oligomer
ugaaaaauagagccuaagg

SEQ ID NO: 4427 - RNA, 19 nt, artificial
  Oligomer
uuaggugaacuggaacagg

SEQ ID NO: 4428 - RNA, 19 nt, artificial
  Oligomer
acuggauguagccuuccuc

SEQ ID NO: 4429 - RNA, 19 nt, artificial
  Oligomer
auuuucaaucugcugcugu

SEQ ID NO: 4430 - RNA, 19 nt, artificial
  Oligomer
uccaacauaguucggguag

SEQ ID NO: 4431 - RNA, 19 nt, artificial
  Oligomer
ucucaguacuuucugaagg

SEQ ID NO: 4432 - RNA, 19 nt, artificial
  Oligomer
auggaacuugaauucacug

SEQ ID NO: 4433 - RNA, 19 nt, artificial
  Oligomer
augauuuugcuguagucga

SEQ ID NO: 4434 - RNA, 19 nt, artificial
  Oligomer
uuucucugaguucguugcu

SEQ ID NO: 4435 - RNA, 19 nt, artificial
  Oligomer
uuucagcagacagauugcc

SEQ ID NO: 4436 - RNA, 19 nt, artificial
  Oligomer
augguugaggcaaaaaugg

SEQ ID NO: 4437 - RNA, 19 nt, artificial
  Oligomer
uuuccuuucuuuaaaucuu

SEQ ID NO: 4438 - RNA, 19 nt, artificial
  Oligomer
agggcguucacuuuucuuc

SEQ ID NO: 4439 - RNA, 19 nt, artificial
  Oligomer
uggagcugcgcuuuuucag

SEQ ID NO: 4440 - RNA, 19 nt, artificial
  Oligomer
auuacauuucucugaguuc

SEQ ID NO: 4441 - RNA, 19 nt, artificial
  Oligomer
uccgaguugggcuucuuca

SEQ ID NO: 4442 - RNA, 19 nt, artificial
  Oligomer
accuuguucacuguucuca

SEQ ID NO: 4443 - RNA, 19 nt, artificial
  Oligomer
aaaaauagagccuaagggc

SEQ ID NO: 4444 - RNA, 19 nt, artificial
  Oligomer
uucguacaucauaugauca

SEQ ID NO: 4445 - RNA, 19 nt, artificial
  Oligomer
ucacugauucgcuugucca

SEQ ID NO: 4446 - RNA, 19 nt, artificial
  Oligomer
uuuucaaucugcugcuguu

SEQ ID NO: 4447 - RNA, 19 nt, artificial
  Oligomer
ucagcugaauuuuuuuccc

SEQ ID NO: 4448 - RNA, 19 nt, artificial
  Oligomer
guuguuauuguccucugcc

SEQ ID NO: 4449 - RNA, 19 nt, artificial
  Oligomer
ucacgcaguucacugauuc

SEQ ID NO: 4450 - RNA, 19 nt, artificial
  Oligomer
uccaugagcagcauuugag

SEQ ID NO: 4451 - RNA, 19 nt, artificial
  Oligomer
uggaacuugaauucacugu

SEQ ID NO: 4452 - RNA, 19 nt, artificial
  Oligomer
auuuucuagcugcagcuuu

SEQ ID NO: 4453 - RNA, 19 nt, artificial
  Oligomer
ucuuuaaaucuuccaauug

SEQ ID NO: 4454 - RNA, 19 nt, artificial
  Oligomer
aggauucacauuguggacg

SEQ ID NO: 4455 - RNA, 19 nt, artificial
  Oligomer
uugcuggagguacauggag

SEQ ID NO: 4456 - RNA, 19 nt, artificial
  Oligomer
ucuucagcuuguucuccug

SEQ ID NO: 4457 - RNA, 19 nt, artificial
  Oligomer
auuguaagacuggaaccca

SEQ ID NO: 4458 - RNA, 19 nt, artificial
  Oligomer
ucagccuuuaggugaacug

SEQ ID NO: 4459 - RNA, 19 nt, artificial
  Oligomer
agcaguuucaaugucgcuu

SEQ ID NO: 4460 - RNA, 19 nt, artificial
  Oligomer
acuugaauucacugucugg

SEQ ID NO: 4461 - RNA, 19 nt, artificial
  Oligomer
uuuucauuuucagaaauag

SEQ ID NO: 4462 - RNA, 19 nt, artificial
  Oligomer
cauugcacgaauuuucuuc

SEQ ID NO: 4463 - RNA, 19 nt, artificial
  Oligomer
uacauggaguauauggaac

SEQ ID NO: 4464 - RNA, 19 nt, artificial
  Oligomer
uucuuucaauuucugaagc

SEQ ID NO: 4465 - RNA, 19 nt, artificial
  Oligomer
ugguauauaaaaagccugu

SEQ ID NO: 4466 - RNA, 19 nt, artificial
  Oligomer
uuucuucaccacacuaugu

SEQ ID NO: 4467 - RNA, 19 nt, artificial
  Oligomer
auuguggacgcugucugcu

SEQ ID NO: 4468 - RNA, 19 nt, artificial
  Oligomer
ucuugguacagucuuuuua

SEQ ID NO: 4469 - RNA, 19 nt, artificial
  Oligomer
uuccuucugcugcugaagu

SEQ ID NO: 4470 - RNA, 19 nt, artificial
  Oligomer
uuuuaacuccaccgccgcu

SEQ ID NO: 4471 - RNA, 19 nt, artificial
  Oligomer
uaacugacuuauuuaaggc

SEQ ID NO: 4472 - RNA, 19 nt, artificial
  Oligomer
acgaauuuucuucagcuug

SEQ ID NO: 4473 - RNA, 19 nt, artificial
  Oligomer
uuccauacagaggcuccuu

SEQ ID NO: 4474 - RNA, 19 nt, artificial
  Oligomer
uucauuguugcucaagaaa

SEQ ID NO: 4475 - RNA, 19 nt, artificial
  Oligomer
uccuuucuuuaaaucuucc

SEQ ID NO: 4476 - RNA, 19 nt, artificial
  Oligomer
uauguacagucagugcucc

SEQ ID NO: 4477 - RNA, 19 nt, artificial
  Oligomer
ucucgacagguuguuuccg

SEQ ID NO: 4478 - RNA, 19 nt, artificial
  Oligomer
uucuugguacagucuuuuu

SEQ ID NO: 4479 - RNA, 19 nt, artificial
  Oligomer
uccagguacauuuauuaca

SEQ ID NO: 4480 - RNA, 19 nt, artificial
  Oligomer
uucaccacacuauguacag

SEQ ID NO: 4481 - RNA, 19 nt, artificial
  Oligomer
uucaucacacccagcuuuu

SEQ ID NO: 4482 - RNA, 19 nt, artificial
  Oligomer
uaaguugguuacgaaucug

SEQ ID NO: 4483 - RNA, 19 nt, artificial
  Oligomer
ucacauuguggacgcuguc

SEQ ID NO: 4484 - RNA, 19 nt, artificial
  Oligomer
uagaaacugggagcacugg

SEQ ID NO: 4485 - RNA, 19 nt, artificial
  Oligomer
cacuuuaccaaucucgaug

SEQ ID NO: 4486 - RNA, 19 nt, artificial
  Oligomer
uccacacuucagcuaaaug

SEQ ID NO: 4487 - RNA, 19 nt, artificial
  Oligomer
uaagagcuucugucuucac

SEQ ID NO: 4488 - RNA, 19 nt, artificial
  Oligomer
uaccauacacugcuuuaac

SEQ ID NO: 4489 - RNA, 19 nt, artificial
  Oligomer
acaauaaucucuuaagugg

SEQ ID NO: 4490 - RNA, 19 nt, artificial
  Oligomer
uacauuucucugaguucgu

SEQ ID NO: 4491 - RNA, 19 nt, artificial
  Oligomer
guuguuguuauuguccucu

SEQ ID NO: 4492 - RNA, 19 nt, artificial
  Oligomer
acugacuuauuuaaggcgc

SEQ ID NO: 4493 - RNA, 19 nt, artificial
  Oligomer
uccaauugcugacuaagcu

SEQ ID NO: 4494 - RNA, 19 nt, artificial
  Oligomer
aguaagagcuucugucuuc

SEQ ID NO: 4495 - RNA, 19 nt, artificial
  Oligomer
uguuguuauuguccucugc

SEQ ID NO: 4496 - RNA, 19 nt, artificial
  Oligomer
uuucauuuucagaaauaga

SEQ ID NO: 4497 - RNA, 19 nt, artificial
  Oligomer
cauuucucugaguucguug

SEQ ID NO: 4498 - RNA, 19 nt, artificial
  Oligomer
acaguuaauaucaucggca

SEQ ID NO: 4499 - RNA, 19 nt, artificial
  Oligomer
cggauuuggaucuuccaug

SEQ ID NO: 4500 - RNA, 19 nt, artificial
  Oligomer
guuaauaucaucggcauca

SEQ ID NO: 4501 - RNA, 19 nt, artificial
  Oligomer
ugaauuugagcuugcaggg

SEQ ID NO: 4502 - RNA, 19 nt, artificial
  Oligomer
ucucccaguugucacuugg

SEQ ID NO: 4503 - RNA, 19 nt, artificial
  Oligomer
auacacugcuuuaacugac

SEQ ID NO: 4504 - RNA, 19 nt, artificial
  Oligomer
gucugcaucacucugguag

SEQ ID NO: 4505 - RNA, 19 nt, artificial
  Oligomer
acauaguucggguagcuuu

SEQ ID NO: 4506 - RNA, 19 nt, artificial
  Oligomer
uccaucauuagcggauuug

SEQ ID NO: 4507 - RNA, 19 nt, artificial
  Oligomer
auaucuuggagcucugaga

SEQ ID NO: 4508 - RNA, 19 nt, artificial
  Oligomer
uuucccauagagacguuca

SEQ ID NO: 4509 - RNA, 19 nt, artificial
  Oligomer
uuugaaaguggguauuuau

SEQ ID NO: 4510 - RNA, 19 nt, artificial
  Oligomer
cugaguucguugcucuugg

SEQ ID NO: 4511 - RNA, 19 nt, artificial
  Oligomer
uucacaccucagugaagcg

SEQ ID NO: 4512 - RNA, 19 nt, artificial
  Oligomer
uguaaacgcuguuccuugg

SEQ ID NO: 4513 - RNA, 19 nt, artificial
  Oligomer
cugaauuugagcuugcagg

SEQ ID NO: 4514 - RNA, 19 nt, artificial
  Oligomer
ucauuguugcucaagaaaa

SEQ ID NO: 4515 - RNA, 19 nt, artificial
  Oligomer
uacaucauaugaucaaagg

SEQ ID NO: 4516 - RNA, 19 nt, artificial
  Oligomer
uugaagcgcugguacagca

SEQ ID NO: 4517 - RNA, 19 nt, artificial
  Oligomer
cacguuguuguuauugucc

SEQ ID NO: 4518 - RNA, 19 nt, artificial
  Oligomer
ucugaagcuuuucauuuuc

SEQ ID NO: 4519 - RNA, 19 nt, artificial
  Oligomer
uccucugcugaaucuguug

SEQ ID NO: 4520 - RNA, 19 nt, artificial
  Oligomer
uugcuguagucgacuuguc

SEQ ID NO: 4521 - RNA, 19 nt, artificial
  Oligomer
acuuauuuaaggcgcugug

SEQ ID NO: 4522 - RNA, 19 nt, artificial
  Oligomer
ucccaguugucacuugguc

SEQ ID NO: 4523 - RNA, 19 nt, artificial
  Oligomer
ugcacgaauuuucuucagc

SEQ ID NO: 4524 - RNA, 19 nt, artificial
  Oligomer
uuuccgguguuauaggaac

SEQ ID NO: 4525 - RNA, 19 nt, artificial
  Oligomer
guuuuugggcacauagccc

SEQ ID NO: 4526 - RNA, 19 nt, artificial
  Oligomer
aaaauuucacuucuucccu

SEQ ID NO: 4527 - RNA, 19 nt, artificial
  Oligomer
uagaaaauguaaacgcugu

SEQ ID NO: 4528 - RNA, 19 nt, artificial
  Oligomer
ugacuaagcugaucaaccc

SEQ ID NO: 4529 - RNA, 19 nt, artificial
  Oligomer
uccauacagaggcuccuuu

SEQ ID NO: 4530 - RNA, 19 nt, artificial
  Oligomer
ugaaaguggguauuuauuu

SEQ ID NO: 4531 - RNA, 19 nt, artificial
  Oligomer
cugacuaagcugaucaacc

SEQ ID NO: 4532 - RNA, 19 nt, artificial
  Oligomer
auaugaucaaaggguaugg

SEQ ID NO: 4533 - RNA, 19 nt, artificial
  Oligomer
accucauagaugauccucu

SEQ ID NO: 4534 - RNA, 19 nt, artificial
  Oligomer
guuaaguugguuacgaauc

SEQ ID NO: 4535 - RNA, 19 nt, artificial
  Oligomer
ucauuuucagaaauagacu

SEQ ID NO: 4536 - RNA, 19 nt, artificial
  Oligomer
aaucuguaguucuugguac

SEQ ID NO: 4537 - RNA, 19 nt, artificial
  Oligomer
uagucaaaaaauacuuuug

SEQ ID NO: 4538 - RNA, 19 nt, artificial
  Oligomer
aaauagacugcugcugacg

SEQ ID NO: 4539 - RNA, 19 nt, artificial
  Oligomer
ucgaacucuccuuccagag

SEQ ID NO: 4540 - RNA, 19 nt, artificial
  Oligomer
uucuuuaaaucuuccaauu

SEQ ID NO: 4541 - RNA, 19 nt, artificial
  Oligomer
uugguacagucuuuuuaac

SEQ ID NO: 4542 - RNA, 19 nt, artificial
  Oligomer
aaccuuucuauuucagcag

SEQ ID NO: 4543 - RNA, 19 nt, artificial
  Oligomer
uacaacaucucgacagguu

SEQ ID NO: 4544 - RNA, 19 nt, artificial
  Oligomer
uggucuagucaaaaaauac

SEQ ID NO: 4545 - RNA, 19 nt, artificial
  Oligomer
uucucaguacuuucugaag

SEQ ID NO: 4546 - RNA, 19 nt, artificial
  Oligomer
ucuuccaugagcagcauuu

SEQ ID NO: 4547 - RNA, 19 nt, artificial
  Oligomer
auucacaccucagugaagc

SEQ ID NO: 4548 - RNA, 19 nt, artificial
  Oligomer
uucacguugacaccaaaau

SEQ ID NO: 4549 - RNA, 19 nt, artificial
  Oligomer
uacagucuuuuuaacucca

SEQ ID NO: 4550 - RNA, 19 nt, artificial
  Oligomer
ucugcaucacucugguagc

SEQ ID NO: 4551 - RNA, 19 nt, artificial
  Oligomer
ucaauuucugaagcuuuuc

SEQ ID NO: 4552 - RNA, 19 nt, artificial
  Oligomer
uccugguuaaguugguuac

SEQ ID NO: 4553 - RNA, 19 nt, artificial
  Oligomer
ugcucaggcucuuucucag

SEQ ID NO: 4554 - RNA, 19 nt, artificial
  Oligomer
ucuguaguucuugguacag

SEQ ID NO: 4555 - RNA, 19 nt, artificial
  Oligomer
accauuaagaccauuuucu

SEQ ID NO: 4556 - RNA, 19 nt, artificial
  Oligomer
uguugcgcuuauuuaagag

SEQ ID NO: 4557 - RNA, 19 nt, artificial
  Oligomer
ugguacagcagcuucugga

SEQ ID NO: 4558 - RNA, 19 nt, artificial
  Oligomer
uaagacuggaacccauuca

SEQ ID NO: 4559 - RNA, 19 nt, artificial
  Oligomer
acuuuugguauauaaaaag

SEQ ID NO: 4560 - RNA, 19 nt, artificial
  Oligomer
cuucagcuuguucuccugg

SEQ ID NO: 4561 - RNA, 19 nt, artificial
  Oligomer
uggauguagccuuccucca

SEQ ID NO: 4562 - RNA, 19 nt, artificial
  Oligomer
ucagugggaguucaggcuu

SEQ ID NO: 4563 - RNA, 19 nt, artificial
  Oligomer
aauuuucuucagcuuguuc

SEQ ID NO: 4564 - RNA, 19 nt, artificial
  Oligomer
uccuuggaggcgaaaguac

SEQ ID NO: 4565 - RNA, 19 nt, artificial
  Oligomer
acuaagcugaucaacccuu

SEQ ID NO: 4566 - RNA, 19 nt, artificial
  Oligomer
ucuuccagguuuccauugg

SEQ ID NO: 4567 - RNA, 19 nt, artificial
  Oligomer
ugcuuuaacugacuuauuu

SEQ ID NO: 4568 - RNA, 19 nt, artificial
  Oligomer
ugauuuucaaucugcugcu

SEQ ID NO: 4569 - RNA, 19 nt, artificial
  Oligomer
agucuguacuuccugcuuc

SEQ ID NO: 4570 - RNA, 19 nt, artificial
  Oligomer
ugaagcuuuucauuuucag

SEQ ID NO: 4571 - RNA, 19 nt, artificial
  Oligomer
ggcuucuucaaguuggucc

SEQ ID NO: 4572 - RNA, 19 nt, artificial
  Oligomer
uuacgaaucuguaguucuu

SEQ ID NO: 4573 - RNA, 19 nt, artificial
  Oligomer
ucaacccuuaaaauugcag

SEQ ID NO: 4574 - RNA, 19 nt, artificial
  Oligomer
aaacaguuaauaucaucgg

SEQ ID NO: 4575 - RNA, 19 nt, artificial
  Oligomer
uccagcaccugacuccauu

SEQ ID NO: 4576 - RNA, 19 nt, artificial
  Oligomer
uucuccagguacauuuauu

SEQ ID NO: 4577 - RNA, 19 nt, artificial
  Oligomer
aacugacuuauuuaaggcg

SEQ ID NO: 4578 - RNA, 19 nt, artificial
  Oligomer
uggacauguuuccauacag

SEQ ID NO: 4579 - RNA, 19 nt, artificial
  Oligomer
uacggaaauccucugcuga

SEQ ID NO: 4580 - RNA, 19 nt, artificial
  Oligomer
uucugaagcuuuucauuuu

SEQ ID NO: 4581 - RNA, 19 nt, artificial
  Oligomer
ugagacggguuuauugugc

SEQ ID NO: 4582 - RNA, 19 nt, artificial
  Oligomer
ugcaccagaucgaacucuc

SEQ ID NO: 4583 - RNA, 19 nt, artificial
  Oligomer
augucgcuuaugguugagg

SEQ ID NO: 4584 - RNA, 19 nt, artificial
  Oligomer
uugcugggaucuuccaccu

SEQ ID NO: 4585 - RNA, 19 nt, artificial
  Oligomer
uccugcucaggcucuuucu

SEQ ID NO: 4586 - RNA, 19 nt, artificial
  Oligomer
ucuucaaguugguccgcuu

SEQ ID NO: 4587 - RNA, 19 nt, artificial
  Oligomer
acaccuuuguucaucacac

SEQ ID NO: 4588 - RNA, 19 nt, artificial
  Oligomer
uugcucaagaaaacaguua

SEQ ID NO: 4589 - RNA, 19 nt, artificial
  Oligomer
acuauguacagucagugcu

SEQ ID NO: 4590 - RNA, 19 nt, artificial
  Oligomer
uaaaaagccuguacguaca

SEQ ID NO: 4591 - RNA, 19 nt, artificial
  Oligomer
uuccuccaucuccucacac

SEQ ID NO: 4592 - RNA, 19 nt, artificial
  Oligomer
uguucauuguugcucaaga

SEQ ID NO: 4593 - RNA, 19 nt, artificial
  Oligomer
ucacguugacaccaaaauc

SEQ ID NO: 4594 - RNA, 19 nt, artificial
  Oligomer
aacuugaauucacugucug

SEQ ID NO: 4595 - RNA, 19 nt, artificial
  Oligomer
cuguacuuccugcuucuuu

SEQ ID NO: 4596 - RNA, 19 nt, artificial
  Oligomer
ucgcuuaugguugaggcaa

SEQ ID NO: 4597 - RNA, 19 nt, artificial
  Oligomer
ugaacccgaagguaaaacg

SEQ ID NO: 4598 - RNA, 19 nt, artificial
  Oligomer
auugcacgaauuuucuuca

SEQ ID NO: 4599 - RNA, 19 nt, artificial
  Oligomer
ugaacuggaacaggaagcg

SEQ ID NO: 4600 - RNA, 19 nt, artificial
  Oligomer
uguugcucaagaaaacagu

SEQ ID NO: 4601 - RNA, 19 nt, artificial
  Oligomer
aaaaucuguucauuguugc

SEQ ID NO: 4602 - RNA, 19 nt, artificial
  Oligomer
aaauagagccuaagggccu

SEQ ID NO: 4603 - RNA, 19 nt, artificial
  Oligomer
acgcaguucacugauucgc

SEQ ID NO: 4604 - RNA, 19 nt, artificial
  Oligomer
gucugcagcaguuucaaug

SEQ ID NO: 4605 - RNA, 19 nt, artificial
  Oligomer
uacaugaaaaauagagccu

SEQ ID NO: 4606 - RNA, 19 nt, artificial
  Oligomer
cuucacgaugugauggugg

SEQ ID NO: 4607 - RNA, 19 nt, artificial
  Oligomer
uucuccagguuccuugcaa

SEQ ID NO: 4608 - RNA, 19 nt, artificial
  Oligomer
uccuucaggcaccaaacag

SEQ ID NO: 4609 - RNA, 19 nt, artificial
  Oligomer
cuuguccucucauugcacg

SEQ ID NO: 4610 - RNA, 19 nt, artificial
  Oligomer
uguugaagcgcugguacag

SEQ ID NO: 4611 - RNA, 19 nt, artificial
  Oligomer
cauuuauuacauuucucug

SEQ ID NO: 4612 - RNA, 19 nt, artificial
  Oligomer
agguaacucauuaucauug

SEQ ID NO: 4613 - RNA, 19 nt, artificial
  Oligomer
ugaaucuguugugaggagc

SEQ ID NO: 4614 - RNA, 19 nt, artificial
  Oligomer
uugcuuuagaaaauguaaa

SEQ ID NO: 4615 - RNA, 19 nt, artificial
  Oligomer
aucugcugcuguugccuag

SEQ ID NO: 4616 - RNA, 19 nt, artificial
  Oligomer
caugauuuugcuguagucg

SEQ ID NO: 4617 - RNA, 19 nt, artificial
  Oligomer
aacccauucaguuuuccuu

SEQ ID NO: 4618 - RNA, 19 nt, artificial
  Oligomer
uccauccaucacuaucagc

SEQ ID NO: 4619 - RNA, 19 nt, artificial
  Oligomer
uaaagugagcaccauuaag

SEQ ID NO: 4620 - RNA, 19 nt, artificial
  Oligomer
cuuuucuucaccacacuau

SEQ ID NO: 4621 - RNA, 19 nt, artificial
  Oligomer
acaacaucucgacagguug

SEQ ID NO: 4622 - RNA, 19 nt, artificial
  Oligomer
ugguguuuccauuguccac

SEQ ID NO: 4623 - RNA, 19 nt, artificial
  Oligomer
ugcuaaagugagcaccauu

SEQ ID NO: 4624 - RNA, 19 nt, artificial
  Oligomer
uggguaugucccauagcuu

SEQ ID NO: 4625 - RNA, 19 nt, artificial
  Oligomer
ucuauuucagcagacagau

SEQ ID NO: 4626 - RNA, 19 nt, artificial
  Oligomer
uccauguugcgcuuauuua

SEQ ID NO: 4627 - RNA, 19 nt, artificial
  Oligomer
auucaguuuuccuuucuuu

SEQ ID NO: 4628 - RNA, 19 nt, artificial
  Oligomer
ugguaauucuuagguggug

SEQ ID NO: 4629 - RNA, 19 nt, artificial
  Oligomer
ucacacccagcuuuuccug

SEQ ID NO: 4630 - RNA, 19 nt, artificial
  Oligomer
cauaguucggguagcuuug

SEQ ID NO: 4631 - RNA, 19 nt, artificial
  Oligomer
ugaguguccgauucgguga

SEQ ID NO: 4632 - RNA, 19 nt, artificial
  Oligomer
auccagcaggaacuucacg

SEQ ID NO: 4633 - RNA, 19 nt, artificial
  Oligomer
ugacuuauuuaaggcgcug

SEQ ID NO: 4634 - RNA, 19 nt, artificial
  Oligomer
agguacauggaguauaugg

SEQ ID NO: 4635 - RNA, 19 nt, artificial
  Oligomer
ucagucucgcuuucguccu

SEQ ID NO: 4636 - RNA, 19 nt, artificial
  Oligomer
uuaauaucaucggcaucau

SEQ ID NO: 4637 - RNA, 19 nt, artificial
  Oligomer
uauggaacuugaauucacu

SEQ ID NO: 4638 - RNA, 19 nt, artificial
  Oligomer
aauguaaacgcuguuccuu

SEQ ID NO: 4639 - RNA, 19 nt, artificial
  Oligomer
uguagucgacuuguccucu

SEQ ID NO: 4640 - RNA, 19 nt, artificial
  Oligomer
uugacaccaaaauccagca

SEQ ID NO: 4641 - RNA, 19 nt, artificial
  Oligomer
ugaucaaaggguaugggac

SEQ ID NO: 4642 - RNA, 19 nt, artificial
  Oligomer
uaugaucaaaggguauggg

SEQ ID NO: 4643 - RNA, 19 nt, artificial
  Oligomer
acuuuaccaaucucgaugc

SEQ ID NO: 4644 - RNA, 19 nt, artificial
  Oligomer
aaauccagcaggaacuuca

SEQ ID NO: 4645 - RNA, 19 nt, artificial
  Oligomer
agcauuugaggcaauacug

SEQ ID NO: 4646 - RNA, 19 nt, artificial
  Oligomer
aagaaaacaguuaauauca

SEQ ID NO: 4647 - RNA, 19 nt, artificial
  Oligomer
uccaggucugcaucacucu

SEQ ID NO: 4648 - RNA, 19 nt, artificial
  Oligomer
ucuagucaaaaaauacuuu

SEQ ID NO: 4649 - RNA, 19 nt, artificial
  Oligomer
ugaggaagaugauauugaa

SEQ ID NO: 4650 - RNA, 19 nt, artificial
  Oligomer
caaccuuaauucagcugaa

SEQ ID NO: 4651 - RNA, 19 nt, artificial
  Oligomer
gcuaauuguucauaaucaa

SEQ ID NO: 4652 - RNA, 19 nt, artificial
  Oligomer
aaagcaucuugaagaaaaa

SEQ ID NO: 4653 - RNA, 19 nt, artificial
  Oligomer
aaaagaauagacacuaaaa

SEQ ID NO: 4654 - RNA, 19 nt, artificial
  Oligomer
acacgagcgucaugaagaa

SEQ ID NO: 4655 - RNA, 19 nt, artificial
  Oligomer
ggaacacgagcgucaugaa

SEQ ID NO: 4656 - RNA, 19 nt, artificial
  Oligomer
cagguugucuacuaaagaa

SEQ ID NO: 4657 - RNA, 19 nt, artificial
  Oligomer
cguuccuaauuuaguaaaa

SEQ ID NO: 4658 - RNA, 19 nt, artificial
  Oligomer
ccaaggaguuccucuuuaa

SEQ ID NO: 4659 - RNA, 19 nt, artificial
  Oligomer
ggaagaugauauugaaaga

SEQ ID NO: 4660 - RNA, 19 nt, artificial
  Oligomer
ggguuuguccaaaauaaau

SEQ ID NO: 4661 - RNA, 19 nt, artificial
  Oligomer
gggcauauucucugcagaa

SEQ ID NO: 4662 - RNA, 19 nt, artificial
  Oligomer
cugcauuggugaauuuaau

SEQ ID NO: 4663 - RNA, 19 nt, artificial
  Oligomer
gcuuuugcauuauaaggaa

SEQ ID NO: 4664 - RNA, 19 nt, artificial
  Oligomer
aaaucauguugaucuauaa

SEQ ID NO: 4665 - RNA, 19 nt, artificial
  Oligomer
gaaugaauaacauugauaa

SEQ ID NO: 4666 - RNA, 19 nt, artificial
  Oligomer
ccucgguuucuauuuauaa

SEQ ID NO: 4667 - RNA, 19 nt, artificial
  Oligomer
gugaaaauuugguaguaaa

SEQ ID NO: 4668 - RNA, 19 nt, artificial
  Oligomer
gaugcagguugucuacuaa

SEQ ID NO: 4669 - RNA, 19 nt, artificial
  Oligomer
cagcuuuauucuaagcaaa

SEQ ID NO: 4670 - RNA, 19 nt, artificial
  Oligomer
caaggaguuccucuuuaaa

SEQ ID NO: 4671 - RNA, 19 nt, artificial
  Oligomer
cugcguuccuaauuuagua

SEQ ID NO: 4672 - RNA, 19 nt, artificial
  Oligomer
uguucauaaucaacagaaa

SEQ ID NO: 4673 - RNA, 19 nt, artificial
  Oligomer
gaggaagaugauauugaaa

SEQ ID NO: 4674 - RNA, 19 nt, artificial
  Oligomer
uggagacauggaaaaaaua

SEQ ID NO: 4675 - RNA, 19 nt, artificial
  Oligomer
gaaagcaucuugaagaaaa

SEQ ID NO: 4676 - RNA, 19 nt, artificial
  Oligomer
aaauuaucugcaaccuuaa

SEQ ID NO: 4677 - RNA, 19 nt, artificial
  Oligomer
ggaugcagguugucuacua

SEQ ID NO: 4678 - RNA, 19 nt, artificial
  Oligomer
aaguugaaagcaucuugaa

SEQ ID NO: 4679 - RNA, 19 nt, artificial
  Oligomer
auaaaagaauagacacuaa

SEQ ID NO: 4680 - RNA, 19 nt, artificial
  Oligomer
gcagguugucuacuaaaga

SEQ ID NO: 4681 - RNA, 19 nt, artificial
  Oligomer
gccucgguuucuauuuaua

SEQ ID NO: 4682 - RNA, 19 nt, artificial
  Oligomer
gcauuauaaggaauuaagu

SEQ ID NO: 4683 - RNA, 19 nt, artificial
  Oligomer
acaccuaugggaucaauaa

SEQ ID NO: 4684 - RNA, 19 nt, artificial
  Oligomer
cuaugcuaauuguucauaa

SEQ ID NO: 4685 - RNA, 19 nt, artificial
  Oligomer
gaauagacacuaaaaucau

SEQ ID NO: 4686 - RNA, 19 nt, artificial
  Oligomer
caacagaaaccaagauaga

SEQ ID NO: 4687 - RNA, 19 nt, artificial
  Oligomer
gauuaaugucuacugugaa

SEQ ID NO: 4688 - RNA, 19 nt, artificial
  Oligomer
aaagaauagacacuaaaau

SEQ ID NO: 4689 - RNA, 19 nt, artificial
  Oligomer
ccuuauauaucacacuauu

SEQ ID NO: 4690 - RNA, 19 nt, artificial
  Oligomer
cagggcuucugaaacagau

SEQ ID NO: 4691 - RNA, 19 nt, artificial
  Oligomer
ccauagcauuggagagaaa

SEQ ID NO: 4692 - RNA, 19 nt, artificial
  Oligomer
gguuuguccaaaauaaaua

SEQ ID NO: 4693 - RNA, 19 nt, artificial
  Oligomer
gaaguugaaagcaucuuga

SEQ ID NO: 4694 - RNA, 19 nt, artificial
  Oligomer
aagaaggaaagaaguugaa

SEQ ID NO: 4695 - RNA, 19 nt, artificial
  Oligomer
uaaaagaauagacacuaaa

SEQ ID NO: 4696 - RNA, 19 nt, artificial
  Oligomer
ucugcauuggugaauuuaa

SEQ ID NO: 4697 - RNA, 19 nt, artificial
  Oligomer
cacuauuguagaaaguauu

SEQ ID NO: 4698 - RNA, 19 nt, artificial
  Oligomer
gaaguacuuuauauuucaa

SEQ ID NO: 4699 - RNA, 19 nt, artificial
  Oligomer
caacauagcucacugaaga

SEQ ID NO: 4700 - RNA, 19 nt, artificial
  Oligomer
cuaaaaucauguugaucua

SEQ ID NO: 4701 - RNA, 19 nt, artificial
  Oligomer
ggaauuaagucuccgauua

SEQ ID NO: 4702 - RNA, 19 nt, artificial
  Oligomer
acacuauuguagaaaguau

SEQ ID NO: 4703 - RNA, 19 nt, artificial
  Oligomer
ggaaagaaguugaaagcau

SEQ ID NO: 4704 - RNA, 19 nt, artificial
  Oligomer
cucgguuucuauuuauaau

SEQ ID NO: 4705 - RNA, 19 nt, artificial
  Oligomer
cauaaucaacagaaaccaa

SEQ ID NO: 4706 - RNA, 19 nt, artificial
  Oligomer
cagcugaaguacuuuauau

SEQ ID NO: 4707 - RNA, 19 nt, artificial
  Oligomer
cagccucgguuucuauuua

SEQ ID NO: 4708 - RNA, 19 nt, artificial
  Oligomer
aggugaucacccuggauga

SEQ ID NO: 4709 - RNA, 19 nt, artificial
  Oligomer
cagaauuucugaaaguuuu

SEQ ID NO: 4710 - RNA, 19 nt, artificial
  Oligomer
aaaccaagauagagcuaca

SEQ ID NO: 4711 - RNA, 19 nt, artificial
  Oligomer
gaauuaagucuccgauuau

SEQ ID NO: 4712 - RNA, 19 nt, artificial
  Oligomer
ggccuuauauaucacacua

SEQ ID NO: 4713 - RNA, 19 nt, artificial
  Oligomer
acacuaaaaucauguugau

SEQ ID NO: 4714 - RNA, 19 nt, artificial
  Oligomer
ccuuaauucagcugaagua

SEQ ID NO: 4715 - RNA, 19 nt, artificial
  Oligomer
guacaguucguacacuaaa

SEQ ID NO: 4716 - RNA, 19 nt, artificial
  Oligomer
caagucggccggaaaauau

SEQ ID NO: 4717 - RNA, 19 nt, artificial
  Oligomer
aauaaaaucgcuacuuuaa

SEQ ID NO: 4718 - RNA, 19 nt, artificial
  Oligomer
aacucuucuugcuuuugca

SEQ ID NO: 4719 - RNA, 19 nt, artificial
  Oligomer
caacagggcuucugaaaca

SEQ ID NO: 4720 - RNA, 19 nt, artificial
  Oligomer
ugaucaguuuucugcugaa

SEQ ID NO: 4721 - RNA, 19 nt, artificial
  Oligomer
uugaaagcaucuugaagaa

SEQ ID NO: 4722 - RNA, 19 nt, artificial
  Oligomer
agguugucuacuaaagaaa

SEQ ID NO: 4723 - RNA, 19 nt, artificial
  Oligomer
aaagaaggaaagaaguuga

SEQ ID NO: 4724 - RNA, 19 nt, artificial
  Oligomer
ggguagaacugcacuucag

SEQ ID NO: 4725 - RNA, 19 nt, artificial
  Oligomer
agaaggaaagaaguugaaa

SEQ ID NO: 4726 - RNA, 19 nt, artificial
  Oligomer
gaugauauugaaagaagga

SEQ ID NO: 4727 - RNA, 19 nt, artificial
  Oligomer
agcaccuuuugaugaagaa

SEQ ID NO: 4728 - RNA, 19 nt, artificial
  Oligomer
uaauaaaaucgcuacuuua

SEQ ID NO: 4729 - RNA, 19 nt, artificial
  Oligomer
auagcauuggagagaaaaa

SEQ ID NO: 4730 - RNA, 19 nt, artificial
  Oligomer
gaaggcaccuacucaguau

SEQ ID NO: 4731 - RNA, 19 nt, artificial
  Oligomer
agggcuucugaaacagaua

SEQ ID NO: 4732 - RNA, 19 nt, artificial
  Oligomer
ccaagagcucucacuguga

SEQ ID NO: 4733 - RNA, 19 nt, artificial
  Oligomer
guaaaugcugcguuccuaa

SEQ ID NO: 4734 - RNA, 19 nt, artificial
  Oligomer
ucauguugaucuauaauua

SEQ ID NO: 4735 - RNA, 19 nt, artificial
  Oligomer
ugauauugaaagaaggaaa

SEQ ID NO: 4736 - RNA, 19 nt, artificial
  Oligomer
ucuugcuuuugcauuauaa

SEQ ID NO: 4737 - RNA, 19 nt, artificial
  Oligomer
guguuuauuuguucuguaa

SEQ ID NO: 4738 - RNA, 19 nt, artificial
  Oligomer
ucagcuuuauucuaagcaa

SEQ ID NO: 4739 - RNA, 19 nt, artificial
  Oligomer
aggaguuccucuuuaaaca

SEQ ID NO: 4740 - RNA, 19 nt, artificial
  Oligomer
aagucggccggaaaauauu

SEQ ID NO: 4741 - RNA, 19 nt, artificial
  Oligomer
guugaaagcaucuugaaga

SEQ ID NO: 4742 - RNA, 19 nt, artificial
  Oligomer
guucguuaguggauuacuu

SEQ ID NO: 4743 - RNA, 19 nt, artificial
  Oligomer
cagcucacagucugaggaa

SEQ ID NO: 4744 - RNA, 19 nt, artificial
  Oligomer
uggaaaaaauacugcugga

SEQ ID NO: 4745 - RNA, 19 nt, artificial
  Oligomer
auaucacacuauuguagaa

SEQ ID NO: 4746 - RNA, 19 nt, artificial
  Oligomer
caucuugaagaaaaacuca

SEQ ID NO: 4747 - RNA, 19 nt, artificial
  Oligomer
agcaugucagacugauuaa

SEQ ID NO: 4748 - RNA, 19 nt, artificial
  Oligomer
auggagacauggaaaaaau

SEQ ID NO: 4749 - RNA, 19 nt, artificial
  Oligomer
cacugaagagcuguuagau

SEQ ID NO: 4750 - RNA, 19 nt, artificial
  Oligomer
uaccaacagggcuucugaa

SEQ ID NO: 4751 - RNA, 19 nt, artificial
  Oligomer
gaucuauaauuacaccuau

SEQ ID NO: 4752 - RNA, 19 nt, artificial
  Oligomer
guugucuacuaaagaaaga

SEQ ID NO: 4753 - RNA, 19 nt, artificial
  Oligomer
ucaaaagaaugaauaacau

SEQ ID NO: 4754 - RNA, 19 nt, artificial
  Oligomer
cgagcgucaugaagaaagg

SEQ ID NO: 4755 - RNA, 19 nt, artificial
  Oligomer
ugcugaaggcaccuacuca

SEQ ID NO: 4756 - RNA, 19 nt, artificial
  Oligomer
gcaccuacucaguaucuuu

SEQ ID NO: 4757 - RNA, 19 nt, artificial
  Oligomer
aaaauuaucugcaaccuua

SEQ ID NO: 4758 - RNA, 19 nt, artificial
  Oligomer
cagucugaggaagaugaua

SEQ ID NO: 4759 - RNA, 19 nt, artificial
  Oligomer
ucagcugaaguacuuuaua

SEQ ID NO: 4760 - RNA, 19 nt, artificial
  Oligomer
uggauaugggauuggucaa

SEQ ID NO: 4761 - RNA, 19 nt, artificial
  Oligomer
acuauuguagaaaguauua

SEQ ID NO: 4762 - RNA, 19 nt, artificial
  Oligomer
ugcuaauuguucauaauca

SEQ ID NO: 4763 - RNA, 19 nt, artificial
  Oligomer
gccuuauauaucacacuau

SEQ ID NO: 4764 - RNA, 19 nt, artificial
  Oligomer
cauugauaauaaaaucgcu

SEQ ID NO: 4765 - RNA, 19 nt, artificial
  Oligomer
guuuguccaaaauaaauau

SEQ ID NO: 4766 - RNA, 19 nt, artificial
  Oligomer
gaacugcacuucagcaaua

SEQ ID NO: 4767 - RNA, 19 nt, artificial
  Oligomer
guucguacacuaaacucuu

SEQ ID NO: 4768 - RNA, 19 nt, artificial
  Oligomer
aagaaugaauaacauugau

SEQ ID NO: 4769 - RNA, 19 nt, artificial
  Oligomer
guuaguggauuacuucuga

SEQ ID NO: 4770 - RNA, 19 nt, artificial
  Oligomer
gaucaauaagcaugucaga

SEQ ID NO: 4771 - RNA, 19 nt, artificial
  Oligomer
ccaagauagagcuacaaac

SEQ ID NO: 4772 - RNA, 19 nt, artificial
  Oligomer
cuacuaaagaaagauuaua

SEQ ID NO: 4773 - RNA, 19 nt, artificial
  Oligomer
ugaucacccuggaugauca

SEQ ID NO: 4774 - RNA, 19 nt, artificial
  Oligomer
aauggagacauggaaaaaa

SEQ ID NO: 4775 - RNA, 19 nt, artificial
  Oligomer
uggguagaacugcacuuca

SEQ ID NO: 4776 - RNA, 19 nt, artificial
  Oligomer
agaauagacacuaaaauca

SEQ ID NO: 4777 - RNA, 19 nt, artificial
  Oligomer
caagauagagcuacaaacu

SEQ ID NO: 4778 - RNA, 19 nt, artificial
  Oligomer
agauagagcuacaaacuca

SEQ ID NO: 4779 - RNA, 19 nt, artificial
  Oligomer
ugaaguacuuuauauuuca

SEQ ID NO: 4780 - RNA, 19 nt, artificial
  Oligomer
gguuucuauuuauaaugga

SEQ ID NO: 4781 - RNA, 19 nt, artificial
  Oligomer
uaugcuaauuguucauaau

SEQ ID NO: 4782 - RNA, 19 nt, artificial
  Oligomer
uguccaaaauaaauauugu

SEQ ID NO: 4783 - RNA, 19 nt, artificial
  Oligomer
aauggaugcagguugucua

SEQ ID NO: 4784 - RNA, 19 nt, artificial
  Oligomer
uguacaguucguacacuaa

SEQ ID NO: 4785 - RNA, 19 nt, artificial
  Oligomer
cacccuggaugaucaguuu

SEQ ID NO: 4786 - RNA, 19 nt, artificial
  Oligomer
accaagauagagcuacaaa

SEQ ID NO: 4787 - RNA, 19 nt, artificial
  Oligomer
auuggaaggcgucugacaa

SEQ ID NO: 4788 - RNA, 19 nt, artificial
  Oligomer
ugaggaacacgagcgucau

SEQ ID NO: 4789 - RNA, 19 nt, artificial
  Oligomer
gcuuuuaaaaucagcuuua

SEQ ID NO: 4790 - RNA, 19 nt, artificial
  Oligomer
gagagaaaaacagcucaca

SEQ ID NO: 4791 - RNA, 19 nt, artificial
  Oligomer
cuguacaguucguacacua

SEQ ID NO: 4792 - RNA, 19 nt, artificial
  Oligomer
cccaaggaguuccucuuua

SEQ ID NO: 4793 - RNA, 19 nt, artificial
  Oligomer
gagacauggaaaaaauacu

SEQ ID NO: 4794 - RNA, 19 nt, artificial
  Oligomer
aaccaagauagagcuacaa

SEQ ID NO: 4795 - RNA, 19 nt, artificial
  Oligomer
gaagaugauauugaaagaa

SEQ ID NO: 4796 - RNA, 19 nt, artificial
  Oligomer
gcauauucucugcagaauu

SEQ ID NO: 4797 - RNA, 19 nt, artificial
  Oligomer
accagcaccuuuugaugaa

SEQ ID NO: 4798 - RNA, 19 nt, artificial
  Oligomer
aaagaaugaauaacauuga

SEQ ID NO: 4799 - RNA, 19 nt, artificial
  Oligomer
gaaaaacucagauuggaua

SEQ ID NO: 4800 - RNA, 19 nt, artificial
  Oligomer
augcagguugucuacuaaa

SEQ ID NO: 4801 - RNA, 19 nt, artificial
  Oligomer
cugugaaaauuugguagua

SEQ ID NO: 4802 - RNA, 19 nt, artificial
  Oligomer
cacgagcgucaugaagaaa

SEQ ID NO: 4803 - RNA, 19 nt, artificial
  Oligomer
gguugucuacuaaagaaag

SEQ ID NO: 4804 - RNA, 19 nt, artificial
  Oligomer
ggcauauucucugcagaau

SEQ ID NO: 4805 - RNA, 19 nt, artificial
  Oligomer
ucuucuugcuuuugcauua

SEQ ID NO: 4806 - RNA, 19 nt, artificial
  Oligomer
caugagucuggacggagua

SEQ ID NO: 4807 - RNA, 19 nt, artificial
  Oligomer
cuucugagcuugcaacaua

SEQ ID NO: 4808 - RNA, 19 nt, artificial
  Oligomer
cauauucucugcagaauuu

SEQ ID NO: 4809 - RNA, 19 nt, artificial
  Oligomer
uuauaauggagacauggaa

SEQ ID NO: 4810 - RNA, 19 nt, artificial
  Oligomer
cuuuuaaaaucagcuuuau

SEQ ID NO: 4811 - RNA, 19 nt, artificial
  Oligomer
guaguaaauuuucauuuga

SEQ ID NO: 4812 - RNA, 19 nt, artificial
  Oligomer
gagaaaaacagcucacagu

SEQ ID NO: 4813 - RNA, 19 nt, artificial
  Oligomer
ccuaugggaucaauaagca

SEQ ID NO: 4814 - RNA, 19 nt, artificial
  Oligomer
cccauagcauuggagagaa

SEQ ID NO: 4815 - RNA, 19 nt, artificial
  Oligomer
uugcauuauaaggaauuaa

SEQ ID NO: 4816 - RNA, 19 nt, artificial
  Oligomer
gcguuccuaauuuaguaaa

SEQ ID NO: 4817 - RNA, 19 nt, artificial
  Oligomer
uauauaucacacuauugua

SEQ ID NO: 4818 - RNA, 19 nt, artificial
  Oligomer
gcagaauuucugaaaguuu

SEQ ID NO: 4819 - RNA, 19 nt, artificial
  Oligomer
gucuacuaaagaaagauua

SEQ ID NO: 4820 - RNA, 19 nt, artificial
  Oligomer
aaaacagcucacagucuga

SEQ ID NO: 4821 - RNA, 19 nt, artificial
  Oligomer
cacagucugaggaagauga

SEQ ID NO: 4822 - RNA, 19 nt, artificial
  Oligomer
cuacaaacucagcuguaca

SEQ ID NO: 4823 - RNA, 19 nt, artificial
  Oligomer
gucugaggaagaugauauu

SEQ ID NO: 4824 - RNA, 19 nt, artificial
  Oligomer
uaaucaacagaaaccaaga

SEQ ID NO: 4825 - RNA, 19 nt, artificial
  Oligomer
aagaaaaacucagauugga

SEQ ID NO: 4826 - RNA, 19 nt, artificial
  Oligomer
ugauuaaugucuacuguga

SEQ ID NO: 4827 - RNA, 19 nt, artificial
  Oligomer
uaacuaugcuaauuguuca

SEQ ID NO: 4828 - RNA, 19 nt, artificial
  Oligomer
ccuggaugaucaguuuucu

SEQ ID NO: 4829 - RNA, 19 nt, artificial
  Oligomer
cacacuauuguagaaagua

SEQ ID NO: 4830 - RNA, 19 nt, artificial
  Oligomer
cucugcagaauuucugaaa

SEQ ID NO: 4831 - RNA, 19 nt, artificial
  Oligomer
ggaugaucaguuuucugcu

SEQ ID NO: 4832 - RNA, 19 nt, artificial
  Oligomer
acugcacuucagcaauaau

SEQ ID NO: 4833 - RNA, 19 nt, artificial
  Oligomer
guuccagccucgguuucua

SEQ ID NO: 4834 - RNA, 19 nt, artificial
  Oligomer
gacacuaaaaucauguuga

SEQ ID NO: 4835 - RNA, 19 nt, artificial
  Oligomer
agcugaaguacuuuauauu

SEQ ID NO: 4836 - RNA, 19 nt, artificial
  Oligomer
guuuauuuguucuguaaau

SEQ ID NO: 4837 - RNA, 19 nt, artificial
  Oligomer
ugugaaaauuugguaguaa

SEQ ID NO: 4838 - RNA, 19 nt, artificial
  Oligomer
aacugcacuucagcaauaa

SEQ ID NO: 4839 - RNA, 19 nt, artificial
  Oligomer
cauagcauuggagagaaaa

SEQ ID NO: 4840 - RNA, 19 nt, artificial
  Oligomer
cucacagucugaggaagau

SEQ ID NO: 4841 - RNA, 19 nt, artificial
  Oligomer
ucuacuaaagaaagauuau

SEQ ID NO: 4842 - RNA, 19 nt, artificial
  Oligomer
gcucacagucugaggaaga

SEQ ID NO: 4843 - RNA, 19 nt, artificial
  Oligomer
ccuggguagaacugcacuu

SEQ ID NO: 4844 - RNA, 19 nt, artificial
  Oligomer
guuccuaauuuaguaaaau

SEQ ID NO: 4845 - RNA, 19 nt, artificial
  Oligomer
agccucgguuucuauuuau

SEQ ID NO: 4846 - RNA, 19 nt, artificial
  Oligomer
ugaaaauuugguaguaaau

SEQ ID NO: 4847 - RNA, 19 nt, artificial
  Oligomer
agcauuggagagaaaaaca

SEQ ID NO: 4848 - RNA, 19 nt, artificial
  Oligomer
gaaagaaguugaaagcauc

SEQ ID NO: 4849 - RNA, 19 nt, artificial
  Oligomer
agucugacuugguucguua

SEQ ID NO: 4850 - RNA, 19 nt, artificial
  Oligomer
auaccaacagggcuucuga

SEQ ID NO: 4851 - RNA, 19 nt, artificial
  Oligomer
caguaucuuuuccucuuua

SEQ ID NO: 4852 - RNA, 19 nt, artificial
  Oligomer
gaaggaaagaaguugaaag

SEQ ID NO: 4853 - RNA, 19 nt, artificial
  Oligomer
agaugauauugaaagaagg

SEQ ID NO: 4854 - RNA, 19 nt, artificial
  Oligomer
ucuugaagaaaaacucaga

SEQ ID NO: 4855 - RNA, 19 nt, artificial
  Oligomer
uaauggagacauggaaaaa

SEQ ID NO: 4856 - RNA, 19 nt, artificial
  Oligomer
cguacacuaaacucuucuu

SEQ ID NO: 4857 - RNA, 19 nt, artificial
  Oligomer
cugaaaguuuuccuuccau

SEQ ID NO: 4858 - RNA, 19 nt, artificial
  Oligomer
acuucagcaauaaugggaa

SEQ ID NO: 4859 - RNA, 19 nt, artificial
  Oligomer
gaaacagauacccauagca

SEQ ID NO: 4860 - RNA, 19 nt, artificial
  Oligomer
ucaagucggccggaaaaua

SEQ ID NO: 4861 - RNA, 19 nt, artificial
  Oligomer
gcugcguuccuaauuuagu

SEQ ID NO: 4862 - RNA, 19 nt, artificial
  Oligomer
gcaugucagacugauuaau

SEQ ID NO: 4863 - RNA, 19 nt, artificial
  Oligomer
uccucuuuaaacacccgaa

SEQ ID NO: 4864 - RNA, 19 nt, artificial
  Oligomer
cugcaaccuuaauucagcu

SEQ ID NO: 4865 - RNA, 19 nt, artificial
  Oligomer
caaaagaaugaauaacauu

SEQ ID NO: 4866 - RNA, 19 nt, artificial
  Oligomer
cagcuguacaguucguaca

SEQ ID NO: 4867 - RNA, 19 nt, artificial
  Oligomer
cucagcaugaggaacacga

SEQ ID NO: 4868 - RNA, 19 nt, artificial
  Oligomer
ucagcaugaggaacacgag

SEQ ID NO: 4869 - RNA, 19 nt, artificial
  Oligomer
cagcaccuuuugaugaaga

SEQ ID NO: 4870 - RNA, 19 nt, artificial
  Oligomer
ggugaucacccuggaugau

SEQ ID NO: 4871 - RNA, 19 nt, artificial
  Oligomer
cagacugauuaaugucuac

SEQ ID NO: 4872 - RNA, 19 nt, artificial
  Oligomer
agaaaaacucagauuggau

SEQ ID NO: 4873 - RNA, 19 nt, artificial
  Oligomer
cugaggaagaugauauuga

SEQ ID NO: 4874 - RNA, 19 nt, artificial
  Oligomer
aauuaucugcaaccuuaau

SEQ ID NO: 4875 - RNA, 19 nt, artificial
  Oligomer
cugcagaauuucugaaagu

SEQ ID NO: 4876 - RNA, 19 nt, artificial
  Oligomer
gauuauauauaacuaugcu

SEQ ID NO: 4877 - RNA, 19 nt, artificial
  Oligomer
caucucugcugcucucuca

SEQ ID NO: 4878 - RNA, 19 nt, artificial
  Oligomer
ggcaccuacucaguaucuu

SEQ ID NO: 4879 - RNA, 19 nt, artificial
  Oligomer
ucgcagacaccacaagaua

SEQ ID NO: 4880 - RNA, 19 nt, artificial
  Oligomer
ugaaggcaccuacucagua

SEQ ID NO: 4881 - RNA, 19 nt, artificial
  Oligomer
gaaaguuuuccuuccaucu

SEQ ID NO: 4882 - RNA, 19 nt, artificial
  Oligomer
uauaauggagacauggaaa

SEQ ID NO: 4883 - RNA, 19 nt, artificial
  Oligomer
uuugcauuauaaggaauua

SEQ ID NO: 4884 - RNA, 19 nt, artificial
  Oligomer
aacacgagcgucaugaaga

SEQ ID NO: 4885 - RNA, 19 nt, artificial
  Oligomer
cuaugggaucaauaagcau

SEQ ID NO: 4886 - RNA, 19 nt, artificial
  Oligomer
auuaaugucuacugugaaa

SEQ ID NO: 4887 - RNA, 19 nt, artificial
  Oligomer
gauuacuucugagcuugca

SEQ ID NO: 4888 - RNA, 19 nt, artificial
  Oligomer
cuugaagaaaaacucagau

SEQ ID NO: 4889 - RNA, 19 nt, artificial
  Oligomer
cagacaccacaagauacca

SEQ ID NO: 4890 - RNA, 19 nt, artificial
  Oligomer
gauagagcuacaaacucag

SEQ ID NO: 4891 - RNA, 19 nt, artificial
  Oligomer
acagucugaggaagaugau

SEQ ID NO: 4892 - RNA, 19 nt, artificial
  Oligomer
guggauuacuucugagcuu

SEQ ID NO: 4893 - RNA, 19 nt, artificial
  Oligomer
augcugcguuccuaauuua

SEQ ID NO: 4894 - RNA, 19 nt, artificial
  Oligomer
guaaaauaaaagaauagac

SEQ ID NO: 4895 - RNA, 19 nt, artificial
  Oligomer
ucagacugauuaaugucua

SEQ ID NO: 4896 - RNA, 19 nt, artificial
  Oligomer
gacuugguucguuagugga

SEQ ID NO: 4897 - RNA, 19 nt, artificial
  Oligomer
cuauuguagaaaguauuau

SEQ ID NO: 4898 - RNA, 19 nt, artificial
  Oligomer
gcugaaguacuuuauauuu

SEQ ID NO: 4899 - RNA, 19 nt, artificial
  Oligomer
aaaaucagcuuuauucuaa

SEQ ID NO: 4900 - RNA, 19 nt, artificial
  Oligomer
uguaaaugcugcguuccua

SEQ ID NO: 4901 - RNA, 19 nt, artificial
  Oligomer
accaacagggcuucugaaa

SEQ ID NO: 4902 - RNA, 19 nt, artificial
  Oligomer
uauugaaagaaggaaagaa

SEQ ID NO: 4903 - RNA, 19 nt, artificial
  Oligomer
ucugcugaaggcaccuacu

SEQ ID NO: 4904 - RNA, 19 nt, artificial
  Oligomer
aggaaagaaguugaaagca

SEQ ID NO: 4905 - RNA, 19 nt, artificial
  Oligomer
agcuacaaacucagcugua

SEQ ID NO: 4906 - RNA, 19 nt, artificial
  Oligomer
cuacugugaaaauuuggua

SEQ ID NO: 4907 - RNA, 19 nt, artificial
  Oligomer
guagaacugcacuucagca

SEQ ID NO: 4908 - RNA, 19 nt, artificial
  Oligomer
agcuuuauucuaagcaaau

SEQ ID NO: 4909 - RNA, 19 nt, artificial
  Oligomer
ugaaagaaggaaagaaguu

SEQ ID NO: 4910 - RNA, 19 nt, artificial
  Oligomer
aaggaauuaagucuccgau

SEQ ID NO: 4911 - RNA, 19 nt, artificial
  Oligomer
ggagacauggaaaaaauac

SEQ ID NO: 4912 - RNA, 19 nt, artificial
  Oligomer
acaccacaagauaccaaca

SEQ ID NO: 4913 - RNA, 19 nt, artificial
  Oligomer
caaacucagcuguacaguu

SEQ ID NO: 4914 - RNA, 19 nt, artificial
  Oligomer
agaaugaauaacauugaua

SEQ ID NO: 4915 - RNA, 19 nt, artificial
  Oligomer
uugaaagaaggaaagaagu

SEQ ID NO: 4916 - RNA, 19 nt, artificial
  Oligomer
acuggagucugacuugguu

SEQ ID NO: 4917 - RNA, 19 nt, artificial
  Oligomer
uaaggaauuaagucuccga

SEQ ID NO: 4918 - RNA, 19 nt, artificial
  Oligomer
caccuaugggaucaauaag

SEQ ID NO: 4919 - RNA, 19 nt, artificial
  Oligomer
uggagagaaaaacagcuca

SEQ ID NO: 4920 - RNA, 19 nt, artificial
  Oligomer
aaauacugcuggacgcaca

SEQ ID NO: 4921 - RNA, 19 nt, artificial
  Oligomer
aggaauuaagucuccgauu

SEQ ID NO: 4922 - RNA, 19 nt, artificial
  Oligomer
ugcguuccuaauuuaguaa

SEQ ID NO: 4923 - RNA, 19 nt, artificial
  Oligomer
aagcaugucagacugauua

SEQ ID NO: 4924 - RNA, 19 nt, artificial
  Oligomer
gagcuugcaacauagcuca

SEQ ID NO: 4925 - RNA, 19 nt, artificial
  Oligomer
aauaaaagaauagacacua

SEQ ID NO: 4926 - RNA, 19 nt, artificial
  Oligomer
ccucuuuaucacucugcau

SEQ ID NO: 4927 - RNA, 19 nt, artificial
  Oligomer
uuaauauacuagucaugau

SEQ ID NO: 4928 - RNA, 19 nt, artificial
  Oligomer
ucacugaagagcuguuaga

SEQ ID NO: 4929 - RNA, 19 nt, artificial
  Oligomer
acagggcuucugaaacaga

SEQ ID NO: 4930 - RNA, 19 nt, artificial
  Oligomer
gaucuauauuggaaggcgu

SEQ ID NO: 4931 - RNA, 19 nt, artificial
  Oligomer
cuucuugcuuuugcauuau

SEQ ID NO: 4932 - RNA, 19 nt, artificial
  Oligomer
aguugaaagcaucuugaag

SEQ ID NO: 4933 - RNA, 19 nt, artificial
  Oligomer
auuugguaguaaauuuuca

SEQ ID NO: 4934 - RNA, 19 nt, artificial
  Oligomer
augaagaacuggagucuga

SEQ ID NO: 4935 - RNA, 19 nt, artificial
  Oligomer
acucagauuggauauggga

SEQ ID NO: 4936 - RNA, 19 nt, artificial
  Oligomer
uguuuauuuguucuguaaa

SEQ ID NO: 4937 - RNA, 19 nt, artificial
  Oligomer
auuacuucugagcuugcaa

SEQ ID NO: 4938 - RNA, 19 nt, artificial
  Oligomer
ugcaacauagcucacugaa

SEQ ID NO: 4939 - RNA, 19 nt, artificial
  Oligomer
auuaggugaucacccugga

SEQ ID NO: 4940 - RNA, 19 nt, artificial
  Oligomer
gcaacauagcucacugaag

SEQ ID NO: 4941 - RNA, 19 nt, artificial
  Oligomer
cucgcagacaccacaagau

SEQ ID NO: 4942 - RNA, 19 nt, artificial
  Oligomer
ugcauuauaaggaauuaag

SEQ ID NO: 4943 - RNA, 19 nt, artificial
  Oligomer
ugcuuuugcauuauaagga

SEQ ID NO: 4944 - RNA, 19 nt, artificial
  Oligomer
ucugaaaguuuuccuucca

SEQ ID NO: 4945 - RNA, 19 nt, artificial
  Oligomer
gaacacgagcgucaugaag

SEQ ID NO: 4946 - RNA, 19 nt, artificial
  Oligomer
cuugcuuuugcauuauaag

SEQ ID NO: 4947 - RNA, 19 nt, artificial
  Oligomer
cgcagacaccacaagauac

SEQ ID NO: 4948 - RNA, 19 nt, artificial
  Oligomer
aauuaagucuccgauuauu

SEQ ID NO: 4949 - RNA, 19 nt, artificial
  Oligomer
augucagacugauuaaugu

SEQ ID NO: 4950 - RNA, 19 nt, artificial
  Oligomer
aaaucagcuuuauucuaag

SEQ ID NO: 4951 - RNA, 19 nt, artificial
  Oligomer
uugguucguuaguggauua

SEQ ID NO: 4952 - RNA, 19 nt, artificial
  Oligomer
aagagcucucacugugaca

SEQ ID NO: 4953 - RNA, 19 nt, artificial
  Oligomer
auaauggagacauggaaaa

SEQ ID NO: 4954 - RNA, 19 nt, artificial
  Oligomer
uucucugcagaauuucuga

SEQ ID NO: 4955 - RNA, 19 nt, artificial
  Oligomer
gauuggauaugggauuggu

SEQ ID NO: 4956 - RNA, 19 nt, artificial
  Oligomer
auauaacuaugcuaauugu

SEQ ID NO: 4957 - RNA, 19 nt, artificial
  Oligomer
auuaagucuccgauuauua

SEQ ID NO: 4958 - RNA, 19 nt, artificial
  Oligomer
cucagauuggauaugggau

SEQ ID NO: 4959 - RNA, 19 nt, artificial
  Oligomer
cucugcauuggugaauuua

SEQ ID NO: 4960 - RNA, 19 nt, artificial
  Oligomer
agagaaaaacagcucacag

SEQ ID NO: 4961 - RNA, 19 nt, artificial
  Oligomer
cuuuugcauuauaaggaau

SEQ ID NO: 4962 - RNA, 19 nt, artificial
  Oligomer
cuccaccagcaccuuuuga

SEQ ID NO: 4963 - RNA, 19 nt, artificial
  Oligomer
cugaaggcaccuacucagu

SEQ ID NO: 4964 - RNA, 19 nt, artificial
  Oligomer
uauuggaaggcgucugaca

SEQ ID NO: 4965 - RNA, 19 nt, artificial
  Oligomer
caccagcaccuuuugauga

SEQ ID NO: 4966 - RNA, 19 nt, artificial
  Oligomer
gaaaaacagcucacagucu

SEQ ID NO: 4967 - RNA, 19 nt, artificial
  Oligomer
uaaugucuacugugaaaau

SEQ ID NO: 4968 - RNA, 19 nt, artificial
  Oligomer
uaaaaucagcuuuauucua

SEQ ID NO: 4969 - RNA, 19 nt, artificial
  Oligomer
caccuacucaguaucuuuu

SEQ ID NO: 4970 - RNA, 19 nt, artificial
  Oligomer
ugaaagcaucuugaagaaa

SEQ ID NO: 4971 - RNA, 19 nt, artificial
  Oligomer
gaagaaaaacucagauugg

SEQ ID NO: 4972 - RNA, 19 nt, artificial
  Oligomer
acacuaaacucuucuugcu

SEQ ID NO: 4973 - RNA, 19 nt, artificial
  Oligomer
uacaccuaugggaucaaua

SEQ ID NO: 4974 - RNA, 19 nt, artificial
  Oligomer
gguucguuaguggauuacu

SEQ ID NO: 4975 - RNA, 19 nt, artificial
  Oligomer
cuaaacucuucuugcuuuu

SEQ ID NO: 4976 - RNA, 19 nt, artificial
  Oligomer
auguugaucuauaauuaca

SEQ ID NO: 4977 - RNA, 19 nt, artificial
  Oligomer
agacaccacaagauaccaa

SEQ ID NO: 4978 - RNA, 19 nt, artificial
  Oligomer
ucugaaacagauacccaua

SEQ ID NO: 4979 - RNA, 19 nt, artificial
  Oligomer
gaagaacuggagucugacu

SEQ ID NO: 4980 - RNA, 19 nt, artificial
  Oligomer
aacagauacccauagcauu

SEQ ID NO: 4981 - RNA, 19 nt, artificial
  Oligomer
ccaccagcaccuuuugaug

SEQ ID NO: 4982 - RNA, 19 nt, artificial
  Oligomer
ggaucaauaagcaugucag

SEQ ID NO: 4983 - RNA, 19 nt, artificial
  Oligomer
gguaguaaauuuucauuug

SEQ ID NO: 4984 - RNA, 19 nt, artificial
  Oligomer
aaaaucauguugaucuaua

SEQ ID NO: 4985 - RNA, 19 nt, artificial
  Oligomer
cacuaaacucuucuugcuu

SEQ ID NO: 4986 - RNA, 19 nt, artificial
  Oligomer
aauagacacuaaaaucaug

SEQ ID NO: 4987 - RNA, 19 nt, artificial
  Oligomer
agaacugcacuucagcaau

SEQ ID NO: 4988 - RNA, 19 nt, artificial
  Oligomer
uccucuuuaucacucugca

SEQ ID NO: 4989 - RNA, 19 nt, artificial
  Oligomer
cauguugaucuauaauuac

SEQ ID NO: 4990 - RNA, 19 nt, artificial
  Oligomer
agauacccauagcauugga

SEQ ID NO: 4991 - RNA, 19 nt, artificial
  Oligomer
gucaagucggccggaaaau

SEQ ID NO: 4992 - RNA, 19 nt, artificial
  Oligomer
uauaauuacaccuauggga

SEQ ID NO: 4993 - RNA, 19 nt, artificial
  Oligomer
gagucugacuugguucguu

SEQ ID NO: 4994 - RNA, 19 nt, artificial
  Oligomer
aaucauguugaucuauaau

SEQ ID NO: 4995 - RNA, 19 nt, artificial
  Oligomer
caagauaccaacagggcuu

SEQ ID NO: 4996 - RNA, 19 nt, artificial
  Oligomer
ugaucuauaauuacaccua

SEQ ID NO: 4997 - RNA, 19 nt, artificial
  Oligomer
cuuuugaugaagaacugga

SEQ ID NO: 4998 - RNA, 19 nt, artificial
  Oligomer
gcaucuugaagaaaaacuc

SEQ ID NO: 4999 - RNA, 19 nt, artificial
  Oligomer
uaucugcaaccuuaauuca

SEQ ID NO: 5000 - RNA, 19 nt, artificial
  Oligomer
aauuguucauaaucaacag

SEQ ID NO: 5001 - RNA, 19 nt, artificial
  Oligomer
caguuuucugcugaaggca

SEQ ID NO: 5002 - RNA, 19 nt, artificial
  Oligomer
aaauaaaagaauagacacu

SEQ ID NO: 5003 - RNA, 19 nt, artificial
  Oligomer
ucucugcagaauuucugaa

SEQ ID NO: 5004 - RNA, 19 nt, artificial
  Oligomer
gcauuggagagaaaaacag

SEQ ID NO: 5005 - RNA, 19 nt, artificial
  Oligomer
ccagccucgguuucuauuu

SEQ ID NO: 5006 - RNA, 19 nt, artificial
  Oligomer
aacuaugcuaauuguucau

SEQ ID NO: 5007 - RNA, 19 nt, artificial
  Oligomer
cuugguucguuaguggauu

SEQ ID NO: 5008 - RNA, 19 nt, artificial
  Oligomer
cgguuucuauuuauaaugg

SEQ ID NO: 5009 - RNA, 19 nt, artificial
  Oligomer
ggagagaaaaacagcucac

SEQ ID NO: 5010 - RNA, 19 nt, artificial
  Oligomer
uaagcaugucagacugauu

SEQ ID NO: 5011 - RNA, 19 nt, artificial
  Oligomer
cauuauaaggaauuaaguc

SEQ ID NO: 5012 - RNA, 19 nt, artificial
  Oligomer
ucacacuauuguagaaagu

SEQ ID NO: 5013 - RNA, 19 nt, artificial
  Oligomer
cagaaaccaagauagagcu

SEQ ID NO: 5014 - RNA, 19 nt, artificial
  Oligomer
augauauugaaagaaggaa

SEQ ID NO: 5015 - RNA, 19 nt, artificial
  Oligomer
cacucugcauuggugaauu

SEQ ID NO: 5016 - RNA, 19 nt, artificial
  Oligomer
acugauuaaugucuacugu

SEQ ID NO: 5017 - RNA, 19 nt, artificial
  Oligomer
ucauaaucaacagaaacca

SEQ ID NO: 5018 - RNA, 19 nt, artificial
  Oligomer
auugaaagaaggaaagaag

SEQ ID NO: 5019 - RNA, 19 nt, artificial
  Oligomer
uucaaaagaaugaauaaca

SEQ ID NO: 5020 - RNA, 19 nt, artificial
  Oligomer
aaagaaguugaaagcaucu

SEQ ID NO: 5021 - RNA, 19 nt, artificial
  Oligomer
ugcagguugucuacuaaag

SEQ ID NO: 5022 - RNA, 19 nt, artificial
  Oligomer
aagaauagacacuaaaauc

SEQ ID NO: 5023 - RNA, 19 nt, artificial
  Oligomer
aaacagauacccauagcau

SEQ ID NO: 5024 - RNA, 19 nt, artificial
  Oligomer
ccucuuuaaacacccgaag

SEQ ID NO: 5025 - RNA, 19 nt, artificial
  Oligomer
uagacacuaaaaucauguu

SEQ ID NO: 5026 - RNA, 19 nt, artificial
  Oligomer
gucuccgauuauuagguga

SEQ ID NO: 5027 - RNA, 19 nt, artificial
  Oligomer
aaguuuuccuuccaucucu

SEQ ID NO: 5028 - RNA, 19 nt, artificial
  Oligomer
uuaggugaucacccuggau

SEQ ID NO: 5029 - RNA, 19 nt, artificial
  Oligomer
gcaaccuuaauucagcuga

SEQ ID NO: 5030 - RNA, 19 nt, artificial
  Oligomer
gggaucaauaagcauguca

SEQ ID NO: 5031 - RNA, 19 nt, artificial
  Oligomer
cauuggugaauuuaauccu

SEQ ID NO: 5032 - RNA, 19 nt, artificial
  Oligomer
aaugcugcguuccuaauuu

SEQ ID NO: 5033 - RNA, 19 nt, artificial
  Oligomer
acucuucuugcuuuugcau

SEQ ID NO: 5034 - RNA, 19 nt, artificial
  Oligomer
aaaaauuaucugcaaccuu

SEQ ID NO: 5035 - RNA, 19 nt, artificial
  Oligomer
aaaauaaaagaauagacac

SEQ ID NO: 5036 - RNA, 19 nt, artificial
  Oligomer
caagagcucucacugugac

SEQ ID NO: 5037 - RNA, 19 nt, artificial
  Oligomer
cuucugaaacagauaccca

SEQ ID NO: 5038 - RNA, 19 nt, artificial
  Oligomer
acagcucacagucugagga

SEQ ID NO: 5039 - RNA, 19 nt, artificial
  Oligomer
gaaaauuugguaguaaauu

SEQ ID NO: 5040 - RNA, 19 nt, artificial
  Oligomer
ugcagaauuucugaaaguu

SEQ ID NO: 5041 - RNA, 19 nt, artificial
  Oligomer
gguagaacugcacuucagc

SEQ ID NO: 5042 - RNA, 19 nt, artificial
  Oligomer
aguucguacacuaaacucu

SEQ ID NO: 5043 - RNA, 19 nt, artificial
  Oligomer
cuccaagagcucucacugu

SEQ ID NO: 5044 - RNA, 19 nt, artificial
  Oligomer
gugcuuuuaaaaucagcuu

SEQ ID NO: 5045 - RNA, 19 nt, artificial
  Oligomer
cuguaaaugcugcguuccu

SEQ ID NO: 5046 - RNA, 19 nt, artificial
  Oligomer
ccagcaccuuuugaugaag

SEQ ID NO: 5047 - RNA, 19 nt, artificial
  Oligomer
cacuucagcaauaauggga

SEQ ID NO: 5048 - RNA, 19 nt, artificial
  Oligomer
aaucaacagaaaccaagau

SEQ ID NO: 5049 - RNA, 19 nt, artificial
  Oligomer
uagaacugcacuucagcaa

SEQ ID NO: 5050 - RNA, 19 nt, artificial
  Oligomer
ccgauuauuaggugaucac

SEQ ID NO: 5051 - RNA, 19 nt, artificial
  Oligomer
uuugguaguaaauuuucau

SEQ ID NO: 5052 - RNA, 19 nt, artificial
  Oligomer
cucaguaucuuuuccucuu

SEQ ID NO: 5053 - RNA, 19 nt, artificial
  Oligomer
uucugaaacagauacccau

SEQ ID NO: 5054 - RNA, 19 nt, artificial
  Oligomer
uuggauaugggauugguca

SEQ ID NO: 5055 - RNA, 19 nt, artificial
  Oligomer
gcucacugaagagcuguua

SEQ ID NO: 5056 - RNA, 19 nt, artificial
  Oligomer
ucguuaguggauuacuucu

SEQ ID NO: 5057 - RNA, 19 nt, artificial
  Oligomer
acuugguucguuaguggau

SEQ ID NO: 5058 - RNA, 19 nt, artificial
  Oligomer
gauauugaaagaaggaaag

SEQ ID NO: 5059 - RNA, 19 nt, artificial
  Oligomer
ccaacagggcuucugaaac

SEQ ID NO: 5060 - RNA, 19 nt, artificial
  Oligomer
uaauucagcugaaguacuu

SEQ ID NO: 5061 - RNA, 19 nt, artificial
  Oligomer
uucuugcuuuugcauuaua

SEQ ID NO: 5062 - RNA, 19 nt, artificial
  Oligomer
gaucacccuggaugaucag

SEQ ID NO: 5063 - RNA, 19 nt, artificial
  Oligomer
accuuaauucagcugaagu

SEQ ID NO: 5064 - RNA, 19 nt, artificial
  Oligomer
aguaucuuuuccucuuuau

SEQ ID NO: 5065 - RNA, 19 nt, artificial
  Oligomer
uacaguucguacacuaaac

SEQ ID NO: 5066 - RNA, 19 nt, artificial
  Oligomer
cagcaauaaugggaacggg

SEQ ID NO: 5067 - RNA, 19 nt, artificial
  Oligomer
gcuacaaacucagcuguac

SEQ ID NO: 5068 - RNA, 19 nt, artificial
  Oligomer
ugucuacuaaagaaagauu

SEQ ID NO: 5069 - RNA, 19 nt, artificial
  Oligomer
ggaguuccucuuuaaacac

SEQ ID NO: 5070 - RNA, 19 nt, artificial
  Oligomer
gagcuacaaacucagcugu

SEQ ID NO: 5071 - RNA, 19 nt, artificial
  Oligomer
augaggaacacgagcguca

SEQ ID NO: 5072 - RNA, 19 nt, artificial
  Oligomer
caccuuuugaugaagaacu

SEQ ID NO: 5073 - RNA, 19 nt, artificial
  Oligomer
ugaagagcuguuagauccu

SEQ ID NO: 5074 - RNA, 19 nt, artificial
  Oligomer
ccacaagauaccaacaggg

SEQ ID NO: 5075 - RNA, 19 nt, artificial
  Oligomer
cguuaguggauuacuucug

SEQ ID NO: 5076 - RNA, 19 nt, artificial
  Oligomer
acucugcauuggugaauuu

SEQ ID NO: 5077 - RNA, 19 nt, artificial
  Oligomer
uccgauuauuaggugauca

SEQ ID NO: 5078 - RNA, 19 nt, artificial
  Oligomer
guccaaaauaaauauugug

SEQ ID NO: 5079 - RNA, 19 nt, artificial
  Oligomer
agaaaccaagauagagcua

SEQ ID NO: 5080 - RNA, 19 nt, artificial
  Oligomer
gaaagaaggaaagaaguug

SEQ ID NO: 5081 - RNA, 19 nt, artificial
  Oligomer
agucugaggaagaugauau

SEQ ID NO: 5082 - RNA, 19 nt, artificial
  Oligomer
ugaauuuaauccucuccuu

SEQ ID NO: 5083 - RNA, 19 nt, artificial
  Oligomer
cuuauauaucacacuauug

SEQ ID NO: 5084 - RNA, 19 nt, artificial
  Oligomer
cucugcugcucucucauuu

SEQ ID NO: 5085 - RNA, 19 nt, artificial
  Oligomer
cuauaauuacaccuauggg

SEQ ID NO: 5086 - RNA, 19 nt, artificial
  Oligomer
cucagcuguacaguucgua

SEQ ID NO: 5087 - RNA, 19 nt, artificial
  Oligomer
aauuuaaauggaugcaggu

SEQ ID NO: 5088 - RNA, 19 nt, artificial
  Oligomer
caauaagcaugucagacug

SEQ ID NO: 5089 - RNA, 19 nt, artificial
  Oligomer
aaaaacucagauuggauau

SEQ ID NO: 5090 - RNA, 19 nt, artificial
  Oligomer
acccucagcaugaggaaca

SEQ ID NO: 5091 - RNA, 19 nt, artificial
  Oligomer
cuggaugaucaguuuucug

SEQ ID NO: 5092 - RNA, 19 nt, artificial
  Oligomer
caguucguacacuaaacuc

SEQ ID NO: 5093 - RNA, 19 nt, artificial
  Oligomer
aggcaccuacucaguaucu

SEQ ID NO: 5094 - RNA, 19 nt, artificial
  Oligomer
agaaguugaaagcaucuug

SEQ ID NO: 5095 - RNA, 19 nt, artificial
  Oligomer
auaaaaucgcuacuuuaag

SEQ ID NO: 5096 - RNA, 19 nt, artificial
  Oligomer
uacuucugagcuugcaaca

SEQ ID NO: 5097 - RNA, 19 nt, artificial
  Oligomer
aucacucugcauuggugaa

SEQ ID NO: 5098 - RNA, 19 nt, artificial
  Oligomer
uauauuggaaggcgucuga

SEQ ID NO: 5099 - RNA, 19 nt, artificial
  Oligomer
uuuauaauggagacaugga

SEQ ID NO: 5100 - RNA, 19 nt, artificial
  Oligomer
acaagauaccaacagggcu

SEQ ID NO: 5101 - RNA, 19 nt, artificial
  Oligomer
gacugauuaaugucuacug

SEQ ID NO: 5102 - RNA, 19 nt, artificial
  Oligomer
uugcaacauagcucacuga

SEQ ID NO: 5103 - RNA, 19 nt, artificial
  Oligomer
aggaacacgagcgucauga

SEQ ID NO: 5104 - RNA, 19 nt, artificial
  Oligomer
uaauuguucauaaucaaca

SEQ ID NO: 5105 - RNA, 19 nt, artificial
  Oligomer
aguggauuacuucugagcu

SEQ ID NO: 5106 - RNA, 19 nt, artificial
  Oligomer
uugucuacuaaagaaagau

SEQ ID NO: 5107 - RNA, 19 nt, artificial
  Oligomer
accuuuugaugaagaacug

SEQ ID NO: 5108 - RNA, 19 nt, artificial
  Oligomer
uauaucacacuauuguaga

SEQ ID NO: 5109 - RNA, 19 nt, artificial
  Oligomer
cauuggagagaaaaacagc

SEQ ID NO: 5110 - RNA, 19 nt, artificial
  Oligomer
guagcuccaagagcucuca

SEQ ID NO: 5111 - RNA, 19 nt, artificial
  Oligomer
uucugagcuugcaacauag

SEQ ID NO: 5112 - RNA, 19 nt, artificial
  Oligomer
uuaaauggaugcagguugu

SEQ ID NO: 5113 - RNA, 19 nt, artificial
  Oligomer
gcacuucagcaauaauggg

SEQ ID NO: 5114 - RNA, 19 nt, artificial
  Oligomer
ugucuacugugaaaauuug

SEQ ID NO: 5115 - RNA, 19 nt, artificial
  Oligomer
ugcugcguuccuaauuuag

SEQ ID NO: 5116 - RNA, 19 nt, artificial
  Oligomer
aaccuuaauucagcugaag

SEQ ID NO: 5117 - RNA, 19 nt, artificial
  Oligomer
uaaaugcugcguuccuaau

SEQ ID NO: 5118 - RNA, 19 nt, artificial
  Oligomer
uccaccagcaccuuuugau

SEQ ID NO: 5119 - RNA, 19 nt, artificial
  Oligomer
cuuuauucuaagcaaaucu

SEQ ID NO: 5120 - RNA, 19 nt, artificial
  Oligomer
gggcuucugaaacagauac

SEQ ID NO: 5121 - RNA, 19 nt, artificial
  Oligomer
gaauuuaauccucuccuuu

SEQ ID NO: 5122 - RNA, 19 nt, artificial
  Oligomer
aaggaaagaaguugaaagc

SEQ ID NO: 5123 - RNA, 19 nt, artificial
  Oligomer
auaauaaaaucgcuacuuu

SEQ ID NO: 5124 - RNA, 19 nt, artificial
  Oligomer
ggauaugggauuggucaag

SEQ ID NO: 5125 - RNA, 19 nt, artificial
  Oligomer
uccuggguagaacugcacu

SEQ ID NO: 5126 - RNA, 19 nt, artificial
  Oligomer
augucuacugugaaaauuu

SEQ ID NO: 5127 - RNA, 19 nt, artificial
  Oligomer
uucagcugaaguacuuuau

SEQ ID NO: 5128 - RNA, 19 nt, artificial
  Oligomer
ucagauuggauaugggauu

SEQ ID NO: 5129 - RNA, 19 nt, artificial
  Oligomer
uuaagucuccgauuauuag

SEQ ID NO: 5130 - RNA, 19 nt, artificial
  Oligomer
ugauaauaaaaucgcuacu

SEQ ID NO: 5131 - RNA, 19 nt, artificial
  Oligomer
gcuguacaguucguacacu

SEQ ID NO: 5132 - RNA, 19 nt, artificial
  Oligomer
gauaugggauuggucaagu

SEQ ID NO: 5133 - RNA, 19 nt, artificial
  Oligomer
gucugacuugguucguuag

SEQ ID NO: 5134 - RNA, 19 nt, artificial
  Oligomer
uuguucauaaucaacagaa

SEQ ID NO: 5135 - RNA, 19 nt, artificial
  Oligomer
agucggccggaaaauauuc

SEQ ID NO: 5136 - RNA, 19 nt, artificial
  Oligomer
auuacaccuaugggaucaa

SEQ ID NO: 5137 - RNA, 19 nt, artificial
  Oligomer
aacuggagucugacuuggu

SEQ ID NO: 5138 - RNA, 19 nt, artificial
  Oligomer
guucauaaucaacagaaac

SEQ ID NO: 5139 - RNA, 19 nt, artificial
  Oligomer
aagaugauauugaaagaag

SEQ ID NO: 5140 - RNA, 19 nt, artificial
  Oligomer
uuauauaucacacuauugu

SEQ ID NO: 5141 - RNA, 19 nt, artificial
  Oligomer
cugcacuucagcaauaaug

SEQ ID NO: 5142 - RNA, 19 nt, artificial
  Oligomer
auauugaaagaaggaaaga

SEQ ID NO: 5143 - RNA, 19 nt, artificial
  Oligomer
agaauuucugaaaguuuuc

SEQ ID NO: 5144 - RNA, 19 nt, artificial
  Oligomer
aaaugcugcguuccuaauu

SEQ ID NO: 5145 - RNA, 19 nt, artificial
  Oligomer
auucagcugaaguacuuua

SEQ ID NO: 5146 - RNA, 19 nt, artificial
  Oligomer
auugauaauaaaaucgcua

SEQ ID NO: 5147 - RNA, 19 nt, artificial
  Oligomer
uauucucugcagaauuucu

SEQ ID NO: 5148 - RNA, 19 nt, artificial
  Oligomer
aacagaaaccaagauagag

SEQ ID NO: 5149 - RNA, 19 nt, artificial
  Oligomer
guucaacuuuugugugcuu

SEQ ID NO: 5150 - RNA, 19 nt, artificial
  Oligomer
uccuuuguguucaacuuuu

SEQ ID NO: 5151 - RNA, 19 nt, artificial
  Oligomer
uucaauaucaucuuccuca

SEQ ID NO: 5152 - RNA, 19 nt, artificial
  Oligomer
uucagcugaauuaagguug

SEQ ID NO: 5153 - RNA, 19 nt, artificial
  Oligomer
uugauuaugaacaauuagc

SEQ ID NO: 5154 - RNA, 19 nt, artificial
  Oligomer
uuuuucuucaagaugcuuu

SEQ ID NO: 5155 - RNA, 19 nt, artificial
  Oligomer
uuuuagugucuauucuuuu

SEQ ID NO: 5156 - RNA, 19 nt, artificial
  Oligomer
uucuucaugacgcucgugu

SEQ ID NO: 5157 - RNA, 19 nt, artificial
  Oligomer
uucaugacgcucguguucc

SEQ ID NO: 5158 - RNA, 19 nt, artificial
  Oligomer
uucuuuaguagacaaccug

SEQ ID NO: 5159 - RNA, 19 nt, artificial
  Oligomer
uuuuacuaaauuaggaacg

SEQ ID NO: 5160 - RNA, 19 nt, artificial
  Oligomer
uuaaagaggaacuccuugg

SEQ ID NO: 5161 - RNA, 19 nt, artificial
  Oligomer
ucuuucaauaucaucuucc

SEQ ID NO: 5162 - RNA, 19 nt, artificial
  Oligomer
auuuauuuuggacaaaccc

SEQ ID NO: 5163 - RNA, 19 nt, artificial
  Oligomer
uucugcagagaauaugccc

SEQ ID NO: 5164 - RNA, 19 nt, artificial
  Oligomer
auuaaauucaccaaugcag

SEQ ID NO: 5165 - RNA, 19 nt, artificial
  Oligomer
uuccuuauaaugcaaaagc

SEQ ID NO: 5166 - RNA, 19 nt, artificial
  Oligomer
uuauagaucaacaugauuu

SEQ ID NO: 5167 - RNA, 19 nt, artificial
  Oligomer
uuaucaauguuauucauuc

SEQ ID NO: 5168 - RNA, 19 nt, artificial
  Oligomer
uuauaaauagaaaccgagg

SEQ ID NO: 5169 - RNA, 19 nt, artificial
  Oligomer
uuuacuaccaaauuuucac

SEQ ID NO: 5170 - RNA, 19 nt, artificial
  Oligomer
uuaguagacaaccugcauc

SEQ ID NO: 5171 - RNA, 19 nt, artificial
  Oligomer
uuugcuuagaauaaagcug

SEQ ID NO: 5172 - RNA, 19 nt, artificial
  Oligomer
uuuaaagaggaacuccuug

SEQ ID NO: 5173 - RNA, 19 nt, artificial
  Oligomer
uacuaaauuaggaacgcag

SEQ ID NO: 5174 - RNA, 19 nt, artificial
  Oligomer
uuucuguugauuaugaaca

SEQ ID NO: 5175 - RNA, 19 nt, artificial
  Oligomer
uuucaauaucaucuuccuc

SEQ ID NO: 5176 - RNA, 19 nt, artificial
  Oligomer
uauuuuuuccaugucucca

SEQ ID NO: 5177 - RNA, 19 nt, artificial
  Oligomer
uuuucuucaagaugcuuuc

SEQ ID NO: 5178 - RNA, 19 nt, artificial
  Oligomer
uuaagguugcagauaauuu

SEQ ID NO: 5179 - RNA, 19 nt, artificial
  Oligomer
uaguagacaaccugcaucc

SEQ ID NO: 5180 - RNA, 19 nt, artificial
  Oligomer
uucaagaugcuuucaacuu

SEQ ID NO: 5181 - RNA, 19 nt, artificial
  Oligomer
uuagugucuauucuuuuau

SEQ ID NO: 5182 - RNA, 19 nt, artificial
  Oligomer
ucuuuaguagacaaccugc

SEQ ID NO: 5183 - RNA, 19 nt, artificial
  Oligomer
uauaaauagaaaccgaggc

SEQ ID NO: 5184 - RNA, 19 nt, artificial
  Oligomer
acuuaauuccuuauaaugc

SEQ ID NO: 5185 - RNA, 19 nt, artificial
  Oligomer
uuauugaucccauaggugu

SEQ ID NO: 5186 - RNA, 19 nt, artificial
  Oligomer
uuaugaacaauuagcauag

SEQ ID NO: 5187 - RNA, 19 nt, artificial
  Oligomer
augauuuuagugucuauuc

SEQ ID NO: 5188 - RNA, 19 nt, artificial
  Oligomer
ucuaucuugguuucuguug

SEQ ID NO: 5189 - RNA, 19 nt, artificial
  Oligomer
uucacaguagacauuaauc

SEQ ID NO: 5190 - RNA, 19 nt, artificial
  Oligomer
auuuuagugucuauucuuu

SEQ ID NO: 5191 - RNA, 19 nt, artificial
  Oligomer
aauagugugauauauaagg

SEQ ID NO: 5192 - RNA, 19 nt, artificial
  Oligomer
aucuguuucagaagcccug

SEQ ID NO: 5193 - RNA, 19 nt, artificial
  Oligomer
uuucucuccaaugcuaugg

SEQ ID NO: 5194 - RNA, 19 nt, artificial
  Oligomer
uauuuauuuuggacaaacc

SEQ ID NO: 5195 - RNA, 19 nt, artificial
  Oligomer
ucaagaugcuuucaacuuc

SEQ ID NO: 5196 - RNA, 19 nt, artificial
  Oligomer
uucaacuucuuuccuucuu

SEQ ID NO: 5197 - RNA, 19 nt, artificial
  Oligomer
uuuagugucuauucuuuua

SEQ ID NO: 5198 - RNA, 19 nt, artificial
  Oligomer
uuaaauucaccaaugcaga

SEQ ID NO: 5199 - RNA, 19 nt, artificial
  Oligomer
aauacuuucuacaauagug

SEQ ID NO: 5200 - RNA, 19 nt, artificial
  Oligomer
uugaaauauaaaguacuuc

SEQ ID NO: 5201 - RNA, 19 nt, artificial
  Oligomer
ucuucagugagcuauguug

SEQ ID NO: 5202 - RNA, 19 nt, artificial
  Oligomer
uagaucaacaugauuuuag

SEQ ID NO: 5203 - RNA, 19 nt, artificial
  Oligomer
uaaucggagacuuaauucc

SEQ ID NO: 5204 - RNA, 19 nt, artificial
  Oligomer
auacuuucuacaauagugu

SEQ ID NO: 5205 - RNA, 19 nt, artificial
  Oligomer
augcuuucaacuucuuucc

SEQ ID NO: 5206 - RNA, 19 nt, artificial
  Oligomer
auuauaaauagaaaccgag

SEQ ID NO: 5207 - RNA, 19 nt, artificial
  Oligomer
uugguuucuguugauuaug

SEQ ID NO: 5208 - RNA, 19 nt, artificial
  Oligomer
auauaaaguacuucagcug

SEQ ID NO: 5209 - RNA, 19 nt, artificial
  Oligomer
uaaauagaaaccgaggcug

SEQ ID NO: 5210 - RNA, 19 nt, artificial
  Oligomer
ucauccagggugaucaccu

SEQ ID NO: 5211 - RNA, 19 nt, artificial
  Oligomer
aaaacuuucagaaauucug

SEQ ID NO: 5212 - RNA, 19 nt, artificial
  Oligomer
uguagcucuaucuugguuu

SEQ ID NO: 5213 - RNA, 19 nt, artificial
  Oligomer
auaaucggagacuuaauuc

SEQ ID NO: 5214 - RNA, 19 nt, artificial
  Oligomer
uagugugauauauaaggcc

SEQ ID NO: 5215 - RNA, 19 nt, artificial
  Oligomer
aucaacaugauuuuagugu

SEQ ID NO: 5216 - RNA, 19 nt, artificial
  Oligomer
uacuucagcugaauuaagg

SEQ ID NO: 5217 - RNA, 19 nt, artificial
  Oligomer
uuuaguguacgaacuguac

SEQ ID NO: 5218 - RNA, 19 nt, artificial
  Oligomer
auauuuuccggccgacuug

SEQ ID NO: 5219 - RNA, 19 nt, artificial
  Oligomer
uuaaaguagcgauuuuauu

SEQ ID NO: 5220 - RNA, 19 nt, artificial
  Oligomer
ugcaaaagcaagaagaguu

SEQ ID NO: 5221 - RNA, 19 nt, artificial
  Oligomer
uguuucagaagcccuguug

SEQ ID NO: 5222 - RNA, 19 nt, artificial
  Oligomer
uucagcagaaaacugauca

SEQ ID NO: 5223 - RNA, 19 nt, artificial
  Oligomer
uucuucaagaugcuuucaa

SEQ ID NO: 5224 - RNA, 19 nt, artificial
  Oligomer
uuucuuuaguagacaaccu

SEQ ID NO: 5225 - RNA, 19 nt, artificial
  Oligomer
ucaacuucuuuccuucuuu

SEQ ID NO: 5226 - RNA, 19 nt, artificial
  Oligomer
cugaagugcaguucuaccc

SEQ ID NO: 5227 - RNA, 19 nt, artificial
  Oligomer
uuucaacuucuuuccuucu

SEQ ID NO: 5228 - RNA, 19 nt, artificial
  Oligomer
uccuucuuucaauaucauc

SEQ ID NO: 5229 - RNA, 19 nt, artificial
  Oligomer
uucuucaucaaaaggugcu

SEQ ID NO: 5230 - RNA, 19 nt, artificial
  Oligomer
uaaaguagcgauuuuauua

SEQ ID NO: 5231 - RNA, 19 nt, artificial
  Oligomer
uuuuucucuccaaugcuau

SEQ ID NO: 5232 - RNA, 19 nt, artificial
  Oligomer
auacugaguaggugccuuc

SEQ ID NO: 5233 - RNA, 19 nt, artificial
  Oligomer
uaucuguuucagaagcccu

SEQ ID NO: 5234 - RNA, 19 nt, artificial
  Oligomer
ucacagugagagcucuugg

SEQ ID NO: 5235 - RNA, 19 nt, artificial
  Oligomer
uuaggaacgcagcauuuac

SEQ ID NO: 5236 - RNA, 19 nt, artificial
  Oligomer
uaauuauagaucaacauga

SEQ ID NO: 5237 - RNA, 19 nt, artificial
  Oligomer
uuuccuucuuucaauauca

SEQ ID NO: 5238 - RNA, 19 nt, artificial
  Oligomer
uuauaaugcaaaagcaaga

SEQ ID NO: 5239 - RNA, 19 nt, artificial
  Oligomer
uuacagaacaaauaaacac

SEQ ID NO: 5240 - RNA, 19 nt, artificial
  Oligomer
uugcuuagaauaaagcuga

SEQ ID NO: 5241 - RNA, 19 nt, artificial
  Oligomer
uguuuaaagaggaacuccu

SEQ ID NO: 5242 - RNA, 19 nt, artificial
  Oligomer
aauauuuuccggccgacuu

SEQ ID NO: 5243 - RNA, 19 nt, artificial
  Oligomer
ucuucaagaugcuuucaac

SEQ ID NO: 5244 - RNA, 19 nt, artificial
  Oligomer
aaguaauccacuaacgaac

SEQ ID NO: 5245 - RNA, 19 nt, artificial
  Oligomer
uuccucagacugugagcug

SEQ ID NO: 5246 - RNA, 19 nt, artificial
  Oligomer
uccagcaguauuuuuucca

SEQ ID NO: 5247 - RNA, 19 nt, artificial
  Oligomer
uucuacaauagugugauau

SEQ ID NO: 5248 - RNA, 19 nt, artificial
  Oligomer
ugaguuuuucuucaagaug

SEQ ID NO: 5249 - RNA, 19 nt, artificial
  Oligomer
uuaaucagucugacaugcu

SEQ ID NO: 5250 - RNA, 19 nt, artificial
  Oligomer
auuuuuuccaugucuccau

SEQ ID NO: 5251 - RNA, 19 nt, artificial
  Oligomer
aucuaacagcucuucagug

SEQ ID NO: 5252 - RNA, 19 nt, artificial
  Oligomer
uucagaagcccuguuggua

SEQ ID NO: 5253 - RNA, 19 nt, artificial
  Oligomer
auagguguaauuauagauc

SEQ ID NO: 5254 - RNA, 19 nt, artificial
  Oligomer
ucuuucuuuaguagacaac

SEQ ID NO: 5255 - RNA, 19 nt, artificial
  Oligomer
auguuauucauucuuuuga

SEQ ID NO: 5256 - RNA, 19 nt, artificial
  Oligomer
ccuuucuucaugacgcucg

SEQ ID NO: 5257 - RNA, 19 nt, artificial
  Oligomer
ugaguaggugccuucagca

SEQ ID NO: 5258 - RNA, 19 nt, artificial
  Oligomer
aaagauacugaguaggugc

SEQ ID NO: 5259 - RNA, 19 nt, artificial
  Oligomer
uaagguugcagauaauuuu

SEQ ID NO: 5260 - RNA, 19 nt, artificial
  Oligomer
uaucaucuuccucagacug

SEQ ID NO: 5261 - RNA, 19 nt, artificial
  Oligomer
uauaaaguacuucagcuga

SEQ ID NO: 5262 - RNA, 19 nt, artificial
  Oligomer
uugaccaaucccauaucca

SEQ ID NO: 5263 - RNA, 19 nt, artificial
  Oligomer
uaauacuuucuacaauagu

SEQ ID NO: 5264 - RNA, 19 nt, artificial
  Oligomer
ugauuaugaacaauuagca

SEQ ID NO: 5265 - RNA, 19 nt, artificial
  Oligomer
auagugugauauauaaggc

SEQ ID NO: 5266 - RNA, 19 nt, artificial
  Oligomer
agcgauuuuauuaucaaug

SEQ ID NO: 5267 - RNA, 19 nt, artificial
  Oligomer
auauuuauuuuggacaaac

SEQ ID NO: 5268 - RNA, 19 nt, artificial
  Oligomer
uauugcugaagugcaguuc

SEQ ID NO: 5269 - RNA, 19 nt, artificial
  Oligomer
aagaguuuaguguacgaac

SEQ ID NO: 5270 - RNA, 19 nt, artificial
  Oligomer
aucaauguuauucauucuu

SEQ ID NO: 5271 - RNA, 19 nt, artificial
  Oligomer
ucagaaguaauccacuaac

SEQ ID NO: 5272 - RNA, 19 nt, artificial
  Oligomer
ucugacaugcuuauugauc

SEQ ID NO: 5273 - RNA, 19 nt, artificial
  Oligomer
guuuguagcucuaucuugg

SEQ ID NO: 5274 - RNA, 19 nt, artificial
  Oligomer
uauaaucuuucuuuaguag

SEQ ID NO: 5275 - RNA, 19 nt, artificial
  Oligomer
ugaucauccagggugauca

SEQ ID NO: 5276 - RNA, 19 nt, artificial
  Oligomer
uuuuuuccaugucuccauu

SEQ ID NO: 5277 - RNA, 19 nt, artificial
  Oligomer
ugaagugcaguucuaccca

SEQ ID NO: 5278 - RNA, 19 nt, artificial
  Oligomer
ugauuuuagugucuauucu

SEQ ID NO: 5279 - RNA, 19 nt, artificial
  Oligomer
aguuuguagcucuaucuug

SEQ ID NO: 5280 - RNA, 19 nt, artificial
  Oligomer
ugaguuuguagcucuaucu

SEQ ID NO: 5281 - RNA, 19 nt, artificial
  Oligomer
ugaaauauaaaguacuuca

SEQ ID NO: 5282 - RNA, 19 nt, artificial
  Oligomer
uccauuauaaauagaaacc

SEQ ID NO: 5283 - RNA, 19 nt, artificial
  Oligomer
auuaugaacaauuagcaua

SEQ ID NO: 5284 - RNA, 19 nt, artificial
  Oligomer
acaauauuuauuuuggaca

SEQ ID NO: 5285 - RNA, 19 nt, artificial
  Oligomer
uagacaaccugcauccauu

SEQ ID NO: 5286 - RNA, 19 nt, artificial
  Oligomer
uuaguguacgaacuguaca

SEQ ID NO: 5287 - RNA, 19 nt, artificial
  Oligomer
aaacugaucauccagggug

SEQ ID NO: 5288 - RNA, 19 nt, artificial
  Oligomer
uuuguagcucuaucuuggu

SEQ ID NO: 5289 - RNA, 19 nt, artificial
  Oligomer
uugucagacgccuuccaau

SEQ ID NO: 5290 - RNA, 19 nt, artificial
  Oligomer
augacgcucguguuccuca

SEQ ID NO: 5291 - RNA, 19 nt, artificial
  Oligomer
uaaagcugauuuuaaaagc

SEQ ID NO: 5292 - RNA, 19 nt, artificial
  Oligomer
ugugagcuguuuuucucuc

SEQ ID NO: 5293 - RNA, 19 nt, artificial
  Oligomer
uaguguacgaacuguacag

SEQ ID NO: 5294 - RNA, 19 nt, artificial
  Oligomer
uaaagaggaacuccuuggg

SEQ ID NO: 5295 - RNA, 19 nt, artificial
  Oligomer
aguauuuuuuccaugucuc

SEQ ID NO: 5296 - RNA, 19 nt, artificial
  Oligomer
uuguagcucuaucuugguu

SEQ ID NO: 5297 - RNA, 19 nt, artificial
  Oligomer
uucuuucaauaucaucuuc

SEQ ID NO: 5298 - RNA, 19 nt, artificial
  Oligomer
aauucugcagagaauaugc

SEQ ID NO: 5299 - RNA, 19 nt, artificial
  Oligomer
uucaucaaaaggugcuggu

SEQ ID NO: 5300 - RNA, 19 nt, artificial
  Oligomer
ucaauguuauucauucuuu

SEQ ID NO: 5301 - RNA, 19 nt, artificial
  Oligomer
uauccaaucugaguuuuuc

SEQ ID NO: 5302 - RNA, 19 nt, artificial
  Oligomer
uuuaguagacaaccugcau

SEQ ID NO: 5303 - RNA, 19 nt, artificial
  Oligomer
uacuaccaaauuuucacag

SEQ ID NO: 5304 - RNA, 19 nt, artificial
  Oligomer
uuucuucaugacgcucgug

SEQ ID NO: 5305 - RNA, 19 nt, artificial
  Oligomer
cuuucuuuaguagacaacc

SEQ ID NO: 5306 - RNA, 19 nt, artificial
  Oligomer
auucugcagagaauaugcc

SEQ ID NO: 5307 - RNA, 19 nt, artificial
  Oligomer
uaaugcaaaagcaagaaga

SEQ ID NO: 5308 - RNA, 19 nt, artificial
  Oligomer
uacuccguccagacucaug

SEQ ID NO: 5309 - RNA, 19 nt, artificial
  Oligomer
uauguugcaagcucagaag

SEQ ID NO: 5310 - RNA, 19 nt, artificial
  Oligomer
aaauucugcagagaauaug

SEQ ID NO: 5311 - RNA, 19 nt, artificial
  Oligomer
uuccaugucuccauuauaa

SEQ ID NO: 5312 - RNA, 19 nt, artificial
  Oligomer
auaaagcugauuuuaaaag

SEQ ID NO: 5313 - RNA, 19 nt, artificial
  Oligomer
ucaaaugaaaauuuacuac

SEQ ID NO: 5314 - RNA, 19 nt, artificial
  Oligomer
acugugagcuguuuuucuc

SEQ ID NO: 5315 - RNA, 19 nt, artificial
  Oligomer
ugcuuauugaucccauagg

SEQ ID NO: 5316 - RNA, 19 nt, artificial
  Oligomer
uucucuccaaugcuauggg

SEQ ID NO: 5317 - RNA, 19 nt, artificial
  Oligomer
uuaauuccuuauaaugcaa

SEQ ID NO: 5318 - RNA, 19 nt, artificial
  Oligomer
uuuacuaaauuaggaacgc

SEQ ID NO: 5319 - RNA, 19 nt, artificial
  Oligomer
uacaauagugugauauaua

SEQ ID NO: 5320 - RNA, 19 nt, artificial
  Oligomer
aaacuuucagaaauucugc

SEQ ID NO: 5321 - RNA, 19 nt, artificial
  Oligomer
uaaucuuucuuuaguagac

SEQ ID NO: 5322 - RNA, 19 nt, artificial
  Oligomer
ucagacugugagcuguuuu

SEQ ID NO: 5323 - RNA, 19 nt, artificial
  Oligomer
ucaucuuccucagacugug

SEQ ID NO: 5324 - RNA, 19 nt, artificial
  Oligomer
uguacagcugaguuuguag

SEQ ID NO: 5325 - RNA, 19 nt, artificial
  Oligomer
aauaucaucuuccucagac

SEQ ID NO: 5326 - RNA, 19 nt, artificial
  Oligomer
ucuugguuucuguugauua

SEQ ID NO: 5327 - RNA, 19 nt, artificial
  Oligomer
uccaaucugaguuuuucuu

SEQ ID NO: 5328 - RNA, 19 nt, artificial
  Oligomer
ucacaguagacauuaauca

SEQ ID NO: 5329 - RNA, 19 nt, artificial
  Oligomer
ugaacaauuagcauaguua

SEQ ID NO: 5330 - RNA, 19 nt, artificial
  Oligomer
agaaaacugaucauccagg

SEQ ID NO: 5331 - RNA, 19 nt, artificial
  Oligomer
uacuuucuacaauagugug

SEQ ID NO: 5332 - RNA, 19 nt, artificial
  Oligomer
uuucagaaauucugcagag

SEQ ID NO: 5333 - RNA, 19 nt, artificial
  Oligomer
agcagaaaacugaucaucc

SEQ ID NO: 5334 - RNA, 19 nt, artificial
  Oligomer
auuauugcugaagugcagu

SEQ ID NO: 5335 - RNA, 19 nt, artificial
  Oligomer
uagaaaccgaggcuggaac

SEQ ID NO: 5336 - RNA, 19 nt, artificial
  Oligomer
ucaacaugauuuuaguguc

SEQ ID NO: 5337 - RNA, 19 nt, artificial
  Oligomer
aauauaaaguacuucagcu

SEQ ID NO: 5338 - RNA, 19 nt, artificial
  Oligomer
auuuacagaacaaauaaac

SEQ ID NO: 5339 - RNA, 19 nt, artificial
  Oligomer
uuacuaccaaauuuucaca

SEQ ID NO: 5340 - RNA, 19 nt, artificial
  Oligomer
uuauugcugaagugcaguu

SEQ ID NO: 5341 - RNA, 19 nt, artificial
  Oligomer
uuuucucuccaaugcuaug

SEQ ID NO: 5342 - RNA, 19 nt, artificial
  Oligomer
aucuuccucagacugugag

SEQ ID NO: 5343 - RNA, 19 nt, artificial
  Oligomer
auaaucuuucuuuaguaga

SEQ ID NO: 5344 - RNA, 19 nt, artificial
  Oligomer
ucuuccucagacugugagc

SEQ ID NO: 5345 - RNA, 19 nt, artificial
  Oligomer
aagugcaguucuacccagg

SEQ ID NO: 5346 - RNA, 19 nt, artificial
  Oligomer
auuuuacuaaauuaggaac

SEQ ID NO: 5347 - RNA, 19 nt, artificial
  Oligomer
auaaauagaaaccgaggcu

SEQ ID NO: 5348 - RNA, 19 nt, artificial
  Oligomer
auuuacuaccaaauuuuca

SEQ ID NO: 5349 - RNA, 19 nt, artificial
  Oligomer
uguuuuucucuccaaugcu

SEQ ID NO: 5350 - RNA, 19 nt, artificial
  Oligomer
gaugcuuucaacuucuuuc

SEQ ID NO: 5351 - RNA, 19 nt, artificial
  Oligomer
uaacgaaccaagucagacu

SEQ ID NO: 5352 - RNA, 19 nt, artificial
  Oligomer
ucagaagcccuguugguau

SEQ ID NO: 5353 - RNA, 19 nt, artificial
  Oligomer
uaaagaggaaaagauacug

SEQ ID NO: 5354 - RNA, 19 nt, artificial
  Oligomer
cuuucaacuucuuuccuuc

SEQ ID NO: 5355 - RNA, 19 nt, artificial
  Oligomer
ccuucuuucaauaucaucu

SEQ ID NO: 5356 - RNA, 19 nt, artificial
  Oligomer
ucugaguuuuucuucaaga

SEQ ID NO: 5357 - RNA, 19 nt, artificial
  Oligomer
uuuuuccaugucuccauua

SEQ ID NO: 5358 - RNA, 19 nt, artificial
  Oligomer
aagaagaguuuaguguacg

SEQ ID NO: 5359 - RNA, 19 nt, artificial
  Oligomer
auggaaggaaaacuuucag

SEQ ID NO: 5360 - RNA, 19 nt, artificial
  Oligomer
uucccauuauugcugaagu

SEQ ID NO: 5361 - RNA, 19 nt, artificial
  Oligomer
ugcuauggguaucuguuuc

SEQ ID NO: 5362 - RNA, 19 nt, artificial
  Oligomer
uauuuuccggccgacuuga

SEQ ID NO: 5363 - RNA, 19 nt, artificial
  Oligomer
acuaaauuaggaacgcagc

SEQ ID NO: 5364 - RNA, 19 nt, artificial
  Oligomer
auuaaucagucugacaugc

SEQ ID NO: 5365 - RNA, 19 nt, artificial
  Oligomer
uucggguguuuaaagagga

SEQ ID NO: 5366 - RNA, 19 nt, artificial
  Oligomer
agcugaauuaagguugcag

SEQ ID NO: 5367 - RNA, 19 nt, artificial
  Oligomer
aauguuauucauucuuuug

SEQ ID NO: 5368 - RNA, 19 nt, artificial
  Oligomer
uguacgaacuguacagcug

SEQ ID NO: 5369 - RNA, 19 nt, artificial
  Oligomer
ucguguuccucaugcugag

SEQ ID NO: 5370 - RNA, 19 nt, artificial
  Oligomer
cucguguuccucaugcuga

SEQ ID NO: 5371 - RNA, 19 nt, artificial
  Oligomer
ucuucaucaaaaggugcug

SEQ ID NO: 5372 - RNA, 19 nt, artificial
  Oligomer
aucauccagggugaucacc

SEQ ID NO: 5373 - RNA, 19 nt, artificial
  Oligomer
guagacauuaaucagucug

SEQ ID NO: 5374 - RNA, 19 nt, artificial
  Oligomer
auccaaucugaguuuuucu

SEQ ID NO: 5375 - RNA, 19 nt, artificial
  Oligomer
ucaauaucaucuuccucag

SEQ ID NO: 5376 - RNA, 19 nt, artificial
  Oligomer
auuaagguugcagauaauu

SEQ ID NO: 5377 - RNA, 19 nt, artificial
  Oligomer
acuuucagaaauucugcag

SEQ ID NO: 5378 - RNA, 19 nt, artificial
  Oligomer
agcauaguuauauauaauc

SEQ ID NO: 5379 - RNA, 19 nt, artificial
  Oligomer
ugagagagcagcagagaug

SEQ ID NO: 5380 - RNA, 19 nt, artificial
  Oligomer
aagauacugaguaggugcc

SEQ ID NO: 5381 - RNA, 19 nt, artificial
  Oligomer
uaucuuguggugucugcga

SEQ ID NO: 5382 - RNA, 19 nt, artificial
  Oligomer
uacugaguaggugccuuca

SEQ ID NO: 5383 - RNA, 19 nt, artificial
  Oligomer
agauggaaggaaaacuuuc

SEQ ID NO: 5384 - RNA, 19 nt, artificial
  Oligomer
uuuccaugucuccauuaua

SEQ ID NO: 5385 - RNA, 19 nt, artificial
  Oligomer
uaauuccuuauaaugcaaa

SEQ ID NO: 5386 - RNA, 19 nt, artificial
  Oligomer
ucuucaugacgcucguguu

SEQ ID NO: 5387 - RNA, 19 nt, artificial
  Oligomer
augcuuauugaucccauag

SEQ ID NO: 5388 - RNA, 19 nt, artificial
  Oligomer
uuucacaguagacauuaau

SEQ ID NO: 5389 - RNA, 19 nt, artificial
  Oligomer
ugcaagcucagaaguaauc

SEQ ID NO: 5390 - RNA, 19 nt, artificial
  Oligomer
aucugaguuuuucuucaag

SEQ ID NO: 5391 - RNA, 19 nt, artificial
  Oligomer
ugguaucuuguggugucug

SEQ ID NO: 5392 - RNA, 19 nt, artificial
  Oligomer
cugaguuuguagcucuauc

SEQ ID NO: 5393 - RNA, 19 nt, artificial
  Oligomer
aucaucuuccucagacugu

SEQ ID NO: 5394 - RNA, 19 nt, artificial
  Oligomer
aagcucagaaguaauccac

SEQ ID NO: 5395 - RNA, 19 nt, artificial
  Oligomer
uaaauuaggaacgcagcau

SEQ ID NO: 5396 - RNA, 19 nt, artificial
  Oligomer
gucuauucuuuuauuuuac

SEQ ID NO: 5397 - RNA, 19 nt, artificial
  Oligomer
uagacauuaaucagucuga

SEQ ID NO: 5398 - RNA, 19 nt, artificial
  Oligomer
uccacuaacgaaccaaguc

SEQ ID NO: 5399 - RNA, 19 nt, artificial
  Oligomer
auaauacuuucuacaauag

SEQ ID NO: 5400 - RNA, 19 nt, artificial
  Oligomer
aaauauaaaguacuucagc

SEQ ID NO: 5401 - RNA, 19 nt, artificial
  Oligomer
uuagaauaaagcugauuuu

SEQ ID NO: 5402 - RNA, 19 nt, artificial
  Oligomer
uaggaacgcagcauuuaca

SEQ ID NO: 5403 - RNA, 19 nt, artificial
  Oligomer
uuucagaagcccuguuggu

SEQ ID NO: 5404 - RNA, 19 nt, artificial
  Oligomer
uucuuuccuucuuucaaua

SEQ ID NO: 5405 - RNA, 19 nt, artificial
  Oligomer
aguaggugccuucagcaga

SEQ ID NO: 5406 - RNA, 19 nt, artificial
  Oligomer
ugcuuucaacuucuuuccu

SEQ ID NO: 5407 - RNA, 19 nt, artificial
  Oligomer
uacagcugaguuuguagcu

SEQ ID NO: 5408 - RNA, 19 nt, artificial
  Oligomer
uaccaaauuuucacaguag

SEQ ID NO: 5409 - RNA, 19 nt, artificial
  Oligomer
ugcugaagugcaguucuac

SEQ ID NO: 5410 - RNA, 19 nt, artificial
  Oligomer
auuugcuuagaauaaagcu

SEQ ID NO: 5411 - RNA, 19 nt, artificial
  Oligomer
aacuucuuuccuucuuuca

SEQ ID NO: 5412 - RNA, 19 nt, artificial
  Oligomer
aucggagacuuaauuccuu

SEQ ID NO: 5413 - RNA, 19 nt, artificial
  Oligomer
guauuuuuuccaugucucc

SEQ ID NO: 5414 - RNA, 19 nt, artificial
  Oligomer
uguugguaucuuguggugu

SEQ ID NO: 5415 - RNA, 19 nt, artificial
  Oligomer
aacuguacagcugaguuug

SEQ ID NO: 5416 - RNA, 19 nt, artificial
  Oligomer
uaucaauguuauucauucu

SEQ ID NO: 5417 - RNA, 19 nt, artificial
  Oligomer
acuucuuuccuucuuucaa

SEQ ID NO: 5418 - RNA, 19 nt, artificial
  Oligomer
aaccaagucagacuccagu

SEQ ID NO: 5419 - RNA, 19 nt, artificial
  Oligomer
ucggagacuuaauuccuua

SEQ ID NO: 5420 - RNA, 19 nt, artificial
  Oligomer
cuuauugaucccauaggug

SEQ ID NO: 5421 - RNA, 19 nt, artificial
  Oligomer
ugagcuguuuuucucucca

SEQ ID NO: 5422 - RNA, 19 nt, artificial
  Oligomer
ugugcguccagcaguauuu

SEQ ID NO: 5423 - RNA, 19 nt, artificial
  Oligomer
aaucggagacuuaauuccu

SEQ ID NO: 5424 - RNA, 19 nt, artificial
  Oligomer
uuacuaaauuaggaacgca

SEQ ID NO: 5425 - RNA, 19 nt, artificial
  Oligomer
uaaucagucugacaugcuu

SEQ ID NO: 5426 - RNA, 19 nt, artificial
  Oligomer
ugagcuauguugcaagcuc

SEQ ID NO: 5427 - RNA, 19 nt, artificial
  Oligomer
uagugucuauucuuuuauu

SEQ ID NO: 5428 - RNA, 19 nt, artificial
  Oligomer
augcagagugauaaagagg

SEQ ID NO: 5429 - RNA, 19 nt, artificial
  Oligomer
aucaugacuaguauauuaa

SEQ ID NO: 5430 - RNA, 19 nt, artificial
  Oligomer
ucuaacagcucuucaguga

SEQ ID NO: 5431 - RNA, 19 nt, artificial
  Oligomer
ucuguuucagaagcccugu

SEQ ID NO: 5432 - RNA, 19 nt, artificial
  Oligomer
acgccuuccaauauagauc

SEQ ID NO: 5433 - RNA, 19 nt, artificial
  Oligomer
auaaugcaaaagcaagaag

SEQ ID NO: 5434 - RNA, 19 nt, artificial
  Oligomer
cuucaagaugcuuucaacu

SEQ ID NO: 5435 - RNA, 19 nt, artificial
  Oligomer
ugaaaauuuacuaccaaau

SEQ ID NO: 5436 - RNA, 19 nt, artificial
  Oligomer
ucagacuccaguucuucau

SEQ ID NO: 5437 - RNA, 19 nt, artificial
  Oligomer
ucccauauccaaucugagu

SEQ ID NO: 5438 - RNA, 19 nt, artificial
  Oligomer
uuuacagaacaaauaaaca

SEQ ID NO: 5439 - RNA, 19 nt, artificial
  Oligomer
uugcaagcucagaaguaau

SEQ ID NO: 5440 - RNA, 19 nt, artificial
  Oligomer
uucagugagcuauguugca

SEQ ID NO: 5441 - RNA, 19 nt, artificial
  Oligomer
uccagggugaucaccuaau

SEQ ID NO: 5442 - RNA, 19 nt, artificial
  Oligomer
cuucagugagcuauguugc

SEQ ID NO: 5443 - RNA, 19 nt, artificial
  Oligomer
aucuuguggugucugcgag

SEQ ID NO: 5444 - RNA, 19 nt, artificial
  Oligomer
cuuaauuccuuauaaugca

SEQ ID NO: 5445 - RNA, 19 nt, artificial
  Oligomer
uccuuauaaugcaaaagca

SEQ ID NO: 5446 - RNA, 19 nt, artificial
  Oligomer
uggaaggaaaacuuucaga

SEQ ID NO: 5447 - RNA, 19 nt, artificial
  Oligomer
cuucaugacgcucguguuc

SEQ ID NO: 5448 - RNA, 19 nt, artificial
  Oligomer
cuuauaaugcaaaagcaag

SEQ ID NO: 5449 - RNA, 19 nt, artificial
  Oligomer
guaucuuguggugucugcg

SEQ ID NO: 5450 - RNA, 19 nt, artificial
  Oligomer
aauaaucggagacuuaauu

SEQ ID NO: 5451 - RNA, 19 nt, artificial
  Oligomer
acauuaaucagucugacau

SEQ ID NO: 5452 - RNA, 19 nt, artificial
  Oligomer
cuuagaauaaagcugauuu

SEQ ID NO: 5453 - RNA, 19 nt, artificial
  Oligomer
uaauccacuaacgaaccaa

SEQ ID NO: 5454 - RNA, 19 nt, artificial
  Oligomer
ugucacagugagagcucuu

SEQ ID NO: 5455 - RNA, 19 nt, artificial
  Oligomer
uuuuccaugucuccauuau

SEQ ID NO: 5456 - RNA, 19 nt, artificial
  Oligomer
ucagaaauucugcagagaa

SEQ ID NO: 5457 - RNA, 19 nt, artificial
  Oligomer
accaaucccauauccaauc

SEQ ID NO: 5458 - RNA, 19 nt, artificial
  Oligomer
acaauuagcauaguuauau

SEQ ID NO: 5459 - RNA, 19 nt, artificial
  Oligomer
uaauaaucggagacuuaau

SEQ ID NO: 5460 - RNA, 19 nt, artificial
  Oligomer
aucccauauccaaucugag

SEQ ID NO: 5461 - RNA, 19 nt, artificial
  Oligomer
uaaauucaccaaugcagag

SEQ ID NO: 5462 - RNA, 19 nt, artificial
  Oligomer
cugugagcuguuuuucucu

SEQ ID NO: 5463 - RNA, 19 nt, artificial
  Oligomer
auuccuuauaaugcaaaag

SEQ ID NO: 5464 - RNA, 19 nt, artificial
  Oligomer
ucaaaaggugcugguggag

SEQ ID NO: 5465 - RNA, 19 nt, artificial
  Oligomer
acugaguaggugccuucag

SEQ ID NO: 5466 - RNA, 19 nt, artificial
  Oligomer
ugucagacgccuuccaaua

SEQ ID NO: 5467 - RNA, 19 nt, artificial
  Oligomer
ucaucaaaaggugcuggug

SEQ ID NO: 5468 - RNA, 19 nt, artificial
  Oligomer
agacugugagcuguuuuuc

SEQ ID NO: 5469 - RNA, 19 nt, artificial
  Oligomer
auuuucacaguagacauua

SEQ ID NO: 5470 - RNA, 19 nt, artificial
  Oligomer
uagaauaaagcugauuuua

SEQ ID NO: 5471 - RNA, 19 nt, artificial
  Oligomer
aaaagauacugaguaggug

SEQ ID NO: 5472 - RNA, 19 nt, artificial
  Oligomer
uuucuucaagaugcuuuca

SEQ ID NO: 5473 - RNA, 19 nt, artificial
  Oligomer
ccaaucugaguuuuucuuc

SEQ ID NO: 5474 - RNA, 19 nt, artificial
  Oligomer
agcaagaagaguuuagugu

SEQ ID NO: 5475 - RNA, 19 nt, artificial
  Oligomer
uauugaucccauaggugua

SEQ ID NO: 5476 - RNA, 19 nt, artificial
  Oligomer
aguaauccacuaacgaacc

SEQ ID NO: 5477 - RNA, 19 nt, artificial
  Oligomer
aaaagcaagaagaguuuag

SEQ ID NO: 5478 - RNA, 19 nt, artificial
  Oligomer
uguaauuauagaucaacau

SEQ ID NO: 5479 - RNA, 19 nt, artificial
  Oligomer
uugguaucuuguggugucu

SEQ ID NO: 5480 - RNA, 19 nt, artificial
  Oligomer
uauggguaucuguuucaga

SEQ ID NO: 5481 - RNA, 19 nt, artificial
  Oligomer
agucagacuccaguucuuc

SEQ ID NO: 5482 - RNA, 19 nt, artificial
  Oligomer
aaugcuauggguaucuguu

SEQ ID NO: 5483 - RNA, 19 nt, artificial
  Oligomer
caucaaaaggugcuggugg

SEQ ID NO: 5484 - RNA, 19 nt, artificial
  Oligomer
cugacaugcuuauugaucc

SEQ ID NO: 5485 - RNA, 19 nt, artificial
  Oligomer
caaaugaaaauuuacuacc

SEQ ID NO: 5486 - RNA, 19 nt, artificial
  Oligomer
uauagaucaacaugauuuu

SEQ ID NO: 5487 - RNA, 19 nt, artificial
  Oligomer
aagcaagaagaguuuagug

SEQ ID NO: 5488 - RNA, 19 nt, artificial
  Oligomer
caugauuuuagugucuauu

SEQ ID NO: 5489 - RNA, 19 nt, artificial
  Oligomer
auugcugaagugcaguucu

SEQ ID NO: 5490 - RNA, 19 nt, artificial
  Oligomer
ugcagagugauaaagagga

SEQ ID NO: 5491 - RNA, 19 nt, artificial
  Oligomer
guaauuauagaucaacaug

SEQ ID NO: 5492 - RNA, 19 nt, artificial
  Oligomer
uccaaugcuauggguaucu

SEQ ID NO: 5493 - RNA, 19 nt, artificial
  Oligomer
auuuuccggccgacuugac

SEQ ID NO: 5494 - RNA, 19 nt, artificial
  Oligomer
ucccauagguguaauuaua

SEQ ID NO: 5495 - RNA, 19 nt, artificial
  Oligomer
aacgaaccaagucagacuc

SEQ ID NO: 5496 - RNA, 19 nt, artificial
  Oligomer
auuauagaucaacaugauu

SEQ ID NO: 5497 - RNA, 19 nt, artificial
  Oligomer
aagcccuguugguaucuug

SEQ ID NO: 5498 - RNA, 19 nt, artificial
  Oligomer
uagguguaauuauagauca

SEQ ID NO: 5499 - RNA, 19 nt, artificial
  Oligomer
uccaguucuucaucaaaag

SEQ ID NO: 5500 - RNA, 19 nt, artificial
  Oligomer
gaguuuuucuucaagaugc

SEQ ID NO: 5501 - RNA, 19 nt, artificial
  Oligomer
ugaauuaagguugcagaua

SEQ ID NO: 5502 - RNA, 19 nt, artificial
  Oligomer
cuguugauuaugaacaauu

SEQ ID NO: 5503 - RNA, 19 nt, artificial
  Oligomer
ugccuucagcagaaaacug

SEQ ID NO: 5504 - RNA, 19 nt, artificial
  Oligomer
agugucuauucuuuuauuu

SEQ ID NO: 5505 - RNA, 19 nt, artificial
  Oligomer
uucagaaauucugcagaga

SEQ ID NO: 5506 - RNA, 19 nt, artificial
  Oligomer
cuguuuuucucuccaaugc

SEQ ID NO: 5507 - RNA, 19 nt, artificial
  Oligomer
aaauagaaaccgaggcugg

SEQ ID NO: 5508 - RNA, 19 nt, artificial
  Oligomer
augaacaauuagcauaguu

SEQ ID NO: 5509 - RNA, 19 nt, artificial
  Oligomer
aauccacuaacgaaccaag

SEQ ID NO: 5510 - RNA, 19 nt, artificial
  Oligomer
ccauuauaaauagaaaccg

SEQ ID NO: 5511 - RNA, 19 nt, artificial
  Oligomer
gugagcuguuuuucucucc

SEQ ID NO: 5512 - RNA, 19 nt, artificial
  Oligomer
aaucagucugacaugcuua

SEQ ID NO: 5513 - RNA, 19 nt, artificial
  Oligomer
gacuuaauuccuuauaaug

SEQ ID NO: 5514 - RNA, 19 nt, artificial
  Oligomer
acuuucuacaauaguguga

SEQ ID NO: 5515 - RNA, 19 nt, artificial
  Oligomer
agcucuaucuugguuucug

SEQ ID NO: 5516 - RNA, 19 nt, artificial
  Oligomer
uuccuucuuucaauaucau

SEQ ID NO: 5517 - RNA, 19 nt, artificial
  Oligomer
aauucaccaaugcagagug

SEQ ID NO: 5518 - RNA, 19 nt, artificial
  Oligomer
acaguagacauuaaucagu

SEQ ID NO: 5519 - RNA, 19 nt, artificial
  Oligomer
ugguuucuguugauuauga

SEQ ID NO: 5520 - RNA, 19 nt, artificial
  Oligomer
cuucuuuccuucuuucaau

SEQ ID NO: 5521 - RNA, 19 nt, artificial
  Oligomer
uguuauucauucuuuugaa

SEQ ID NO: 5522 - RNA, 19 nt, artificial
  Oligomer
agaugcuuucaacuucuuu

SEQ ID NO: 5523 - RNA, 19 nt, artificial
  Oligomer
cuuuaguagacaaccugca

SEQ ID NO: 5524 - RNA, 19 nt, artificial
  Oligomer
gauuuuagugucuauucuu

SEQ ID NO: 5525 - RNA, 19 nt, artificial
  Oligomer
augcuauggguaucuguuu

SEQ ID NO: 5526 - RNA, 19 nt, artificial
  Oligomer
cuucggguguuuaaagagg

SEQ ID NO: 5527 - RNA, 19 nt, artificial
  Oligomer
aacaugauuuuagugucua

SEQ ID NO: 5528 - RNA, 19 nt, artificial
  Oligomer
ucaccuaauaaucggagac

SEQ ID NO: 5529 - RNA, 19 nt, artificial
  Oligomer
agagauggaaggaaaacuu

SEQ ID NO: 5530 - RNA, 19 nt, artificial
  Oligomer
auccagggugaucaccuaa

SEQ ID NO: 5531 - RNA, 19 nt, artificial
  Oligomer
ucagcugaauuaagguugc

SEQ ID NO: 5532 - RNA, 19 nt, artificial
  Oligomer
ugacaugcuuauugauccc

SEQ ID NO: 5533 - RNA, 19 nt, artificial
  Oligomer
aggauuaaauucaccaaug

SEQ ID NO: 5534 - RNA, 19 nt, artificial
  Oligomer
aaauuaggaacgcagcauu

SEQ ID NO: 5535 - RNA, 19 nt, artificial
  Oligomer
augcaaaagcaagaagagu

SEQ ID NO: 5536 - RNA, 19 nt, artificial
  Oligomer
aagguugcagauaauuuuu

SEQ ID NO: 5537 - RNA, 19 nt, artificial
  Oligomer
gugucuauucuuuuauuuu

SEQ ID NO: 5538 - RNA, 19 nt, artificial
  Oligomer
gucacagugagagcucuug

SEQ ID NO: 5539 - RNA, 19 nt, artificial
  Oligomer
uggguaucuguuucagaag

SEQ ID NO: 5540 - RNA, 19 nt, artificial
  Oligomer
uccucagacugugagcugu

SEQ ID NO: 5541 - RNA, 19 nt, artificial
  Oligomer
aauuuacuaccaaauuuuc

SEQ ID NO: 5542 - RNA, 19 nt, artificial
  Oligomer
aacuuucagaaauucugca

SEQ ID NO: 5543 - RNA, 19 nt, artificial
  Oligomer
gcugaagugcaguucuacc

SEQ ID NO: 5544 - RNA, 19 nt, artificial
  Oligomer
agaguuuaguguacgaacu

SEQ ID NO: 5545 - RNA, 19 nt, artificial
  Oligomer
acagugagagcucuuggag

SEQ ID NO: 5546 - RNA, 19 nt, artificial
  Oligomer
aagcugauuuuaaaagcac

SEQ ID NO: 5547 - RNA, 19 nt, artificial
  Oligomer
aggaacgcagcauuuacag

SEQ ID NO: 5548 - RNA, 19 nt, artificial
  Oligomer
cuucaucaaaaggugcugg

SEQ ID NO: 5549 - RNA, 19 nt, artificial
  Oligomer
ucccauuauugcugaagug

SEQ ID NO: 5550 - RNA, 19 nt, artificial
  Oligomer
aucuugguuucuguugauu

SEQ ID NO: 5551 - RNA, 19 nt, artificial
  Oligomer
uugcugaagugcaguucua

SEQ ID NO: 5552 - RNA, 19 nt, artificial
  Oligomer
gugaucaccuaauaaucgg

SEQ ID NO: 5553 - RNA, 19 nt, artificial
  Oligomer
augaaaauuuacuaccaaa

SEQ ID NO: 5554 - RNA, 19 nt, artificial
  Oligomer
aagaggaaaagauacugag

SEQ ID NO: 5555 - RNA, 19 nt, artificial
  Oligomer
auggguaucuguuucagaa

SEQ ID NO: 5556 - RNA, 19 nt, artificial
  Oligomer
ugaccaaucccauauccaa

SEQ ID NO: 5557 - RNA, 19 nt, artificial
  Oligomer
uaacagcucuucagugagc

SEQ ID NO: 5558 - RNA, 19 nt, artificial
  Oligomer
agaaguaauccacuaacga

SEQ ID NO: 5559 - RNA, 19 nt, artificial
  Oligomer
auccacuaacgaaccaagu

SEQ ID NO: 5560 - RNA, 19 nt, artificial
  Oligomer
cuuuccuucuuucaauauc

SEQ ID NO: 5561 - RNA, 19 nt, artificial
  Oligomer
guuucagaagcccuguugg

SEQ ID NO: 5562 - RNA, 19 nt, artificial
  Oligomer
aaguacuucagcugaauua

SEQ ID NO: 5563 - RNA, 19 nt, artificial
  Oligomer
uauaaugcaaaagcaagaa

SEQ ID NO: 5564 - RNA, 19 nt, artificial
  Oligomer
cugaucauccagggugauc

SEQ ID NO: 5565 - RNA, 19 nt, artificial
  Oligomer
acuucagcugaauuaaggu

SEQ ID NO: 5566 - RNA, 19 nt, artificial
  Oligomer
auaaagaggaaaagauacu

SEQ ID NO: 5567 - RNA, 19 nt, artificial
  Oligomer
guuuaguguacgaacugua

SEQ ID NO: 5568 - RNA, 19 nt, artificial
  Oligomer
cccguucccauuauugcug

SEQ ID NO: 5569 - RNA, 19 nt, artificial
  Oligomer
guacagcugaguuuguagc

SEQ ID NO: 5570 - RNA, 19 nt, artificial
  Oligomer
aaucuuucuuuaguagaca

SEQ ID NO: 5571 - RNA, 19 nt, artificial
  Oligomer
guguuuaaagaggaacucc

SEQ ID NO: 5572 - RNA, 19 nt, artificial
  Oligomer
acagcugaguuuguagcuc

SEQ ID NO: 5573 - RNA, 19 nt, artificial
  Oligomer
ugacgcucguguuccucau

SEQ ID NO: 5574 - RNA, 19 nt, artificial
  Oligomer
aguucuucaucaaaaggug

SEQ ID NO: 5575 - RNA, 19 nt, artificial
  Oligomer
aggaucuaacagcucuuca

SEQ ID NO: 5576 - RNA, 19 nt, artificial
  Oligomer
cccuguugguaucuugugg

SEQ ID NO: 5577 - RNA, 19 nt, artificial
  Oligomer
cagaaguaauccacuaacg

SEQ ID NO: 5578 - RNA, 19 nt, artificial
  Oligomer
aaauucaccaaugcagagu

SEQ ID NO: 5579 - RNA, 19 nt, artificial
  Oligomer
ugaucaccuaauaaucgga

SEQ ID NO: 5580 - RNA, 19 nt, artificial
  Oligomer
cacaauauuuauuuuggac

SEQ ID NO: 5581 - RNA, 19 nt, artificial
  Oligomer
uagcucuaucuugguuucu

SEQ ID NO: 5582 - RNA, 19 nt, artificial
  Oligomer
caacuucuuuccuucuuuc

SEQ ID NO: 5583 - RNA, 19 nt, artificial
  Oligomer
auaucaucuuccucagacu

SEQ ID NO: 5584 - RNA, 19 nt, artificial
  Oligomer
aaggagaggauuaaauuca

SEQ ID NO: 5585 - RNA, 19 nt, artificial
  Oligomer
caauagugugauauauaag

SEQ ID NO: 5586 - RNA, 19 nt, artificial
  Oligomer
aaaugagagagcagcagag

SEQ ID NO: 5587 - RNA, 19 nt, artificial
  Oligomer
cccauagguguaauuauag

SEQ ID NO: 5588 - RNA, 19 nt, artificial
  Oligomer
uacgaacuguacagcugag

SEQ ID NO: 5589 - RNA, 19 nt, artificial
  Oligomer
accugcauccauuuaaauu

SEQ ID NO: 5590 - RNA, 19 nt, artificial
  Oligomer
cagucugacaugcuuauug

SEQ ID NO: 5591 - RNA, 19 nt, artificial
  Oligomer
auauccaaucugaguuuuu

SEQ ID NO: 5592 - RNA, 19 nt, artificial
  Oligomer
uguuccucaugcugagggu

SEQ ID NO: 5593 - RNA, 19 nt, artificial
  Oligomer
cagaaaacugaucauccag

SEQ ID NO: 5594 - RNA, 19 nt, artificial
  Oligomer
gaguuuaguguacgaacug

SEQ ID NO: 5595 - RNA, 19 nt, artificial
  Oligomer
agauacugaguaggugccu

SEQ ID NO: 5596 - RNA, 19 nt, artificial
  Oligomer
caagaugcuuucaacuucu

SEQ ID NO: 5597 - RNA, 19 nt, artificial
  Oligomer
cuuaaaguagcgauuuuau

SEQ ID NO: 5598 - RNA, 19 nt, artificial
  Oligomer
uguugcaagcucagaagua

SEQ ID NO: 5599 - RNA, 19 nt, artificial
  Oligomer
uucaccaaugcagagugau

SEQ ID NO: 5600 - RNA, 19 nt, artificial
  Oligomer
ucagacgccuuccaauaua

SEQ ID NO: 5601 - RNA, 19 nt, artificial
  Oligomer
uccaugucuccauuauaaa

SEQ ID NO: 5602 - RNA, 19 nt, artificial
  Oligomer
agcccuguugguaucuugu

SEQ ID NO: 5603 - RNA, 19 nt, artificial
  Oligomer
caguagacauuaaucaguc

SEQ ID NO: 5604 - RNA, 19 nt, artificial
  Oligomer
ucagugagcuauguugcaa

SEQ ID NO: 5605 - RNA, 19 nt, artificial
  Oligomer
ucaugacgcucguguuccu

SEQ ID NO: 5606 - RNA, 19 nt, artificial
  Oligomer
uguugauuaugaacaauua

SEQ ID NO: 5607 - RNA, 19 nt, artificial
  Oligomer
agcucagaaguaauccacu

SEQ ID NO: 5608 - RNA, 19 nt, artificial
  Oligomer
aucuuucuuuaguagacaa

SEQ ID NO: 5609 - RNA, 19 nt, artificial
  Oligomer
caguucuucaucaaaaggu

SEQ ID NO: 5610 - RNA, 19 nt, artificial
  Oligomer
ucuacaauagugugauaua

SEQ ID NO: 5611 - RNA, 19 nt, artificial
  Oligomer
gcuguuuuucucuccaaug

SEQ ID NO: 5612 - RNA, 19 nt, artificial
  Oligomer
ugagagcucuuggagcuac

SEQ ID NO: 5613 - RNA, 19 nt, artificial
  Oligomer
cuauguugcaagcucagaa

SEQ ID NO: 5614 - RNA, 19 nt, artificial
  Oligomer
acaaccugcauccauuuaa

SEQ ID NO: 5615 - RNA, 19 nt, artificial
  Oligomer
cccauuauugcugaagugc

SEQ ID NO: 5616 - RNA, 19 nt, artificial
  Oligomer
caaauuuucacaguagaca

SEQ ID NO: 5617 - RNA, 19 nt, artificial
  Oligomer
cuaaauuaggaacgcagca

SEQ ID NO: 5618 - RNA, 19 nt, artificial
  Oligomer
cuucagcugaauuaagguu

SEQ ID NO: 5619 - RNA, 19 nt, artificial
  Oligomer
auuaggaacgcagcauuua

SEQ ID NO: 5620 - RNA, 19 nt, artificial
  Oligomer
aucaaaaggugcuggugga

SEQ ID NO: 5621 - RNA, 19 nt, artificial
  Oligomer
agauuugcuuagaauaaag

SEQ ID NO: 5622 - RNA, 19 nt, artificial
  Oligomer
guaucuguuucagaagccc

SEQ ID NO: 5623 - RNA, 19 nt, artificial
  Oligomer
aaaggagaggauuaaauuc

SEQ ID NO: 5624 - RNA, 19 nt, artificial
  Oligomer
gcuuucaacuucuuuccuu

SEQ ID NO: 5625 - RNA, 19 nt, artificial
  Oligomer
aaaguagcgauuuuauuau

SEQ ID NO: 5626 - RNA, 19 nt, artificial
  Oligomer
cuugaccaaucccauaucc

SEQ ID NO: 5627 - RNA, 19 nt, artificial
  Oligomer
agugcaguucuacccagga

SEQ ID NO: 5628 - RNA, 19 nt, artificial
  Oligomer
aaauuuucacaguagacau

SEQ ID NO: 5629 - RNA, 19 nt, artificial
  Oligomer
auaaaguacuucagcugaa

SEQ ID NO: 5630 - RNA, 19 nt, artificial
  Oligomer
aaucccauauccaaucuga

SEQ ID NO: 5631 - RNA, 19 nt, artificial
  Oligomer
cuaauaaucggagacuuaa

SEQ ID NO: 5632 - RNA, 19 nt, artificial
  Oligomer
aguagcgauuuuauuauca

SEQ ID NO: 5633 - RNA, 19 nt, artificial
  Oligomer
aguguacgaacuguacagc

SEQ ID NO: 5634 - RNA, 19 nt, artificial
  Oligomer
acuugaccaaucccauauc

SEQ ID NO: 5635 - RNA, 19 nt, artificial
  Oligomer
cuaacgaaccaagucagac

SEQ ID NO: 5636 - RNA, 19 nt, artificial
  Oligomer
uucuguugauuaugaacaa

SEQ ID NO: 5637 - RNA, 19 nt, artificial
  Oligomer
gaauauuuuccggccgacu

SEQ ID NO: 5638 - RNA, 19 nt, artificial
  Oligomer
uugaucccauagguguaau

SEQ ID NO: 5639 - RNA, 19 nt, artificial
  Oligomer
accaagucagacuccaguu

SEQ ID NO: 5640 - RNA, 19 nt, artificial
  Oligomer
guuucuguugauuaugaac

SEQ ID NO: 5641 - RNA, 19 nt, artificial
  Oligomer
cuucuuucaauaucaucuu

SEQ ID NO: 5642 - RNA, 19 nt, artificial
  Oligomer
acaauagugugauauauaa

SEQ ID NO: 5643 - RNA, 19 nt, artificial
  Oligomer
cauuauugcugaagugcag

SEQ ID NO: 5644 - RNA, 19 nt, artificial
  Oligomer
ucuuuccuucuuucaauau

SEQ ID NO: 5645 - RNA, 19 nt, artificial
  Oligomer
gaaaacuuucagaaauucu

SEQ ID NO: 5646 - RNA, 19 nt, artificial
  Oligomer
aauuaggaacgcagcauuu

SEQ ID NO: 5647 - RNA, 19 nt, artificial
  Oligomer
uaaaguacuucagcugaau

SEQ ID NO: 5648 - RNA, 19 nt, artificial
  Oligomer
uagcgauuuuauuaucaau

SEQ ID NO: 5649 - RNA, 19 nt, artificial
  Oligomer
agaaauucugcagagaaua

SEQ ID NO: 5650 - RNA, 19 nt, artificial
  Oligomer
cucuaucuugguuucuguu

SEQ ID NO: 5651 - RNA, 19 nt, artificial
  Oligomer
aagcacacaaaaguugaac

SEQ ID NO: 5652 - RNA, 19 nt, artificial
  Oligomer
aaaaguugaacacaaagga

SEQ ID NO: 5653 - RNA, 19 nt, artificial
  Oligomer
cgacgcuacucagaugaaa

SEQ ID NO: 5654 - RNA, 19 nt, artificial
  Oligomer
gugggaacauggauuuuga

SEQ ID NO: 5655 - RNA, 19 nt, artificial
  Oligomer
ucaugaacauucucaauaa

SEQ ID NO: 5656 - RNA, 19 nt, artificial
  Oligomer
ccauguuccgugccuucaa

SEQ ID NO: 5657 - RNA, 19 nt, artificial
  Oligomer
cuucaaaucucuugacaaa

SEQ ID NO: 5658 - RNA, 19 nt, artificial
  Oligomer
gaccauuugcaguagugaa

SEQ ID NO: 5659 - RNA, 19 nt, artificial
  Oligomer
cauguuccgugccuucaaa

SEQ ID NO: 5660 - RNA, 19 nt, artificial
  Oligomer
ugguuaacucguucuugaa

SEQ ID NO: 5661 - RNA, 19 nt, artificial
  Oligomer
ccacagaacucaugaacau

SEQ ID NO: 5662 - RNA, 19 nt, artificial
  Oligomer
gauggauagcgacaccaca

SEQ ID NO: 5663 - RNA, 19 nt, artificial
  Oligomer
caggguuccaccugaauga

SEQ ID NO: 5664 - RNA, 19 nt, artificial
  Oligomer
ggaacauggauuuugacaa

SEQ ID NO: 5665 - RNA, 19 nt, artificial
  Oligomer
aggcccaggaggaaauaaa

SEQ ID NO: 5666 - RNA, 19 nt, artificial
  Oligomer
ccuucaaaucucuugacaa

SEQ ID NO: 5667 - RNA, 19 nt, artificial
  Oligomer
cuggacaaauccaggugaa

SEQ ID NO: 5668 - RNA, 19 nt, artificial
  Oligomer
aacucaugaacauucucaa

SEQ ID NO: 5669 - RNA, 19 nt, artificial
  Oligomer
gauccugucugcagucaca

SEQ ID NO: 5670 - RNA, 19 nt, artificial
  Oligomer
cgaucagggaccauuugca

SEQ ID NO: 5671 - RNA, 19 nt, artificial
  Oligomer
ccugaaugagcaucucuau

SEQ ID NO: 5672 - RNA, 19 nt, artificial
  Oligomer
ccgacgcuacucagaugaa

SEQ ID NO: 5673 - RNA, 19 nt, artificial
  Oligomer
cccugaucugaagacugau

SEQ ID NO: 5674 - RNA, 19 nt, artificial
  Oligomer
acuuguggaacaacaucaa

SEQ ID NO: 5675 - RNA, 19 nt, artificial
  Oligomer
ggcugcagcugacuaugua

SEQ ID NO: 5676 - RNA, 19 nt, artificial
  Oligomer
cugguuaacucguucuuga

SEQ ID NO: 5677 - RNA, 19 nt, artificial
  Oligomer
caaaucucuugacaaagau

SEQ ID NO: 5678 - RNA, 19 nt, artificial
  Oligomer
cacgacacccugaucugaa

SEQ ID NO: 5679 - RNA, 19 nt, artificial
  Oligomer
cugacuauguauuccugaa

SEQ ID NO: 5680 - RNA, 19 nt, artificial
  Oligomer
gcucuaggacacucuaaca

SEQ ID NO: 5681 - RNA, 19 nt, artificial
  Oligomer
ccauauacaaacaguucga

SEQ ID NO: 5682 - RNA, 19 nt, artificial
  Oligomer
ggaccauuugcaguaguga

SEQ ID NO: 5683 - RNA, 19 nt, artificial
  Oligomer
ugggcuuugaggaauucaa

SEQ ID NO: 5684 - RNA, 19 nt, artificial
  Oligomer
ggcccaggaggaaauaaac

SEQ ID NO: 5685 - RNA, 19 nt, artificial
  Oligomer
gguuccaccugaaugagca

SEQ ID NO: 5686 - RNA, 19 nt, artificial
  Oligomer
gagcaucucuauaacauga

SEQ ID NO: 5687 - RNA, 19 nt, artificial
  Oligomer
gacaaauccaggugaacau

SEQ ID NO: 5688 - RNA, 19 nt, artificial
  Oligomer
cccucacugccuugcuaua

SEQ ID NO: 5689 - RNA, 19 nt, artificial
  Oligomer
cuuguggaacaacaucaaa

SEQ ID NO: 5690 - RNA, 19 nt, artificial
  Oligomer
cacauuacuccaacauuga

SEQ ID NO: 5691 - RNA, 19 nt, artificial
  Oligomer
cccagcuucucaacaucca

SEQ ID NO: 5692 - RNA, 19 nt, artificial
  Oligomer
gaccgaucagggaccauuu

SEQ ID NO: 5693 - RNA, 19 nt, artificial
  Oligomer
ucaaguacuuguggaacaa

SEQ ID NO: 5694 - RNA, 19 nt, artificial
  Oligomer
cccagugccuuugucuaua

SEQ ID NO: 5695 - RNA, 19 nt, artificial
  Oligomer
ggacaaauccaggugaaca

SEQ ID NO: 5696 - RNA, 19 nt, artificial
  Oligomer
guucgacacugaccgauca

SEQ ID NO: 5697 - RNA, 19 nt, artificial
  Oligomer
ccagugccuuugucuauau

SEQ ID NO: 5698 - RNA, 19 nt, artificial
  Oligomer
gaaugagcaucucuauaac

SEQ ID NO: 5699 - RNA, 19 nt, artificial
  Oligomer
aguacuuguggaacaacau

SEQ ID NO: 5700 - RNA, 19 nt, artificial
  Oligomer
caauaagguugugacacga

SEQ ID NO: 5701 - RNA, 19 nt, artificial
  Oligomer
caagcugggcuuugaggaa

SEQ ID NO: 5702 - RNA, 19 nt, artificial
  Oligomer
gggcuuugaggaauucaag

SEQ ID NO: 5703 - RNA, 19 nt, artificial
  Oligomer
cucaguucugggaggauga

SEQ ID NO: 5704 - RNA, 19 nt, artificial
  Oligomer
gcccaggaggaaauaaaca

SEQ ID NO: 5705 - RNA, 19 nt, artificial
  Oligomer
caggcccaggaggaaauaa

SEQ ID NO: 5706 - RNA, 19 nt, artificial
  Oligomer
cagaacucaugaacauucu

SEQ ID NO: 5707 - RNA, 19 nt, artificial
  Oligomer
aaguacuuguggaacaaca

SEQ ID NO: 5708 - RNA, 19 nt, artificial
  Oligomer
acaugaucauccgacgcua

SEQ ID NO: 5709 - RNA, 19 nt, artificial
  Oligomer
acccugaucugaagacuga

SEQ ID NO: 5710 - RNA, 19 nt, artificial
  Oligomer
cugaaugagcaucucuaua

SEQ ID NO: 5711 - RNA, 19 nt, artificial
  Oligomer
gaacauucucaauaagguu

SEQ ID NO: 5712 - RNA, 19 nt, artificial
  Oligomer
aaauccaggugaacaucca

SEQ ID NO: 5713 - RNA, 19 nt, artificial
  Oligomer
accugaaugagcaucucua

SEQ ID NO: 5714 - RNA, 19 nt, artificial
  Oligomer
gugccuuugucuauauucu

SEQ ID NO: 5715 - RNA, 19 nt, artificial
  Oligomer
ccugggaaaugugcuugga

SEQ ID NO: 5716 - RNA, 19 nt, artificial
  Oligomer
aauucaaguacuuguggaa

SEQ ID NO: 5717 - RNA, 19 nt, artificial
  Oligomer
ugaacauucucaauaaggu

SEQ ID NO: 5718 - RNA, 19 nt, artificial
  Oligomer
cugucugcagucacaucuu

SEQ ID NO: 5719 - RNA, 19 nt, artificial
  Oligomer
ucugaagacugaugguuuu

SEQ ID NO: 5720 - RNA, 19 nt, artificial
  Oligomer
caugaacauucucaauaag

SEQ ID NO: 5721 - RNA, 19 nt, artificial
  Oligomer
ggaacaacaucaaaaggug

SEQ ID NO: 5722 - RNA, 19 nt, artificial
  Oligomer
cccaggaggaaauaaacau

SEQ ID NO: 5723 - RNA, 19 nt, artificial
  Oligomer
caagccuagcacuugugau

SEQ ID NO: 5724 - RNA, 19 nt, artificial
  Oligomer
uuguggaacaacaucaaaa

SEQ ID NO: 5725 - RNA, 19 nt, artificial
  Oligomer
gcuauaggagucaccugga

SEQ ID NO: 5726 - RNA, 19 nt, artificial
  Oligomer
ccauguuccugguuaacuc

SEQ ID NO: 5727 - RNA, 19 nt, artificial
  Oligomer
gggaacauggauuuugaca

SEQ ID NO: 5728 - RNA, 19 nt, artificial
  Oligomer
cucuaggacacucuaacaa

SEQ ID NO: 5729 - RNA, 19 nt, artificial
  Oligomer
gcugcagcugacuauguau

SEQ ID NO: 5730 - RNA, 19 nt, artificial
  Oligomer
augaaagugggaacaugga

SEQ ID NO: 5731 - RNA, 19 nt, artificial
  Oligomer
ucaaaucucuugacaaaga

SEQ ID NO: 5732 - RNA, 19 nt, artificial
  Oligomer
agcuuuuguucucucagua

SEQ ID NO: 5733 - RNA, 19 nt, artificial
  Oligomer
cagugccuuugucuauauu

SEQ ID NO: 5734 - RNA, 19 nt, artificial
  Oligomer
cgacacccugaucugaaga

SEQ ID NO: 5735 - RNA, 19 nt, artificial
  Oligomer
gaauucaaguacuugugga

SEQ ID NO: 5736 - RNA, 19 nt, artificial
  Oligomer
gaacauggauuuugacaac

SEQ ID NO: 5737 - RNA, 19 nt, artificial
  Oligomer
acaguucgacacugaccga

SEQ ID NO: 5738 - RNA, 19 nt, artificial
  Oligomer
cauccgacgcuacucagau

SEQ ID NO: 5739 - RNA, 19 nt, artificial
  Oligomer
agcaggguuccaccugaau

SEQ ID NO: 5740 - RNA, 19 nt, artificial
  Oligomer
ugaaugagcaucucuauaa

SEQ ID NO: 5741 - RNA, 19 nt, artificial
  Oligomer
caacauccagggcccaauu

SEQ ID NO: 5742 - RNA, 19 nt, artificial
  Oligomer
caaacaguucgacacugac

SEQ ID NO: 5743 - RNA, 19 nt, artificial
  Oligomer
acucaugaacauucucaau

SEQ ID NO: 5744 - RNA, 19 nt, artificial
  Oligomer
ucacugccuugcuauagga

SEQ ID NO: 5745 - RNA, 19 nt, artificial
  Oligomer
auagcgacaccacaggcaa

SEQ ID NO: 5746 - RNA, 19 nt, artificial
  Oligomer
guuccaccugaaugagcau

SEQ ID NO: 5747 - RNA, 19 nt, artificial
  Oligomer
ucucaauaagguugugaca

SEQ ID NO: 5748 - RNA, 19 nt, artificial
  Oligomer
ccaagccuagcacuuguga

SEQ ID NO: 5749 - RNA, 19 nt, artificial
  Oligomer
ccagcuucucaacauccag

SEQ ID NO: 5750 - RNA, 19 nt, artificial
  Oligomer
uggauuuugacaacuucau

SEQ ID NO: 5751 - RNA, 19 nt, artificial
  Oligomer
cuauaacaugaucauccga

SEQ ID NO: 5752 - RNA, 19 nt, artificial
  Oligomer
aggugaacauccaggagug

SEQ ID NO: 5753 - RNA, 19 nt, artificial
  Oligomer
uuguuacccagcuucucaa

SEQ ID NO: 5754 - RNA, 19 nt, artificial
  Oligomer
ggcuuugaggaauucaagu

SEQ ID NO: 5755 - RNA, 19 nt, artificial
  Oligomer
ugaucugaagacugauggu

SEQ ID NO: 5756 - RNA, 19 nt, artificial
  Oligomer
uguggaacaacaucaaaag

SEQ ID NO: 5757 - RNA, 19 nt, artificial
  Oligomer
acaaacaguucgacacuga

SEQ ID NO: 5758 - RNA, 19 nt, artificial
  Oligomer
gccuucaaaucucuugaca

SEQ ID NO: 5759 - RNA, 19 nt, artificial
  Oligomer
auggauuuugacaacuuca

SEQ ID NO: 5760 - RNA, 19 nt, artificial
  Oligomer
cuuguuacccagcuucuca

SEQ ID NO: 5761 - RNA, 19 nt, artificial
  Oligomer
gaggaauucaaguacuugu

SEQ ID NO: 5762 - RNA, 19 nt, artificial
  Oligomer
ugaaagugggaacauggau

SEQ ID NO: 5763 - RNA, 19 nt, artificial
  Oligomer
gaucauccgacgcuacuca

SEQ ID NO: 5764 - RNA, 19 nt, artificial
  Oligomer
cauggauuuugacaacuuc

SEQ ID NO: 5765 - RNA, 19 nt, artificial
  Oligomer
gugccuucaaaucucuuga

SEQ ID NO: 5766 - RNA, 19 nt, artificial
  Oligomer
ggcucuaggacacucuaac

SEQ ID NO: 5767 - RNA, 19 nt, artificial
  Oligomer
aaugagcaucucuauaaca

SEQ ID NO: 5768 - RNA, 19 nt, artificial
  Oligomer
cacagaacucaugaacauu

SEQ ID NO: 5769 - RNA, 19 nt, artificial
  Oligomer
gauuuugacaacuucauca

SEQ ID NO: 5770 - RNA, 19 nt, artificial
  Oligomer
gaaagugggaacauggauu

SEQ ID NO: 5771 - RNA, 19 nt, artificial
  Oligomer
uugcaguagugaacuccca

SEQ ID NO: 5772 - RNA, 19 nt, artificial
  Oligomer
ugggaacauggauuuugac

SEQ ID NO: 5773 - RNA, 19 nt, artificial
  Oligomer
ccgugccuucaaaucucuu

SEQ ID NO: 5774 - RNA, 19 nt, artificial
  Oligomer
cucaguacuuguuacccag

SEQ ID NO: 5775 - RNA, 19 nt, artificial
  Oligomer
acgacacccugaucugaag

SEQ ID NO: 5776 - RNA, 19 nt, artificial
  Oligomer
uccaggugaacauccagga

SEQ ID NO: 5777 - RNA, 19 nt, artificial
  Oligomer
acacgacacccugaucuga

SEQ ID NO: 5778 - RNA, 19 nt, artificial
  Oligomer
aucucuauaacaugaucau

SEQ ID NO: 5779 - RNA, 19 nt, artificial
  Oligomer
gcugacuauguauuccuga

SEQ ID NO: 5780 - RNA, 19 nt, artificial
  Oligomer
auaagguugugacacgaca

SEQ ID NO: 5781 - RNA, 19 nt, artificial
  Oligomer
uacucagaugaaaguggga

SEQ ID NO: 5782 - RNA, 19 nt, artificial
  Oligomer
gcuuugaggaauucaagua

SEQ ID NO: 5783 - RNA, 19 nt, artificial
  Oligomer
gaacucaugaacauucuca

SEQ ID NO: 5784 - RNA, 19 nt, artificial
  Oligomer
ccaggaggaaauaaacaug

SEQ ID NO: 5785 - RNA, 19 nt, artificial
  Oligomer
gacgcuacucagaugaaag

SEQ ID NO: 5786 - RNA, 19 nt, artificial
  Oligomer
caucucuauaacaugauca

SEQ ID NO: 5787 - RNA, 19 nt, artificial
  Oligomer
ggagaugacauggagguca

SEQ ID NO: 5788 - RNA, 19 nt, artificial
  Oligomer
cucaugaacauucucaaua

SEQ ID NO: 5789 - RNA, 19 nt, artificial
  Oligomer
gcacuugugaugccuccau

SEQ ID NO: 5790 - RNA, 19 nt, artificial
  Oligomer
gagaugacauggaggucag

SEQ ID NO: 5791 - RNA, 19 nt, artificial
  Oligomer
acauggauuuugacaacuu

SEQ ID NO: 5792 - RNA, 19 nt, artificial
  Oligomer
cucuaacaagcucugucca

SEQ ID NO: 5793 - RNA, 19 nt, artificial
  Oligomer
gaugaaagugggaacaugg

SEQ ID NO: 5794 - RNA, 19 nt, artificial
  Oligomer
ugcugacccacaagcuuuu

SEQ ID NO: 5795 - RNA, 19 nt, artificial
  Oligomer
gcaguuccggagacucuuu

SEQ ID NO: 5796 - RNA, 19 nt, artificial
  Oligomer
ccauuugcaguagugaacu

SEQ ID NO: 5797 - RNA, 19 nt, artificial
  Oligomer
ugucugcagucacaucuuu

SEQ ID NO: 5798 - RNA, 19 nt, artificial
  Oligomer
ugacccacaagcuuuuguu

SEQ ID NO: 5799 - RNA, 19 nt, artificial
  Oligomer
ucucaguacuuguuaccca

SEQ ID NO: 5800 - RNA, 19 nt, artificial
  Oligomer
ggauuuugacaacuucauc

SEQ ID NO: 5801 - RNA, 19 nt, artificial
  Oligomer
uugugacacgacacccuga

SEQ ID NO: 5802 - RNA, 19 nt, artificial
  Oligomer
gacuauguauuccugaacu

SEQ ID NO: 5803 - RNA, 19 nt, artificial
  Oligomer
ugagcaucucuauaacaug

SEQ ID NO: 5804 - RNA, 19 nt, artificial
  Oligomer
uauguauuccugaacugga

SEQ ID NO: 5805 - RNA, 19 nt, artificial
  Oligomer
augagcaucucuauaacau

SEQ ID NO: 5806 - RNA, 19 nt, artificial
  Oligomer
gcaucucuauaacaugauc

SEQ ID NO: 5807 - RNA, 19 nt, artificial
  Oligomer
aguacuuguuacccagcuu

SEQ ID NO: 5808 - RNA, 19 nt, artificial
  Oligomer
ucauccgacgcuacucaga

SEQ ID NO: 5809 - RNA, 19 nt, artificial
  Oligomer
gggaccauuugcaguagug

SEQ ID NO: 5810 - RNA, 19 nt, artificial
  Oligomer
caggugaacauccaggagu

SEQ ID NO: 5811 - RNA, 19 nt, artificial
  Oligomer
uucaaguacuuguggaaca

SEQ ID NO: 5812 - RNA, 19 nt, artificial
  Oligomer
cugggaaaugugcuuggag

SEQ ID NO: 5813 - RNA, 19 nt, artificial
  Oligomer
auauacaaacaguucgaca

SEQ ID NO: 5814 - RNA, 19 nt, artificial
  Oligomer
gaucagggaccauuugcag

SEQ ID NO: 5815 - RNA, 19 nt, artificial
  Oligomer
guucucucaguacuuguua

SEQ ID NO: 5816 - RNA, 19 nt, artificial
  Oligomer
ucugcagucacaucuuugu

SEQ ID NO: 5817 - RNA, 19 nt, artificial
  Oligomer
aagcuuuuguucucucagu

SEQ ID NO: 5818 - RNA, 19 nt, artificial
  Oligomer
caguacuuguuacccagcu

SEQ ID NO: 5819 - RNA, 19 nt, artificial
  Oligomer
gguuaacucguucuugaag

SEQ ID NO: 5820 - RNA, 19 nt, artificial
  Oligomer
uuacccagcuucucaacau

SEQ ID NO: 5821 - RNA, 19 nt, artificial
  Oligomer
ggacacucuaacaagcucu

SEQ ID NO: 5822 - RNA, 19 nt, artificial
  Oligomer
acaagcuuuuguucucuca

SEQ ID NO: 5823 - RNA, 19 nt, artificial
  Oligomer
cuaggacacucuaacaagc

SEQ ID NO: 5824 - RNA, 19 nt, artificial
  Oligomer
ccaccugaaugagcaucuc

SEQ ID NO: 5825 - RNA, 19 nt, artificial
  Oligomer
uugaggaauucaaguacuu

SEQ ID NO: 5826 - RNA, 19 nt, artificial
  Oligomer
agaugaaagugggaacaug

SEQ ID NO: 5827 - RNA, 19 nt, artificial
  Oligomer
cagaugaaagugggaacau

SEQ ID NO: 5828 - RNA, 19 nt, artificial
  Oligomer
cuauaggagucaccuggag

SEQ ID NO: 5829 - RNA, 19 nt, artificial
  Oligomer
acgcuacucagaugaaagu

SEQ ID NO: 5830 - RNA, 19 nt, artificial
  Oligomer
cccacaagcuuuuguucuc

SEQ ID NO: 5831 - RNA, 19 nt, artificial
  Oligomer
aauccaggugaacauccag

SEQ ID NO: 5832 - RNA, 19 nt, artificial
  Oligomer
ccacaagcuuuuguucucu

SEQ ID NO: 5833 - RNA, 19 nt, artificial
  Oligomer
cucucaguucugggaggau

SEQ ID NO: 5834 - RNA, 19 nt, artificial
  Oligomer
agcugggcuuugaggaauu

SEQ ID NO: 5835 - RNA, 19 nt, artificial
  Oligomer
cuuuuguucucucaguacu

SEQ ID NO: 5836 - RNA, 19 nt, artificial
  Oligomer
acuggacaaauccagguga

SEQ ID NO: 5837 - RNA, 19 nt, artificial
  Oligomer
agcaucucuauaacaugau

SEQ ID NO: 5838 - RNA, 19 nt, artificial
  Oligomer
aacucccaggugccuuuga

SEQ ID NO: 5839 - RNA, 19 nt, artificial
  Oligomer
ucagggaccauuugcagua

SEQ ID NO: 5840 - RNA, 19 nt, artificial
  Oligomer
auguauuccugaacuggag

SEQ ID NO: 5841 - RNA, 19 nt, artificial
  Oligomer
caugaucauccgacgcuac

SEQ ID NO: 5842 - RNA, 19 nt, artificial
  Oligomer
cagggaccauuugcaguag

SEQ ID NO: 5843 - RNA, 19 nt, artificial
  Oligomer
ugugacacgacacccugau

SEQ ID NO: 5844 - RNA, 19 nt, artificial
  Oligomer
ccugucugcagucacaucu

SEQ ID NO: 5845 - RNA, 19 nt, artificial
  Oligomer
cacccugaucugaagacug

SEQ ID NO: 5846 - RNA, 19 nt, artificial
  Oligomer
agggaccauuugcaguagu

SEQ ID NO: 5847 - RNA, 19 nt, artificial
  Oligomer
ggaggaaauaaacaugccc

SEQ ID NO: 5848 - RNA, 19 nt, artificial
  Oligomer
ugaacucccaggugccuuu

SEQ ID NO: 5849 - RNA, 19 nt, artificial
  Oligomer
ugccuuugucuauauucug

SEQ ID NO: 5850 - RNA, 19 nt, artificial
  Oligomer
ugucuauauucugcuccca

SEQ ID NO: 5851 - RNA, 19 nt, artificial
  Oligomer
uguuccugguuaacucguu

SEQ ID NO: 5852 - RNA, 19 nt, artificial
  Oligomer
cugggcuuugaggaauuca

SEQ ID NO: 5853 - RNA, 19 nt, artificial
  Oligomer
ugauggauagcgacaccac

SEQ ID NO: 5854 - RNA, 19 nt, artificial
  Oligomer
caccugaaugagcaucucu

SEQ ID NO: 5855 - RNA, 19 nt, artificial
  Oligomer
cacuugugaugccuccaug

SEQ ID NO: 5856 - RNA, 19 nt, artificial
  Oligomer
caguagugaacucccaggu

SEQ ID NO: 5857 - RNA, 19 nt, artificial
  Oligomer
auccuaggcggagucauca

SEQ ID NO: 5858 - RNA, 19 nt, artificial
  Oligomer
aaagugggaacauggauuu

SEQ ID NO: 5859 - RNA, 19 nt, artificial
  Oligomer
acauuacuccaacauugag

SEQ ID NO: 5860 - RNA, 19 nt, artificial
  Oligomer
aucugaagacugaugguuu

SEQ ID NO: 5861 - RNA, 19 nt, artificial
  Oligomer
guggaacaacaucaaaagg

SEQ ID NO: 5862 - RNA, 19 nt, artificial
  Oligomer
caagcuuuuguucucucag

SEQ ID NO: 5863 - RNA, 19 nt, artificial
  Oligomer
caguucgacacugaccgau

SEQ ID NO: 5864 - RNA, 19 nt, artificial
  Oligomer
cugcugacccacaagcuuu

SEQ ID NO: 5865 - RNA, 19 nt, artificial
  Oligomer
aagugggaacauggauuuu

SEQ ID NO: 5866 - RNA, 19 nt, artificial
  Oligomer
cuggagaugacauggaggu

SEQ ID NO: 5867 - RNA, 19 nt, artificial
  Oligomer
uacuuguggaacaacauca

SEQ ID NO: 5868 - RNA, 19 nt, artificial
  Oligomer
gcuuuuguucucucaguac

SEQ ID NO: 5869 - RNA, 19 nt, artificial
  Oligomer
cugccuugcuauaggaguc

SEQ ID NO: 5870 - RNA, 19 nt, artificial
  Oligomer
ucaacauccagggcccaau

SEQ ID NO: 5871 - RNA, 19 nt, artificial
  Oligomer
caguucugggaggaugacu

SEQ ID NO: 5872 - RNA, 19 nt, artificial
  Oligomer
ugggaaaugugcuuggagg

SEQ ID NO: 5873 - RNA, 19 nt, artificial
  Oligomer
uggacaaauccaggugaac

SEQ ID NO: 5874 - RNA, 19 nt, artificial
  Oligomer
gcacuggacaaauccaggu

SEQ ID NO: 5875 - RNA, 19 nt, artificial
  Oligomer
aggaggaaauaaacaugcc

SEQ ID NO: 5876 - RNA, 19 nt, artificial
  Oligomer
agcacuugugaugccucca

SEQ ID NO: 5877 - RNA, 19 nt, artificial
  Oligomer
acucagaugaaagugggaa

SEQ ID NO: 5878 - RNA, 19 nt, artificial
  Oligomer
ccugaucugaagacugaug

SEQ ID NO: 5879 - RNA, 19 nt, artificial
  Oligomer
uuuuguucucucaguacuu

SEQ ID NO: 5880 - RNA, 19 nt, artificial
  Oligomer
ccuuugucuauauucugcu

SEQ ID NO: 5881 - RNA, 19 nt, artificial
  Oligomer
cagcugacuauguauuccu

SEQ ID NO: 5882 - RNA, 19 nt, artificial
  Oligomer
gaacaacaucaaaaggugg

SEQ ID NO: 5883 - RNA, 19 nt, artificial
  Oligomer
uguucucucaguacuuguu

SEQ ID NO: 5884 - RNA, 19 nt, artificial
  Oligomer
cucacugccuugcuauagg

SEQ ID NO: 5885 - RNA, 19 nt, artificial
  Oligomer
ucuauaacaugaucauccg

SEQ ID NO: 5886 - RNA, 19 nt, artificial
  Oligomer
guuacccagcuucucaaca

SEQ ID NO: 5887 - RNA, 19 nt, artificial
  Oligomer
ucagaugaaagugggaaca

SEQ ID NO: 5888 - RNA, 19 nt, artificial
  Oligomer
cugcagucacaucuuugug

SEQ ID NO: 5889 - RNA, 19 nt, artificial
  Oligomer
caaguacuuguggaacaac

SEQ ID NO: 5890 - RNA, 19 nt, artificial
  Oligomer
cucagaugaaagugggaac

SEQ ID NO: 5891 - RNA, 19 nt, artificial
  Oligomer
ucuaggacacucuaacaag

SEQ ID NO: 5892 - RNA, 19 nt, artificial
  Oligomer
cauucucaauaagguugug

SEQ ID NO: 5893 - RNA, 19 nt, artificial
  Oligomer
auacaaacaguucgacacu

SEQ ID NO: 5894 - RNA, 19 nt, artificial
  Oligomer
ugaccgaucagggaccauu

SEQ ID NO: 5895 - RNA, 19 nt, artificial
  Oligomer
aggguuccaccugaaugag

SEQ ID NO: 5896 - RNA, 19 nt, artificial
  Oligomer
cacugccuugcuauaggag

SEQ ID NO: 5897 - RNA, 19 nt, artificial
  Oligomer
gugauggauagcgacacca

SEQ ID NO: 5898 - RNA, 19 nt, artificial
  Oligomer
cuugcuauaggagucaccu

SEQ ID NO: 5899 - RNA, 19 nt, artificial
  Oligomer
aaaugugcuuggaggccug

SEQ ID NO: 5900 - RNA, 19 nt, artificial
  Oligomer
uccgugccuucaaaucucu

SEQ ID NO: 5901 - RNA, 19 nt, artificial
  Oligomer
agcugacuauguauuccug

SEQ ID NO: 5902 - RNA, 19 nt, artificial
  Oligomer
cauuugcaguagugaacuc

SEQ ID NO: 5903 - RNA, 19 nt, artificial
  Oligomer
gacacucuaacaagcucug

SEQ ID NO: 5904 - RNA, 19 nt, artificial
  Oligomer
aagccuagcacuugugaug

SEQ ID NO: 5905 - RNA, 19 nt, artificial
  Oligomer
cgugccuucaaaucucuug

SEQ ID NO: 5906 - RNA, 19 nt, artificial
  Oligomer
auggauagcgacaccacag

SEQ ID NO: 5907 - RNA, 19 nt, artificial
  Oligomer
gucugcagucacaucuuug

SEQ ID NO: 5908 - RNA, 19 nt, artificial
  Oligomer
guacuuguggaacaacauc

SEQ ID NO: 5909 - RNA, 19 nt, artificial
  Oligomer
uggaacaacaucaaaaggu

SEQ ID NO: 5910 - RNA, 19 nt, artificial
  Oligomer
caggaggaaauaaacaugc

SEQ ID NO: 5911 - RNA, 19 nt, artificial
  Oligomer
guuccgugccuucaaaucu

SEQ ID NO: 5912 - RNA, 19 nt, artificial
  Oligomer
gcagucacaucuuuguggg

SEQ ID NO: 5913 - RNA, 19 nt, artificial
  Oligomer
acacccugaucugaagacu

SEQ ID NO: 5914 - RNA, 19 nt, artificial
  Oligomer
gaucugaagacugaugguu

SEQ ID NO: 5915 - RNA, 19 nt, artificial
  Oligomer
agaacucaugaacauucuc

SEQ ID NO: 5916 - RNA, 19 nt, artificial
  Oligomer
aaaucucuugacaaagaug

SEQ ID NO: 5917 - RNA, 19 nt, artificial
  Oligomer
gacccacaagcuuuuguuc

SEQ ID NO: 5918 - RNA, 19 nt, artificial
  Oligomer
ccuagcacuugugaugccu

SEQ ID NO: 5919 - RNA, 19 nt, artificial
  Oligomer
auaacaugaucauccgacg

SEQ ID NO: 5920 - RNA, 19 nt, artificial
  Oligomer
ccugguuaacucguucuug

SEQ ID NO: 5921 - RNA, 19 nt, artificial
  Oligomer
uacccagcuucucaacauc

SEQ ID NO: 5922 - RNA, 19 nt, artificial
  Oligomer
accauuugcaguagugaac

SEQ ID NO: 5923 - RNA, 19 nt, artificial
  Oligomer
auguuccgugccuucaaau

SEQ ID NO: 5924 - RNA, 19 nt, artificial
  Oligomer
uaagguugugacacgacac

SEQ ID NO: 5925 - RNA, 19 nt, artificial
  Oligomer
ggaauucaaguacuugugg

SEQ ID NO: 5926 - RNA, 19 nt, artificial
  Oligomer
acacccuucacgguugcua

SEQ ID NO: 5927 - RNA, 19 nt, artificial
  Oligomer
ugcaguagugaacucccag

SEQ ID NO: 5928 - RNA, 19 nt, artificial
  Oligomer
cacucuaacaagcucuguc

SEQ ID NO: 5929 - RNA, 19 nt, artificial
  Oligomer
acugccuugcuauaggagu

SEQ ID NO: 5930 - RNA, 19 nt, artificial
  Oligomer
cuacucagaugaaaguggg

SEQ ID NO: 5931 - RNA, 19 nt, artificial
  Oligomer
uacuuguuacccagcuucu

SEQ ID NO: 5932 - RNA, 19 nt, artificial
  Oligomer
uuugaggaauucaaguacu

SEQ ID NO: 5933 - RNA, 19 nt, artificial
  Oligomer
auccugucugcagucacau

SEQ ID NO: 5934 - RNA, 19 nt, artificial
  Oligomer
accgaucagggaccauuug

SEQ ID NO: 5935 - RNA, 19 nt, artificial
  Oligomer
cugacccacaagcuuuugu

SEQ ID NO: 5936 - RNA, 19 nt, artificial
  Oligomer
cugcagcugacuauguauu

SEQ ID NO: 5937 - RNA, 19 nt, artificial
  Oligomer
acaacuucaucagcugcuu

SEQ ID NO: 5938 - RNA, 19 nt, artificial
  Oligomer
cauguuccugguuaacucg

SEQ ID NO: 5939 - RNA, 19 nt, artificial
  Oligomer
uccgacgcuacucagauga

SEQ ID NO: 5940 - RNA, 19 nt, artificial
  Oligomer
aggaauucaaguacuugug

SEQ ID NO: 5941 - RNA, 19 nt, artificial
  Oligomer
aggacacucuaacaagcuc

SEQ ID NO: 5942 - RNA, 19 nt, artificial
  Oligomer
uccugguuaacucguucuu

SEQ ID NO: 5943 - RNA, 19 nt, artificial
  Oligomer
cauauacaaacaguucgac

SEQ ID NO: 5944 - RNA, 19 nt, artificial
  Oligomer
gccuuugucuauauucugc

SEQ ID NO: 5945 - RNA, 19 nt, artificial
  Oligomer
ugccuugcuauaggaguca

SEQ ID NO: 5946 - RNA, 19 nt, artificial
  Oligomer
augaucauccgacgcuacu

SEQ ID NO: 5947 - RNA, 19 nt, artificial
  Oligomer
cuuugaggaauucaaguac

SEQ ID NO: 5948 - RNA, 19 nt, artificial
  Oligomer
auccgacgcuacucagaug

SEQ ID NO: 5949 - RNA, 19 nt, artificial
  Oligomer
agugccuuugucuauauuc

SEQ ID NO: 5950 - RNA, 19 nt, artificial
  Oligomer
aaugugcuuggaggccuga

SEQ ID NO: 5951 - RNA, 19 nt, artificial
  Oligomer
augugcuuggaggccugau

SEQ ID NO: 5952 - RNA, 19 nt, artificial
  Oligomer
gucuauauucugcucccag

SEQ ID NO: 5953 - RNA, 19 nt, artificial
  Oligomer
uaggacacucuaacaagcu

SEQ ID NO: 5954 - RNA, 19 nt, artificial
  Oligomer
uccugucugcagucacauc

SEQ ID NO: 5955 - RNA, 19 nt, artificial
  Oligomer
ccucacugccuugcuauag

SEQ ID NO: 5956 - RNA, 19 nt, artificial
  Oligomer
ucaauaagguugugacacg

SEQ ID NO: 5957 - RNA, 19 nt, artificial
  Oligomer
ugacacgacacccugaucu

SEQ ID NO: 5958 - RNA, 19 nt, artificial
  Oligomer
acagaacucaugaacauuc

SEQ ID NO: 5959 - RNA, 19 nt, artificial
  Oligomer
uuguucucucaguacuugu

SEQ ID NO: 5960 - RNA, 19 nt, artificial
  Oligomer
guuccugguuaacucguuc

SEQ ID NO: 5961 - RNA, 19 nt, artificial
  Oligomer
ccuugcuauaggagucacc

SEQ ID NO: 5962 - RNA, 19 nt, artificial
  Oligomer
acuuguuacccagcuucuc

SEQ ID NO: 5963 - RNA, 19 nt, artificial
  Oligomer
uuccgugccuucaaaucuc

SEQ ID NO: 5964 - RNA, 19 nt, artificial
  Oligomer
acauccagggcccaauuug

SEQ ID NO: 5965 - RNA, 19 nt, artificial
  Oligomer
cgcuacucagaugaaagug

SEQ ID NO: 5966 - RNA, 19 nt, artificial
  Oligomer
ucucucaguucugggagga

SEQ ID NO: 5967 - RNA, 19 nt, artificial
  Oligomer
agaugacauggaggucagc

SEQ ID NO: 5968 - RNA, 19 nt, artificial
  Oligomer
ucaucagcugcuuggucag

SEQ ID NO: 5969 - RNA, 19 nt, artificial
  Oligomer
gccuugcuauaggagucac

SEQ ID NO: 5970 - RNA, 19 nt, artificial
  Oligomer
aagcugggcuuugaggaau

SEQ ID NO: 5971 - RNA, 19 nt, artificial
  Oligomer
aguucugggaggaugacuc

SEQ ID NO: 5972 - RNA, 19 nt, artificial
  Oligomer
acacucuaacaagcucugu

SEQ ID NO: 5973 - RNA, 19 nt, artificial
  Oligomer
cuaacaagcucuguccacg

SEQ ID NO: 5974 - RNA, 19 nt, artificial
  Oligomer
aguagugaacucccaggug

SEQ ID NO: 5975 - RNA, 19 nt, artificial
  Oligomer
acauucucaauaagguugu

SEQ ID NO: 5976 - RNA, 19 nt, artificial
  Oligomer
cagcuucucaacauccagg

SEQ ID NO: 5977 - RNA, 19 nt, artificial
  Oligomer
ugaucauccgacgcuacuc

SEQ ID NO: 5978 - RNA, 19 nt, artificial
  Oligomer
ugacuauguauuccugaac

SEQ ID NO: 5979 - RNA, 19 nt, artificial
  Oligomer
aauuugcccugccuggagu

SEQ ID NO: 5980 - RNA, 19 nt, artificial
  Oligomer
uauacaaacaguucgacac

SEQ ID NO: 5981 - RNA, 19 nt, artificial
  Oligomer
aguucgacacugaccgauc

SEQ ID NO: 5982 - RNA, 19 nt, artificial
  Oligomer
ugaggaauucaaguacuug

SEQ ID NO: 5983 - RNA, 19 nt, artificial
  Oligomer
ugccuucaaaucucuugac

SEQ ID NO: 5984 - RNA, 19 nt, artificial
  Oligomer
aacaguucgacacugaccg

SEQ ID NO: 5985 - RNA, 19 nt, artificial
  Oligomer
gcagcugacuauguauucc

SEQ ID NO: 5986 - RNA, 19 nt, artificial
  Oligomer
cugaagacugaugguuuug

SEQ ID NO: 5987 - RNA, 19 nt, artificial
  Oligomer
aaacaguucgacacugacc

SEQ ID NO: 5988 - RNA, 19 nt, artificial
  Oligomer
cucuauaacaugaucaucc

SEQ ID NO: 5989 - RNA, 19 nt, artificial
  Oligomer
acccacaagcuuuuguucu

SEQ ID NO: 5990 - RNA, 19 nt, artificial
  Oligomer
ucaguucugggaggaugac

SEQ ID NO: 5991 - RNA, 19 nt, artificial
  Oligomer
gcugacccacaagcuuuug

SEQ ID NO: 5992 - RNA, 19 nt, artificial
  Oligomer
acuauguauuccugaacug

SEQ ID NO: 5993 - RNA, 19 nt, artificial
  Oligomer
uucaaaucucuugacaaag

SEQ ID NO: 5994 - RNA, 19 nt, artificial
  Oligomer
uguuacccagcuucucaac

SEQ ID NO: 5995 - RNA, 19 nt, artificial
  Oligomer
aacauccagggcccaauuu

SEQ ID NO: 5996 - RNA, 19 nt, artificial
  Oligomer
cuauguauuccugaacugg

SEQ ID NO: 5997 - RNA, 19 nt, artificial
  Oligomer
uucucaauaagguugugac

SEQ ID NO: 5998 - RNA, 19 nt, artificial
  Oligomer
agugggaacauggauuuug

SEQ ID NO: 5999 - RNA, 19 nt, artificial
  Oligomer
cuuugucuauauucugcuc

SEQ ID NO: 6000 - RNA, 19 nt, artificial
  Oligomer
acuucaucagcugcuuggu

SEQ ID NO: 6001 - RNA, 19 nt, artificial
  Oligomer
cauuacuccaacauugagg

SEQ ID NO: 6002 - RNA, 19 nt, artificial
  Oligomer
cugaucugaagacugaugg

SEQ ID NO: 6003 - RNA, 19 nt, artificial
  Oligomer
acuugugaugccuccaugc

SEQ ID NO: 6004 - RNA, 19 nt, artificial
  Oligomer
gacacccugaucugaagac

SEQ ID NO: 6005 - RNA, 19 nt, artificial
  Oligomer
uucucucaguacuuguuac

SEQ ID NO: 6006 - RNA, 19 nt, artificial
  Oligomer
gaaaugugcuuggaggccu

SEQ ID NO: 6007 - RNA, 19 nt, artificial
  Oligomer
uugcuauaggagucaccug

SEQ ID NO: 6008 - RNA, 19 nt, artificial
  Oligomer
uaacaagcucuguccacgg

SEQ ID NO: 6009 - RNA, 19 nt, artificial
  Oligomer
cacuggacaaauccaggug

SEQ ID NO: 6010 - RNA, 19 nt, artificial
  Oligomer
aacauggauuuugacaacu

SEQ ID NO: 6011 - RNA, 19 nt, artificial
  Oligomer
gcugggcuuugaggaauuc

SEQ ID NO: 6012 - RNA, 19 nt, artificial
  Oligomer
cuagcacuugugaugccuc

SEQ ID NO: 6013 - RNA, 19 nt, artificial
  Oligomer
caguuccggagacucuuug

SEQ ID NO: 6014 - RNA, 19 nt, artificial
  Oligomer
aucagggaccauuugcagu

SEQ ID NO: 6015 - RNA, 19 nt, artificial
  Oligomer
acaaauccaggugaacauc

SEQ ID NO: 6016 - RNA, 19 nt, artificial
  Oligomer
aucauccgacgcuacucag

SEQ ID NO: 6017 - RNA, 19 nt, artificial
  Oligomer
uucaucagcugcuugguca

SEQ ID NO: 6018 - RNA, 19 nt, artificial
  Oligomer
gacaacuucaucagcugcu

SEQ ID NO: 6019 - RNA, 19 nt, artificial
  Oligomer
ugcuauaggagucaccugg

SEQ ID NO: 6020 - RNA, 19 nt, artificial
  Oligomer
ucucuauaacaugaucauc

SEQ ID NO: 6021 - RNA, 19 nt, artificial
  Oligomer
augaacauucucaauaagg

SEQ ID NO: 6022 - RNA, 19 nt, artificial
  Oligomer
auuugcccugccuggaguu

SEQ ID NO: 6023 - RNA, 19 nt, artificial
  Oligomer
cacaagcuuuuguucucuc

SEQ ID NO: 6024 - RNA, 19 nt, artificial
  Oligomer
uggagaugacauggagguc

SEQ ID NO: 6025 - RNA, 19 nt, artificial
  Oligomer
caacuucaucagcugcuug

SEQ ID NO: 6026 - RNA, 19 nt, artificial
  Oligomer
uucugggaggaugacucca

SEQ ID NO: 6027 - RNA, 19 nt, artificial
  Oligomer
uccaccugaaugagcaucu

SEQ ID NO: 6028 - RNA, 19 nt, artificial
  Oligomer
ugcagcugacuauguauuc

SEQ ID NO: 6029 - RNA, 19 nt, artificial
  Oligomer
uucgacacugaccgaucag

SEQ ID NO: 6030 - RNA, 19 nt, artificial
  Oligomer
cucaauaagguugugacac

SEQ ID NO: 6031 - RNA, 19 nt, artificial
  Oligomer
acucuaacaagcucugucc

SEQ ID NO: 6032 - RNA, 19 nt, artificial
  Oligomer
ucuaacaagcucuguccac

SEQ ID NO: 6033 - RNA, 19 nt, artificial
  Oligomer
aagguugugacacgacacc

SEQ ID NO: 6034 - RNA, 19 nt, artificial
  Oligomer
ugaagacugaugguuuugg

SEQ ID NO: 6035 - RNA, 19 nt, artificial
  Oligomer
caaauccaggugaacaucc

SEQ ID NO: 6036 - RNA, 19 nt, artificial
  Oligomer
aauaagguugugacacgac

SEQ ID NO: 6037 - RNA, 19 nt, artificial
  Oligomer
guacuuguuacccagcuuc

SEQ ID NO: 6038 - RNA, 19 nt, artificial
  Oligomer
gcuacucagaugaaagugg

SEQ ID NO: 6039 - RNA, 19 nt, artificial
  Oligomer
ucucaguucugggaggaug

SEQ ID NO: 6040 - RNA, 19 nt, artificial
  Oligomer
ugcagucacaucuuugugg

SEQ ID NO: 6041 - RNA, 19 nt, artificial
  Oligomer
ucuauauucugcucccagc

SEQ ID NO: 6042 - RNA, 19 nt, artificial
  Oligomer
uagcacuugugaugccucc

SEQ ID NO: 6043 - RNA, 19 nt, artificial
  Oligomer
uguuccgugccuucaaauc

SEQ ID NO: 6044 - RNA, 19 nt, artificial
  Oligomer
uacaaacaguucgacacug

SEQ ID NO: 6045 - RNA, 19 nt, artificial
  Oligomer
auucucaauaagguuguga

SEQ ID NO: 6046 - RNA, 19 nt, artificial
  Oligomer
aacaugaucauccgacgcu

SEQ ID NO: 6047 - RNA, 19 nt, artificial
  Oligomer
uugacaacuucaucagcug

SEQ ID NO: 6048 - RNA, 19 nt, artificial
  Oligomer
cuauauucugcucccagcc

SEQ ID NO: 6049 - RNA, 19 nt, artificial
  Oligomer
aaucucuugacaaagaugg

SEQ ID NO: 6050 - RNA, 19 nt, artificial
  Oligomer
acccagcuucucaacaucc

SEQ ID NO: 6051 - RNA, 19 nt, artificial
  Oligomer
uugucuauauucugcuccc

SEQ ID NO: 6052 - RNA, 19 nt, artificial
  Oligomer
uuugcaguagugaacuccc

SEQ ID NO: 6053 - RNA, 19 nt, artificial
  Oligomer
auguuccugguuaacucgu

SEQ ID NO: 6054 - RNA, 19 nt, artificial
  Oligomer
aguuccggagacucuuugc

SEQ ID NO: 6055 - RNA, 19 nt, artificial
  Oligomer
agcuucucaacauccaggg

SEQ ID NO: 6056 - RNA, 19 nt, artificial
  Oligomer
auccaggugaacauccagg

SEQ ID NO: 6057 - RNA, 19 nt, artificial
  Oligomer
uuugacaacuucaucagcu

SEQ ID NO: 6058 - RNA, 19 nt, artificial
  Oligomer
agccuagcacuugugaugc

SEQ ID NO: 6059 - RNA, 19 nt, artificial
  Oligomer
auuuugacaacuucaucag

SEQ ID NO: 6060 - RNA, 19 nt, artificial
  Oligomer
auucaaguacuuguggaac

SEQ ID NO: 6061 - RNA, 19 nt, artificial
  Oligomer
uuccugguuaacucguucu

SEQ ID NO: 6062 - RNA, 19 nt, artificial
  Oligomer
ucaguacuuguuacccagc

SEQ ID NO: 6063 - RNA, 19 nt, artificial
  Oligomer
uaacaugaucauccgacgc

SEQ ID NO: 6064 - RNA, 19 nt, artificial
  Oligomer
cucucaguacuuguuaccc

SEQ ID NO: 6065 - RNA, 19 nt, artificial
  Oligomer
auauucugcucccagccug

SEQ ID NO: 6066 - RNA, 19 nt, artificial
  Oligomer
uauaacaugaucauccgac

SEQ ID NO: 6067 - RNA, 19 nt, artificial
  Oligomer
uuuguucucucaguacuug

SEQ ID NO: 6068 - RNA, 19 nt, artificial
  Oligomer
cuucaucagcugcuugguc

SEQ ID NO: 6069 - RNA, 19 nt, artificial
  Oligomer
uguauuccugaacuggagc

SEQ ID NO: 6070 - RNA, 19 nt, artificial
  Oligomer
uauaggagucaccuggagc

SEQ ID NO: 6071 - RNA, 19 nt, artificial
  Oligomer
uauauucugcucccagccu

SEQ ID NO: 6072 - RNA, 19 nt, artificial
  Oligomer
auuacuccaacauugaggc

SEQ ID NO: 6073 - RNA, 19 nt, artificial
  Oligomer
aacauucucaauaagguug

SEQ ID NO: 6074 - RNA, 19 nt, artificial
  Oligomer
ugacaacuucaucagcugc

SEQ ID NO: 6075 - RNA, 19 nt, artificial
  Oligomer
uuuugacaacuucaucagc

SEQ ID NO: 6076 - RNA, 19 nt, artificial
  Oligomer
ucucucaguacuuguuacc

SEQ ID NO: 6077 - RNA, 19 nt, artificial
  Oligomer
aacuucaucagcugcuugg

SEQ ID NO: 6078 - RNA, 19 nt, artificial
  Oligomer
guauuccugaacuggagcc

SEQ ID NO: 6079 - RNA, 19 nt, artificial
  Oligomer
uuacuccaacauugaggcc

SEQ ID NO: 6080 - RNA, 19 nt, artificial
  Oligomer
auuugcaguagugaacucc

SEQ ID NO: 6081 - RNA, 19 nt, artificial
  Oligomer
uauuccugaacuggagccc

SEQ ID NO: 6082 - RNA, 19 nt, artificial
  Oligomer
uuccaccugaaugagcauc

SEQ ID NO: 6083 - RNA, 19 nt, artificial
  Oligomer
uuugucuauauucugcucc

SEQ ID NO: 6084 - RNA, 19 nt, artificial
  Oligomer
uuucaucugaguagcgucg

SEQ ID NO: 6085 - RNA, 19 nt, artificial
  Oligomer
ucaaaauccauguucccac

SEQ ID NO: 6086 - RNA, 19 nt, artificial
  Oligomer
uuauugagaauguucauga

SEQ ID NO: 6087 - RNA, 19 nt, artificial
  Oligomer
uugaaggcacggaacaugg

SEQ ID NO: 6088 - RNA, 19 nt, artificial
  Oligomer
uuugucaagagauuugaag

SEQ ID NO: 6089 - RNA, 19 nt, artificial
  Oligomer
uucacuacugcaaaugguc

SEQ ID NO: 6090 - RNA, 19 nt, artificial
  Oligomer
uuugaaggcacggaacaug

SEQ ID NO: 6091 - RNA, 19 nt, artificial
  Oligomer
uucaagaacgaguuaacca

SEQ ID NO: 6092 - RNA, 19 nt, artificial
  Oligomer
auguucaugaguucugugg

SEQ ID NO: 6093 - RNA, 19 nt, artificial
  Oligomer
uguggugucgcuauccauc

SEQ ID NO: 6094 - RNA, 19 nt, artificial
  Oligomer
ucauucagguggaacccug

SEQ ID NO: 6095 - RNA, 19 nt, artificial
  Oligomer
uugucaaaauccauguucc

SEQ ID NO: 6096 - RNA, 19 nt, artificial
  Oligomer
uuuauuuccuccugggccu

SEQ ID NO: 6097 - RNA, 19 nt, artificial
  Oligomer
uugucaagagauuugaagg

SEQ ID NO: 6098 - RNA, 19 nt, artificial
  Oligomer
uucaccuggauuuguccag

SEQ ID NO: 6099 - RNA, 19 nt, artificial
  Oligomer
uugagaauguucaugaguu

SEQ ID NO: 6100 - RNA, 19 nt, artificial
  Oligomer
ugugacugcagacaggauc

SEQ ID NO: 6101 - RNA, 19 nt, artificial
  Oligomer
ugcaaauggucccugaucg

SEQ ID NO: 6102 - RNA, 19 nt, artificial
  Oligomer
auagagaugcucauucagg

SEQ ID NO: 6103 - RNA, 19 nt, artificial
  Oligomer
uucaucugaguagcgucgg

SEQ ID NO: 6104 - RNA, 19 nt, artificial
  Oligomer
aucagucuucagaucaggg

SEQ ID NO: 6105 - RNA, 19 nt, artificial
  Oligomer
uugauguuguuccacaagu

SEQ ID NO: 6106 - RNA, 19 nt, artificial
  Oligomer
uacauagucagcugcagcc

SEQ ID NO: 6107 - RNA, 19 nt, artificial
  Oligomer
ucaagaacgaguuaaccag

SEQ ID NO: 6108 - RNA, 19 nt, artificial
  Oligomer
aucuuugucaagagauuug

SEQ ID NO: 6109 - RNA, 19 nt, artificial
  Oligomer
uucagaucagggugucgug

SEQ ID NO: 6110 - RNA, 19 nt, artificial
  Oligomer
uucaggaauacauagucag

SEQ ID NO: 6111 - RNA, 19 nt, artificial
  Oligomer
uguuagaguguccuagagc

SEQ ID NO: 6112 - RNA, 19 nt, artificial
  Oligomer
ucgaacuguuuguauaugg

SEQ ID NO: 6113 - RNA, 19 nt, artificial
  Oligomer
ucacuacugcaaauggucc

SEQ ID NO: 6114 - RNA, 19 nt, artificial
  Oligomer
uugaauuccucaaagccca

SEQ ID NO: 6115 - RNA, 19 nt, artificial
  Oligomer
guuuauuuccuccugggcc

SEQ ID NO: 6116 - RNA, 19 nt, artificial
  Oligomer
ugcucauucagguggaacc

SEQ ID NO: 6117 - RNA, 19 nt, artificial
  Oligomer
ucauguuauagagaugcuc

SEQ ID NO: 6118 - RNA, 19 nt, artificial
  Oligomer
auguucaccuggauuuguc

SEQ ID NO: 6119 - RNA, 19 nt, artificial
  Oligomer
uauagcaaggcagugaggg

SEQ ID NO: 6120 - RNA, 19 nt, artificial
  Oligomer
uuugauguuguuccacaag

SEQ ID NO: 6121 - RNA, 19 nt, artificial
  Oligomer
ucaauguuggaguaaugug

SEQ ID NO: 6122 - RNA, 19 nt, artificial
  Oligomer
uggauguugagaagcuggg

SEQ ID NO: 6123 - RNA, 19 nt, artificial
  Oligomer
aaauggucccugaucgguc

SEQ ID NO: 6124 - RNA, 19 nt, artificial
  Oligomer
uuguuccacaaguacuuga

SEQ ID NO: 6125 - RNA, 19 nt, artificial
  Oligomer
uauagacaaaggcacuggg

SEQ ID NO: 6126 - RNA, 19 nt, artificial
  Oligomer
uguucaccuggauuugucc

SEQ ID NO: 6127 - RNA, 19 nt, artificial
  Oligomer
ugaucggucagugucgaac

SEQ ID NO: 6128 - RNA, 19 nt, artificial
  Oligomer
auauagacaaaggcacugg

SEQ ID NO: 6129 - RNA, 19 nt, artificial
  Oligomer
guuauagagaugcucauuc

SEQ ID NO: 6130 - RNA, 19 nt, artificial
  Oligomer
auguuguuccacaaguacu

SEQ ID NO: 6131 - RNA, 19 nt, artificial
  Oligomer
ucgugucacaaccuuauug

SEQ ID NO: 6132 - RNA, 19 nt, artificial
  Oligomer
uuccucaaagcccagcuug

SEQ ID NO: 6133 - RNA, 19 nt, artificial
  Oligomer
cuugaauuccucaaagccc

SEQ ID NO: 6134 - RNA, 19 nt, artificial
  Oligomer
ucauccucccagaacugag

SEQ ID NO: 6135 - RNA, 19 nt, artificial
  Oligomer
uguuuauuuccuccugggc

SEQ ID NO: 6136 - RNA, 19 nt, artificial
  Oligomer
uuauuuccuccugggccug

SEQ ID NO: 6137 - RNA, 19 nt, artificial
  Oligomer
agaauguucaugaguucug

SEQ ID NO: 6138 - RNA, 19 nt, artificial
  Oligomer
uguuguuccacaaguacuu

SEQ ID NO: 6139 - RNA, 19 nt, artificial
  Oligomer
uagcgucggaugaucaugu

SEQ ID NO: 6140 - RNA, 19 nt, artificial
  Oligomer
ucagucuucagaucagggu

SEQ ID NO: 6141 - RNA, 19 nt, artificial
  Oligomer
uauagagaugcucauucag

SEQ ID NO: 6142 - RNA, 19 nt, artificial
  Oligomer
aaccuuauugagaauguuc

SEQ ID NO: 6143 - RNA, 19 nt, artificial
  Oligomer
uggauguucaccuggauuu

SEQ ID NO: 6144 - RNA, 19 nt, artificial
  Oligomer
uagagaugcucauucaggu

SEQ ID NO: 6145 - RNA, 19 nt, artificial
  Oligomer
agaauauagacaaaggcac

SEQ ID NO: 6146 - RNA, 19 nt, artificial
  Oligomer
uccaagcacauuucccagg

SEQ ID NO: 6147 - RNA, 19 nt, artificial
  Oligomer
uuccacaaguacuugaauu

SEQ ID NO: 6148 - RNA, 19 nt, artificial
  Oligomer
accuuauugagaauguuca

SEQ ID NO: 6149 - RNA, 19 nt, artificial
  Oligomer
aagaugugacugcagacag

SEQ ID NO: 6150 - RNA, 19 nt, artificial
  Oligomer
aaaaccaucagucuucaga

SEQ ID NO: 6151 - RNA, 19 nt, artificial
  Oligomer
cuuauugagaauguucaug

SEQ ID NO: 6152 - RNA, 19 nt, artificial
  Oligomer
caccuuuugauguuguucc

SEQ ID NO: 6153 - RNA, 19 nt, artificial
  Oligomer
auguuuauuuccuccuggg

SEQ ID NO: 6154 - RNA, 19 nt, artificial
  Oligomer
aucacaagugcuaggcuug

SEQ ID NO: 6155 - RNA, 19 nt, artificial
  Oligomer
uuuugauguuguuccacaa

SEQ ID NO: 6156 - RNA, 19 nt, artificial
  Oligomer
uccaggugacuccuauagc

SEQ ID NO: 6157 - RNA, 19 nt, artificial
  Oligomer
gaguuaaccaggaacaugg

SEQ ID NO: 6158 - RNA, 19 nt, artificial
  Oligomer
ugucaaaauccauguuccc

SEQ ID NO: 6159 - RNA, 19 nt, artificial
  Oligomer
uuguuagaguguccuagag

SEQ ID NO: 6160 - RNA, 19 nt, artificial
  Oligomer
auacauagucagcugcagc

SEQ ID NO: 6161 - RNA, 19 nt, artificial
  Oligomer
uccauguucccacuuucau

SEQ ID NO: 6162 - RNA, 19 nt, artificial
  Oligomer
ucuuugucaagagauuuga

SEQ ID NO: 6163 - RNA, 19 nt, artificial
  Oligomer
uacugagagaacaaaagcu

SEQ ID NO: 6164 - RNA, 19 nt, artificial
  Oligomer
aauauagacaaaggcacug

SEQ ID NO: 6165 - RNA, 19 nt, artificial
  Oligomer
ucuucagaucagggugucg

SEQ ID NO: 6166 - RNA, 19 nt, artificial
  Oligomer
uccacaaguacuugaauuc

SEQ ID NO: 6167 - RNA, 19 nt, artificial
  Oligomer
guugucaaaauccauguuc

SEQ ID NO: 6168 - RNA, 19 nt, artificial
  Oligomer
ucggucagugucgaacugu

SEQ ID NO: 6169 - RNA, 19 nt, artificial
  Oligomer
aucugaguagcgucggaug

SEQ ID NO: 6170 - RNA, 19 nt, artificial
  Oligomer
auucagguggaacccugcu

SEQ ID NO: 6171 - RNA, 19 nt, artificial
  Oligomer
uuauagagaugcucauuca

SEQ ID NO: 6172 - RNA, 19 nt, artificial
  Oligomer
aauugggcccuggauguug

SEQ ID NO: 6173 - RNA, 19 nt, artificial
  Oligomer
gucagugucgaacuguuug

SEQ ID NO: 6174 - RNA, 19 nt, artificial
  Oligomer
auugagaauguucaugagu

SEQ ID NO: 6175 - RNA, 19 nt, artificial
  Oligomer
uccuauagcaaggcaguga

SEQ ID NO: 6176 - RNA, 19 nt, artificial
  Oligomer
uugccuguggugucgcuau

SEQ ID NO: 6177 - RNA, 19 nt, artificial
  Oligomer
augcucauucagguggaac

SEQ ID NO: 6178 - RNA, 19 nt, artificial
  Oligomer
ugucacaaccuuauugaga

SEQ ID NO: 6179 - RNA, 19 nt, artificial
  Oligomer
ucacaagugcuaggcuugg

SEQ ID NO: 6180 - RNA, 19 nt, artificial
  Oligomer
cuggauguugagaagcugg

SEQ ID NO: 6181 - RNA, 19 nt, artificial
  Oligomer
augaaguugucaaaaucca

SEQ ID NO: 6182 - RNA, 19 nt, artificial
  Oligomer
ucggaugaucauguuauag

SEQ ID NO: 6183 - RNA, 19 nt, artificial
  Oligomer
cacuccuggauguucaccu

SEQ ID NO: 6184 - RNA, 19 nt, artificial
  Oligomer
uugagaagcuggguaacaa

SEQ ID NO: 6185 - RNA, 19 nt, artificial
  Oligomer
acuugaauuccucaaagcc

SEQ ID NO: 6186 - RNA, 19 nt, artificial
  Oligomer
accaucagucuucagauca

SEQ ID NO: 6187 - RNA, 19 nt, artificial
  Oligomer
cuuuugauguuguuccaca

SEQ ID NO: 6188 - RNA, 19 nt, artificial
  Oligomer
ucagugucgaacuguuugu

SEQ ID NO: 6189 - RNA, 19 nt, artificial
  Oligomer
ugucaagagauuugaaggc

SEQ ID NO: 6190 - RNA, 19 nt, artificial
  Oligomer
ugaaguugucaaaauccau

SEQ ID NO: 6191 - RNA, 19 nt, artificial
  Oligomer
ugagaagcuggguaacaag

SEQ ID NO: 6192 - RNA, 19 nt, artificial
  Oligomer
acaaguacuugaauuccuc

SEQ ID NO: 6193 - RNA, 19 nt, artificial
  Oligomer
auccauguucccacuuuca

SEQ ID NO: 6194 - RNA, 19 nt, artificial
  Oligomer
ugaguagcgucggaugauc

SEQ ID NO: 6195 - RNA, 19 nt, artificial
  Oligomer
gaaguugucaaaauccaug

SEQ ID NO: 6196 - RNA, 19 nt, artificial
  Oligomer
ucaagagauuugaaggcac

SEQ ID NO: 6197 - RNA, 19 nt, artificial
  Oligomer
guuagaguguccuagagcc

SEQ ID NO: 6198 - RNA, 19 nt, artificial
  Oligomer
uguuauagagaugcucauu

SEQ ID NO: 6199 - RNA, 19 nt, artificial
  Oligomer
aauguucaugaguucugug

SEQ ID NO: 6200 - RNA, 19 nt, artificial
  Oligomer
ugaugaaguugucaaaauc

SEQ ID NO: 6201 - RNA, 19 nt, artificial
  Oligomer
aauccauguucccacuuuc

SEQ ID NO: 6202 - RNA, 19 nt, artificial
  Oligomer
ugggaguucacuacugcaa

SEQ ID NO: 6203 - RNA, 19 nt, artificial
  Oligomer
gucaaaauccauguuccca

SEQ ID NO: 6204 - RNA, 19 nt, artificial
  Oligomer
aagagauuugaaggcacgg

SEQ ID NO: 6205 - RNA, 19 nt, artificial
  Oligomer
cuggguaacaaguacugag

SEQ ID NO: 6206 - RNA, 19 nt, artificial
  Oligomer
cuucagaucagggugucgu

SEQ ID NO: 6207 - RNA, 19 nt, artificial
  Oligomer
uccuggauguucaccugga

SEQ ID NO: 6208 - RNA, 19 nt, artificial
  Oligomer
ucagaucagggugucgugu

SEQ ID NO: 6209 - RNA, 19 nt, artificial
  Oligomer
augaucauguuauagagau

SEQ ID NO: 6210 - RNA, 19 nt, artificial
  Oligomer
ucaggaauacauagucagc

SEQ ID NO: 6211 - RNA, 19 nt, artificial
  Oligomer
ugucgugucacaaccuuau

SEQ ID NO: 6212 - RNA, 19 nt, artificial
  Oligomer
ucccacuuucaucugagua

SEQ ID NO: 6213 - RNA, 19 nt, artificial
  Oligomer
uacuugaauuccucaaagc

SEQ ID NO: 6214 - RNA, 19 nt, artificial
  Oligomer
ugagaauguucaugaguuc

SEQ ID NO: 6215 - RNA, 19 nt, artificial
  Oligomer
cauguuuauuuccuccugg

SEQ ID NO: 6216 - RNA, 19 nt, artificial
  Oligomer
cuuucaucugaguagcguc

SEQ ID NO: 6217 - RNA, 19 nt, artificial
  Oligomer
ugaucauguuauagagaug

SEQ ID NO: 6218 - RNA, 19 nt, artificial
  Oligomer
ugaccuccaugucaucucc

SEQ ID NO: 6219 - RNA, 19 nt, artificial
  Oligomer
uauugagaauguucaugag

SEQ ID NO: 6220 - RNA, 19 nt, artificial
  Oligomer
auggaggcaucacaagugc

SEQ ID NO: 6221 - RNA, 19 nt, artificial
  Oligomer
cugaccuccaugucaucuc

SEQ ID NO: 6222 - RNA, 19 nt, artificial
  Oligomer
aaguugucaaaauccaugu

SEQ ID NO: 6223 - RNA, 19 nt, artificial
  Oligomer
uggacagagcuuguuagag

SEQ ID NO: 6224 - RNA, 19 nt, artificial
  Oligomer
ccauguucccacuuucauc

SEQ ID NO: 6225 - RNA, 19 nt, artificial
  Oligomer
aaaagcuugugggucagca

SEQ ID NO: 6226 - RNA, 19 nt, artificial
  Oligomer
aaagagucuccggaacugc

SEQ ID NO: 6227 - RNA, 19 nt, artificial
  Oligomer
aguucacuacugcaaaugg

SEQ ID NO: 6228 - RNA, 19 nt, artificial
  Oligomer
aaagaugugacugcagaca

SEQ ID NO: 6229 - RNA, 19 nt, artificial
  Oligomer
aacaaaagcuuguggguca

SEQ ID NO: 6230 - RNA, 19 nt, artificial
  Oligomer
uggguaacaaguacugaga

SEQ ID NO: 6231 - RNA, 19 nt, artificial
  Oligomer
gaugaaguugucaaaaucc

SEQ ID NO: 6232 - RNA, 19 nt, artificial
  Oligomer
ucagggugucgugucacaa

SEQ ID NO: 6233 - RNA, 19 nt, artificial
  Oligomer
aguucaggaauacauaguc

SEQ ID NO: 6234 - RNA, 19 nt, artificial
  Oligomer
cauguuauagagaugcuca

SEQ ID NO: 6235 - RNA, 19 nt, artificial
  Oligomer
uccaguucaggaauacaua

SEQ ID NO: 6236 - RNA, 19 nt, artificial
  Oligomer
auguuauagagaugcucau

SEQ ID NO: 6237 - RNA, 19 nt, artificial
  Oligomer
gaucauguuauagagaugc

SEQ ID NO: 6238 - RNA, 19 nt, artificial
  Oligomer
aagcuggguaacaaguacu

SEQ ID NO: 6239 - RNA, 19 nt, artificial
  Oligomer
ucugaguagcgucggauga

SEQ ID NO: 6240 - RNA, 19 nt, artificial
  Oligomer
cacuacugcaaaugguccc

SEQ ID NO: 6241 - RNA, 19 nt, artificial
  Oligomer
acuccuggauguucaccug

SEQ ID NO: 6242 - RNA, 19 nt, artificial
  Oligomer
uguuccacaaguacuugaa

SEQ ID NO: 6243 - RNA, 19 nt, artificial
  Oligomer
cuccaagcacauuucccag

SEQ ID NO: 6244 - RNA, 19 nt, artificial
  Oligomer
ugucgaacuguuuguauau

SEQ ID NO: 6245 - RNA, 19 nt, artificial
  Oligomer
cugcaaauggucccugauc

SEQ ID NO: 6246 - RNA, 19 nt, artificial
  Oligomer
uaacaaguacugagagaac

SEQ ID NO: 6247 - RNA, 19 nt, artificial
  Oligomer
acaaagaugugacugcaga

SEQ ID NO: 6248 - RNA, 19 nt, artificial
  Oligomer
acugagagaacaaaagcuu

SEQ ID NO: 6249 - RNA, 19 nt, artificial
  Oligomer
agcuggguaacaaguacug

SEQ ID NO: 6250 - RNA, 19 nt, artificial
  Oligomer
cuucaagaacgaguuaacc

SEQ ID NO: 6251 - RNA, 19 nt, artificial
  Oligomer
auguugagaagcuggguaa

SEQ ID NO: 6252 - RNA, 19 nt, artificial
  Oligomer
agagcuuguuagagugucc

SEQ ID NO: 6253 - RNA, 19 nt, artificial
  Oligomer
ugagagaacaaaagcuugu

SEQ ID NO: 6254 - RNA, 19 nt, artificial
  Oligomer
gcuuguuagaguguccuag

SEQ ID NO: 6255 - RNA, 19 nt, artificial
  Oligomer
gagaugcucauucaggugg

SEQ ID NO: 6256 - RNA, 19 nt, artificial
  Oligomer
aaguacuugaauuccucaa

SEQ ID NO: 6257 - RNA, 19 nt, artificial
  Oligomer
cauguucccacuuucaucu

SEQ ID NO: 6258 - RNA, 19 nt, artificial
  Oligomer
auguucccacuuucaucug

SEQ ID NO: 6259 - RNA, 19 nt, artificial
  Oligomer
cuccaggugacuccuauag

SEQ ID NO: 6260 - RNA, 19 nt, artificial
  Oligomer
acuuucaucugaguagcgu

SEQ ID NO: 6261 - RNA, 19 nt, artificial
  Oligomer
gagaacaaaagcuuguggg

SEQ ID NO: 6262 - RNA, 19 nt, artificial
  Oligomer
cuggauguucaccuggauu

SEQ ID NO: 6263 - RNA, 19 nt, artificial
  Oligomer
agagaacaaaagcuugugg

SEQ ID NO: 6264 - RNA, 19 nt, artificial
  Oligomer
auccucccagaacugagag

SEQ ID NO: 6265 - RNA, 19 nt, artificial
  Oligomer
aauuccucaaagcccagcu

SEQ ID NO: 6266 - RNA, 19 nt, artificial
  Oligomer
aguacugagagaacaaaag

SEQ ID NO: 6267 - RNA, 19 nt, artificial
  Oligomer
ucaccuggauuuguccagu

SEQ ID NO: 6268 - RNA, 19 nt, artificial
  Oligomer
aucauguuauagagaugcu

SEQ ID NO: 6269 - RNA, 19 nt, artificial
  Oligomer
ucaaaggcaccugggaguu

SEQ ID NO: 6270 - RNA, 19 nt, artificial
  Oligomer
uacugcaaauggucccuga

SEQ ID NO: 6271 - RNA, 19 nt, artificial
  Oligomer
cuccaguucaggaauacau

SEQ ID NO: 6272 - RNA, 19 nt, artificial
  Oligomer
guagcgucggaugaucaug

SEQ ID NO: 6273 - RNA, 19 nt, artificial
  Oligomer
cuacugcaaauggucccug

SEQ ID NO: 6274 - RNA, 19 nt, artificial
  Oligomer
aucagggugucgugucaca

SEQ ID NO: 6275 - RNA, 19 nt, artificial
  Oligomer
agaugugacugcagacagg

SEQ ID NO: 6276 - RNA, 19 nt, artificial
  Oligomer
cagucuucagaucagggug

SEQ ID NO: 6277 - RNA, 19 nt, artificial
  Oligomer
acuacugcaaauggucccu

SEQ ID NO: 6278 - RNA, 19 nt, artificial
  Oligomer
gggcauguuuauuuccucc

SEQ ID NO: 6279 - RNA, 19 nt, artificial
  Oligomer
aaaggcaccugggaguuca

SEQ ID NO: 6280 - RNA, 19 nt, artificial
  Oligomer
cagaauauagacaaaggca

SEQ ID NO: 6281 - RNA, 19 nt, artificial
  Oligomer
ugggagcagaauauagaca

SEQ ID NO: 6282 - RNA, 19 nt, artificial
  Oligomer
aacgaguuaaccaggaaca

SEQ ID NO: 6283 - RNA, 19 nt, artificial
  Oligomer
ugaauuccucaaagcccag

SEQ ID NO: 6284 - RNA, 19 nt, artificial
  Oligomer
guggugucgcuauccauca

SEQ ID NO: 6285 - RNA, 19 nt, artificial
  Oligomer
agagaugcucauucaggug

SEQ ID NO: 6286 - RNA, 19 nt, artificial
  Oligomer
cauggaggcaucacaagug

SEQ ID NO: 6287 - RNA, 19 nt, artificial
  Oligomer
accugggaguucacuacug

SEQ ID NO: 6288 - RNA, 19 nt, artificial
  Oligomer
ugaugacuccgccuaggau

SEQ ID NO: 6289 - RNA, 19 nt, artificial
  Oligomer
aaauccauguucccacuuu

SEQ ID NO: 6290 - RNA, 19 nt, artificial
  Oligomer
cucaauguuggaguaaugu

SEQ ID NO: 6291 - RNA, 19 nt, artificial
  Oligomer
aaaccaucagucuucagau

SEQ ID NO: 6292 - RNA, 19 nt, artificial
  Oligomer
ccuuuugauguuguuccac

SEQ ID NO: 6293 - RNA, 19 nt, artificial
  Oligomer
cugagagaacaaaagcuug

SEQ ID NO: 6294 - RNA, 19 nt, artificial
  Oligomer
aucggucagugucgaacug

SEQ ID NO: 6295 - RNA, 19 nt, artificial
  Oligomer
aaagcuugugggucagcag

SEQ ID NO: 6296 - RNA, 19 nt, artificial
  Oligomer
aaaauccauguucccacuu

SEQ ID NO: 6297 - RNA, 19 nt, artificial
  Oligomer
accuccaugucaucuccag

SEQ ID NO: 6298 - RNA, 19 nt, artificial
  Oligomer
ugauguuguuccacaagua

SEQ ID NO: 6299 - RNA, 19 nt, artificial
  Oligomer
guacugagagaacaaaagc

SEQ ID NO: 6300 - RNA, 19 nt, artificial
  Oligomer
gacuccuauagcaaggcag

SEQ ID NO: 6301 - RNA, 19 nt, artificial
  Oligomer
auugggcccuggauguuga

SEQ ID NO: 6302 - RNA, 19 nt, artificial
  Oligomer
agucauccucccagaacug

SEQ ID NO: 6303 - RNA, 19 nt, artificial
  Oligomer
ccuccaagcacauuuccca

SEQ ID NO: 6304 - RNA, 19 nt, artificial
  Oligomer
guucaccuggauuugucca

SEQ ID NO: 6305 - RNA, 19 nt, artificial
  Oligomer
accuggauuuguccagugc

SEQ ID NO: 6306 - RNA, 19 nt, artificial
  Oligomer
ggcauguuuauuuccuccu

SEQ ID NO: 6307 - RNA, 19 nt, artificial
  Oligomer
uggaggcaucacaagugcu

SEQ ID NO: 6308 - RNA, 19 nt, artificial
  Oligomer
uucccacuuucaucugagu

SEQ ID NO: 6309 - RNA, 19 nt, artificial
  Oligomer
caucagucuucagaucagg

SEQ ID NO: 6310 - RNA, 19 nt, artificial
  Oligomer
aaguacugagagaacaaaa

SEQ ID NO: 6311 - RNA, 19 nt, artificial
  Oligomer
agcagaauauagacaaagg

SEQ ID NO: 6312 - RNA, 19 nt, artificial
  Oligomer
aggaauacauagucagcug

SEQ ID NO: 6313 - RNA, 19 nt, artificial
  Oligomer
ccaccuuuugauguuguuc

SEQ ID NO: 6314 - RNA, 19 nt, artificial
  Oligomer
aacaaguacugagagaaca

SEQ ID NO: 6315 - RNA, 19 nt, artificial
  Oligomer
ccuauagcaaggcagugag

SEQ ID NO: 6316 - RNA, 19 nt, artificial
  Oligomer
cggaugaucauguuauaga

SEQ ID NO: 6317 - RNA, 19 nt, artificial
  Oligomer
uguugagaagcuggguaac

SEQ ID NO: 6318 - RNA, 19 nt, artificial
  Oligomer
uguucccacuuucaucuga

SEQ ID NO: 6319 - RNA, 19 nt, artificial
  Oligomer
cacaaagaugugacugcag

SEQ ID NO: 6320 - RNA, 19 nt, artificial
  Oligomer
guuguuccacaaguacuug

SEQ ID NO: 6321 - RNA, 19 nt, artificial
  Oligomer
guucccacuuucaucugag

SEQ ID NO: 6322 - RNA, 19 nt, artificial
  Oligomer
cuuguuagaguguccuaga

SEQ ID NO: 6323 - RNA, 19 nt, artificial
  Oligomer
cacaaccuuauugagaaug

SEQ ID NO: 6324 - RNA, 19 nt, artificial
  Oligomer
agugucgaacuguuuguau

SEQ ID NO: 6325 - RNA, 19 nt, artificial
  Oligomer
aauggucccugaucgguca

SEQ ID NO: 6326 - RNA, 19 nt, artificial
  Oligomer
cucauucagguggaacccu

SEQ ID NO: 6327 - RNA, 19 nt, artificial
  Oligomer
cuccuauagcaaggcagug

SEQ ID NO: 6328 - RNA, 19 nt, artificial
  Oligomer
uggugucgcuauccaucac

SEQ ID NO: 6329 - RNA, 19 nt, artificial
  Oligomer
aggugacuccuauagcaag

SEQ ID NO: 6330 - RNA, 19 nt, artificial
  Oligomer
caggccuccaagcacauuu

SEQ ID NO: 6331 - RNA, 19 nt, artificial
  Oligomer
agagauuugaaggcacgga

SEQ ID NO: 6332 - RNA, 19 nt, artificial
  Oligomer
caggaauacauagucagcu

SEQ ID NO: 6333 - RNA, 19 nt, artificial
  Oligomer
gaguucacuacugcaaaug

SEQ ID NO: 6334 - RNA, 19 nt, artificial
  Oligomer
cagagcuuguuagaguguc

SEQ ID NO: 6335 - RNA, 19 nt, artificial
  Oligomer
caucacaagugcuaggcuu

SEQ ID NO: 6336 - RNA, 19 nt, artificial
  Oligomer
caagagauuugaaggcacg

SEQ ID NO: 6337 - RNA, 19 nt, artificial
  Oligomer
cuguggugucgcuauccau

SEQ ID NO: 6338 - RNA, 19 nt, artificial
  Oligomer
caaagaugugacugcagac

SEQ ID NO: 6339 - RNA, 19 nt, artificial
  Oligomer
gauguuguuccacaaguac

SEQ ID NO: 6340 - RNA, 19 nt, artificial
  Oligomer
accuuuugauguuguucca

SEQ ID NO: 6341 - RNA, 19 nt, artificial
  Oligomer
gcauguuuauuuccuccug

SEQ ID NO: 6342 - RNA, 19 nt, artificial
  Oligomer
agauuugaaggcacggaac

SEQ ID NO: 6343 - RNA, 19 nt, artificial
  Oligomer
cccacaaagaugugacugc

SEQ ID NO: 6344 - RNA, 19 nt, artificial
  Oligomer
agucuucagaucagggugu

SEQ ID NO: 6345 - RNA, 19 nt, artificial
  Oligomer
aaccaucagucuucagauc

SEQ ID NO: 6346 - RNA, 19 nt, artificial
  Oligomer
gagaauguucaugaguucu

SEQ ID NO: 6347 - RNA, 19 nt, artificial
  Oligomer
caucuuugucaagagauuu

SEQ ID NO: 6348 - RNA, 19 nt, artificial
  Oligomer
gaacaaaagcuuguggguc

SEQ ID NO: 6349 - RNA, 19 nt, artificial
  Oligomer
aggcaucacaagugcuagg

SEQ ID NO: 6350 - RNA, 19 nt, artificial
  Oligomer
cgucggaugaucauguuau

SEQ ID NO: 6351 - RNA, 19 nt, artificial
  Oligomer
caagaacgaguuaaccagg

SEQ ID NO: 6352 - RNA, 19 nt, artificial
  Oligomer
gauguugagaagcugggua

SEQ ID NO: 6353 - RNA, 19 nt, artificial
  Oligomer
guucacuacugcaaauggu

SEQ ID NO: 6354 - RNA, 19 nt, artificial
  Oligomer
auuugaaggcacggaacau

SEQ ID NO: 6355 - RNA, 19 nt, artificial
  Oligomer
gugucgugucacaaccuua

SEQ ID NO: 6356 - RNA, 19 nt, artificial
  Oligomer
ccacaaguacuugaauucc

SEQ ID NO: 6357 - RNA, 19 nt, artificial
  Oligomer
uagcaaccgugaagggugu

SEQ ID NO: 6358 - RNA, 19 nt, artificial
  Oligomer
cugggaguucacuacugca

SEQ ID NO: 6359 - RNA, 19 nt, artificial
  Oligomer
gacagagcuuguuagagug

SEQ ID NO: 6360 - RNA, 19 nt, artificial
  Oligomer
acuccuauagcaaggcagu

SEQ ID NO: 6361 - RNA, 19 nt, artificial
  Oligomer
cccacuuucaucugaguag

SEQ ID NO: 6362 - RNA, 19 nt, artificial
  Oligomer
agaagcuggguaacaagua

SEQ ID NO: 6363 - RNA, 19 nt, artificial
  Oligomer
aguacuugaauuccucaaa

SEQ ID NO: 6364 - RNA, 19 nt, artificial
  Oligomer
augugacugcagacaggau

SEQ ID NO: 6365 - RNA, 19 nt, artificial
  Oligomer
caaauggucccugaucggu

SEQ ID NO: 6366 - RNA, 19 nt, artificial
  Oligomer
acaaaagcuugugggucag

SEQ ID NO: 6367 - RNA, 19 nt, artificial
  Oligomer
aauacauagucagcugcag

SEQ ID NO: 6368 - RNA, 19 nt, artificial
  Oligomer
aagcagcugaugaaguugu

SEQ ID NO: 6369 - RNA, 19 nt, artificial
  Oligomer
cgaguuaaccaggaacaug

SEQ ID NO: 6370 - RNA, 19 nt, artificial
  Oligomer
ucaucugaguagcgucgga

SEQ ID NO: 6371 - RNA, 19 nt, artificial
  Oligomer
cacaaguacuugaauuccu

SEQ ID NO: 6372 - RNA, 19 nt, artificial
  Oligomer
gagcuuguuagaguguccu

SEQ ID NO: 6373 - RNA, 19 nt, artificial
  Oligomer
aagaacgaguuaaccagga

SEQ ID NO: 6374 - RNA, 19 nt, artificial
  Oligomer
gucgaacuguuuguauaug

SEQ ID NO: 6375 - RNA, 19 nt, artificial
  Oligomer
gcagaauauagacaaaggc

SEQ ID NO: 6376 - RNA, 19 nt, artificial
  Oligomer
ugacuccuauagcaaggca

SEQ ID NO: 6377 - RNA, 19 nt, artificial
  Oligomer
aguagcgucggaugaucau

SEQ ID NO: 6378 - RNA, 19 nt, artificial
  Oligomer
guacuugaauuccucaaag

SEQ ID NO: 6379 - RNA, 19 nt, artificial
  Oligomer
caucugaguagcgucggau

SEQ ID NO: 6380 - RNA, 19 nt, artificial
  Oligomer
gaauauagacaaaggcacu

SEQ ID NO: 6381 - RNA, 19 nt, artificial
  Oligomer
ucaggccuccaagcacauu

SEQ ID NO: 6382 - RNA, 19 nt, artificial
  Oligomer
aucaggccuccaagcacau

SEQ ID NO: 6383 - RNA, 19 nt, artificial
  Oligomer
cugggagcagaauauagac

SEQ ID NO: 6384 - RNA, 19 nt, artificial
  Oligomer
agcuuguuagaguguccua

SEQ ID NO: 6385 - RNA, 19 nt, artificial
  Oligomer
gaugugacugcagacagga

SEQ ID NO: 6386 - RNA, 19 nt, artificial
  Oligomer
cuauagcaaggcagugagg

SEQ ID NO: 6387 - RNA, 19 nt, artificial
  Oligomer
cgugucacaaccuuauuga

SEQ ID NO: 6388 - RNA, 19 nt, artificial
  Oligomer
agaucagggugucguguca

SEQ ID NO: 6389 - RNA, 19 nt, artificial
  Oligomer
gaauguucaugaguucugu

SEQ ID NO: 6390 - RNA, 19 nt, artificial
  Oligomer
acaaguacugagagaacaa

SEQ ID NO: 6391 - RNA, 19 nt, artificial
  Oligomer
gaacgaguuaaccaggaac

SEQ ID NO: 6392 - RNA, 19 nt, artificial
  Oligomer
ggugacuccuauagcaagg

SEQ ID NO: 6393 - RNA, 19 nt, artificial
  Oligomer
gagaagcuggguaacaagu

SEQ ID NO: 6394 - RNA, 19 nt, artificial
  Oligomer
gagauuugaaggcacggaa

SEQ ID NO: 6395 - RNA, 19 nt, artificial
  Oligomer
caaauugggcccuggaugu

SEQ ID NO: 6396 - RNA, 19 nt, artificial
  Oligomer
cacuuucaucugaguagcg

SEQ ID NO: 6397 - RNA, 19 nt, artificial
  Oligomer
uccucccagaacugagaga

SEQ ID NO: 6398 - RNA, 19 nt, artificial
  Oligomer
gcugaccuccaugucaucu

SEQ ID NO: 6399 - RNA, 19 nt, artificial
  Oligomer
cugaccaagcagcugauga

SEQ ID NO: 6400 - RNA, 19 nt, artificial
  Oligomer
gugacuccuauagcaaggc

SEQ ID NO: 6401 - RNA, 19 nt, artificial
  Oligomer
auuccucaaagcccagcuu

SEQ ID NO: 6402 - RNA, 19 nt, artificial
  Oligomer
gagucauccucccagaacu

SEQ ID NO: 6403 - RNA, 19 nt, artificial
  Oligomer
acagagcuuguuagagugu

SEQ ID NO: 6404 - RNA, 19 nt, artificial
  Oligomer
cguggacagagcuuguuag

SEQ ID NO: 6405 - RNA, 19 nt, artificial
  Oligomer
caccugggaguucacuacu

SEQ ID NO: 6406 - RNA, 19 nt, artificial
  Oligomer
acaaccuuauugagaaugu

SEQ ID NO: 6407 - RNA, 19 nt, artificial
  Oligomer
ccuggauguugagaagcug

SEQ ID NO: 6408 - RNA, 19 nt, artificial
  Oligomer
gaguagcgucggaugauca

SEQ ID NO: 6409 - RNA, 19 nt, artificial
  Oligomer
guucaggaauacauaguca

SEQ ID NO: 6410 - RNA, 19 nt, artificial
  Oligomer
acuccaggcagggcaaauu

SEQ ID NO: 6411 - RNA, 19 nt, artificial
  Oligomer
gugucgaacuguuuguaua

SEQ ID NO: 6412 - RNA, 19 nt, artificial
  Oligomer
gaucggucagugucgaacu

SEQ ID NO: 6413 - RNA, 19 nt, artificial
  Oligomer
caaguacuugaauuccuca

SEQ ID NO: 6414 - RNA, 19 nt, artificial
  Oligomer
gucaagagauuugaaggca

SEQ ID NO: 6415 - RNA, 19 nt, artificial
  Oligomer
cggucagugucgaacuguu

SEQ ID NO: 6416 - RNA, 19 nt, artificial
  Oligomer
ggaauacauagucagcugc

SEQ ID NO: 6417 - RNA, 19 nt, artificial
  Oligomer
caaaaccaucagucuucag

SEQ ID NO: 6418 - RNA, 19 nt, artificial
  Oligomer
ggucagugucgaacuguuu

SEQ ID NO: 6419 - RNA, 19 nt, artificial
  Oligomer
ggaugaucauguuauagag

SEQ ID NO: 6420 - RNA, 19 nt, artificial
  Oligomer
agaacaaaagcuugugggu

SEQ ID NO: 6421 - RNA, 19 nt, artificial
  Oligomer
gucauccucccagaacuga

SEQ ID NO: 6422 - RNA, 19 nt, artificial
  Oligomer
caaaagcuugugggucagc

SEQ ID NO: 6423 - RNA, 19 nt, artificial
  Oligomer
caguucaggaauacauagu

SEQ ID NO: 6424 - RNA, 19 nt, artificial
  Oligomer
cuuugucaagagauuugaa

SEQ ID NO: 6425 - RNA, 19 nt, artificial
  Oligomer
guugagaagcuggguaaca

SEQ ID NO: 6426 - RNA, 19 nt, artificial
  Oligomer
aaauugggcccuggauguu

SEQ ID NO: 6427 - RNA, 19 nt, artificial
  Oligomer
ccaguucaggaauacauag

SEQ ID NO: 6428 - RNA, 19 nt, artificial
  Oligomer
gucacaaccuuauugagaa

SEQ ID NO: 6429 - RNA, 19 nt, artificial
  Oligomer
caaaauccauguucccacu

SEQ ID NO: 6430 - RNA, 19 nt, artificial
  Oligomer
gagcagaauauagacaaag

SEQ ID NO: 6431 - RNA, 19 nt, artificial
  Oligomer
accaagcagcugaugaagu

SEQ ID NO: 6432 - RNA, 19 nt, artificial
  Oligomer
ccucaauguuggaguaaug

SEQ ID NO: 6433 - RNA, 19 nt, artificial
  Oligomer
ccaucagucuucagaucag

SEQ ID NO: 6434 - RNA, 19 nt, artificial
  Oligomer
gcauggaggcaucacaagu

SEQ ID NO: 6435 - RNA, 19 nt, artificial
  Oligomer
gucuucagaucaggguguc

SEQ ID NO: 6436 - RNA, 19 nt, artificial
  Oligomer
guaacaaguacugagagaa

SEQ ID NO: 6437 - RNA, 19 nt, artificial
  Oligomer
aggccuccaagcacauuuc

SEQ ID NO: 6438 - RNA, 19 nt, artificial
  Oligomer
caggugacuccuauagcaa

SEQ ID NO: 6439 - RNA, 19 nt, artificial
  Oligomer
ccguggacagagcuuguua

SEQ ID NO: 6440 - RNA, 19 nt, artificial
  Oligomer
caccuggauuuguccagug

SEQ ID NO: 6441 - RNA, 19 nt, artificial
  Oligomer
aguugucaaaauccauguu

SEQ ID NO: 6442 - RNA, 19 nt, artificial
  Oligomer
gaauuccucaaagcccagc

SEQ ID NO: 6443 - RNA, 19 nt, artificial
  Oligomer
gaggcaucacaagugcuag

SEQ ID NO: 6444 - RNA, 19 nt, artificial
  Oligomer
caaagagucuccggaacug

SEQ ID NO: 6445 - RNA, 19 nt, artificial
  Oligomer
acugcaaauggucccugau

SEQ ID NO: 6446 - RNA, 19 nt, artificial
  Oligomer
gauguucaccuggauuugu

SEQ ID NO: 6447 - RNA, 19 nt, artificial
  Oligomer
cugaguagcgucggaugau

SEQ ID NO: 6448 - RNA, 19 nt, artificial
  Oligomer
ugaccaagcagcugaugaa

SEQ ID NO: 6449 - RNA, 19 nt, artificial
  Oligomer
agcagcugaugaaguuguc

SEQ ID NO: 6450 - RNA, 19 nt, artificial
  Oligomer
ccaggugacuccuauagca

SEQ ID NO: 6451 - RNA, 19 nt, artificial
  Oligomer
gaugaucauguuauagaga

SEQ ID NO: 6452 - RNA, 19 nt, artificial
  Oligomer
ccuuauugagaauguucau

SEQ ID NO: 6453 - RNA, 19 nt, artificial
  Oligomer
aacuccaggcagggcaaau

SEQ ID NO: 6454 - RNA, 19 nt, artificial
  Oligomer
gagagaacaaaagcuugug

SEQ ID NO: 6455 - RNA, 19 nt, artificial
  Oligomer
gaccuccaugucaucucca

SEQ ID NO: 6456 - RNA, 19 nt, artificial
  Oligomer
caagcagcugaugaaguug

SEQ ID NO: 6457 - RNA, 19 nt, artificial
  Oligomer
uggagucauccucccagaa

SEQ ID NO: 6458 - RNA, 19 nt, artificial
  Oligomer
agaugcucauucaggugga

SEQ ID NO: 6459 - RNA, 19 nt, artificial
  Oligomer
gaauacauagucagcugca

SEQ ID NO: 6460 - RNA, 19 nt, artificial
  Oligomer
cugaucggucagugucgaa

SEQ ID NO: 6461 - RNA, 19 nt, artificial
  Oligomer
gugucacaaccuuauugag

SEQ ID NO: 6462 - RNA, 19 nt, artificial
  Oligomer
ggacagagcuuguuagagu

SEQ ID NO: 6463 - RNA, 19 nt, artificial
  Oligomer
guggacagagcuuguuaga

SEQ ID NO: 6464 - RNA, 19 nt, artificial
  Oligomer
ggugucgugucacaaccuu

SEQ ID NO: 6465 - RNA, 19 nt, artificial
  Oligomer
ccaaaaccaucagucuuca

SEQ ID NO: 6466 - RNA, 19 nt, artificial
  Oligomer
ggauguucaccuggauuug

SEQ ID NO: 6467 - RNA, 19 nt, artificial
  Oligomer
gucgugucacaaccuuauu

SEQ ID NO: 6468 - RNA, 19 nt, artificial
  Oligomer
gaagcuggguaacaaguac

SEQ ID NO: 6469 - RNA, 19 nt, artificial
  Oligomer
ccacuuucaucugaguagc

SEQ ID NO: 6470 - RNA, 19 nt, artificial
  Oligomer
cauccucccagaacugaga

SEQ ID NO: 6471 - RNA, 19 nt, artificial
  Oligomer
ccacaaagaugugacugca

SEQ ID NO: 6472 - RNA, 19 nt, artificial
  Oligomer
gcugggagcagaauauaga

SEQ ID NO: 6473 - RNA, 19 nt, artificial
  Oligomer
ggaggcaucacaagugcua

SEQ ID NO: 6474 - RNA, 19 nt, artificial
  Oligomer
gauuugaaggcacggaaca

SEQ ID NO: 6475 - RNA, 19 nt, artificial
  Oligomer
cagugucgaacuguuugua

SEQ ID NO: 6476 - RNA, 19 nt, artificial
  Oligomer
ucacaaccuuauugagaau

SEQ ID NO: 6477 - RNA, 19 nt, artificial
  Oligomer
agcgucggaugaucauguu

SEQ ID NO: 6478 - RNA, 19 nt, artificial
  Oligomer
cagcugaugaaguugucaa

SEQ ID NO: 6479 - RNA, 19 nt, artificial
  Oligomer
ggcugggagcagaauauag

SEQ ID NO: 6480 - RNA, 19 nt, artificial
  Oligomer
ccaucuuugucaagagauu

SEQ ID NO: 6481 - RNA, 19 nt, artificial
  Oligomer
ggauguugagaagcugggu

SEQ ID NO: 6482 - RNA, 19 nt, artificial
  Oligomer
gggagcagaauauagacaa

SEQ ID NO: 6483 - RNA, 19 nt, artificial
  Oligomer
gggaguucacuacugcaaa

SEQ ID NO: 6484 - RNA, 19 nt, artificial
  Oligomer
acgaguuaaccaggaacau

SEQ ID NO: 6485 - RNA, 19 nt, artificial
  Oligomer
gcaaagagucuccggaacu

SEQ ID NO: 6486 - RNA, 19 nt, artificial
  Oligomer
cccuggauguugagaagcu

SEQ ID NO: 6487 - RNA, 19 nt, artificial
  Oligomer
ccuggauguucaccuggau

SEQ ID NO: 6488 - RNA, 19 nt, artificial
  Oligomer
agcugaugaaguugucaaa

SEQ ID NO: 6489 - RNA, 19 nt, artificial
  Oligomer
gcaucacaagugcuaggcu

SEQ ID NO: 6490 - RNA, 19 nt, artificial
  Oligomer
cugaugaaguugucaaaau

SEQ ID NO: 6491 - RNA, 19 nt, artificial
  Oligomer
guuccacaaguacuugaau

SEQ ID NO: 6492 - RNA, 19 nt, artificial
  Oligomer
agaacgaguuaaccaggaa

SEQ ID NO: 6493 - RNA, 19 nt, artificial
  Oligomer
gcuggguaacaaguacuga

SEQ ID NO: 6494 - RNA, 19 nt, artificial
  Oligomer
gcgucggaugaucauguua

SEQ ID NO: 6495 - RNA, 19 nt, artificial
  Oligomer
ggguaacaaguacugagag

SEQ ID NO: 6496 - RNA, 19 nt, artificial
  Oligomer
caggcugggagcagaauau

SEQ ID NO: 6497 - RNA, 19 nt, artificial
  Oligomer
gucggaugaucauguuaua

SEQ ID NO: 6498 - RNA, 19 nt, artificial
  Oligomer
caaguacugagagaacaaa

SEQ ID NO: 6499 - RNA, 19 nt, artificial
  Oligomer
gaccaagcagcugaugaag

SEQ ID NO: 6500 - RNA, 19 nt, artificial
  Oligomer
gcuccaguucaggaauaca

SEQ ID NO: 6501 - RNA, 19 nt, artificial
  Oligomer
gcuccaggugacuccuaua

SEQ ID NO: 6502 - RNA, 19 nt, artificial
  Oligomer
aggcugggagcagaauaua

SEQ ID NO: 6503 - RNA, 19 nt, artificial
  Oligomer
gccucaauguuggaguaau

SEQ ID NO: 6504 - RNA, 19 nt, artificial
  Oligomer
caaccuuauugagaauguu

SEQ ID NO: 6505 - RNA, 19 nt, artificial
  Oligomer
gcagcugaugaaguuguca

SEQ ID NO: 6506 - RNA, 19 nt, artificial
  Oligomer
gcugaugaaguugucaaaa

SEQ ID NO: 6507 - RNA, 19 nt, artificial
  Oligomer
gguaacaaguacugagaga

SEQ ID NO: 6508 - RNA, 19 nt, artificial
  Oligomer
ccaagcagcugaugaaguu

SEQ ID NO: 6509 - RNA, 19 nt, artificial
  Oligomer
ggcuccaguucaggaauac

SEQ ID NO: 6510 - RNA, 19 nt, artificial
  Oligomer
ggccucaauguuggaguaa

SEQ ID NO: 6511 - RNA, 19 nt, artificial
  Oligomer
ggaguucacuacugcaaau

SEQ ID NO: 6512 - RNA, 19 nt, artificial
  Oligomer
gggcuccaguucaggaaua

SEQ ID NO: 6513 - RNA, 19 nt, artificial
  Oligomer
gaugcucauucagguggaa

SEQ ID NO: 6514 - RNA, 19 nt, artificial
  Oligomer
ggagcagaauauagacaaa

SEQ ID NO: 6515 - RNA, 19 nt, artificial
  Oligomer
gcguagaugugaaaaaaaa

SEQ ID NO: 6516 - RNA, 19 nt, artificial
  Oligomer
cagcguagaugugaaaaaa

SEQ ID NO: 6517 - RNA, 19 nt, artificial
  Oligomer
gggugaagguacaauaaau

SEQ ID NO: 6518 - RNA, 19 nt, artificial
  Oligomer
ggaugaugcuauuaagaaa

SEQ ID NO: 6519 - RNA, 19 nt, artificial
  Oligomer
ugacaaugcugcuacaaaa

SEQ ID NO: 6520 - RNA, 19 nt, artificial
  Oligomer
caaaggauauggaaacaaa

SEQ ID NO: 6521 - RNA, 19 nt, artificial
  Oligomer
agacaagggugcugaacaa

SEQ ID NO: 6522 - RNA, 19 nt, artificial
  Oligomer
agagauggagaaaguaaaa

SEQ ID NO: 6523 - RNA, 19 nt, artificial
  Oligomer
aaaggauauggaaacaaaa

SEQ ID NO: 6524 - RNA, 19 nt, artificial
  Oligomer
caaucuuuaacauguugaa

SEQ ID NO: 6525 - RNA, 19 nt, artificial
  Oligomer
cguagaugugaaaaaaaau

SEQ ID NO: 6526 - RNA, 19 nt, artificial
  Oligomer
ggagaaaguaaaacgugaa

SEQ ID NO: 6527 - RNA, 19 nt, artificial
  Oligomer
cagauauacuacaacucaa

SEQ ID NO: 6528 - RNA, 19 nt, artificial
  Oligomer
gguacagcguagaugugaa

SEQ ID NO: 6529 - RNA, 19 nt, artificial
  Oligomer
aagagauggagaaaguaaa

SEQ ID NO: 6530 - RNA, 19 nt, artificial
  Oligomer
cgaaggugaucaucaucca

SEQ ID NO: 6531 - RNA, 19 nt, artificial
  Oligomer
ccgcaagguucgauuuuca

SEQ ID NO: 6532 - RNA, 19 nt, artificial
  Oligomer
aggcauuugugggaagaaa

SEQ ID NO: 6533 - RNA, 19 nt, artificial
  Oligomer
aauuaugucugcugaauaa

SEQ ID NO: 6534 - RNA, 19 nt, artificial
  Oligomer
agcguagaugugaaaaaaa

SEQ ID NO: 6535 - RNA, 19 nt, artificial
  Oligomer
augucugcugaauaauaaa

SEQ ID NO: 6536 - RNA, 19 nt, artificial
  Oligomer
gaagaaacacucugagcaa

SEQ ID NO: 6537 - RNA, 19 nt, artificial
  Oligomer
caagggugcugaacaagga

SEQ ID NO: 6538 - RNA, 19 nt, artificial
  Oligomer
cucccuagaagaagcucaa

SEQ ID NO: 6539 - RNA, 19 nt, artificial
  Oligomer
gagaaaguaaaacgugaaa

SEQ ID NO: 6540 - RNA, 19 nt, artificial
  Oligomer
gcucagaagggaaugucaa

SEQ ID NO: 6541 - RNA, 19 nt, artificial
  Oligomer
gcaugacaaugcugcuaca

SEQ ID NO: 6542 - RNA, 19 nt, artificial
  Oligomer
ggcagagauuuauccaaua

SEQ ID NO: 6543 - RNA, 19 nt, artificial
  Oligomer
gaagagauggagaaaguaa

SEQ ID NO: 6544 - RNA, 19 nt, artificial
  Oligomer
gaaaguaaaacgugaaaau

SEQ ID NO: 6545 - RNA, 19 nt, artificial
  Oligomer
gcacguuccugguguucau

SEQ ID NO: 6546 - RNA, 19 nt, artificial
  Oligomer
uccugaaggagaagagaaa

SEQ ID NO: 6547 - RNA, 19 nt, artificial
  Oligomer
ggcucagaagggaauguca

SEQ ID NO: 6548 - RNA, 19 nt, artificial
  Oligomer
ggaagagauggagaaagua

SEQ ID NO: 6549 - RNA, 19 nt, artificial
  Oligomer
agaagaagcucaaaggaua

SEQ ID NO: 6550 - RNA, 19 nt, artificial
  Oligomer
acaagguccugaaggagaa

SEQ ID NO: 6551 - RNA, 19 nt, artificial
  Oligomer
cgugaaaaugcuacaguua

SEQ ID NO: 6552 - RNA, 19 nt, artificial
  Oligomer
aacucaaugcaaucuuuaa

SEQ ID NO: 6553 - RNA, 19 nt, artificial
  Oligomer
aggaguuucuggaaaccua

SEQ ID NO: 6554 - RNA, 19 nt, artificial
  Oligomer
gacaguauuccuagaagaa

SEQ ID NO: 6555 - RNA, 19 nt, artificial
  Oligomer
ggaguuucuggaaaccuau

SEQ ID NO: 6556 - RNA, 19 nt, artificial
  Oligomer
ccucuucccaggacauuaa

SEQ ID NO: 6557 - RNA, 19 nt, artificial
  Oligomer
caagcuuugcucccuagaa

SEQ ID NO: 6558 - RNA, 19 nt, artificial
  Oligomer
gaugaauuauuacagacaa

SEQ ID NO: 6559 - RNA, 19 nt, artificial
  Oligomer
ggacauuaaaauaaggaaa

SEQ ID NO: 6560 - RNA, 19 nt, artificial
  Oligomer
caaggaagagauggagaaa

SEQ ID NO: 6561 - RNA, 19 nt, artificial
  Oligomer
caugggugaagguacaaua

SEQ ID NO: 6562 - RNA, 19 nt, artificial
  Oligomer
cauugaacauaugcaagaa

SEQ ID NO: 6563 - RNA, 19 nt, artificial
  Oligomer
uggaauuaugucugcugaa

SEQ ID NO: 6564 - RNA, 19 nt, artificial
  Oligomer
gggugcugaacaaggaaga

SEQ ID NO: 6565 - RNA, 19 nt, artificial
  Oligomer
gcugaauaauaaacuuuuu

SEQ ID NO: 6566 - RNA, 19 nt, artificial
  Oligomer
gcauuugugggaagaaaca

SEQ ID NO: 6567 - RNA, 19 nt, artificial
  Oligomer
ugagcaagucccagauaua

SEQ ID NO: 6568 - RNA, 19 nt, artificial
  Oligomer
agagcuggaggcauuugca

SEQ ID NO: 6569 - RNA, 19 nt, artificial
  Oligomer
gguccugaaggagaagaga

SEQ ID NO: 6570 - RNA, 19 nt, artificial
  Oligomer
uaugucugcugaauaauaa

SEQ ID NO: 6571 - RNA, 19 nt, artificial
  Oligomer
ggcucuguuuuuauuggaa

SEQ ID NO: 6572 - RNA, 19 nt, artificial
  Oligomer
gaauuaugucugcugaaua

SEQ ID NO: 6573 - RNA, 19 nt, artificial
  Oligomer
cauuaucugcaaugaagaa

SEQ ID NO: 6574 - RNA, 19 nt, artificial
  Oligomer
cgcaagguucgauuuucau

SEQ ID NO: 6575 - RNA, 19 nt, artificial
  Oligomer
ugggugaagguacaauaaa

SEQ ID NO: 6576 - RNA, 19 nt, artificial
  Oligomer
cuggaugaauuauuacaga

SEQ ID NO: 6577 - RNA, 19 nt, artificial
  Oligomer
gcucuuccacaccagauaa

SEQ ID NO: 6578 - RNA, 19 nt, artificial
  Oligomer
aagggugcugaacaaggaa

SEQ ID NO: 6579 - RNA, 19 nt, artificial
  Oligomer
gcagagauuuauccaauaa

SEQ ID NO: 6580 - RNA, 19 nt, artificial
  Oligomer
uggagaaaguaaaacguga

SEQ ID NO: 6581 - RNA, 19 nt, artificial
  Oligomer
gaaagagugacuuugacaa

SEQ ID NO: 6582 - RNA, 19 nt, artificial
  Oligomer
augggugaagguacaauaa

SEQ ID NO: 6583 - RNA, 19 nt, artificial
  Oligomer
gaagacucauugaacauau

SEQ ID NO: 6584 - RNA, 19 nt, artificial
  Oligomer
aaccgaaggugaucaucau

SEQ ID NO: 6585 - RNA, 19 nt, artificial
  Oligomer
acagcguagaugugaaaaa

SEQ ID NO: 6586 - RNA, 19 nt, artificial
  Oligomer
gcaagucccagauauacua

SEQ ID NO: 6587 - RNA, 19 nt, artificial
  Oligomer
agaagagaaagcuguuuau

SEQ ID NO: 6588 - RNA, 19 nt, artificial
  Oligomer
aggacauuaaaauaaggaa

SEQ ID NO: 6589 - RNA, 19 nt, artificial
  Oligomer
cucuucccaggacauuaaa

SEQ ID NO: 6590 - RNA, 19 nt, artificial
  Oligomer
agcugagguugacaucaca

SEQ ID NO: 6591 - RNA, 19 nt, artificial
  Oligomer
gaagcucaaaggauaugga

SEQ ID NO: 6592 - RNA, 19 nt, artificial
  Oligomer
ggaaaccuaucuuuaccaa

SEQ ID NO: 6593 - RNA, 19 nt, artificial
  Oligomer
ccaauaauggacaagucaa

SEQ ID NO: 6594 - RNA, 19 nt, artificial
  Oligomer
gucucaugguauucgggaa

SEQ ID NO: 6595 - RNA, 19 nt, artificial
  Oligomer
guacagcguagaugugaaa

SEQ ID NO: 6596 - RNA, 19 nt, artificial
  Oligomer
cuuacuggaugaauuauua

SEQ ID NO: 6597 - RNA, 19 nt, artificial
  Oligomer
uuaacauguugaauaccaa

SEQ ID NO: 6598 - RNA, 19 nt, artificial
  Oligomer
uacagacaagggugcugaa

SEQ ID NO: 6599 - RNA, 19 nt, artificial
  Oligomer
cagagauuuauccaauaau

SEQ ID NO: 6600 - RNA, 19 nt, artificial
  Oligomer
acgugaaaaugcuacaguu

SEQ ID NO: 6601 - RNA, 19 nt, artificial
  Oligomer
agcucaaaggauauggaaa

SEQ ID NO: 6602 - RNA, 19 nt, artificial
  Oligomer
gaagaagcucaaaggauau

SEQ ID NO: 6603 - RNA, 19 nt, artificial
  Oligomer
guuuaaagauucaguagga

SEQ ID NO: 6604 - RNA, 19 nt, artificial
  Oligomer
cggcagagauuuauccaau

SEQ ID NO: 6605 - RNA, 19 nt, artificial
  Oligomer
acucauugaacauaugcaa

SEQ ID NO: 6606 - RNA, 19 nt, artificial
  Oligomer
cacauacauuugugaagaa

SEQ ID NO: 6607 - RNA, 19 nt, artificial
  Oligomer
ggugugguuuaaagauuca

SEQ ID NO: 6608 - RNA, 19 nt, artificial
  Oligomer
ccagauaauguuucuugga

SEQ ID NO: 6609 - RNA, 19 nt, artificial
  Oligomer
aggacaaaccgaaggugau

SEQ ID NO: 6610 - RNA, 19 nt, artificial
  Oligomer
gugggaagaaacacucuga

SEQ ID NO: 6611 - RNA, 19 nt, artificial
  Oligomer
ugacaguauuccuagaaga

SEQ ID NO: 6612 - RNA, 19 nt, artificial
  Oligomer
guccugaaggagaagagaa

SEQ ID NO: 6613 - RNA, 19 nt, artificial
  Oligomer
caacucaaugcaaucuuua

SEQ ID NO: 6614 - RNA, 19 nt, artificial
  Oligomer
gcuuugcucccuagaagaa

SEQ ID NO: 6615 - RNA, 19 nt, artificial
  Oligomer
aagcucaaaggauauggaa

SEQ ID NO: 6616 - RNA, 19 nt, artificial
  Oligomer
cugguguggugugguuuaa

SEQ ID NO: 6617 - RNA, 19 nt, artificial
  Oligomer
caguauuccuagaagaacu

SEQ ID NO: 6618 - RNA, 19 nt, artificial
  Oligomer
aggagaagagaaagcuguu

SEQ ID NO: 6619 - RNA, 19 nt, artificial
  Oligomer
cuucggacaugacuacaga

SEQ ID NO: 6620 - RNA, 19 nt, artificial
  Oligomer
acauguugaauaccaagaa

SEQ ID NO: 6621 - RNA, 19 nt, artificial
  Oligomer
aaggcauuugugggaagaa

SEQ ID NO: 6622 - RNA, 19 nt, artificial
  Oligomer
guguggugugguuuaaaga

SEQ ID NO: 6623 - RNA, 19 nt, artificial
  Oligomer
gugguuuaaagauucagua

SEQ ID NO: 6624 - RNA, 19 nt, artificial
  Oligomer
cucuguuuuuauuggaaga

SEQ ID NO: 6625 - RNA, 19 nt, artificial
  Oligomer
ugguguggugugguuuaaa

SEQ ID NO: 6626 - RNA, 19 nt, artificial
  Oligomer
cuagaagaagcucaaagga

SEQ ID NO: 6627 - RNA, 19 nt, artificial
  Oligomer
ccugugauguggaggaaau

SEQ ID NO: 6628 - RNA, 19 nt, artificial
  Oligomer
ugaagaauuugacaguauu

SEQ ID NO: 6629 - RNA, 19 nt, artificial
  Oligomer
agagugacuuugacaagau

SEQ ID NO: 6630 - RNA, 19 nt, artificial
  Oligomer
caguaggaguuucuggaaa

SEQ ID NO: 6631 - RNA, 19 nt, artificial
  Oligomer
cagacaagggugcugaaca

SEQ ID NO: 6632 - RNA, 19 nt, artificial
  Oligomer
gaggaugaugcuauuaaga

SEQ ID NO: 6633 - RNA, 19 nt, artificial
  Oligomer
caaugggcucuguuuuuau

SEQ ID NO: 6634 - RNA, 19 nt, artificial
  Oligomer
ucucauuaucugcaaugaa

SEQ ID NO: 6635 - RNA, 19 nt, artificial
  Oligomer
cagagcacaagaccucuga

SEQ ID NO: 6636 - RNA, 19 nt, artificial
  Oligomer
ggaauuaugucugcugaau

SEQ ID NO: 6637 - RNA, 19 nt, artificial
  Oligomer
gggcucuguuuuuauugga

SEQ ID NO: 6638 - RNA, 19 nt, artificial
  Oligomer
augcuacaguuauggauaa

SEQ ID NO: 6639 - RNA, 19 nt, artificial
  Oligomer
ccugguguggugugguuua

SEQ ID NO: 6640 - RNA, 19 nt, artificial
  Oligomer
uuaaaauaaggaaacugua

SEQ ID NO: 6641 - RNA, 19 nt, artificial
  Oligomer
ugaacauaugcaagaauau

SEQ ID NO: 6642 - RNA, 19 nt, artificial
  Oligomer
guaaaacgugaaaaugcua

SEQ ID NO: 6643 - RNA, 19 nt, artificial
  Oligomer
ugaggaugaugcuauuaag

SEQ ID NO: 6644 - RNA, 19 nt, artificial
  Oligomer
acaaggaagagauggagaa

SEQ ID NO: 6645 - RNA, 19 nt, artificial
  Oligomer
gacucauugaacauaugca

SEQ ID NO: 6646 - RNA, 19 nt, artificial
  Oligomer
ggaagaaacacucugagca

SEQ ID NO: 6647 - RNA, 19 nt, artificial
  Oligomer
uuggaagacucauugaaca

SEQ ID NO: 6648 - RNA, 19 nt, artificial
  Oligomer
gaaugucugugggcaggaa

SEQ ID NO: 6649 - RNA, 19 nt, artificial
  Oligomer
ggaugaauuauuacagaca

SEQ ID NO: 6650 - RNA, 19 nt, artificial
  Oligomer
agucccagauauacuacaa

SEQ ID NO: 6651 - RNA, 19 nt, artificial
  Oligomer
uuaugucugcugaauaaua

SEQ ID NO: 6652 - RNA, 19 nt, artificial
  Oligomer
gagcacaagaccucugaca

SEQ ID NO: 6653 - RNA, 19 nt, artificial
  Oligomer
aguaaaacgugaaaaugcu

SEQ ID NO: 6654 - RNA, 19 nt, artificial
  Oligomer
ccagauauacuacaacuca

SEQ ID NO: 6655 - RNA, 19 nt, artificial
  Oligomer
agcuuugcucccuagaaga

SEQ ID NO: 6656 - RNA, 19 nt, artificial
  Oligomer
cugugauguggaggaaauu

SEQ ID NO: 6657 - RNA, 19 nt, artificial
  Oligomer
cccaggacauuaaaauaag

SEQ ID NO: 6658 - RNA, 19 nt, artificial
  Oligomer
agauaauguuucuuggaga

SEQ ID NO: 6659 - RNA, 19 nt, artificial
  Oligomer
uggaggaaauuuuccgcaa

SEQ ID NO: 6660 - RNA, 19 nt, artificial
  Oligomer
aaagguuuuuggaauuaug

SEQ ID NO: 6661 - RNA, 19 nt, artificial
  Oligomer
cucaaugcaaucuuuaaca

SEQ ID NO: 6662 - RNA, 19 nt, artificial
  Oligomer
agaacugcccaaguuugaa

SEQ ID NO: 6663 - RNA, 19 nt, artificial
  Oligomer
agauauacuacaacucaau

SEQ ID NO: 6664 - RNA, 19 nt, artificial
  Oligomer
aaccuaucuuuaccaacua

SEQ ID NO: 6665 - RNA, 19 nt, artificial
  Oligomer
guucaugucucaugguauu

SEQ ID NO: 6666 - RNA, 19 nt, artificial
  Oligomer
gagugacuuugacaagaug

SEQ ID NO: 6667 - RNA, 19 nt, artificial
  Oligomer
aaauaaggaaacuguauga

SEQ ID NO: 6668 - RNA, 19 nt, artificial
  Oligomer
uuaagaaagcccacauaga

SEQ ID NO: 6669 - RNA, 19 nt, artificial
  Oligomer
uauuggaagacucauugaa

SEQ ID NO: 6670 - RNA, 19 nt, artificial
  Oligomer
gugaaaaugcuacaguuau

SEQ ID NO: 6671 - RNA, 19 nt, artificial
  Oligomer
gacaaugcugcuacaaaau

SEQ ID NO: 6672 - RNA, 19 nt, artificial
  Oligomer
acaugacuacagagcugga

SEQ ID NO: 6673 - RNA, 19 nt, artificial
  Oligomer
aaauuugcaucacauacau

SEQ ID NO: 6674 - RNA, 19 nt, artificial
  Oligomer
cuacagagcuggaggcauu

SEQ ID NO: 6675 - RNA, 19 nt, artificial
  Oligomer
caagauguuucuaccucuu

SEQ ID NO: 6676 - RNA, 19 nt, artificial
  Oligomer
ugaagagauccuucuguaa

SEQ ID NO: 6677 - RNA, 19 nt, artificial
  Oligomer
aagagugacuuugacaaga

SEQ ID NO: 6678 - RNA, 19 nt, artificial
  Oligomer
caacuacagaagaguuuga

SEQ ID NO: 6679 - RNA, 19 nt, artificial
  Oligomer
gggcaggaagugaagagau

SEQ ID NO: 6680 - RNA, 19 nt, artificial
  Oligomer
ugguauucgggaaggcauu

SEQ ID NO: 6681 - RNA, 19 nt, artificial
  Oligomer
gagaagagaaagcuguuua

SEQ ID NO: 6682 - RNA, 19 nt, artificial
  Oligomer
guuugaggaugaugcuauu

SEQ ID NO: 6683 - RNA, 19 nt, artificial
  Oligomer
ucccuagaagaagcucaaa

SEQ ID NO: 6684 - RNA, 19 nt, artificial
  Oligomer
agaaaguaaaacgugaaaa

SEQ ID NO: 6685 - RNA, 19 nt, artificial
  Oligomer
augcaaucuuuaacauguu

SEQ ID NO: 6686 - RNA, 19 nt, artificial
  Oligomer
gaagagauccuucuguaaa

SEQ ID NO: 6687 - RNA, 19 nt, artificial
  Oligomer
acugaaagagugacuuuga

SEQ ID NO: 6688 - RNA, 19 nt, artificial
  Oligomer
aaaagucggcagagauuua

SEQ ID NO: 6689 - RNA, 19 nt, artificial
  Oligomer
ugcugaacaaggaagagau

SEQ ID NO: 6690 - RNA, 19 nt, artificial
  Oligomer
guuucuuggagacauccca

SEQ ID NO: 6691 - RNA, 19 nt, artificial
  Oligomer
gauaagacccgagcuuuga

SEQ ID NO: 6692 - RNA, 19 nt, artificial
  Oligomer
cuguaaagguuuuuggaau

SEQ ID NO: 6693 - RNA, 19 nt, artificial
  Oligomer
caugguauucgggaaggca

SEQ ID NO: 6694 - RNA, 19 nt, artificial
  Oligomer
cacacgucuugcucucauu

SEQ ID NO: 6695 - RNA, 19 nt, artificial
  Oligomer
ugcucuuccacaccagaua

SEQ ID NO: 6696 - RNA, 19 nt, artificial
  Oligomer
augacaaugcugcuacaaa

SEQ ID NO: 6697 - RNA, 19 nt, artificial
  Oligomer
ucuuggagacaucccacaa

SEQ ID NO: 6698 - RNA, 19 nt, artificial
  Oligomer
guuuuuauuggaagacuca

SEQ ID NO: 6699 - RNA, 19 nt, artificial
  Oligomer
gggaaggcauuugugggaa

SEQ ID NO: 6700 - RNA, 19 nt, artificial
  Oligomer
gaacuggagcugagguuga

SEQ ID NO: 6701 - RNA, 19 nt, artificial
  Oligomer
ccaggacauuaaaauaagg

SEQ ID NO: 6702 - RNA, 19 nt, artificial
  Oligomer
caggcaugacaaugcugcu

SEQ ID NO: 6703 - RNA, 19 nt, artificial
  Oligomer
cggacaugacuacagagcu

SEQ ID NO: 6704 - RNA, 19 nt, artificial
  Oligomer
ggcauuugugggaagaaac

SEQ ID NO: 6705 - RNA, 19 nt, artificial
  Oligomer
gaaggcauuugugggaaga

SEQ ID NO: 6706 - RNA, 19 nt, artificial
  Oligomer
aggaagagauggagaaagu

SEQ ID NO: 6707 - RNA, 19 nt, artificial
  Oligomer
uucccaggacauuaaaaua

SEQ ID NO: 6708 - RNA, 19 nt, artificial
  Oligomer
caagaauaugccuguuccu

SEQ ID NO: 6709 - RNA, 19 nt, artificial
  Oligomer
gaauuugacaguauuccua

SEQ ID NO: 6710 - RNA, 19 nt, artificial
  Oligomer
ggaagacucauugaacaua

SEQ ID NO: 6711 - RNA, 19 nt, artificial
  Oligomer
cauacauuugugaagaaga

SEQ ID NO: 6712 - RNA, 19 nt, artificial
  Oligomer
ucauuaucugcaaugaaga

SEQ ID NO: 6713 - RNA, 19 nt, artificial
  Oligomer
agaaagcccacauagagaa

SEQ ID NO: 6714 - RNA, 19 nt, artificial
  Oligomer
caaauuugcaucacauaca

SEQ ID NO: 6715 - RNA, 19 nt, artificial
  Oligomer
cuuggagacaucccacaau

SEQ ID NO: 6716 - RNA, 19 nt, artificial
  Oligomer
caucacauacauuugugaa

SEQ ID NO: 6717 - RNA, 19 nt, artificial
  Oligomer
cccacaaugggcucuguuu

SEQ ID NO: 6718 - RNA, 19 nt, artificial
  Oligomer
aagaaagcccacauagaga

SEQ ID NO: 6719 - RNA, 19 nt, artificial
  Oligomer
gacaucacaggcaugacaa

SEQ ID NO: 6720 - RNA, 19 nt, artificial
  Oligomer
ggaggaaauuuuccgcaag

SEQ ID NO: 6721 - RNA, 19 nt, artificial
  Oligomer
gagcuuugauugacuccgu

SEQ ID NO: 6722 - RNA, 19 nt, artificial
  Oligomer
agacccgagcuuugauuga

SEQ ID NO: 6723 - RNA, 19 nt, artificial
  Oligomer
cugagcaagucccagauau

SEQ ID NO: 6724 - RNA, 19 nt, artificial
  Oligomer
ucuucccaggacauuaaaa

SEQ ID NO: 6725 - RNA, 19 nt, artificial
  Oligomer
aggaugaugcuauuaagaa

SEQ ID NO: 6726 - RNA, 19 nt, artificial
  Oligomer
auacuacaacucaaugcaa

SEQ ID NO: 6727 - RNA, 19 nt, artificial
  Oligomer
gaaggagaagagaaagcug

SEQ ID NO: 6728 - RNA, 19 nt, artificial
  Oligomer
ggauaagacccgagcuuug

SEQ ID NO: 6729 - RNA, 19 nt, artificial
  Oligomer
caagguucgauuuucauuu

SEQ ID NO: 6730 - RNA, 19 nt, artificial
  Oligomer
ucggcagagauuuauccaa

SEQ ID NO: 6731 - RNA, 19 nt, artificial
  Oligomer
uuccaugggugaagguaca

SEQ ID NO: 6732 - RNA, 19 nt, artificial
  Oligomer
gauggagaaaguaaaacgu

SEQ ID NO: 6733 - RNA, 19 nt, artificial
  Oligomer
aagguuuuuggaauuaugu

SEQ ID NO: 6734 - RNA, 19 nt, artificial
  Oligomer
gguguggugugguuuaaag

SEQ ID NO: 6735 - RNA, 19 nt, artificial
  Oligomer
gaugugaaaaaaaaucuca

SEQ ID NO: 6736 - RNA, 19 nt, artificial
  Oligomer
acccgagcuuugauugacu

SEQ ID NO: 6737 - RNA, 19 nt, artificial
  Oligomer
uuggaauuaugucugcuga

SEQ ID NO: 6738 - RNA, 19 nt, artificial
  Oligomer
ugaacaaggaagagaugga

SEQ ID NO: 6739 - RNA, 19 nt, artificial
  Oligomer
gcaucacauacauuuguga

SEQ ID NO: 6740 - RNA, 19 nt, artificial
  Oligomer
caauaauggacaagucaag

SEQ ID NO: 6741 - RNA, 19 nt, artificial
  Oligomer
aaaacgugaaaaugcuaca

SEQ ID NO: 6742 - RNA, 19 nt, artificial
  Oligomer
caggacauuaaaauaagga

SEQ ID NO: 6743 - RNA, 19 nt, artificial
  Oligomer
cacaagaccucugacagca

SEQ ID NO: 6744 - RNA, 19 nt, artificial
  Oligomer
gugaagagauccuucugua

SEQ ID NO: 6745 - RNA, 19 nt, artificial
  Oligomer
ucugcaaugaagaauuuga

SEQ ID NO: 6746 - RNA, 19 nt, artificial
  Oligomer
ggguacagcguagauguga

SEQ ID NO: 6747 - RNA, 19 nt, artificial
  Oligomer
ggaaauuuuccgcaagguu

SEQ ID NO: 6748 - RNA, 19 nt, artificial
  Oligomer
ccuguuccugugaugugga

SEQ ID NO: 6749 - RNA, 19 nt, artificial
  Oligomer
acaucacaggcaugacaau

SEQ ID NO: 6750 - RNA, 19 nt, artificial
  Oligomer
gacaagguccugaaggaga

SEQ ID NO: 6751 - RNA, 19 nt, artificial
  Oligomer
cugaaagagugacuuugac

SEQ ID NO: 6752 - RNA, 19 nt, artificial
  Oligomer
uugacuccguuauuccgaa

SEQ ID NO: 6753 - RNA, 19 nt, artificial
  Oligomer
agcuggaggcauuugcaca

SEQ ID NO: 6754 - RNA, 19 nt, artificial
  Oligomer
uguggugugguuuaaagau

SEQ ID NO: 6755 - RNA, 19 nt, artificial
  Oligomer
cuucccaggacauuaaaau

SEQ ID NO: 6756 - RNA, 19 nt, artificial
  Oligomer
agauuuauccaauaaugga

SEQ ID NO: 6757 - RNA, 19 nt, artificial
  Oligomer
auuugacaguauuccuaga

SEQ ID NO: 6758 - RNA, 19 nt, artificial
  Oligomer
gcuacaguuauggauaaga

SEQ ID NO: 6759 - RNA, 19 nt, artificial
  Oligomer
ggagcugagguugacauca

SEQ ID NO: 6760 - RNA, 19 nt, artificial
  Oligomer
ugcugaauaauaaacuuuu

SEQ ID NO: 6761 - RNA, 19 nt, artificial
  Oligomer
cucagaagggaaugucaag

SEQ ID NO: 6762 - RNA, 19 nt, artificial
  Oligomer
cagaugcccaccacugaaa

SEQ ID NO: 6763 - RNA, 19 nt, artificial
  Oligomer
cagaagaguuugaggauga

SEQ ID NO: 6764 - RNA, 19 nt, artificial
  Oligomer
cuuugacaagauguuucua

SEQ ID NO: 6765 - RNA, 19 nt, artificial
  Oligomer
cgucuugcucucauuaucu

SEQ ID NO: 6766 - RNA, 19 nt, artificial
  Oligomer
cuuugauugacuccguuau

SEQ ID NO: 6767 - RNA, 19 nt, artificial
  Oligomer
ugacuccguuauuccgaaa

SEQ ID NO: 6768 - RNA, 19 nt, artificial
  Oligomer
gugacuuugacaagauguu

SEQ ID NO: 6769 - RNA, 19 nt, artificial
  Oligomer
acaacucaaugcaaucuuu

SEQ ID NO: 6770 - RNA, 19 nt, artificial
  Oligomer
cucucauuaucugcaauga

SEQ ID NO: 6771 - RNA, 19 nt, artificial
  Oligomer
gcacacgucuugcucucau

SEQ ID NO: 6772 - RNA, 19 nt, artificial
  Oligomer
gcaagguucgauuuucauu

SEQ ID NO: 6773 - RNA, 19 nt, artificial
  Oligomer
agaagaguuugaggaugau

SEQ ID NO: 6774 - RNA, 19 nt, artificial
  Oligomer
ucugcugaauaauaaacuu

SEQ ID NO: 6775 - RNA, 19 nt, artificial
  Oligomer
cgcuuucugcucuuccaca

SEQ ID NO: 6776 - RNA, 19 nt, artificial
  Oligomer
uaaagguuuuuggaauuau

SEQ ID NO: 6777 - RNA, 19 nt, artificial
  Oligomer
agguucgauuuucauuuga

SEQ ID NO: 6778 - RNA, 19 nt, artificial
  Oligomer
caugacaaugcugcuacaa

SEQ ID NO: 6779 - RNA, 19 nt, artificial
  Oligomer
ucccaggacauuaaaauaa

SEQ ID NO: 6780 - RNA, 19 nt, artificial
  Oligomer
cagaugguagagcgcagau

SEQ ID NO: 6781 - RNA, 19 nt, artificial
  Oligomer
caaugcugcuacaaaaucu

SEQ ID NO: 6782 - RNA, 19 nt, artificial
  Oligomer
uugcucucauuaucugcaa

SEQ ID NO: 6783 - RNA, 19 nt, artificial
  Oligomer
cucugagcaagucccagau

SEQ ID NO: 6784 - RNA, 19 nt, artificial
  Oligomer
gguucgauuuucauuugag

SEQ ID NO: 6785 - RNA, 19 nt, artificial
  Oligomer
ccuaucuuuaccaacuaca

SEQ ID NO: 6786 - RNA, 19 nt, artificial
  Oligomer
uguucaugucucaugguau

SEQ ID NO: 6787 - RNA, 19 nt, artificial
  Oligomer
ugcaaugaagaauuugaca

SEQ ID NO: 6788 - RNA, 19 nt, artificial
  Oligomer
cacaccagauaauguuucu

SEQ ID NO: 6789 - RNA, 19 nt, artificial
  Oligomer
guguucaugucucauggua

SEQ ID NO: 6790 - RNA, 19 nt, artificial
  Oligomer
ccugaaggagaagagaaag

SEQ ID NO: 6791 - RNA, 19 nt, artificial
  Oligomer
aaacaaaagucggcagaga

SEQ ID NO: 6792 - RNA, 19 nt, artificial
  Oligomer
ucuguaaagguuuuuggaa

SEQ ID NO: 6793 - RNA, 19 nt, artificial
  Oligomer
cugcaaugaagaauuugac

SEQ ID NO: 6794 - RNA, 19 nt, artificial
  Oligomer
ggaaacaaaagucggcaga

SEQ ID NO: 6795 - RNA, 19 nt, artificial
  Oligomer
ucaguaggaguuucuggaa

SEQ ID NO: 6796 - RNA, 19 nt, artificial
  Oligomer
ggagaagagaaagcuguuu

SEQ ID NO: 6797 - RNA, 19 nt, artificial
  Oligomer
cuacaguuauggauaagac

SEQ ID NO: 6798 - RNA, 19 nt, artificial
  Oligomer
uccugguguucaugucuca

SEQ ID NO: 6799 - RNA, 19 nt, artificial
  Oligomer
cucaaaggauauggaaaca

SEQ ID NO: 6800 - RNA, 19 nt, artificial
  Oligomer
agcuguuuauccguuccau

SEQ ID NO: 6801 - RNA, 19 nt, artificial
  Oligomer
cuaucuuuaccaacuacag

SEQ ID NO: 6802 - RNA, 19 nt, artificial
  Oligomer
aguuauggauaagacccga

SEQ ID NO: 6803 - RNA, 19 nt, artificial
  Oligomer
aagcccacauagagaagga

SEQ ID NO: 6804 - RNA, 19 nt, artificial
  Oligomer
cacgucuugcucucauuau

SEQ ID NO: 6805 - RNA, 19 nt, artificial
  Oligomer
ccacauagagaaggauuuu

SEQ ID NO: 6806 - RNA, 19 nt, artificial
  Oligomer
uauuaagaaagcccacaua

SEQ ID NO: 6807 - RNA, 19 nt, artificial
  Oligomer
caaugaagaauuugacagu

SEQ ID NO: 6808 - RNA, 19 nt, artificial
  Oligomer
gcuuugauugacuccguua

SEQ ID NO: 6809 - RNA, 19 nt, artificial
  Oligomer
uaaaauaaggaaacuguau

SEQ ID NO: 6810 - RNA, 19 nt, artificial
  Oligomer
ugaaagagugacuuugaca

SEQ ID NO: 6811 - RNA, 19 nt, artificial
  Oligomer
ugucaagcuuugcucccua

SEQ ID NO: 6812 - RNA, 19 nt, artificial
  Oligomer
gaugcccaccacugaaaga

SEQ ID NO: 6813 - RNA, 19 nt, artificial
  Oligomer
ccacaaugggcucuguuuu

SEQ ID NO: 6814 - RNA, 19 nt, artificial
  Oligomer
cguuccaugggugaaggua

SEQ ID NO: 6815 - RNA, 19 nt, artificial
  Oligomer
ucaaugcaaucuuuaacau

SEQ ID NO: 6816 - RNA, 19 nt, artificial
  Oligomer
acacgucuugcucucauua

SEQ ID NO: 6817 - RNA, 19 nt, artificial
  Oligomer
aggauauggaaacaaaagu

SEQ ID NO: 6818 - RNA, 19 nt, artificial
  Oligomer
ggugaagguacaauaaaug

SEQ ID NO: 6819 - RNA, 19 nt, artificial
  Oligomer
auaagacccgagcuuugau

SEQ ID NO: 6820 - RNA, 19 nt, artificial
  Oligomer
cauuugugaagaagacagu

SEQ ID NO: 6821 - RNA, 19 nt, artificial
  Oligomer
aagaacugcccaaguuuga

SEQ ID NO: 6822 - RNA, 19 nt, artificial
  Oligomer
auaaggaaacuguaugaau

SEQ ID NO: 6823 - RNA, 19 nt, artificial
  Oligomer
gcaaucuuuaacauguuga

SEQ ID NO: 6824 - RNA, 19 nt, artificial
  Oligomer
agcuuugauugacuccguu

SEQ ID NO: 6825 - RNA, 19 nt, artificial
  Oligomer
aagagauccuucuguaaag

SEQ ID NO: 6826 - RNA, 19 nt, artificial
  Oligomer
augguauucgggaaggcau

SEQ ID NO: 6827 - RNA, 19 nt, artificial
  Oligomer
gaaaaaaaaucucacugcu

SEQ ID NO: 6828 - RNA, 19 nt, artificial
  Oligomer
cucuuccacaccagauaau

SEQ ID NO: 6829 - RNA, 19 nt, artificial
  Oligomer
accucuucccaggacauua

SEQ ID NO: 6830 - RNA, 19 nt, artificial
  Oligomer
aaugcuacaguuauggaua

SEQ ID NO: 6831 - RNA, 19 nt, artificial
  Oligomer
cccacauagagaaggauuu

SEQ ID NO: 6832 - RNA, 19 nt, artificial
  Oligomer
ccaugggugaagguacaau

SEQ ID NO: 6833 - RNA, 19 nt, artificial
  Oligomer
gguguucaugucucauggu

SEQ ID NO: 6834 - RNA, 19 nt, artificial
  Oligomer
aaggacaaaccgaagguga

SEQ ID NO: 6835 - RNA, 19 nt, artificial
  Oligomer
guggugugguuuaaagauu

SEQ ID NO: 6836 - RNA, 19 nt, artificial
  Oligomer
ccaagaacugcccaaguuu

SEQ ID NO: 6837 - RNA, 19 nt, artificial
  Oligomer
ugggaagaaacacucugag

SEQ ID NO: 6838 - RNA, 19 nt, artificial
  Oligomer
ccuagaagaagcucaaagg

SEQ ID NO: 6839 - RNA, 19 nt, artificial
  Oligomer
aaggaaacuguaugaaugu

SEQ ID NO: 6840 - RNA, 19 nt, artificial
  Oligomer
gaagggaaugucaagcuuu

SEQ ID NO: 6841 - RNA, 19 nt, artificial
  Oligomer
aaugcaaucuuuaacaugu

SEQ ID NO: 6842 - RNA, 19 nt, artificial
  Oligomer
uugaacauaugcaagaaua

SEQ ID NO: 6843 - RNA, 19 nt, artificial
  Oligomer
uucuggaaaccuaucuuua

SEQ ID NO: 6844 - RNA, 19 nt, artificial
  Oligomer
cuagaagaacuggagcuga

SEQ ID NO: 6845 - RNA, 19 nt, artificial
  Oligomer
cucacugcuucggacauga

SEQ ID NO: 6846 - RNA, 19 nt, artificial
  Oligomer
uucuguaaagguuuuugga

SEQ ID NO: 6847 - RNA, 19 nt, artificial
  Oligomer
ccacugaaagagugacuuu

SEQ ID NO: 6848 - RNA, 19 nt, artificial
  Oligomer
gugauguggaggaaauuuu

SEQ ID NO: 6849 - RNA, 19 nt, artificial
  Oligomer
acugcuucggacaugacua

SEQ ID NO: 6850 - RNA, 19 nt, artificial
  Oligomer
gcucccuagaagaagcuca

SEQ ID NO: 6851 - RNA, 19 nt, artificial
  Oligomer
agagauuuauccaauaaug

SEQ ID NO: 6852 - RNA, 19 nt, artificial
  Oligomer
aacaaaagucggcagagau

SEQ ID NO: 6853 - RNA, 19 nt, artificial
  Oligomer
uggaagacucauugaacau

SEQ ID NO: 6854 - RNA, 19 nt, artificial
  Oligomer
ggaaggcauuugugggaag

SEQ ID NO: 6855 - RNA, 19 nt, artificial
  Oligomer
ggacaugacuacagagcug

SEQ ID NO: 6856 - RNA, 19 nt, artificial
  Oligomer
ugaaaaugcuacaguuaug

SEQ ID NO: 6857 - RNA, 19 nt, artificial
  Oligomer
cuuccacaccagauaaugu

SEQ ID NO: 6858 - RNA, 19 nt, artificial
  Oligomer
uccugugauguggaggaaa

SEQ ID NO: 6859 - RNA, 19 nt, artificial
  Oligomer
agaagggaaugucaagcuu

SEQ ID NO: 6860 - RNA, 19 nt, artificial
  Oligomer
acauagagaaggauuuuau

SEQ ID NO: 6861 - RNA, 19 nt, artificial
  Oligomer
cacauagagaaggauuuua

SEQ ID NO: 6862 - RNA, 19 nt, artificial
  Oligomer
cuaccucuucccaggacau

SEQ ID NO: 6863 - RNA, 19 nt, artificial
  Oligomer
aucuuuaccaacuacagaa

SEQ ID NO: 6864 - RNA, 19 nt, artificial
  Oligomer
ggugcugaacaaggaagag

SEQ ID NO: 6865 - RNA, 19 nt, artificial
  Oligomer
cucauuaucugcaaugaag

SEQ ID NO: 6866 - RNA, 19 nt, artificial
  Oligomer
acaagauguuucuaccucu

SEQ ID NO: 6867 - RNA, 19 nt, artificial
  Oligomer
cugcucuuccacaccagau

SEQ ID NO: 6868 - RNA, 19 nt, artificial
  Oligomer
aaggauauggaaacaaaag

SEQ ID NO: 6869 - RNA, 19 nt, artificial
  Oligomer
cuuuaccaacuacagaaga

SEQ ID NO: 6870 - RNA, 19 nt, artificial
  Oligomer
gaagaacuggagcugaggu

SEQ ID NO: 6871 - RNA, 19 nt, artificial
  Oligomer
ucugcucuuccacaccaga

SEQ ID NO: 6872 - RNA, 19 nt, artificial
  Oligomer
agaguuugaggaugaugcu

SEQ ID NO: 6873 - RNA, 19 nt, artificial
  Oligomer
cacaaugggcucuguuuuu

SEQ ID NO: 6874 - RNA, 19 nt, artificial
  Oligomer
gguuuuuggaauuaugucu

SEQ ID NO: 6875 - RNA, 19 nt, artificial
  Oligomer
ccugguguucaugucucau

SEQ ID NO: 6876 - RNA, 19 nt, artificial
  Oligomer
agguugacaucacaggcau

SEQ ID NO: 6877 - RNA, 19 nt, artificial
  Oligomer
uacuacaacucaaugcaau

SEQ ID NO: 6878 - RNA, 19 nt, artificial
  Oligomer
ugacaucacaggcaugaca

SEQ ID NO: 6879 - RNA, 19 nt, artificial
  Oligomer
aauaaggaaacuguaugaa

SEQ ID NO: 6880 - RNA, 19 nt, artificial
  Oligomer
cucaggcucagaagggaau

SEQ ID NO: 6881 - RNA, 19 nt, artificial
  Oligomer
caagguccugaaggagaag

SEQ ID NO: 6882 - RNA, 19 nt, artificial
  Oligomer
ugcucucauuaucugcaau

SEQ ID NO: 6883 - RNA, 19 nt, artificial
  Oligomer
aagcuuugcucccuagaag

SEQ ID NO: 6884 - RNA, 19 nt, artificial
  Oligomer
cuauuaagaaagcccacau

SEQ ID NO: 6885 - RNA, 19 nt, artificial
  Oligomer
aaugaagaauuugacagua

SEQ ID NO: 6886 - RNA, 19 nt, artificial
  Oligomer
gagcaagucccagauauac

SEQ ID NO: 6887 - RNA, 19 nt, artificial
  Oligomer
agaauuugacaguauuccu

SEQ ID NO: 6888 - RNA, 19 nt, artificial
  Oligomer
ggcuuacuggaugaauuau

SEQ ID NO: 6889 - RNA, 19 nt, artificial
  Oligomer
agagcacaagaccucugac

SEQ ID NO: 6890 - RNA, 19 nt, artificial
  Oligomer
aagacucauugaacauaug

SEQ ID NO: 6891 - RNA, 19 nt, artificial
  Oligomer
agguccugaaggagaagag

SEQ ID NO: 6892 - RNA, 19 nt, artificial
  Oligomer
ugauguggaggaaauuuuc

SEQ ID NO: 6893 - RNA, 19 nt, artificial
  Oligomer
aucgcuuucugcucuucca

SEQ ID NO: 6894 - RNA, 19 nt, artificial
  Oligomer
uuauuggaagacucauuga

SEQ ID NO: 6895 - RNA, 19 nt, artificial
  Oligomer
aaaugcuacaguuauggau

SEQ ID NO: 6896 - RNA, 19 nt, artificial
  Oligomer
aaagagugacuuugacaag

SEQ ID NO: 6897 - RNA, 19 nt, artificial
  Oligomer
gagguugacaucacaggca

SEQ ID NO: 6898 - RNA, 19 nt, artificial
  Oligomer
gucggcagagauuuaucca

SEQ ID NO: 6899 - RNA, 19 nt, artificial
  Oligomer
gcugaacaaggaagagaug

SEQ ID NO: 6900 - RNA, 19 nt, artificial
  Oligomer
gguauucgggaaggcauuu

SEQ ID NO: 6901 - RNA, 19 nt, artificial
  Oligomer
gcucaaaggauauggaaac

SEQ ID NO: 6902 - RNA, 19 nt, artificial
  Oligomer
acaaaagucggcagagauu

SEQ ID NO: 6903 - RNA, 19 nt, artificial
  Oligomer
aagggaaugucaagcuuug

SEQ ID NO: 6904 - RNA, 19 nt, artificial
  Oligomer
guaaagguuuuuggaauua

SEQ ID NO: 6905 - RNA, 19 nt, artificial
  Oligomer
gaaacuguaugaaugucug

SEQ ID NO: 6906 - RNA, 19 nt, artificial
  Oligomer
cauguugaauaccaagaac

SEQ ID NO: 6907 - RNA, 19 nt, artificial
  Oligomer
aaggagaagagaaagcugu

SEQ ID NO: 6908 - RNA, 19 nt, artificial
  Oligomer
aucuuuaacauguugaaua

SEQ ID NO: 6909 - RNA, 19 nt, artificial
  Oligomer
uaucuuuaccaacuacaga

SEQ ID NO: 6910 - RNA, 19 nt, artificial
  Oligomer
aaugggcucuguuuuuauu

SEQ ID NO: 6911 - RNA, 19 nt, artificial
  Oligomer
uaagaaagcccacauagag

SEQ ID NO: 6912 - RNA, 19 nt, artificial
  Oligomer
cuggagcugagguugacau

SEQ ID NO: 6913 - RNA, 19 nt, artificial
  Oligomer
ugggcaggaagugaagaga

SEQ ID NO: 6914 - RNA, 19 nt, artificial
  Oligomer
uguaaagguuuuuggaauu

SEQ ID NO: 6915 - RNA, 19 nt, artificial
  Oligomer
gacccgagcuuugauugac

SEQ ID NO: 6916 - RNA, 19 nt, artificial
  Oligomer
acuggagcugagguugaca

SEQ ID NO: 6917 - RNA, 19 nt, artificial
  Oligomer
uggaaaccuaucuuuacca

SEQ ID NO: 6918 - RNA, 19 nt, artificial
  Oligomer
ugugguuuaaagauucagu

SEQ ID NO: 6919 - RNA, 19 nt, artificial
  Oligomer
ggauauggaaacaaaaguc

SEQ ID NO: 6920 - RNA, 19 nt, artificial
  Oligomer
cauagagaaggauuuuauc

SEQ ID NO: 6921 - RNA, 19 nt, artificial
  Oligomer
uauuccuagaagaacugga

SEQ ID NO: 6922 - RNA, 19 nt, artificial
  Oligomer
cacauccucaggcucagaa

SEQ ID NO: 6923 - RNA, 19 nt, artificial
  Oligomer
acacucugagcaaguccca

SEQ ID NO: 6924 - RNA, 19 nt, artificial
  Oligomer
acucaaugcaaucuuuaac

SEQ ID NO: 6925 - RNA, 19 nt, artificial
  Oligomer
aaaaugcuacaguuaugga

SEQ ID NO: 6926 - RNA, 19 nt, artificial
  Oligomer
gaacaaggaagagauggag

SEQ ID NO: 6927 - RNA, 19 nt, artificial
  Oligomer
cccuagaagaagcucaaag

SEQ ID NO: 6928 - RNA, 19 nt, artificial
  Oligomer
uaaggaaacuguaugaaug

SEQ ID NO: 6929 - RNA, 19 nt, artificial
  Oligomer
gaguuugaggaugaugcua

SEQ ID NO: 6930 - RNA, 19 nt, artificial
  Oligomer
ucugugggcaggaagugaa

SEQ ID NO: 6931 - RNA, 19 nt, artificial
  Oligomer
ucauugaacauaugcaaga

SEQ ID NO: 6932 - RNA, 19 nt, artificial
  Oligomer
uaucugcaaugaagaauuu

SEQ ID NO: 6933 - RNA, 19 nt, artificial
  Oligomer
guuucuggaaaccuaucuu

SEQ ID NO: 6934 - RNA, 19 nt, artificial
  Oligomer
cagaagggaaugucaagcu

SEQ ID NO: 6935 - RNA, 19 nt, artificial
  Oligomer
augcuauuaagaaagccca

SEQ ID NO: 6936 - RNA, 19 nt, artificial
  Oligomer
cacugcuucggacaugacu

SEQ ID NO: 6937 - RNA, 19 nt, artificial
  Oligomer
uuugauugacuccguuauu

SEQ ID NO: 6938 - RNA, 19 nt, artificial
  Oligomer
cuugcucucauuaucugca

SEQ ID NO: 6939 - RNA, 19 nt, artificial
  Oligomer
gcuuacuggaugaauuauu

SEQ ID NO: 6940 - RNA, 19 nt, artificial
  Oligomer
caaugcaaucuuuaacaug

SEQ ID NO: 6941 - RNA, 19 nt, artificial
  Oligomer
gaaggugaucaucauccag

SEQ ID NO: 6942 - RNA, 19 nt, artificial
  Oligomer
uagaagaagcucaaaggau

SEQ ID NO: 6943 - RNA, 19 nt, artificial
  Oligomer
uccaugggugaagguacaa

SEQ ID NO: 6944 - RNA, 19 nt, artificial
  Oligomer
gaagaauuugacaguauuc

SEQ ID NO: 6945 - RNA, 19 nt, artificial
  Oligomer
guuccugugauguggagga

SEQ ID NO: 6946 - RNA, 19 nt, artificial
  Oligomer
gaggaaauuuuccgcaagg

SEQ ID NO: 6947 - RNA, 19 nt, artificial
  Oligomer
cccaccacugaaagaguga

SEQ ID NO: 6948 - RNA, 19 nt, artificial
  Oligomer
aacaaggaagagauggaga

SEQ ID NO: 6949 - RNA, 19 nt, artificial
  Oligomer
uacuggaugaauuauuaca

SEQ ID NO: 6950 - RNA, 19 nt, artificial
  Oligomer
ggcaggaagugaagagauc

SEQ ID NO: 6951 - RNA, 19 nt, artificial
  Oligomer
agcaagucccagauauacu

SEQ ID NO: 6952 - RNA, 19 nt, artificial
  Oligomer
ugacuuugacaagauguuu

SEQ ID NO: 6953 - RNA, 19 nt, artificial
  Oligomer
caugucucaugguauucgg

SEQ ID NO: 6954 - RNA, 19 nt, artificial
  Oligomer
ucuuuaacauguugaauac

SEQ ID NO: 6955 - RNA, 19 nt, artificial
  Oligomer
uagaagaacuggagcugag

SEQ ID NO: 6956 - RNA, 19 nt, artificial
  Oligomer
ucuggaaaccuaucuuuac

SEQ ID NO: 6957 - RNA, 19 nt, artificial
  Oligomer
aaaccuaucuuuaccaacu

SEQ ID NO: 6958 - RNA, 19 nt, artificial
  Oligomer
aaucuuuaacauguugaau

SEQ ID NO: 6959 - RNA, 19 nt, artificial
  Oligomer
gagaaagcuguuuauccgu

SEQ ID NO: 6960 - RNA, 19 nt, artificial
  Oligomer
uugaggaugaugcuauuaa

SEQ ID NO: 6961 - RNA, 19 nt, artificial
  Oligomer
cuacagaagaguuugagga

SEQ ID NO: 6962 - RNA, 19 nt, artificial
  Oligomer
aaaccgaaggugaucauca

SEQ ID NO: 6963 - RNA, 19 nt, artificial
  Oligomer
acagcacguuccugguguu

SEQ ID NO: 6964 - RNA, 19 nt, artificial
  Oligomer
cagauaauguuucuuggag

SEQ ID NO: 6965 - RNA, 19 nt, artificial
  Oligomer
gaauaugccuguuccugug

SEQ ID NO: 6966 - RNA, 19 nt, artificial
  Oligomer
gggaaugucaagcuuugcu

SEQ ID NO: 6967 - RNA, 19 nt, artificial
  Oligomer
aggugaucaucauccaggc

SEQ ID NO: 6968 - RNA, 19 nt, artificial
  Oligomer
acgucuugcucucauuauc

SEQ ID NO: 6969 - RNA, 19 nt, artificial
  Oligomer
aggaaauuuuccgcaaggu

SEQ ID NO: 6970 - RNA, 19 nt, artificial
  Oligomer
gauccuucuguaaagguuu

SEQ ID NO: 6971 - RNA, 19 nt, artificial
  Oligomer
ucacaggcaugacaaugcu

SEQ ID NO: 6972 - RNA, 19 nt, artificial
  Oligomer
ucaaaggauauggaaacaa

SEQ ID NO: 6973 - RNA, 19 nt, artificial
  Oligomer
caggcucagaagggaaugu

SEQ ID NO: 6974 - RNA, 19 nt, artificial
  Oligomer
ucugagcaagucccagaua

SEQ ID NO: 6975 - RNA, 19 nt, artificial
  Oligomer
acauuaaaauaaggaaacu

SEQ ID NO: 6976 - RNA, 19 nt, artificial
  Oligomer
gucugcugaauaauaaacu

SEQ ID NO: 6977 - RNA, 19 nt, artificial
  Oligomer
ugguguucaugucucaugg

SEQ ID NO: 6978 - RNA, 19 nt, artificial
  Oligomer
uuccugugauguggaggaa

SEQ ID NO: 6979 - RNA, 19 nt, artificial
  Oligomer
gugcugaacaaggaagaga

SEQ ID NO: 6980 - RNA, 19 nt, artificial
  Oligomer
ugaaggagaagagaaagcu

SEQ ID NO: 6981 - RNA, 19 nt, artificial
  Oligomer
uacagagcuggaggcauuu

SEQ ID NO: 6982 - RNA, 19 nt, artificial
  Oligomer
gggaagaaacacucugagc

SEQ ID NO: 6983 - RNA, 19 nt, artificial
  Oligomer
aagucccagauauacuaca

SEQ ID NO: 6984 - RNA, 19 nt, artificial
  Oligomer
ugcaggacaacccagcuau

SEQ ID NO: 6985 - RNA, 19 nt, artificial
  Oligomer
ugacaagauguuucuaccu

SEQ ID NO: 6986 - RNA, 19 nt, artificial
  Oligomer
uacagcguagaugugaaaa

SEQ ID NO: 6987 - RNA, 19 nt, artificial
  Oligomer
guucgauuuucauuugagc

SEQ ID NO: 6988 - RNA, 19 nt, artificial
  Oligomer
augaauuauuacagacaag

SEQ ID NO: 6989 - RNA, 19 nt, artificial
  Oligomer
cugcugaauaauaaacuuu

SEQ ID NO: 6990 - RNA, 19 nt, artificial
  Oligomer
gcuauuaagaaagcccaca

SEQ ID NO: 6991 - RNA, 19 nt, artificial
  Oligomer
agagaaagcuguuuauccg

SEQ ID NO: 6992 - RNA, 19 nt, artificial
  Oligomer
augaagaauuugacaguau

SEQ ID NO: 6993 - RNA, 19 nt, artificial
  Oligomer
agcacaagaccucugacag

SEQ ID NO: 6994 - RNA, 19 nt, artificial
  Oligomer
agaaacacucugagcaagu

SEQ ID NO: 6995 - RNA, 19 nt, artificial
  Oligomer
gaguuucuggaaaccuauc

SEQ ID NO: 6996 - RNA, 19 nt, artificial
  Oligomer
guaugaaugucugugggca

SEQ ID NO: 6997 - RNA, 19 nt, artificial
  Oligomer
agcuaugcccacauccuca

SEQ ID NO: 6998 - RNA, 19 nt, artificial
  Oligomer
agaugugaaaaaaaaucuc

SEQ ID NO: 6999 - RNA, 19 nt, artificial
  Oligomer
ucaagcuuugcucccuaga

SEQ ID NO: 7000 - RNA, 19 nt, artificial
  Oligomer
auggacaagucaagccgca

SEQ ID NO: 7001 - RNA, 19 nt, artificial
  Oligomer
gcucuguuuuuauuggaag

SEQ ID NO: 7002 - RNA, 19 nt, artificial
  Oligomer
guggaggaaauuuuccgca

SEQ ID NO: 7003 - RNA, 19 nt, artificial
  Oligomer
gagcugagguugacaucac

SEQ ID NO: 7004 - RNA, 19 nt, artificial
  Oligomer
agcccacauagagaaggau

SEQ ID NO: 7005 - RNA, 19 nt, artificial
  Oligomer
caaaagucggcagagauuu

SEQ ID NO: 7006 - RNA, 19 nt, artificial
  Oligomer
accagauaauguuucuugg

SEQ ID NO: 7007 - RNA, 19 nt, artificial
  Oligomer
gaacauaugcaagaauaug

SEQ ID NO: 7008 - RNA, 19 nt, artificial
  Oligomer
cccgagcuuugauugacuc

SEQ ID NO: 7009 - RNA, 19 nt, artificial
  Oligomer
uauacuacaacucaaugca

SEQ ID NO: 7010 - RNA, 19 nt, artificial
  Oligomer
cguuccugguguucauguc

SEQ ID NO: 7011 - RNA, 19 nt, artificial
  Oligomer
agguuuuuggaauuauguc

SEQ ID NO: 7012 - RNA, 19 nt, artificial
  Oligomer
uccaauaauggacaaguca

SEQ ID NO: 7013 - RNA, 19 nt, artificial
  Oligomer
gcccacauagagaaggauu

SEQ ID NO: 7014 - RNA, 19 nt, artificial
  Oligomer
ccaaauuugcaucacauac

SEQ ID NO: 7015 - RNA, 19 nt, artificial
  Oligomer
uuuuuuuucacaucuacgc

SEQ ID NO: 7016 - RNA, 19 nt, artificial
  Oligomer
uuuuuucacaucuacgcug

SEQ ID NO: 7017 - RNA, 19 nt, artificial
  Oligomer
auuuauuguaccuucaccc

SEQ ID NO: 7018 - RNA, 19 nt, artificial
  Oligomer
uuucuuaauagcaucaucc

SEQ ID NO: 7019 - RNA, 19 nt, artificial
  Oligomer
uuuuguagcagcauuguca

SEQ ID NO: 7020 - RNA, 19 nt, artificial
  Oligomer
uuuguuuccauauccuuug

SEQ ID NO: 7021 - RNA, 19 nt, artificial
  Oligomer
uuguucagcacccuugucu

SEQ ID NO: 7022 - RNA, 19 nt, artificial
  Oligomer
uuuuacuuucuccaucucu

SEQ ID NO: 7023 - RNA, 19 nt, artificial
  Oligomer
uuuuguuuccauauccuuu

SEQ ID NO: 7024 - RNA, 19 nt, artificial
  Oligomer
uucaacauguuaaagauug

SEQ ID NO: 7025 - RNA, 19 nt, artificial
  Oligomer
auuuuuuuucacaucuacg

SEQ ID NO: 7026 - RNA, 19 nt, artificial
  Oligomer
uucacguuuuacuuucucc

SEQ ID NO: 7027 - RNA, 19 nt, artificial
  Oligomer
uugaguuguaguauaucug

SEQ ID NO: 7028 - RNA, 19 nt, artificial
  Oligomer
uucacaucuacgcuguacc

SEQ ID NO: 7029 - RNA, 19 nt, artificial
  Oligomer
uuuacuuucuccaucucuu

SEQ ID NO: 7030 - RNA, 19 nt, artificial
  Oligomer
uggaugaugaucaccuucg

SEQ ID NO: 7031 - RNA, 19 nt, artificial
  Oligomer
ugaaaaucgaaccuugcgg

SEQ ID NO: 7032 - RNA, 19 nt, artificial
  Oligomer
uuucuucccacaaaugccu

SEQ ID NO: 7033 - RNA, 19 nt, artificial
  Oligomer
uuauucagcagacauaauu

SEQ ID NO: 7034 - RNA, 19 nt, artificial
  Oligomer
uuuuuuucacaucuacgcu

SEQ ID NO: 7035 - RNA, 19 nt, artificial
  Oligomer
uuuauuauucagcagacau

SEQ ID NO: 7036 - RNA, 19 nt, artificial
  Oligomer
uugcucagaguguuucuuc

SEQ ID NO: 7037 - RNA, 19 nt, artificial
  Oligomer
uccuuguucagcacccuug

SEQ ID NO: 7038 - RNA, 19 nt, artificial
  Oligomer
uugagcuucuucuagggag

SEQ ID NO: 7039 - RNA, 19 nt, artificial
  Oligomer
uuucacguuuuacuuucuc

SEQ ID NO: 7040 - RNA, 19 nt, artificial
  Oligomer
uugacauucccuucugagc

SEQ ID NO: 7041 - RNA, 19 nt, artificial
  Oligomer
uguagcagcauugucaugc

SEQ ID NO: 7042 - RNA, 19 nt, artificial
  Oligomer
uauuggauaaaucucugcc

SEQ ID NO: 7043 - RNA, 19 nt, artificial
  Oligomer
uuacuuucuccaucucuuc

SEQ ID NO: 7044 - RNA, 19 nt, artificial
  Oligomer
auuuucacguuuuacuuuc

SEQ ID NO: 7045 - RNA, 19 nt, artificial
  Oligomer
augaacaccaggaacgugc

SEQ ID NO: 7046 - RNA, 19 nt, artificial
  Oligomer
uuucucuucuccuucagga

SEQ ID NO: 7047 - RNA, 19 nt, artificial
  Oligomer
ugacauucccuucugagcc

SEQ ID NO: 7048 - RNA, 19 nt, artificial
  Oligomer
uacuuucuccaucucuucc

SEQ ID NO: 7049 - RNA, 19 nt, artificial
  Oligomer
uauccuuugagcuucuucu

SEQ ID NO: 7050 - RNA, 19 nt, artificial
  Oligomer
uucuccuucaggaccuugu

SEQ ID NO: 7051 - RNA, 19 nt, artificial
  Oligomer
uaacuguagcauuuucacg

SEQ ID NO: 7052 - RNA, 19 nt, artificial
  Oligomer
uuaaagauugcauugaguu

SEQ ID NO: 7053 - RNA, 19 nt, artificial
  Oligomer
uagguuuccagaaacuccu

SEQ ID NO: 7054 - RNA, 19 nt, artificial
  Oligomer
uucuucuaggaauacuguc

SEQ ID NO: 7055 - RNA, 19 nt, artificial
  Oligomer
auagguuuccagaaacucc

SEQ ID NO: 7056 - RNA, 19 nt, artificial
  Oligomer
uuaauguccugggaagagg

SEQ ID NO: 7057 - RNA, 19 nt, artificial
  Oligomer
uucuagggagcaaagcuug

SEQ ID NO: 7058 - RNA, 19 nt, artificial
  Oligomer
uugucuguaauaauucauc

SEQ ID NO: 7059 - RNA, 19 nt, artificial
  Oligomer
uuuccuuauuuuaaugucc

SEQ ID NO: 7060 - RNA, 19 nt, artificial
  Oligomer
uuucuccaucucuuccuug

SEQ ID NO: 7061 - RNA, 19 nt, artificial
  Oligomer
uauuguaccuucacccaug

SEQ ID NO: 7062 - RNA, 19 nt, artificial
  Oligomer
uucuugcauauguucaaug

SEQ ID NO: 7063 - RNA, 19 nt, artificial
  Oligomer
uucagcagacauaauucca

SEQ ID NO: 7064 - RNA, 19 nt, artificial
  Oligomer
ucuuccuuguucagcaccc

SEQ ID NO: 7065 - RNA, 19 nt, artificial
  Oligomer
aaaaaguuuauuauucagc

SEQ ID NO: 7066 - RNA, 19 nt, artificial
  Oligomer
uguuucuucccacaaaugc

SEQ ID NO: 7067 - RNA, 19 nt, artificial
  Oligomer
uauaucugggacuugcuca

SEQ ID NO: 7068 - RNA, 19 nt, artificial
  Oligomer
ugcaaaugccuccagcucu

SEQ ID NO: 7069 - RNA, 19 nt, artificial
  Oligomer
ucucuucuccuucaggacc

SEQ ID NO: 7070 - RNA, 19 nt, artificial
  Oligomer
uuauuauucagcagacaua

SEQ ID NO: 7071 - RNA, 19 nt, artificial
  Oligomer
uuccaauaaaaacagagcc

SEQ ID NO: 7072 - RNA, 19 nt, artificial
  Oligomer
uauucagcagacauaauuc

SEQ ID NO: 7073 - RNA, 19 nt, artificial
  Oligomer
uucuucauugcagauaaug

SEQ ID NO: 7074 - RNA, 19 nt, artificial
  Oligomer
augaaaaucgaaccuugcg

SEQ ID NO: 7075 - RNA, 19 nt, artificial
  Oligomer
uuuauuguaccuucaccca

SEQ ID NO: 7076 - RNA, 19 nt, artificial
  Oligomer
ucuguaauaauucauccag

SEQ ID NO: 7077 - RNA, 19 nt, artificial
  Oligomer
uuaucugguguggaagagc

SEQ ID NO: 7078 - RNA, 19 nt, artificial
  Oligomer
uuccuuguucagcacccuu

SEQ ID NO: 7079 - RNA, 19 nt, artificial
  Oligomer
uuauuggauaaaucucugc

SEQ ID NO: 7080 - RNA, 19 nt, artificial
  Oligomer
ucacguuuuacuuucucca

SEQ ID NO: 7081 - RNA, 19 nt, artificial
  Oligomer
uugucaaagucacucuuuc

SEQ ID NO: 7082 - RNA, 19 nt, artificial
  Oligomer
uuauuguaccuucacccau

SEQ ID NO: 7083 - RNA, 19 nt, artificial
  Oligomer
auauguucaaugagucuuc

SEQ ID NO: 7084 - RNA, 19 nt, artificial
  Oligomer
augaugaucaccuucgguu

SEQ ID NO: 7085 - RNA, 19 nt, artificial
  Oligomer
uuuuucacaucuacgcugu

SEQ ID NO: 7086 - RNA, 19 nt, artificial
  Oligomer
uaguauaucugggacuugc

SEQ ID NO: 7087 - RNA, 19 nt, artificial
  Oligomer
auaaacagcuuucucuucu

SEQ ID NO: 7088 - RNA, 19 nt, artificial
  Oligomer
uuccuuauuuuaauguccu

SEQ ID NO: 7089 - RNA, 19 nt, artificial
  Oligomer
uuuaauguccugggaagag

SEQ ID NO: 7090 - RNA, 19 nt, artificial
  Oligomer
ugugaugucaaccucagcu

SEQ ID NO: 7091 - RNA, 19 nt, artificial
  Oligomer
uccauauccuuugagcuuc

SEQ ID NO: 7092 - RNA, 19 nt, artificial
  Oligomer
uugguaaagauagguuucc

SEQ ID NO: 7093 - RNA, 19 nt, artificial
  Oligomer
uugacuuguccauuauugg

SEQ ID NO: 7094 - RNA, 19 nt, artificial
  Oligomer
uucccgaauaccaugagac

SEQ ID NO: 7095 - RNA, 19 nt, artificial
  Oligomer
uuucacaucuacgcuguac

SEQ ID NO: 7096 - RNA, 19 nt, artificial
  Oligomer
uaauaauucauccaguaag

SEQ ID NO: 7097 - RNA, 19 nt, artificial
  Oligomer
uugguauucaacauguuaa

SEQ ID NO: 7098 - RNA, 19 nt, artificial
  Oligomer
uucagcacccuugucugua

SEQ ID NO: 7099 - RNA, 19 nt, artificial
  Oligomer
auuauuggauaaaucucug

SEQ ID NO: 7100 - RNA, 19 nt, artificial
  Oligomer
aacuguagcauuuucacgu

SEQ ID NO: 7101 - RNA, 19 nt, artificial
  Oligomer
uuuccauauccuuugagcu

SEQ ID NO: 7102 - RNA, 19 nt, artificial
  Oligomer
auauccuuugagcuucuuc

SEQ ID NO: 7103 - RNA, 19 nt, artificial
  Oligomer
uccuacugaaucuuuaaac

SEQ ID NO: 7104 - RNA, 19 nt, artificial
  Oligomer
auuggauaaaucucugccg

SEQ ID NO: 7105 - RNA, 19 nt, artificial
  Oligomer
uugcauauguucaaugagu

SEQ ID NO: 7106 - RNA, 19 nt, artificial
  Oligomer
uucuucacaaauguaugug

SEQ ID NO: 7107 - RNA, 19 nt, artificial
  Oligomer
ugaaucuuuaaaccacacc

SEQ ID NO: 7108 - RNA, 19 nt, artificial
  Oligomer
uccaagaaacauuaucugg

SEQ ID NO: 7109 - RNA, 19 nt, artificial
  Oligomer
aucaccuucgguuuguccu

SEQ ID NO: 7110 - RNA, 19 nt, artificial
  Oligomer
ucagaguguuucuucccac

SEQ ID NO: 7111 - RNA, 19 nt, artificial
  Oligomer
ucuucuaggaauacuguca

SEQ ID NO: 7112 - RNA, 19 nt, artificial
  Oligomer
uucucuucuccuucaggac

SEQ ID NO: 7113 - RNA, 19 nt, artificial
  Oligomer
uaaagauugcauugaguug

SEQ ID NO: 7114 - RNA, 19 nt, artificial
  Oligomer
uucuucuagggagcaaagc

SEQ ID NO: 7115 - RNA, 19 nt, artificial
  Oligomer
uuccauauccuuugagcuu

SEQ ID NO: 7116 - RNA, 19 nt, artificial
  Oligomer
uuaaaccacaccacaccag

SEQ ID NO: 7117 - RNA, 19 nt, artificial
  Oligomer
aguucuucuaggaauacug

SEQ ID NO: 7118 - RNA, 19 nt, artificial
  Oligomer
aacagcuuucucuucuccu

SEQ ID NO: 7119 - RNA, 19 nt, artificial
  Oligomer
ucuguagucauguccgaag

SEQ ID NO: 7120 - RNA, 19 nt, artificial
  Oligomer
uucuugguauucaacaugu

SEQ ID NO: 7121 - RNA, 19 nt, artificial
  Oligomer
uucuucccacaaaugccuu

SEQ ID NO: 7122 - RNA, 19 nt, artificial
  Oligomer
ucuuuaaaccacaccacac

SEQ ID NO: 7123 - RNA, 19 nt, artificial
  Oligomer
uacugaaucuuuaaaccac

SEQ ID NO: 7124 - RNA, 19 nt, artificial
  Oligomer
ucuuccaauaaaaacagag

SEQ ID NO: 7125 - RNA, 19 nt, artificial
  Oligomer
uuuaaaccacaccacacca

SEQ ID NO: 7126 - RNA, 19 nt, artificial
  Oligomer
uccuuugagcuucuucuag

SEQ ID NO: 7127 - RNA, 19 nt, artificial
  Oligomer
auuuccuccacaucacagg

SEQ ID NO: 7128 - RNA, 19 nt, artificial
  Oligomer
aauacugucaaauucuuca

SEQ ID NO: 7129 - RNA, 19 nt, artificial
  Oligomer
aucuugucaaagucacucu

SEQ ID NO: 7130 - RNA, 19 nt, artificial
  Oligomer
uuuccagaaacuccuacug

SEQ ID NO: 7131 - RNA, 19 nt, artificial
  Oligomer
uguucagcacccuugucug

SEQ ID NO: 7132 - RNA, 19 nt, artificial
  Oligomer
ucuuaauagcaucauccuc

SEQ ID NO: 7133 - RNA, 19 nt, artificial
  Oligomer
auaaaaacagagcccauug

SEQ ID NO: 7134 - RNA, 19 nt, artificial
  Oligomer
uucauugcagauaaugaga

SEQ ID NO: 7135 - RNA, 19 nt, artificial
  Oligomer
ucagaggucuugugcucug

SEQ ID NO: 7136 - RNA, 19 nt, artificial
  Oligomer
auucagcagacauaauucc

SEQ ID NO: 7137 - RNA, 19 nt, artificial
  Oligomer
uccaauaaaaacagagccc

SEQ ID NO: 7138 - RNA, 19 nt, artificial
  Oligomer
uuauccauaacuguagcau

SEQ ID NO: 7139 - RNA, 19 nt, artificial
  Oligomer
uaaaccacaccacaccagg

SEQ ID NO: 7140 - RNA, 19 nt, artificial
  Oligomer
uacaguuuccuuauuuuaa

SEQ ID NO: 7141 - RNA, 19 nt, artificial
  Oligomer
auauucuugcauauguuca

SEQ ID NO: 7142 - RNA, 19 nt, artificial
  Oligomer
uagcauuuucacguuuuac

SEQ ID NO: 7143 - RNA, 19 nt, artificial
  Oligomer
cuuaauagcaucauccuca

SEQ ID NO: 7144 - RNA, 19 nt, artificial
  Oligomer
uucuccaucucuuccuugu

SEQ ID NO: 7145 - RNA, 19 nt, artificial
  Oligomer
ugcauauguucaaugaguc

SEQ ID NO: 7146 - RNA, 19 nt, artificial
  Oligomer
ugcucagaguguuucuucc

SEQ ID NO: 7147 - RNA, 19 nt, artificial
  Oligomer
uguucaaugagucuuccaa

SEQ ID NO: 7148 - RNA, 19 nt, artificial
  Oligomer
uuccugcccacagacauuc

SEQ ID NO: 7149 - RNA, 19 nt, artificial
  Oligomer
ugucuguaauaauucaucc

SEQ ID NO: 7150 - RNA, 19 nt, artificial
  Oligomer
uuguaguauaucugggacu

SEQ ID NO: 7151 - RNA, 19 nt, artificial
  Oligomer
uauuauucagcagacauaa

SEQ ID NO: 7152 - RNA, 19 nt, artificial
  Oligomer
ugucagaggucuugugcuc

SEQ ID NO: 7153 - RNA, 19 nt, artificial
  Oligomer
agcauuuucacguuuuacu

SEQ ID NO: 7154 - RNA, 19 nt, artificial
  Oligomer
ugaguuguaguauaucugg

SEQ ID NO: 7155 - RNA, 19 nt, artificial
  Oligomer
ucuucuagggagcaaagcu

SEQ ID NO: 7156 - RNA, 19 nt, artificial
  Oligomer
aauuuccuccacaucacag

SEQ ID NO: 7157 - RNA, 19 nt, artificial
  Oligomer
cuuauuuuaauguccuggg

SEQ ID NO: 7158 - RNA, 19 nt, artificial
  Oligomer
ucuccaagaaacauuaucu

SEQ ID NO: 7159 - RNA, 19 nt, artificial
  Oligomer
uugcggaaaauuuccucca

SEQ ID NO: 7160 - RNA, 19 nt, artificial
  Oligomer
cauaauuccaaaaaccuuu

SEQ ID NO: 7161 - RNA, 19 nt, artificial
  Oligomer
uguuaaagauugcauugag

SEQ ID NO: 7162 - RNA, 19 nt, artificial
  Oligomer
uucaaacuugggcaguucu

SEQ ID NO: 7163 - RNA, 19 nt, artificial
  Oligomer
auugaguuguaguauaucu

SEQ ID NO: 7164 - RNA, 19 nt, artificial
  Oligomer
uaguugguaaagauagguu

SEQ ID NO: 7165 - RNA, 19 nt, artificial
  Oligomer
aauaccaugagacaugaac

SEQ ID NO: 7166 - RNA, 19 nt, artificial
  Oligomer
caucuugucaaagucacuc

SEQ ID NO: 7167 - RNA, 19 nt, artificial
  Oligomer
ucauacaguuuccuuauuu

SEQ ID NO: 7168 - RNA, 19 nt, artificial
  Oligomer
ucuaugugggcuuucuuaa

SEQ ID NO: 7169 - RNA, 19 nt, artificial
  Oligomer
uucaaugagucuuccaaua

SEQ ID NO: 7170 - RNA, 19 nt, artificial
  Oligomer
auaacuguagcauuuucac

SEQ ID NO: 7171 - RNA, 19 nt, artificial
  Oligomer
auuuuguagcagcauuguc

SEQ ID NO: 7172 - RNA, 19 nt, artificial
  Oligomer
uccagcucuguagucaugu

SEQ ID NO: 7173 - RNA, 19 nt, artificial
  Oligomer
auguaugugaugcaaauuu

SEQ ID NO: 7174 - RNA, 19 nt, artificial
  Oligomer
aaugccuccagcucuguag

SEQ ID NO: 7175 - RNA, 19 nt, artificial
  Oligomer
aagagguagaaacaucuug

SEQ ID NO: 7176 - RNA, 19 nt, artificial
  Oligomer
uuacagaaggaucucuuca

SEQ ID NO: 7177 - RNA, 19 nt, artificial
  Oligomer
ucuugucaaagucacucuu

SEQ ID NO: 7178 - RNA, 19 nt, artificial
  Oligomer
ucaaacucuucuguaguug

SEQ ID NO: 7179 - RNA, 19 nt, artificial
  Oligomer
aucucuucacuuccugccc

SEQ ID NO: 7180 - RNA, 19 nt, artificial
  Oligomer
aaugccuucccgaauacca

SEQ ID NO: 7181 - RNA, 19 nt, artificial
  Oligomer
uaaacagcuuucucuucuc

SEQ ID NO: 7182 - RNA, 19 nt, artificial
  Oligomer
aauagcaucauccucaaac

SEQ ID NO: 7183 - RNA, 19 nt, artificial
  Oligomer
uuugagcuucuucuaggga

SEQ ID NO: 7184 - RNA, 19 nt, artificial
  Oligomer
uuuucacguuuuacuuucu

SEQ ID NO: 7185 - RNA, 19 nt, artificial
  Oligomer
aacauguuaaagauugcau

SEQ ID NO: 7186 - RNA, 19 nt, artificial
  Oligomer
uuuacagaaggaucucuuc

SEQ ID NO: 7187 - RNA, 19 nt, artificial
  Oligomer
ucaaagucacucuuucagu

SEQ ID NO: 7188 - RNA, 19 nt, artificial
  Oligomer
uaaaucucugccgacuuuu

SEQ ID NO: 7189 - RNA, 19 nt, artificial
  Oligomer
aucucuuccuuguucagca

SEQ ID NO: 7190 - RNA, 19 nt, artificial
  Oligomer
ugggaugucuccaagaaac

SEQ ID NO: 7191 - RNA, 19 nt, artificial
  Oligomer
ucaaagcucgggucuuauc

SEQ ID NO: 7192 - RNA, 19 nt, artificial
  Oligomer
auuccaaaaaccuuuacag

SEQ ID NO: 7193 - RNA, 19 nt, artificial
  Oligomer
ugccuucccgaauaccaug

SEQ ID NO: 7194 - RNA, 19 nt, artificial
  Oligomer
aaugagagcaagacgugug

SEQ ID NO: 7195 - RNA, 19 nt, artificial
  Oligomer
uaucugguguggaagagca

SEQ ID NO: 7196 - RNA, 19 nt, artificial
  Oligomer
uuuguagcagcauugucau

SEQ ID NO: 7197 - RNA, 19 nt, artificial
  Oligomer
uugugggaugucuccaaga

SEQ ID NO: 7198 - RNA, 19 nt, artificial
  Oligomer
ugagucuuccaauaaaaac

SEQ ID NO: 7199 - RNA, 19 nt, artificial
  Oligomer
uucccacaaaugccuuccc

SEQ ID NO: 7200 - RNA, 19 nt, artificial
  Oligomer
ucaaccucagcuccaguuc

SEQ ID NO: 7201 - RNA, 19 nt, artificial
  Oligomer
ccuuauuuuaauguccugg

SEQ ID NO: 7202 - RNA, 19 nt, artificial
  Oligomer
agcagcauugucaugccug

SEQ ID NO: 7203 - RNA, 19 nt, artificial
  Oligomer
agcucuguagucauguccg

SEQ ID NO: 7204 - RNA, 19 nt, artificial
  Oligomer
guuucuucccacaaaugcc

SEQ ID NO: 7205 - RNA, 19 nt, artificial
  Oligomer
ucuucccacaaaugccuuc

SEQ ID NO: 7206 - RNA, 19 nt, artificial
  Oligomer
acuuucuccaucucuuccu

SEQ ID NO: 7207 - RNA, 19 nt, artificial
  Oligomer
uauuuuaauguccugggaa

SEQ ID NO: 7208 - RNA, 19 nt, artificial
  Oligomer
aggaacaggcauauucuug

SEQ ID NO: 7209 - RNA, 19 nt, artificial
  Oligomer
uaggaauacugucaaauuc

SEQ ID NO: 7210 - RNA, 19 nt, artificial
  Oligomer
uauguucaaugagucuucc

SEQ ID NO: 7211 - RNA, 19 nt, artificial
  Oligomer
ucuucuucacaaauguaug

SEQ ID NO: 7212 - RNA, 19 nt, artificial
  Oligomer
ucuucauugcagauaauga

SEQ ID NO: 7213 - RNA, 19 nt, artificial
  Oligomer
uucucuaugugggcuuucu

SEQ ID NO: 7214 - RNA, 19 nt, artificial
  Oligomer
uguaugugaugcaaauuug

SEQ ID NO: 7215 - RNA, 19 nt, artificial
  Oligomer
auugugggaugucuccaag

SEQ ID NO: 7216 - RNA, 19 nt, artificial
  Oligomer
uucacaaauguaugugaug

SEQ ID NO: 7217 - RNA, 19 nt, artificial
  Oligomer
aaacagagcccauuguggg

SEQ ID NO: 7218 - RNA, 19 nt, artificial
  Oligomer
ucucuaugugggcuuucuu

SEQ ID NO: 7219 - RNA, 19 nt, artificial
  Oligomer
uugucaugccugugauguc

SEQ ID NO: 7220 - RNA, 19 nt, artificial
  Oligomer
cuugcggaaaauuuccucc

SEQ ID NO: 7221 - RNA, 19 nt, artificial
  Oligomer
acggagucaaucaaagcuc

SEQ ID NO: 7222 - RNA, 19 nt, artificial
  Oligomer
ucaaucaaagcucgggucu

SEQ ID NO: 7223 - RNA, 19 nt, artificial
  Oligomer
auaucugggacuugcucag

SEQ ID NO: 7224 - RNA, 19 nt, artificial
  Oligomer
uuuuaauguccugggaaga

SEQ ID NO: 7225 - RNA, 19 nt, artificial
  Oligomer
uucuuaauagcaucauccu

SEQ ID NO: 7226 - RNA, 19 nt, artificial
  Oligomer
uugcauugaguuguaguau

SEQ ID NO: 7227 - RNA, 19 nt, artificial
  Oligomer
cagcuuucucuucuccuuc

SEQ ID NO: 7228 - RNA, 19 nt, artificial
  Oligomer
caaagcucgggucuuaucc

SEQ ID NO: 7229 - RNA, 19 nt, artificial
  Oligomer
aaaugaaaaucgaaccuug

SEQ ID NO: 7230 - RNA, 19 nt, artificial
  Oligomer
uuggauaaaucucugccga

SEQ ID NO: 7231 - RNA, 19 nt, artificial
  Oligomer
uguaccuucacccauggaa

SEQ ID NO: 7232 - RNA, 19 nt, artificial
  Oligomer
acguuuuacuuucuccauc

SEQ ID NO: 7233 - RNA, 19 nt, artificial
  Oligomer
acauaauuccaaaaaccuu

SEQ ID NO: 7234 - RNA, 19 nt, artificial
  Oligomer
cuuuaaaccacaccacacc

SEQ ID NO: 7235 - RNA, 19 nt, artificial
  Oligomer
ugagauuuuuuuucacauc

SEQ ID NO: 7236 - RNA, 19 nt, artificial
  Oligomer
agucaaucaaagcucgggu

SEQ ID NO: 7237 - RNA, 19 nt, artificial
  Oligomer
ucagcagacauaauuccaa

SEQ ID NO: 7238 - RNA, 19 nt, artificial
  Oligomer
uccaucucuuccuuguuca

SEQ ID NO: 7239 - RNA, 19 nt, artificial
  Oligomer
ucacaaauguaugugaugc

SEQ ID NO: 7240 - RNA, 19 nt, artificial
  Oligomer
cuugacuuguccauuauug

SEQ ID NO: 7241 - RNA, 19 nt, artificial
  Oligomer
uguagcauuuucacguuuu

SEQ ID NO: 7242 - RNA, 19 nt, artificial
  Oligomer
uccuuauuuuaauguccug

SEQ ID NO: 7243 - RNA, 19 nt, artificial
  Oligomer
ugcugucagaggucuugug

SEQ ID NO: 7244 - RNA, 19 nt, artificial
  Oligomer
uacagaaggaucucuucac

SEQ ID NO: 7245 - RNA, 19 nt, artificial
  Oligomer
ucaaauucuucauugcaga

SEQ ID NO: 7246 - RNA, 19 nt, artificial
  Oligomer
ucacaucuacgcuguaccc

SEQ ID NO: 7247 - RNA, 19 nt, artificial
  Oligomer
aaccuugcggaaaauuucc

SEQ ID NO: 7248 - RNA, 19 nt, artificial
  Oligomer
uccacaucacaggaacagg

SEQ ID NO: 7249 - RNA, 19 nt, artificial
  Oligomer
auugucaugccugugaugu

SEQ ID NO: 7250 - RNA, 19 nt, artificial
  Oligomer
ucuccuucaggaccuuguc

SEQ ID NO: 7251 - RNA, 19 nt, artificial
  Oligomer
gucaaagucacucuuucag

SEQ ID NO: 7252 - RNA, 19 nt, artificial
  Oligomer
uucggaauaacggagucaa

SEQ ID NO: 7253 - RNA, 19 nt, artificial
  Oligomer
ugugcaaaugccuccagcu

SEQ ID NO: 7254 - RNA, 19 nt, artificial
  Oligomer
aucuuuaaaccacaccaca

SEQ ID NO: 7255 - RNA, 19 nt, artificial
  Oligomer
auuuuaauguccugggaag

SEQ ID NO: 7256 - RNA, 19 nt, artificial
  Oligomer
uccauuauuggauaaaucu

SEQ ID NO: 7257 - RNA, 19 nt, artificial
  Oligomer
ucuaggaauacugucaaau

SEQ ID NO: 7258 - RNA, 19 nt, artificial
  Oligomer
ucuuauccauaacuguagc

SEQ ID NO: 7259 - RNA, 19 nt, artificial
  Oligomer
ugaugucaaccucagcucc

SEQ ID NO: 7260 - RNA, 19 nt, artificial
  Oligomer
aaaaguuuauuauucagca

SEQ ID NO: 7261 - RNA, 19 nt, artificial
  Oligomer
cuugacauucccuucugag

SEQ ID NO: 7262 - RNA, 19 nt, artificial
  Oligomer
uuucaguggugggcaucug

SEQ ID NO: 7263 - RNA, 19 nt, artificial
  Oligomer
ucauccucaaacucuucug

SEQ ID NO: 7264 - RNA, 19 nt, artificial
  Oligomer
uagaaacaucuugucaaag

SEQ ID NO: 7265 - RNA, 19 nt, artificial
  Oligomer
agauaaugagagcaagacg

SEQ ID NO: 7266 - RNA, 19 nt, artificial
  Oligomer
auaacggagucaaucaaag

SEQ ID NO: 7267 - RNA, 19 nt, artificial
  Oligomer
uuucggaauaacggaguca

SEQ ID NO: 7268 - RNA, 19 nt, artificial
  Oligomer
aacaucuugucaaagucac

SEQ ID NO: 7269 - RNA, 19 nt, artificial
  Oligomer
aaagauugcauugaguugu

SEQ ID NO: 7270 - RNA, 19 nt, artificial
  Oligomer
ucauugcagauaaugagag

SEQ ID NO: 7271 - RNA, 19 nt, artificial
  Oligomer
augagagcaagacgugugc

SEQ ID NO: 7272 - RNA, 19 nt, artificial
  Oligomer
aaugaaaaucgaaccuugc

SEQ ID NO: 7273 - RNA, 19 nt, artificial
  Oligomer
aucauccucaaacucuucu

SEQ ID NO: 7274 - RNA, 19 nt, artificial
  Oligomer
aaguuuauuauucagcaga

SEQ ID NO: 7275 - RNA, 19 nt, artificial
  Oligomer
uguggaagagcagaaagcg

SEQ ID NO: 7276 - RNA, 19 nt, artificial
  Oligomer
auaauuccaaaaaccuuua

SEQ ID NO: 7277 - RNA, 19 nt, artificial
  Oligomer
ucaaaugaaaaucgaaccu

SEQ ID NO: 7278 - RNA, 19 nt, artificial
  Oligomer
uuguagcagcauugucaug

SEQ ID NO: 7279 - RNA, 19 nt, artificial
  Oligomer
uuauuuuaauguccuggga

SEQ ID NO: 7280 - RNA, 19 nt, artificial
  Oligomer
aucugcgcucuaccaucug

SEQ ID NO: 7281 - RNA, 19 nt, artificial
  Oligomer
agauuuuguagcagcauug

SEQ ID NO: 7282 - RNA, 19 nt, artificial
  Oligomer
uugcagauaaugagagcaa

SEQ ID NO: 7283 - RNA, 19 nt, artificial
  Oligomer
aucugggacuugcucagag

SEQ ID NO: 7284 - RNA, 19 nt, artificial
  Oligomer
cucaaaugaaaaucgaacc

SEQ ID NO: 7285 - RNA, 19 nt, artificial
  Oligomer
uguaguugguaaagauagg

SEQ ID NO: 7286 - RNA, 19 nt, artificial
  Oligomer
auaccaugagacaugaaca

SEQ ID NO: 7287 - RNA, 19 nt, artificial
  Oligomer
ugucaaauucuucauugca

SEQ ID NO: 7288 - RNA, 19 nt, artificial
  Oligomer
agaaacauuaucuggugug

SEQ ID NO: 7289 - RNA, 19 nt, artificial
  Oligomer
uaccaugagacaugaacac

SEQ ID NO: 7290 - RNA, 19 nt, artificial
  Oligomer
cuuucucuucuccuucagg

SEQ ID NO: 7291 - RNA, 19 nt, artificial
  Oligomer
ucucugccgacuuuuguuu

SEQ ID NO: 7292 - RNA, 19 nt, artificial
  Oligomer
uuccaaaaaccuuuacaga

SEQ ID NO: 7293 - RNA, 19 nt, artificial
  Oligomer
gucaaauucuucauugcag

SEQ ID NO: 7294 - RNA, 19 nt, artificial
  Oligomer
ucugccgacuuuuguuucc

SEQ ID NO: 7295 - RNA, 19 nt, artificial
  Oligomer
uuccagaaacuccuacuga

SEQ ID NO: 7296 - RNA, 19 nt, artificial
  Oligomer
aaacagcuuucucuucucc

SEQ ID NO: 7297 - RNA, 19 nt, artificial
  Oligomer
gucuuauccauaacuguag

SEQ ID NO: 7298 - RNA, 19 nt, artificial
  Oligomer
ugagacaugaacaccagga

SEQ ID NO: 7299 - RNA, 19 nt, artificial
  Oligomer
uguuuccauauccuuugag

SEQ ID NO: 7300 - RNA, 19 nt, artificial
  Oligomer
auggaacggauaaacagcu

SEQ ID NO: 7301 - RNA, 19 nt, artificial
  Oligomer
cuguaguugguaaagauag

SEQ ID NO: 7302 - RNA, 19 nt, artificial
  Oligomer
ucgggucuuauccauaacu

SEQ ID NO: 7303 - RNA, 19 nt, artificial
  Oligomer
uccuucucuaugugggcuu

SEQ ID NO: 7304 - RNA, 19 nt, artificial
  Oligomer
auaaugagagcaagacgug

SEQ ID NO: 7305 - RNA, 19 nt, artificial
  Oligomer
aaaauccuucucuaugugg

SEQ ID NO: 7306 - RNA, 19 nt, artificial
  Oligomer
uaugugggcuuucuuaaua

SEQ ID NO: 7307 - RNA, 19 nt, artificial
  Oligomer
acugucaaauucuucauug

SEQ ID NO: 7308 - RNA, 19 nt, artificial
  Oligomer
uaacggagucaaucaaagc

SEQ ID NO: 7309 - RNA, 19 nt, artificial
  Oligomer
auacaguuuccuuauuuua

SEQ ID NO: 7310 - RNA, 19 nt, artificial
  Oligomer
ugucaaagucacucuuuca

SEQ ID NO: 7311 - RNA, 19 nt, artificial
  Oligomer
uagggagcaaagcuugaca

SEQ ID NO: 7312 - RNA, 19 nt, artificial
  Oligomer
ucuuucaguggugggcauc

SEQ ID NO: 7313 - RNA, 19 nt, artificial
  Oligomer
aaaacagagcccauugugg

SEQ ID NO: 7314 - RNA, 19 nt, artificial
  Oligomer
uaccuucacccauggaacg

SEQ ID NO: 7315 - RNA, 19 nt, artificial
  Oligomer
auguuaaagauugcauuga

SEQ ID NO: 7316 - RNA, 19 nt, artificial
  Oligomer
uaaugagagcaagacgugu

SEQ ID NO: 7317 - RNA, 19 nt, artificial
  Oligomer
acuuuuguuuccauauccu

SEQ ID NO: 7318 - RNA, 19 nt, artificial
  Oligomer
cauuuauuguaccuucacc

SEQ ID NO: 7319 - RNA, 19 nt, artificial
  Oligomer
aucaaagcucgggucuuau

SEQ ID NO: 7320 - RNA, 19 nt, artificial
  Oligomer
acugucuucuucacaaaug

SEQ ID NO: 7321 - RNA, 19 nt, artificial
  Oligomer
ucaaacuugggcaguucuu

SEQ ID NO: 7322 - RNA, 19 nt, artificial
  Oligomer
auucauacaguuuccuuau

SEQ ID NO: 7323 - RNA, 19 nt, artificial
  Oligomer
ucaacauguuaaagauugc

SEQ ID NO: 7324 - RNA, 19 nt, artificial
  Oligomer
aacggagucaaucaaagcu

SEQ ID NO: 7325 - RNA, 19 nt, artificial
  Oligomer
cuuuacagaaggaucucuu

SEQ ID NO: 7326 - RNA, 19 nt, artificial
  Oligomer
augccuucccgaauaccau

SEQ ID NO: 7327 - RNA, 19 nt, artificial
  Oligomer
agcagugagauuuuuuuuc

SEQ ID NO: 7328 - RNA, 19 nt, artificial
  Oligomer
auuaucugguguggaagag

SEQ ID NO: 7329 - RNA, 19 nt, artificial
  Oligomer
uaauguccugggaagaggu

SEQ ID NO: 7330 - RNA, 19 nt, artificial
  Oligomer
uauccauaacuguagcauu

SEQ ID NO: 7331 - RNA, 19 nt, artificial
  Oligomer
aaauccuucucuauguggg

SEQ ID NO: 7332 - RNA, 19 nt, artificial
  Oligomer
auuguaccuucacccaugg

SEQ ID NO: 7333 - RNA, 19 nt, artificial
  Oligomer
accaugagacaugaacacc

SEQ ID NO: 7334 - RNA, 19 nt, artificial
  Oligomer
ucaccuucgguuuguccuu

SEQ ID NO: 7335 - RNA, 19 nt, artificial
  Oligomer
aaucuuuaaaccacaccac

SEQ ID NO: 7336 - RNA, 19 nt, artificial
  Oligomer
aaacuugggcaguucuugg

SEQ ID NO: 7337 - RNA, 19 nt, artificial
  Oligomer
cucagaguguuucuuccca

SEQ ID NO: 7338 - RNA, 19 nt, artificial
  Oligomer
ccuuugagcuucuucuagg

SEQ ID NO: 7339 - RNA, 19 nt, artificial
  Oligomer
acauucauacaguuuccuu

SEQ ID NO: 7340 - RNA, 19 nt, artificial
  Oligomer
aaagcuugacauucccuuc

SEQ ID NO: 7341 - RNA, 19 nt, artificial
  Oligomer
acauguuaaagauugcauu

SEQ ID NO: 7342 - RNA, 19 nt, artificial
  Oligomer
uauucuugcauauguucaa

SEQ ID NO: 7343 - RNA, 19 nt, artificial
  Oligomer
uaaagauagguuuccagaa

SEQ ID NO: 7344 - RNA, 19 nt, artificial
  Oligomer
ucagcuccaguucuucuag

SEQ ID NO: 7345 - RNA, 19 nt, artificial
  Oligomer
ucauguccgaagcagugag

SEQ ID NO: 7346 - RNA, 19 nt, artificial
  Oligomer
uccaaaaaccuuuacagaa

SEQ ID NO: 7347 - RNA, 19 nt, artificial
  Oligomer
aaagucacucuuucagugg

SEQ ID NO: 7348 - RNA, 19 nt, artificial
  Oligomer
aaaauuuccuccacaucac

SEQ ID NO: 7349 - RNA, 19 nt, artificial
  Oligomer
uagucauguccgaagcagu

SEQ ID NO: 7350 - RNA, 19 nt, artificial
  Oligomer
ugagcuucuucuagggagc

SEQ ID NO: 7351 - RNA, 19 nt, artificial
  Oligomer
cauuauuggauaaaucucu

SEQ ID NO: 7352 - RNA, 19 nt, artificial
  Oligomer
aucucugccgacuuuuguu

SEQ ID NO: 7353 - RNA, 19 nt, artificial
  Oligomer
auguucaaugagucuucca

SEQ ID NO: 7354 - RNA, 19 nt, artificial
  Oligomer
cuucccacaaaugccuucc

SEQ ID NO: 7355 - RNA, 19 nt, artificial
  Oligomer
cagcucuguagucaugucc

SEQ ID NO: 7356 - RNA, 19 nt, artificial
  Oligomer
cauaacuguagcauuuuca

SEQ ID NO: 7357 - RNA, 19 nt, artificial
  Oligomer
acauuaucugguguggaag

SEQ ID NO: 7358 - RNA, 19 nt, artificial
  Oligomer
uuuccuccacaucacagga

SEQ ID NO: 7359 - RNA, 19 nt, artificial
  Oligomer
aagcuugacauucccuucu

SEQ ID NO: 7360 - RNA, 19 nt, artificial
  Oligomer
auaaaauccuucucuaugu

SEQ ID NO: 7361 - RNA, 19 nt, artificial
  Oligomer
uaaaauccuucucuaugug

SEQ ID NO: 7362 - RNA, 19 nt, artificial
  Oligomer
auguccugggaagagguag

SEQ ID NO: 7363 - RNA, 19 nt, artificial
  Oligomer
uucuguaguugguaaagau

SEQ ID NO: 7364 - RNA, 19 nt, artificial
  Oligomer
cucuuccuuguucagcacc

SEQ ID NO: 7365 - RNA, 19 nt, artificial
  Oligomer
cuucauugcagauaaugag

SEQ ID NO: 7366 - RNA, 19 nt, artificial
  Oligomer
agagguagaaacaucuugu

SEQ ID NO: 7367 - RNA, 19 nt, artificial
  Oligomer
aucugguguggaagagcag

SEQ ID NO: 7368 - RNA, 19 nt, artificial
  Oligomer
cuuuuguuuccauauccuu

SEQ ID NO: 7369 - RNA, 19 nt, artificial
  Oligomer
ucuucuguaguugguaaag

SEQ ID NO: 7370 - RNA, 19 nt, artificial
  Oligomer
accucagcuccaguucuuc

SEQ ID NO: 7371 - RNA, 19 nt, artificial
  Oligomer
ucugguguggaagagcaga

SEQ ID NO: 7372 - RNA, 19 nt, artificial
  Oligomer
agcaucauccucaaacucu

SEQ ID NO: 7373 - RNA, 19 nt, artificial
  Oligomer
aaaaacagagcccauugug

SEQ ID NO: 7374 - RNA, 19 nt, artificial
  Oligomer
agacauaauuccaaaaacc

SEQ ID NO: 7375 - RNA, 19 nt, artificial
  Oligomer
augagacaugaacaccagg

SEQ ID NO: 7376 - RNA, 19 nt, artificial
  Oligomer
augccugugaugucaaccu

SEQ ID NO: 7377 - RNA, 19 nt, artificial
  Oligomer
auugcauugaguuguagua

SEQ ID NO: 7378 - RNA, 19 nt, artificial
  Oligomer
ugucaugccugugauguca

SEQ ID NO: 7379 - RNA, 19 nt, artificial
  Oligomer
uucauacaguuuccuuauu

SEQ ID NO: 7380 - RNA, 19 nt, artificial
  Oligomer
auucccuucugagccugag

SEQ ID NO: 7381 - RNA, 19 nt, artificial
  Oligomer
cuucuccuucaggaccuug

SEQ ID NO: 7382 - RNA, 19 nt, artificial
  Oligomer
auugcagauaaugagagca

SEQ ID NO: 7383 - RNA, 19 nt, artificial
  Oligomer
cuucuagggagcaaagcuu

SEQ ID NO: 7384 - RNA, 19 nt, artificial
  Oligomer
augugggcuuucuuaauag

SEQ ID NO: 7385 - RNA, 19 nt, artificial
  Oligomer
uacugucaaauucuucauu

SEQ ID NO: 7386 - RNA, 19 nt, artificial
  Oligomer
guauaucugggacuugcuc

SEQ ID NO: 7387 - RNA, 19 nt, artificial
  Oligomer
aggaauacugucaaauucu

SEQ ID NO: 7388 - RNA, 19 nt, artificial
  Oligomer
auaauucauccaguaagcc

SEQ ID NO: 7389 - RNA, 19 nt, artificial
  Oligomer
gucagaggucuugugcucu

SEQ ID NO: 7390 - RNA, 19 nt, artificial
  Oligomer
cauauguucaaugagucuu

SEQ ID NO: 7391 - RNA, 19 nt, artificial
  Oligomer
cucuucuccuucaggaccu

SEQ ID NO: 7392 - RNA, 19 nt, artificial
  Oligomer
gaaaauuuccuccacauca

SEQ ID NO: 7393 - RNA, 19 nt, artificial
  Oligomer
uggaagagcagaaagcgau

SEQ ID NO: 7394 - RNA, 19 nt, artificial
  Oligomer
ucaaugagucuuccaauaa

SEQ ID NO: 7395 - RNA, 19 nt, artificial
  Oligomer
auccauaacuguagcauuu

SEQ ID NO: 7396 - RNA, 19 nt, artificial
  Oligomer
cuugucaaagucacucuuu

SEQ ID NO: 7397 - RNA, 19 nt, artificial
  Oligomer
ugccugugaugucaaccuc

SEQ ID NO: 7398 - RNA, 19 nt, artificial
  Oligomer
uggauaaaucucugccgac

SEQ ID NO: 7399 - RNA, 19 nt, artificial
  Oligomer
caucucuuccuuguucagc

SEQ ID NO: 7400 - RNA, 19 nt, artificial
  Oligomer
aaaugccuucccgaauacc

SEQ ID NO: 7401 - RNA, 19 nt, artificial
  Oligomer
guuuccauauccuuugagc

SEQ ID NO: 7402 - RNA, 19 nt, artificial
  Oligomer
aaucucugccgacuuuugu

SEQ ID NO: 7403 - RNA, 19 nt, artificial
  Oligomer
caaagcuugacauucccuu

SEQ ID NO: 7404 - RNA, 19 nt, artificial
  Oligomer
uaauuccaaaaaccuuuac

SEQ ID NO: 7405 - RNA, 19 nt, artificial
  Oligomer
cagacauucauacaguuuc

SEQ ID NO: 7406 - RNA, 19 nt, artificial
  Oligomer
guucuugguauucaacaug

SEQ ID NO: 7407 - RNA, 19 nt, artificial
  Oligomer
acagcuuucucuucuccuu

SEQ ID NO: 7408 - RNA, 19 nt, artificial
  Oligomer
uauucaacauguuaaagau

SEQ ID NO: 7409 - RNA, 19 nt, artificial
  Oligomer
ucuguaguugguaaagaua

SEQ ID NO: 7410 - RNA, 19 nt, artificial
  Oligomer
aauaaaaacagagcccauu

SEQ ID NO: 7411 - RNA, 19 nt, artificial
  Oligomer
cucuaugugggcuuucuua

SEQ ID NO: 7412 - RNA, 19 nt, artificial
  Oligomer
augucaaccucagcuccag

SEQ ID NO: 7413 - RNA, 19 nt, artificial
  Oligomer
ucucuucacuuccugccca

SEQ ID NO: 7414 - RNA, 19 nt, artificial
  Oligomer
aauuccaaaaaccuuuaca

SEQ ID NO: 7415 - RNA, 19 nt, artificial
  Oligomer
gucaaucaaagcucggguc

SEQ ID NO: 7416 - RNA, 19 nt, artificial
  Oligomer
ugucaaccucagcuccagu

SEQ ID NO: 7417 - RNA, 19 nt, artificial
  Oligomer
ugguaaagauagguuucca

SEQ ID NO: 7418 - RNA, 19 nt, artificial
  Oligomer
acugaaucuuuaaaccaca

SEQ ID NO: 7419 - RNA, 19 nt, artificial
  Oligomer
gacuuuuguuuccauaucc

SEQ ID NO: 7420 - RNA, 19 nt, artificial
  Oligomer
gauaaaauccuucucuaug

SEQ ID NO: 7421 - RNA, 19 nt, artificial
  Oligomer
uccaguucuucuaggaaua

SEQ ID NO: 7422 - RNA, 19 nt, artificial
  Oligomer
uucugagccugaggaugug

SEQ ID NO: 7423 - RNA, 19 nt, artificial
  Oligomer
ugggacuugcucagagugu

SEQ ID NO: 7424 - RNA, 19 nt, artificial
  Oligomer
guuaaagauugcauugagu

SEQ ID NO: 7425 - RNA, 19 nt, artificial
  Oligomer
uccauaacuguagcauuuu

SEQ ID NO: 7426 - RNA, 19 nt, artificial
  Oligomer
cuccaucucuuccuuguuc

SEQ ID NO: 7427 - RNA, 19 nt, artificial
  Oligomer
cuuugagcuucuucuaggg

SEQ ID NO: 7428 - RNA, 19 nt, artificial
  Oligomer
cauucauacaguuuccuua

SEQ ID NO: 7429 - RNA, 19 nt, artificial
  Oligomer
uagcaucauccucaaacuc

SEQ ID NO: 7430 - RNA, 19 nt, artificial
  Oligomer
uucacuuccugcccacaga

SEQ ID NO: 7431 - RNA, 19 nt, artificial
  Oligomer
ucuugcauauguucaauga

SEQ ID NO: 7432 - RNA, 19 nt, artificial
  Oligomer
aaauucuucauugcagaua

SEQ ID NO: 7433 - RNA, 19 nt, artificial
  Oligomer
aagauagguuuccagaaac

SEQ ID NO: 7434 - RNA, 19 nt, artificial
  Oligomer
agcuugacauucccuucug

SEQ ID NO: 7435 - RNA, 19 nt, artificial
  Oligomer
ugggcuuucuuaauagcau

SEQ ID NO: 7436 - RNA, 19 nt, artificial
  Oligomer
agucauguccgaagcagug

SEQ ID NO: 7437 - RNA, 19 nt, artificial
  Oligomer
aauaacggagucaaucaaa

SEQ ID NO: 7438 - RNA, 19 nt, artificial
  Oligomer
ugcagauaaugagagcaag

SEQ ID NO: 7439 - RNA, 19 nt, artificial
  Oligomer
aauaauucauccaguaagc

SEQ ID NO: 7440 - RNA, 19 nt, artificial
  Oligomer
cauguuaaagauugcauug

SEQ ID NO: 7441 - RNA, 19 nt, artificial
  Oligomer
cuggaugaugaucaccuuc

SEQ ID NO: 7442 - RNA, 19 nt, artificial
  Oligomer
auccuuugagcuucuucua

SEQ ID NO: 7443 - RNA, 19 nt, artificial
  Oligomer
uuguaccuucacccaugga

SEQ ID NO: 7444 - RNA, 19 nt, artificial
  Oligomer
gaauacugucaaauucuuc

SEQ ID NO: 7445 - RNA, 19 nt, artificial
  Oligomer
uccuccacaucacaggaac

SEQ ID NO: 7446 - RNA, 19 nt, artificial
  Oligomer
ccuugcggaaaauuuccuc

SEQ ID NO: 7447 - RNA, 19 nt, artificial
  Oligomer
ucacucuuucagugguggg

SEQ ID NO: 7448 - RNA, 19 nt, artificial
  Oligomer
ucuccaucucuuccuuguu

SEQ ID NO: 7449 - RNA, 19 nt, artificial
  Oligomer
uguaauaauucauccagua

SEQ ID NO: 7450 - RNA, 19 nt, artificial
  Oligomer
gaucucuucacuuccugcc

SEQ ID NO: 7451 - RNA, 19 nt, artificial
  Oligomer
aguauaucugggacuugcu

SEQ ID NO: 7452 - RNA, 19 nt, artificial
  Oligomer
aaacaucuugucaaaguca

SEQ ID NO: 7453 - RNA, 19 nt, artificial
  Oligomer
ccgaauaccaugagacaug

SEQ ID NO: 7454 - RNA, 19 nt, artificial
  Oligomer
guauucaacauguuaaaga

SEQ ID NO: 7455 - RNA, 19 nt, artificial
  Oligomer
cucagcuccaguucuucua

SEQ ID NO: 7456 - RNA, 19 nt, artificial
  Oligomer
guaaagauagguuuccaga

SEQ ID NO: 7457 - RNA, 19 nt, artificial
  Oligomer
aguugguaaagauagguuu

SEQ ID NO: 7458 - RNA, 19 nt, artificial
  Oligomer
auucaacauguuaaagauu

SEQ ID NO: 7459 - RNA, 19 nt, artificial
  Oligomer
acggauaaacagcuuucuc

SEQ ID NO: 7460 - RNA, 19 nt, artificial
  Oligomer
uuaauagcaucauccucaa

SEQ ID NO: 7461 - RNA, 19 nt, artificial
  Oligomer
uccucaaacucuucuguag

SEQ ID NO: 7462 - RNA, 19 nt, artificial
  Oligomer
ugaugaucaccuucgguuu

SEQ ID NO: 7463 - RNA, 19 nt, artificial
  Oligomer
aacaccaggaacgugcugu

SEQ ID NO: 7464 - RNA, 19 nt, artificial
  Oligomer
cuccaagaaacauuaucug

SEQ ID NO: 7465 - RNA, 19 nt, artificial
  Oligomer
cacaggaacaggcauauuc

SEQ ID NO: 7466 - RNA, 19 nt, artificial
  Oligomer
agcaaagcuugacauuccc

SEQ ID NO: 7467 - RNA, 19 nt, artificial
  Oligomer
gccuggaugaugaucaccu

SEQ ID NO: 7468 - RNA, 19 nt, artificial
  Oligomer
gauaaugagagcaagacgu

SEQ ID NO: 7469 - RNA, 19 nt, artificial
  Oligomer
accuugcggaaaauuuccu

SEQ ID NO: 7470 - RNA, 19 nt, artificial
  Oligomer
aaaccuuuacagaaggauc

SEQ ID NO: 7471 - RNA, 19 nt, artificial
  Oligomer
agcauugucaugccuguga

SEQ ID NO: 7472 - RNA, 19 nt, artificial
  Oligomer
uuguuuccauauccuuuga

SEQ ID NO: 7473 - RNA, 19 nt, artificial
  Oligomer
acauucccuucugagccug

SEQ ID NO: 7474 - RNA, 19 nt, artificial
  Oligomer
uaucugggacuugcucaga

SEQ ID NO: 7475 - RNA, 19 nt, artificial
  Oligomer
aguuuccuuauuuuaaugu

SEQ ID NO: 7476 - RNA, 19 nt, artificial
  Oligomer
aguuuauuauucagcagac

SEQ ID NO: 7477 - RNA, 19 nt, artificial
  Oligomer
ccaugagacaugaacacca

SEQ ID NO: 7478 - RNA, 19 nt, artificial
  Oligomer
uuccuccacaucacaggaa

SEQ ID NO: 7479 - RNA, 19 nt, artificial
  Oligomer
ucucuuccuuguucagcac

SEQ ID NO: 7480 - RNA, 19 nt, artificial
  Oligomer
agcuuucucuucuccuuca

SEQ ID NO: 7481 - RNA, 19 nt, artificial
  Oligomer
aaaugccuccagcucugua

SEQ ID NO: 7482 - RNA, 19 nt, artificial
  Oligomer
gcucagaguguuucuuccc

SEQ ID NO: 7483 - RNA, 19 nt, artificial
  Oligomer
uguaguauaucugggacuu

SEQ ID NO: 7484 - RNA, 19 nt, artificial
  Oligomer
auagcuggguuguccugca

SEQ ID NO: 7485 - RNA, 19 nt, artificial
  Oligomer
agguagaaacaucuuguca

SEQ ID NO: 7486 - RNA, 19 nt, artificial
  Oligomer
uuuucacaucuacgcugua

SEQ ID NO: 7487 - RNA, 19 nt, artificial
  Oligomer
gcucaaaugaaaaucgaac

SEQ ID NO: 7488 - RNA, 19 nt, artificial
  Oligomer
cuugucuguaauaauucau

SEQ ID NO: 7489 - RNA, 19 nt, artificial
  Oligomer
aaaguuuauuauucagcag

SEQ ID NO: 7490 - RNA, 19 nt, artificial
  Oligomer
ugugggcuuucuuaauagc

SEQ ID NO: 7491 - RNA, 19 nt, artificial
  Oligomer
cggauaaacagcuuucucu

SEQ ID NO: 7492 - RNA, 19 nt, artificial
  Oligomer
auacugucaaauucuucau

SEQ ID NO: 7493 - RNA, 19 nt, artificial
  Oligomer
cugucagaggucuugugcu

SEQ ID NO: 7494 - RNA, 19 nt, artificial
  Oligomer
acuugcucagaguguuucu

SEQ ID NO: 7495 - RNA, 19 nt, artificial
  Oligomer
gauagguuuccagaaacuc

SEQ ID NO: 7496 - RNA, 19 nt, artificial
  Oligomer
ugcccacagacauucauac

SEQ ID NO: 7497 - RNA, 19 nt, artificial
  Oligomer
ugaggaugugggcauagcu

SEQ ID NO: 7498 - RNA, 19 nt, artificial
  Oligomer
gagauuuuuuuucacaucu

SEQ ID NO: 7499 - RNA, 19 nt, artificial
  Oligomer
ucuagggagcaaagcuuga

SEQ ID NO: 7500 - RNA, 19 nt, artificial
  Oligomer
ugcggcuugacuuguccau

SEQ ID NO: 7501 - RNA, 19 nt, artificial
  Oligomer
cuuccaauaaaaacagagc

SEQ ID NO: 7502 - RNA, 19 nt, artificial
  Oligomer
ugcggaaaauuuccuccac

SEQ ID NO: 7503 - RNA, 19 nt, artificial
  Oligomer
gugaugucaaccucagcuc

SEQ ID NO: 7504 - RNA, 19 nt, artificial
  Oligomer
auccuucucuaugugggcu

SEQ ID NO: 7505 - RNA, 19 nt, artificial
  Oligomer
aaaucucugccgacuuuug

SEQ ID NO: 7506 - RNA, 19 nt, artificial
  Oligomer
ccaagaaacauuaucuggu

SEQ ID NO: 7507 - RNA, 19 nt, artificial
  Oligomer
cauauucuugcauauguuc

SEQ ID NO: 7508 - RNA, 19 nt, artificial
  Oligomer
gagucaaucaaagcucggg

SEQ ID NO: 7509 - RNA, 19 nt, artificial
  Oligomer
ugcauugaguuguaguaua

SEQ ID NO: 7510 - RNA, 19 nt, artificial
  Oligomer
gacaugaacaccaggaacg

SEQ ID NO: 7511 - RNA, 19 nt, artificial
  Oligomer
gacauaauuccaaaaaccu

SEQ ID NO: 7512 - RNA, 19 nt, artificial
  Oligomer
ugacuuguccauuauugga

SEQ ID NO: 7513 - RNA, 19 nt, artificial
  Oligomer
aauccuucucuaugugggc

SEQ ID NO: 7514 - RNA, 19 nt, artificial
  Oligomer
guaugugaugcaaauuugg

SEQ ID NO: 7515 - RNA, 19 nt, artificial
  Oligomer
uggugaaguugcugaucaa

SEQ ID NO: 7516 - RNA, 19 nt, artificial
  Oligomer
cagugguuauaaaagagaa

SEQ ID NO: 7517 - RNA, 19 nt, artificial
  Oligomer
gauacucagugguuauaaa

SEQ ID NO: 7518 - RNA, 19 nt, artificial
  Oligomer
gauggaaaauaauguauua

SEQ ID NO: 7519 - RNA, 19 nt, artificial
  Oligomer
caacauccgcaacaaagaa

SEQ ID NO: 7520 - RNA, 19 nt, artificial
  Oligomer
cgaugacaccaucuuugaa

SEQ ID NO: 7521 - RNA, 19 nt, artificial
  Oligomer
gagucaucaucuagaggaa

SEQ ID NO: 7522 - RNA, 19 nt, artificial
  Oligomer
gaauuaaaacucauaagaa

SEQ ID NO: 7523 - RNA, 19 nt, artificial
  Oligomer
ggacuucauugcuuucaaa

SEQ ID NO: 7524 - RNA, 19 nt, artificial
  Oligomer
caacuaucuucauaaucga

SEQ ID NO: 7525 - RNA, 19 nt, artificial
  Oligomer
ggagagcaagccuguugaa

SEQ ID NO: 7526 - RNA, 19 nt, artificial
  Oligomer
gcacauuccugguguuuau

SEQ ID NO: 7527 - RNA, 19 nt, artificial
  Oligomer
ccagagucugaaagacaaa

SEQ ID NO: 7528 - RNA, 19 nt, artificial
  Oligomer
ccuguggaauuccaaaaaa

SEQ ID NO: 7529 - RNA, 19 nt, artificial
  Oligomer
ccaaggucaucaucaugca

SEQ ID NO: 7530 - RNA, 19 nt, artificial
  Oligomer
ccaucuuugaaauuuucaa

SEQ ID NO: 7531 - RNA, 19 nt, artificial
  Oligomer
caaggucaucaucaugcaa

SEQ ID NO: 7532 - RNA, 19 nt, artificial
  Oligomer
caggcaaaauauuuaggga

SEQ ID NO: 7533 - RNA, 19 nt, artificial
  Oligomer
ccucaacauccgcaacaaa

SEQ ID NO: 7534 - RNA, 19 nt, artificial
  Oligomer
ccauucaggguaauaucaa

SEQ ID NO: 7535 - RNA, 19 nt, artificial
  Oligomer
agcucaaacugcaggcaaa

SEQ ID NO: 7536 - RNA, 19 nt, artificial
  Oligomer
agaucagagucuaauuuua

SEQ ID NO: 7537 - RNA, 19 nt, artificial
  Oligomer
cuguaaugaugcuguuaca

SEQ ID NO: 7538 - RNA, 19 nt, artificial
  Oligomer
gccucaacauccgcaacaa

SEQ ID NO: 7539 - RNA, 19 nt, artificial
  Oligomer
cucuuuccugggaauuaaa

SEQ ID NO: 7540 - RNA, 19 nt, artificial
  Oligomer
augauuugauggaaaauaa

SEQ ID NO: 7541 - RNA, 19 nt, artificial
  Oligomer
acacgagaucagagucuaa

SEQ ID NO: 7542 - RNA, 19 nt, artificial
  Oligomer
caaacugcaggcaaaauau

SEQ ID NO: 7543 - RNA, 19 nt, artificial
  Oligomer
uccgcaacaaagaauucaa

SEQ ID NO: 7544 - RNA, 19 nt, artificial
  Oligomer
gaugugagaucuacuugaa

SEQ ID NO: 7545 - RNA, 19 nt, artificial
  Oligomer
cuuggagacaugaaacaaa

SEQ ID NO: 7546 - RNA, 19 nt, artificial
  Oligomer
agaugagauacaccuuaua

SEQ ID NO: 7547 - RNA, 19 nt, artificial
  Oligomer
ggaaauggaaacagcacua

SEQ ID NO: 7548 - RNA, 19 nt, artificial
  Oligomer
uguggaauuccaaaaaaca

SEQ ID NO: 7549 - RNA, 19 nt, artificial
  Oligomer
ccugguugaugauaucacu

SEQ ID NO: 7550 - RNA, 19 nt, artificial
  Oligomer
gcucaaacugcaggcaaaa

SEQ ID NO: 7551 - RNA, 19 nt, artificial
  Oligomer
cugaaaaccugguugauga

SEQ ID NO: 7552 - RNA, 19 nt, artificial
  Oligomer
ggaugugagaucuacuuga

SEQ ID NO: 7553 - RNA, 19 nt, artificial
  Oligomer
cuaucuucauaaucgaaau

SEQ ID NO: 7554 - RNA, 19 nt, artificial
  Oligomer
gacuauccaugacacgaua

SEQ ID NO: 7555 - RNA, 19 nt, artificial
  Oligomer
ugggaauuaaaacucauaa

SEQ ID NO: 7556 - RNA, 19 nt, artificial
  Oligomer
ccugggaauuaaaacucau

SEQ ID NO: 7557 - RNA, 19 nt, artificial
  Oligomer
gucugaaagacaaacccaa

SEQ ID NO: 7558 - RNA, 19 nt, artificial
  Oligomer
gcaacaaagaauucaacua

SEQ ID NO: 7559 - RNA, 19 nt, artificial
  Oligomer
ccaugacacgauauuucua

SEQ ID NO: 7560 - RNA, 19 nt, artificial
  Oligomer
cacagcucaggaaauggaa

SEQ ID NO: 7561 - RNA, 19 nt, artificial
  Oligomer
gucggcucuugcaagguaa

SEQ ID NO: 7562 - RNA, 19 nt, artificial
  Oligomer
caccacugacaguggaaaa

SEQ ID NO: 7563 - RNA, 19 nt, artificial
  Oligomer
cugggaauuaaaacucaua

SEQ ID NO: 7564 - RNA, 19 nt, artificial
  Oligomer
uguggugagcaaugcugaa

SEQ ID NO: 7565 - RNA, 19 nt, artificial
  Oligomer
cacuuuguuaugucaaaaa

SEQ ID NO: 7566 - RNA, 19 nt, artificial
  Oligomer
aggacuucauugcuuucaa

SEQ ID NO: 7567 - RNA, 19 nt, artificial
  Oligomer
gaccaagcacugggaucaa

SEQ ID NO: 7568 - RNA, 19 nt, artificial
  Oligomer
ggaauuaaaacucauaaga

SEQ ID NO: 7569 - RNA, 19 nt, artificial
  Oligomer
ugauuugauggaaaauaau

SEQ ID NO: 7570 - RNA, 19 nt, artificial
  Oligomer
cuuuguuaugucaaaaaga

SEQ ID NO: 7571 - RNA, 19 nt, artificial
  Oligomer
guuucuuggagacaugaaa

SEQ ID NO: 7572 - RNA, 19 nt, artificial
  Oligomer
gagcaagccuguugaaauu

SEQ ID NO: 7573 - RNA, 19 nt, artificial
  Oligomer
acaccuguggaauuccaaa

SEQ ID NO: 7574 - RNA, 19 nt, artificial
  Oligomer
aacccaaggucaucaucau

SEQ ID NO: 7575 - RNA, 19 nt, artificial
  Oligomer
acagcugaguucagauaua

SEQ ID NO: 7576 - RNA, 19 nt, artificial
  Oligomer
agccggugcagauacucau

SEQ ID NO: 7577 - RNA, 19 nt, artificial
  Oligomer
ugaugauaucacugagaca

SEQ ID NO: 7578 - RNA, 19 nt, artificial
  Oligomer
caacaaagaauucaacuau

SEQ ID NO: 7579 - RNA, 19 nt, artificial
  Oligomer
ccaaaggaaagcaguuaua

SEQ ID NO: 7580 - RNA, 19 nt, artificial
  Oligomer
gcucugucuucauuuccca

SEQ ID NO: 7581 - RNA, 19 nt, artificial
  Oligomer
gauacaccuuauaggaaaa

SEQ ID NO: 7582 - RNA, 19 nt, artificial
  Oligomer
uaaucgaaaugguucugaa

SEQ ID NO: 7583 - RNA, 19 nt, artificial
  Oligomer
ucaggaaauggaaacagca

SEQ ID NO: 7584 - RNA, 19 nt, artificial
  Oligomer
cagaugagauacaccuuau

SEQ ID NO: 7585 - RNA, 19 nt, artificial
  Oligomer
ggauacucagugguuauaa

SEQ ID NO: 7586 - RNA, 19 nt, artificial
  Oligomer
guucaacauucauuugaga

SEQ ID NO: 7587 - RNA, 19 nt, artificial
  Oligomer
caccuguggaauuccaaaa

SEQ ID NO: 7588 - RNA, 19 nt, artificial
  Oligomer
ucaaaagguucaacauuca

SEQ ID NO: 7589 - RNA, 19 nt, artificial
  Oligomer
ucaacauccgcaacaaaga

SEQ ID NO: 7590 - RNA, 19 nt, artificial
  Oligomer
uuuguuaugucaaaaagaa

SEQ ID NO: 7591 - RNA, 19 nt, artificial
  Oligomer
ccgcaacaaagaauucaac

SEQ ID NO: 7592 - RNA, 19 nt, artificial
  Oligomer
cggugcagauacucauggu

SEQ ID NO: 7593 - RNA, 19 nt, artificial
  Oligomer
uagaggaaauuuuucaaaa

SEQ ID NO: 7594 - RNA, 19 nt, artificial
  Oligomer
caaauuaucuacuacuuca

SEQ ID NO: 7595 - RNA, 19 nt, artificial
  Oligomer
acucagugguuauaaaaga

SEQ ID NO: 7596 - RNA, 19 nt, artificial
  Oligomer
cauucaggguaauaucaac

SEQ ID NO: 7597 - RNA, 19 nt, artificial
  Oligomer
ggaaauuuuucaaaagguu

SEQ ID NO: 7598 - RNA, 19 nt, artificial
  Oligomer
aaagaaaaagagaauuuga

SEQ ID NO: 7599 - RNA, 19 nt, artificial
  Oligomer
gguucaacauucauuugag

SEQ ID NO: 7600 - RNA, 19 nt, artificial
  Oligomer
ucucuuuccugggaauuaa

SEQ ID NO: 7601 - RNA, 19 nt, artificial
  Oligomer
agguaacaucuguaaugau

SEQ ID NO: 7602 - RNA, 19 nt, artificial
  Oligomer
ggaaaagccggugcagaua

SEQ ID NO: 7603 - RNA, 19 nt, artificial
  Oligomer
uggugagcaaugcugaaaa

SEQ ID NO: 7604 - RNA, 19 nt, artificial
  Oligomer
aaucuuccacaccacauaa

SEQ ID NO: 7605 - RNA, 19 nt, artificial
  Oligomer
gaacaccuguggaauucca

SEQ ID NO: 7606 - RNA, 19 nt, artificial
  Oligomer
ugaucaagaccuuucuaga

SEQ ID NO: 7607 - RNA, 19 nt, artificial
  Oligomer
gguugaugauaucacugag

SEQ ID NO: 7608 - RNA, 19 nt, artificial
  Oligomer
uaaaguuuguggugagcaa

SEQ ID NO: 7609 - RNA, 19 nt, artificial
  Oligomer
gcccaccauugaaagacua

SEQ ID NO: 7610 - RNA, 19 nt, artificial
  Oligomer
aaaggaaagcaguuauaca

SEQ ID NO: 7611 - RNA, 19 nt, artificial
  Oligomer
aggcaaaauauuuagggaa

SEQ ID NO: 7612 - RNA, 19 nt, artificial
  Oligomer
cugucuucauuucccaaau

SEQ ID NO: 7613 - RNA, 19 nt, artificial
  Oligomer
cagauguucuucacgauga

SEQ ID NO: 7614 - RNA, 19 nt, artificial
  Oligomer
caaagaauucaacuaucuu

SEQ ID NO: 7615 - RNA, 19 nt, artificial
  Oligomer
gaucagagucuaauuuuau

SEQ ID NO: 7616 - RNA, 19 nt, artificial
  Oligomer
cagcugcccaccauugaaa

SEQ ID NO: 7617 - RNA, 19 nt, artificial
  Oligomer
cuuauaggaaaaugucuaa

SEQ ID NO: 7618 - RNA, 19 nt, artificial
  Oligomer
ggagaaagagaggcgaaca

SEQ ID NO: 7619 - RNA, 19 nt, artificial
  Oligomer
uccuauuuuccaaaggaaa

SEQ ID NO: 7620 - RNA, 19 nt, artificial
  Oligomer
cggcucuugcaagguaaca

SEQ ID NO: 7621 - RNA, 19 nt, artificial
  Oligomer
uacaaaggcucauguggaa

SEQ ID NO: 7622 - RNA, 19 nt, artificial
  Oligomer
gagaaagagaggcgaacau

SEQ ID NO: 7623 - RNA, 19 nt, artificial
  Oligomer
ccagugauggagaaagaga

SEQ ID NO: 7624 - RNA, 19 nt, artificial
  Oligomer
ccaagcacugggaucaaga

SEQ ID NO: 7625 - RNA, 19 nt, artificial
  Oligomer
aaauuuucaacaaccguaa

SEQ ID NO: 7626 - RNA, 19 nt, artificial
  Oligomer
cuagaggaaauuuuucaaa

SEQ ID NO: 7627 - RNA, 19 nt, artificial
  Oligomer
caaaagguucaacauucau

SEQ ID NO: 7628 - RNA, 19 nt, artificial
  Oligomer
gcaaaauauuuagggaaca

SEQ ID NO: 7629 - RNA, 19 nt, artificial
  Oligomer
aaaucuuccacaccacaua

SEQ ID NO: 7630 - RNA, 19 nt, artificial
  Oligomer
uccacugagaggagagcaa

SEQ ID NO: 7631 - RNA, 19 nt, artificial
  Oligomer
caaaggcucauguggaaaa

SEQ ID NO: 7632 - RNA, 19 nt, artificial
  Oligomer
acugcaggcaaaauauuua

SEQ ID NO: 7633 - RNA, 19 nt, artificial
  Oligomer
agauacaccuuauaggaaa

SEQ ID NO: 7634 - RNA, 19 nt, artificial
  Oligomer
caagccuguugaaauuguu

SEQ ID NO: 7635 - RNA, 19 nt, artificial
  Oligomer
auccagugauggagaaaga

SEQ ID NO: 7636 - RNA, 19 nt, artificial
  Oligomer
aggcucauguggaaaagga

SEQ ID NO: 7637 - RNA, 19 nt, artificial
  Oligomer
ucuagaggaaauuuuucaa

SEQ ID NO: 7638 - RNA, 19 nt, artificial
  Oligomer
cccaaauuaucuacuacuu

SEQ ID NO: 7639 - RNA, 19 nt, artificial
  Oligomer
aauuguuuuugcuuucaca

SEQ ID NO: 7640 - RNA, 19 nt, artificial
  Oligomer
caacaagcugguccacuga

SEQ ID NO: 7641 - RNA, 19 nt, artificial
  Oligomer
accuguggaauuccaaaaa

SEQ ID NO: 7642 - RNA, 19 nt, artificial
  Oligomer
ugugagaucuacuugaaaa

SEQ ID NO: 7643 - RNA, 19 nt, artificial
  Oligomer
ucuucauuucccaaauuau

SEQ ID NO: 7644 - RNA, 19 nt, artificial
  Oligomer
ccacauaauguuucuugga

SEQ ID NO: 7645 - RNA, 19 nt, artificial
  Oligomer
augugagaucuacuugaaa

SEQ ID NO: 7646 - RNA, 19 nt, artificial
  Oligomer
uucugguccacauggugaa

SEQ ID NO: 7647 - RNA, 19 nt, artificial
  Oligomer
agugguuauaaaagagaau

SEQ ID NO: 7648 - RNA, 19 nt, artificial
  Oligomer
ccauugaaagacuauccau

SEQ ID NO: 7649 - RNA, 19 nt, artificial
  Oligomer
cucugucuucauuucccaa

SEQ ID NO: 7650 - RNA, 19 nt, artificial
  Oligomer
gagauacaccuuauaggaa

SEQ ID NO: 7651 - RNA, 19 nt, artificial
  Oligomer
gcaagguaacaucuguaau

SEQ ID NO: 7652 - RNA, 19 nt, artificial
  Oligomer
aauucaacuaucuucauaa

SEQ ID NO: 7653 - RNA, 19 nt, artificial
  Oligomer
guuaugucaaaaagaagaa

SEQ ID NO: 7654 - RNA, 19 nt, artificial
  Oligomer
gggaauuaaaacucauaag

SEQ ID NO: 7655 - RNA, 19 nt, artificial
  Oligomer
uggaaaagccggugcagau

SEQ ID NO: 7656 - RNA, 19 nt, artificial
  Oligomer
ugucacauagcauccugaa

SEQ ID NO: 7657 - RNA, 19 nt, artificial
  Oligomer
cagcugaguucagauauau

SEQ ID NO: 7658 - RNA, 19 nt, artificial
  Oligomer
gaaauggaaacagcacuaa

SEQ ID NO: 7659 - RNA, 19 nt, artificial
  Oligomer
gaaucucacagcucaggaa

SEQ ID NO: 7660 - RNA, 19 nt, artificial
  Oligomer
ccuuauaggaaaaugucua

SEQ ID NO: 7661 - RNA, 19 nt, artificial
  Oligomer
ugguccacauggugaaguu

SEQ ID NO: 7662 - RNA, 19 nt, artificial
  Oligomer
gaauucaacuaucuucaua

SEQ ID NO: 7663 - RNA, 19 nt, artificial
  Oligomer
gcugaucaagaccuuucua

SEQ ID NO: 7664 - RNA, 19 nt, artificial
  Oligomer
agagcaagccuguugaaau

SEQ ID NO: 7665 - RNA, 19 nt, artificial
  Oligomer
cgcaacaaagaauucaacu

SEQ ID NO: 7666 - RNA, 19 nt, artificial
  Oligomer
acaccaucuuugaaauuuu

SEQ ID NO: 7667 - RNA, 19 nt, artificial
  Oligomer
uuccuauuuuccaaaggaa

SEQ ID NO: 7668 - RNA, 19 nt, artificial
  Oligomer
cuuggagucaucaucuaga

SEQ ID NO: 7669 - RNA, 19 nt, artificial
  Oligomer
aauuuuccauucaggguaa

SEQ ID NO: 7670 - RNA, 19 nt, artificial
  Oligomer
cagugauggagaaagagag

SEQ ID NO: 7671 - RNA, 19 nt, artificial
  Oligomer
acagcucaggaaauggaaa

SEQ ID NO: 7672 - RNA, 19 nt, artificial
  Oligomer
acgguguucugguccacau

SEQ ID NO: 7673 - RNA, 19 nt, artificial
  Oligomer
uguggaaaaggacuucauu

SEQ ID NO: 7674 - RNA, 19 nt, artificial
  Oligomer
ugagauacaccuuauagga

SEQ ID NO: 7675 - RNA, 19 nt, artificial
  Oligomer
aggcaauggugcugggauu

SEQ ID NO: 7676 - RNA, 19 nt, artificial
  Oligomer
cagcucaaacugcaggcaa

SEQ ID NO: 7677 - RNA, 19 nt, artificial
  Oligomer
ucugcuuccuauuuuccaa

SEQ ID NO: 7678 - RNA, 19 nt, artificial
  Oligomer
agaucuacuugaaaaccuu

SEQ ID NO: 7679 - RNA, 19 nt, artificial
  Oligomer
uucacuuuguuaugucaaa

SEQ ID NO: 7680 - RNA, 19 nt, artificial
  Oligomer
gggauuguuugguucacca

SEQ ID NO: 7681 - RNA, 19 nt, artificial
  Oligomer
ugaaaaccugguugaugau

SEQ ID NO: 7682 - RNA, 19 nt, artificial
  Oligomer
cugaugagaaaccauccaa

SEQ ID NO: 7683 - RNA, 19 nt, artificial
  Oligomer
ucaucuagaggaaauuuuu

SEQ ID NO: 7684 - RNA, 19 nt, artificial
  Oligomer
gaaucugugggaccaagca

SEQ ID NO: 7685 - RNA, 19 nt, artificial
  Oligomer
aacaccuguggaauuccaa

SEQ ID NO: 7686 - RNA, 19 nt, artificial
  Oligomer
aagacaaacccaaggucau

SEQ ID NO: 7687 - RNA, 19 nt, artificial
  Oligomer
guggaauuccaaaaaacag

SEQ ID NO: 7688 - RNA, 19 nt, artificial
  Oligomer
ggcucuugcaagguaacau

SEQ ID NO: 7689 - RNA, 19 nt, artificial
  Oligomer
aacuaucuucauaaucgaa

SEQ ID NO: 7690 - RNA, 19 nt, artificial
  Oligomer
uugaugauuugauggaaaa

SEQ ID NO: 7691 - RNA, 19 nt, artificial
  Oligomer
ugaaaaccuuggauacuca

SEQ ID NO: 7692 - RNA, 19 nt, artificial
  Oligomer
auacucagugguuauaaaa

SEQ ID NO: 7693 - RNA, 19 nt, artificial
  Oligomer
caucuguaaugaugcuguu

SEQ ID NO: 7694 - RNA, 19 nt, artificial
  Oligomer
uggaaacagcacuaaggca

SEQ ID NO: 7695 - RNA, 19 nt, artificial
  Oligomer
agauauauccagugaugga

SEQ ID NO: 7696 - RNA, 19 nt, artificial
  Oligomer
gaugauuugauggaaaaua

SEQ ID NO: 7697 - RNA, 19 nt, artificial
  Oligomer
agaauuugaggacugggaa

SEQ ID NO: 7698 - RNA, 19 nt, artificial
  Oligomer
gaggacugggaauuuucca

SEQ ID NO: 7699 - RNA, 19 nt, artificial
  Oligomer
gcugaugagaaaccaucca

SEQ ID NO: 7700 - RNA, 19 nt, artificial
  Oligomer
cuuggauacucagugguua

SEQ ID NO: 7701 - RNA, 19 nt, artificial
  Oligomer
ggcucauguggaaaaggac

SEQ ID NO: 7702 - RNA, 19 nt, artificial
  Oligomer
aggagagcaagccuguuga

SEQ ID NO: 7703 - RNA, 19 nt, artificial
  Oligomer
caauggugcugggauuguu

SEQ ID NO: 7704 - RNA, 19 nt, artificial
  Oligomer
acaagcugguccacugaga

SEQ ID NO: 7705 - RNA, 19 nt, artificial
  Oligomer
uuggagacaugaaacaaau

SEQ ID NO: 7706 - RNA, 19 nt, artificial
  Oligomer
cuguggaauuccaaaaaac

SEQ ID NO: 7707 - RNA, 19 nt, artificial
  Oligomer
gagagcaagccuguugaaa

SEQ ID NO: 7708 - RNA, 19 nt, artificial
  Oligomer
acgagaucagagucuaauu

SEQ ID NO: 7709 - RNA, 19 nt, artificial
  Oligomer
cugggaauuuuccauucag

SEQ ID NO: 7710 - RNA, 19 nt, artificial
  Oligomer
guaaugaugcuguuacaaa

SEQ ID NO: 7711 - RNA, 19 nt, artificial
  Oligomer
guguuuaugucacauagca

SEQ ID NO: 7712 - RNA, 19 nt, artificial
  Oligomer
ggaaagcaguuauacacga

SEQ ID NO: 7713 - RNA, 19 nt, artificial
  Oligomer
gucuucauuucccaaauua

SEQ ID NO: 7714 - RNA, 19 nt, artificial
  Oligomer
caaauauacugacccagcu

SEQ ID NO: 7715 - RNA, 19 nt, artificial
  Oligomer
uccacauggugaaguugcu

SEQ ID NO: 7716 - RNA, 19 nt, artificial
  Oligomer
gaaauuuucaacaaccgua

SEQ ID NO: 7717 - RNA, 19 nt, artificial
  Oligomer
gagcaaugcugaaaaccug

SEQ ID NO: 7718 - RNA, 19 nt, artificial
  Oligomer
agaggaaauuuuucaaaag

SEQ ID NO: 7719 - RNA, 19 nt, artificial
  Oligomer
gaugacaccaucuuugaaa

SEQ ID NO: 7720 - RNA, 19 nt, artificial
  Oligomer
ucacuuuguuaugucaaaa

SEQ ID NO: 7721 - RNA, 19 nt, artificial
  Oligomer
auucaacuaucuucauaau

SEQ ID NO: 7722 - RNA, 19 nt, artificial
  Oligomer
cuuccuauuuuccaaagga

SEQ ID NO: 7723 - RNA, 19 nt, artificial
  Oligomer
cacgauauuucuaucucuu

SEQ ID NO: 7724 - RNA, 19 nt, artificial
  Oligomer
ggaauuuuccauucagggu

SEQ ID NO: 7725 - RNA, 19 nt, artificial
  Oligomer
ugcaagguaacaucuguaa

SEQ ID NO: 7726 - RNA, 19 nt, artificial
  Oligomer
ucuuugaaauuuucaacaa

SEQ ID NO: 7727 - RNA, 19 nt, artificial
  Oligomer
agauguucuucacgaugac

SEQ ID NO: 7728 - RNA, 19 nt, artificial
  Oligomer
cauccugaauggaaucugu

SEQ ID NO: 7729 - RNA, 19 nt, artificial
  Oligomer
aguuauacacgagaucaga

SEQ ID NO: 7730 - RNA, 19 nt, artificial
  Oligomer
cugaguucagauauaucca

SEQ ID NO: 7731 - RNA, 19 nt, artificial
  Oligomer
cgagaucagagucuaauuu

SEQ ID NO: 7732 - RNA, 19 nt, artificial
  Oligomer
ugagacagcucaaacugca

SEQ ID NO: 7733 - RNA, 19 nt, artificial
  Oligomer
agaauucaacuaucuucau

SEQ ID NO: 7734 - RNA, 19 nt, artificial
  Oligomer
ugucaaaaagaagaaaaca

SEQ ID NO: 7735 - RNA, 19 nt, artificial
  Oligomer
aggguaauaucaacaagcu

SEQ ID NO: 7736 - RNA, 19 nt, artificial
  Oligomer
acgaugacaccaucuuuga

SEQ ID NO: 7737 - RNA, 19 nt, artificial
  Oligomer
cauagcauccugaauggaa

SEQ ID NO: 7738 - RNA, 19 nt, artificial
  Oligomer
acauaauguuucuuggaga

SEQ ID NO: 7739 - RNA, 19 nt, artificial
  Oligomer
uccugguguuuaugucaca

SEQ ID NO: 7740 - RNA, 19 nt, artificial
  Oligomer
aagguaacaucuguaauga

SEQ ID NO: 7741 - RNA, 19 nt, artificial
  Oligomer
gcugcccaccauugaaaga

SEQ ID NO: 7742 - RNA, 19 nt, artificial
  Oligomer
gaucaagaccuuucuagau

SEQ ID NO: 7743 - RNA, 19 nt, artificial
  Oligomer
auggagaaagagaggcgaa

SEQ ID NO: 7744 - RNA, 19 nt, artificial
  Oligomer
aauuaaaacucauaagaag

SEQ ID NO: 7745 - RNA, 19 nt, artificial
  Oligomer
gagaauuugaggacuggga

SEQ ID NO: 7746 - RNA, 19 nt, artificial
  Oligomer
aaagguucaacauucauuu

SEQ ID NO: 7747 - RNA, 19 nt, artificial
  Oligomer
ucuuuccugggaauuaaaa

SEQ ID NO: 7748 - RNA, 19 nt, artificial
  Oligomer
uguuaugucaaaaagaaga

SEQ ID NO: 7749 - RNA, 19 nt, artificial
  Oligomer
gaaaaugucuaaaguuugu

SEQ ID NO: 7750 - RNA, 19 nt, artificial
  Oligomer
aggaaauuuuucaaaaggu

SEQ ID NO: 7751 - RNA, 19 nt, artificial
  Oligomer
cauucuguucacuuuguua

SEQ ID NO: 7752 - RNA, 19 nt, artificial
  Oligomer
cuaucucuuuccugggaau

SEQ ID NO: 7753 - RNA, 19 nt, artificial
  Oligomer
auuaaauacagaugagaua

SEQ ID NO: 7754 - RNA, 19 nt, artificial
  Oligomer
caggaaauggaaacagcac

SEQ ID NO: 7755 - RNA, 19 nt, artificial
  Oligomer
uuugaugauuugauggaaa

SEQ ID NO: 7756 - RNA, 19 nt, artificial
  Oligomer
ggugagcaaugcugaaaac

SEQ ID NO: 7757 - RNA, 19 nt, artificial
  Oligomer
caaaucuuccacaccacau

SEQ ID NO: 7758 - RNA, 19 nt, artificial
  Oligomer
uuuucaaaagguucaacau

SEQ ID NO: 7759 - RNA, 19 nt, artificial
  Oligomer
ugcugaaaaccugguugau

SEQ ID NO: 7760 - RNA, 19 nt, artificial
  Oligomer
aagccggugcagauacuca

SEQ ID NO: 7761 - RNA, 19 nt, artificial
  Oligomer
uccugggaauuaaaacuca

SEQ ID NO: 7762 - RNA, 19 nt, artificial
  Oligomer
auguggaaaaggacuucau

SEQ ID NO: 7763 - RNA, 19 nt, artificial
  Oligomer
gugaaguugcugaucaaga

SEQ ID NO: 7764 - RNA, 19 nt, artificial
  Oligomer
cuugcaagguaacaucugu

SEQ ID NO: 7765 - RNA, 19 nt, artificial
  Oligomer
gaauuuuccauucagggua

SEQ ID NO: 7766 - RNA, 19 nt, artificial
  Oligomer
acacgauauuucuaucucu

SEQ ID NO: 7767 - RNA, 19 nt, artificial
  Oligomer
uguuucuuggagacaugaa

SEQ ID NO: 7768 - RNA, 19 nt, artificial
  Oligomer
auaggaaaaugucuaaagu

SEQ ID NO: 7769 - RNA, 19 nt, artificial
  Oligomer
uguucacuuuguuauguca

SEQ ID NO: 7770 - RNA, 19 nt, artificial
  Oligomer
ugaugauuugauggaaaau

SEQ ID NO: 7771 - RNA, 19 nt, artificial
  Oligomer
aagagaaucucacagcuca

SEQ ID NO: 7772 - RNA, 19 nt, artificial
  Oligomer
guguucugguccacauggu

SEQ ID NO: 7773 - RNA, 19 nt, artificial
  Oligomer
cacugagacagcucaaacu

SEQ ID NO: 7774 - RNA, 19 nt, artificial
  Oligomer
cacgagaucagagucuaau

SEQ ID NO: 7775 - RNA, 19 nt, artificial
  Oligomer
ccugguguuuaugucacau

SEQ ID NO: 7776 - RNA, 19 nt, artificial
  Oligomer
cauccaacgguguucuggu

SEQ ID NO: 7777 - RNA, 19 nt, artificial
  Oligomer
caaaaaacagcugaguuca

SEQ ID NO: 7778 - RNA, 19 nt, artificial
  Oligomer
ggaaaaggacuucauugcu

SEQ ID NO: 7779 - RNA, 19 nt, artificial
  Oligomer
aggaaaaugucuaaaguuu

SEQ ID NO: 7780 - RNA, 19 nt, artificial
  Oligomer
uaaaacucauaagaagcaa

SEQ ID NO: 7781 - RNA, 19 nt, artificial
  Oligomer
gcugggauuguuugguuca

SEQ ID NO: 7782 - RNA, 19 nt, artificial
  Oligomer
cugcuuccuauuuuccaaa

SEQ ID NO: 7783 - RNA, 19 nt, artificial
  Oligomer
guugaugauaucacugaga

SEQ ID NO: 7784 - RNA, 19 nt, artificial
  Oligomer
uaucacugagacagcucaa

SEQ ID NO: 7785 - RNA, 19 nt, artificial
  Oligomer
auugaaagacuauccauga

SEQ ID NO: 7786 - RNA, 19 nt, artificial
  Oligomer
acauggugaaguugcugau

SEQ ID NO: 7787 - RNA, 19 nt, artificial
  Oligomer
ucaaacugcaggcaaaaua

SEQ ID NO: 7788 - RNA, 19 nt, artificial
  Oligomer
ggcaaagaaaaagagaauu

SEQ ID NO: 7789 - RNA, 19 nt, artificial
  Oligomer
acagaugagauacaccuua

SEQ ID NO: 7790 - RNA, 19 nt, artificial
  Oligomer
gcauuuuugaugauuugau

SEQ ID NO: 7791 - RNA, 19 nt, artificial
  Oligomer
ucauggucggcucuugcaa

SEQ ID NO: 7792 - RNA, 19 nt, artificial
  Oligomer
uuugauggaaaauaaugua

SEQ ID NO: 7793 - RNA, 19 nt, artificial
  Oligomer
cccaccauugaaagacuau

SEQ ID NO: 7794 - RNA, 19 nt, artificial
  Oligomer
agucaucaucuagaggaaa

SEQ ID NO: 7795 - RNA, 19 nt, artificial
  Oligomer
uuagggaacaccuguggaa

SEQ ID NO: 7796 - RNA, 19 nt, artificial
  Oligomer
aauuuuucaaaagguucaa

SEQ ID NO: 7797 - RNA, 19 nt, artificial
  Oligomer
aagaauucaacuaucuuca

SEQ ID NO: 7798 - RNA, 19 nt, artificial
  Oligomer
cuacuacuucagagaguau

SEQ ID NO: 7799 - RNA, 19 nt, artificial
  Oligomer
aaacugcaggcaaaauauu

SEQ ID NO: 7800 - RNA, 19 nt, artificial
  Oligomer
gccuguugaaauuguuuuu

SEQ ID NO: 7801 - RNA, 19 nt, artificial
  Oligomer
auagcauccugaauggaau

SEQ ID NO: 7802 - RNA, 19 nt, artificial
  Oligomer
uuuugaugauuugauggaa

SEQ ID NO: 7803 - RNA, 19 nt, artificial
  Oligomer
acugggaauuuuccauuca

SEQ ID NO: 7804 - RNA, 19 nt, artificial
  Oligomer
guauuaaauacagaugaga

SEQ ID NO: 7805 - RNA, 19 nt, artificial
  Oligomer
gucacauagcauccugaau

SEQ ID NO: 7806 - RNA, 19 nt, artificial
  Oligomer
gaaacagcacuaaggcagu

SEQ ID NO: 7807 - RNA, 19 nt, artificial
  Oligomer
gauggagaaagagaggcga

SEQ ID NO: 7808 - RNA, 19 nt, artificial
  Oligomer
uuaugucaaaaagaagaaa

SEQ ID NO: 7809 - RNA, 19 nt, artificial
  Oligomer
aaauggaaacagcacuaag

SEQ ID NO: 7810 - RNA, 19 nt, artificial
  Oligomer
ggcauuuuugaugauuuga

SEQ ID NO: 7811 - RNA, 19 nt, artificial
  Oligomer
ugguguuuaugucacauag

SEQ ID NO: 7812 - RNA, 19 nt, artificial
  Oligomer
ggcugaugagaaaccaucc

SEQ ID NO: 7813 - RNA, 19 nt, artificial
  Oligomer
gcaaagaaaaagagaauuu

SEQ ID NO: 7814 - RNA, 19 nt, artificial
  Oligomer
ucauuucccaaauuaucua

SEQ ID NO: 7815 - RNA, 19 nt, artificial
  Oligomer
cagagaguauucuuggagu

SEQ ID NO: 7816 - RNA, 19 nt, artificial
  Oligomer
agacuauccaugacacgau

SEQ ID NO: 7817 - RNA, 19 nt, artificial
  Oligomer
cugguguuuaugucacaua

SEQ ID NO: 7818 - RNA, 19 nt, artificial
  Oligomer
uaugucaaaaagaagaaaa

SEQ ID NO: 7819 - RNA, 19 nt, artificial
  Oligomer
gaauuugaggacugggaau

SEQ ID NO: 7820 - RNA, 19 nt, artificial
  Oligomer
uguugaaauuguuuuugcu

SEQ ID NO: 7821 - RNA, 19 nt, artificial
  Oligomer
ucacgaugacaccaucuuu

SEQ ID NO: 7822 - RNA, 19 nt, artificial
  Oligomer
aguugcugaucaagaccuu

SEQ ID NO: 7823 - RNA, 19 nt, artificial
  Oligomer
ugaaguugcugaucaagac

SEQ ID NO: 7824 - RNA, 19 nt, artificial
  Oligomer
uccauucaggguaauauca

SEQ ID NO: 7825 - RNA, 19 nt, artificial
  Oligomer
cuucauaaucgaaaugguu

SEQ ID NO: 7826 - RNA, 19 nt, artificial
  Oligomer
aggucaucaucaugcaagc

SEQ ID NO: 7827 - RNA, 19 nt, artificial
  Oligomer
ggguaauaucaacaagcug

SEQ ID NO: 7828 - RNA, 19 nt, artificial
  Oligomer
ggcaaaauauuuagggaac

SEQ ID NO: 7829 - RNA, 19 nt, artificial
  Oligomer
uaaugaugcuguuacaaag

SEQ ID NO: 7830 - RNA, 19 nt, artificial
  Oligomer
caaaaagaagaaaacaccu

SEQ ID NO: 7831 - RNA, 19 nt, artificial
  Oligomer
aaaagccggugcagauacu

SEQ ID NO: 7832 - RNA, 19 nt, artificial
  Oligomer
caagcacugggaucaagag

SEQ ID NO: 7833 - RNA, 19 nt, artificial
  Oligomer
cagacagcacauuccuggu

SEQ ID NO: 7834 - RNA, 19 nt, artificial
  Oligomer
cugcaggcaaaauauuuag

SEQ ID NO: 7835 - RNA, 19 nt, artificial
  Oligomer
caguccucagacagcacau

SEQ ID NO: 7836 - RNA, 19 nt, artificial
  Oligomer
guucacuuuguuaugucaa

SEQ ID NO: 7837 - RNA, 19 nt, artificial
  Oligomer
ggaauuccaaaaaacagcu

SEQ ID NO: 7838 - RNA, 19 nt, artificial
  Oligomer
ggaaaaugucuaaaguuug

SEQ ID NO: 7839 - RNA, 19 nt, artificial
  Oligomer
aauuaucuacuacuucaga

SEQ ID NO: 7840 - RNA, 19 nt, artificial
  Oligomer
ucuucauaaucgaaauggu

SEQ ID NO: 7841 - RNA, 19 nt, artificial
  Oligomer
uucaggguaauaucaacaa

SEQ ID NO: 7842 - RNA, 19 nt, artificial
  Oligomer
uucuuggagucaucaucua

SEQ ID NO: 7843 - RNA, 19 nt, artificial
  Oligomer
gaugagauacaccuuauag

SEQ ID NO: 7844 - RNA, 19 nt, artificial
  Oligomer
cucagugguuauaaaagag

SEQ ID NO: 7845 - RNA, 19 nt, artificial
  Oligomer
caagguaacaucuguaaug

SEQ ID NO: 7846 - RNA, 19 nt, artificial
  Oligomer
acaaagaauucaacuaucu

SEQ ID NO: 7847 - RNA, 19 nt, artificial
  Oligomer
cuuccacaccacauaaugu

SEQ ID NO: 7848 - RNA, 19 nt, artificial
  Oligomer
guucaccacugacagugga

SEQ ID NO: 7849 - RNA, 19 nt, artificial
  Oligomer
ucuuggagacaugaaacaa

SEQ ID NO: 7850 - RNA, 19 nt, artificial
  Oligomer
cacaccacauaauguuucu

SEQ ID NO: 7851 - RNA, 19 nt, artificial
  Oligomer
guuauaaaagagaaucuca

SEQ ID NO: 7852 - RNA, 19 nt, artificial
  Oligomer
agggaacaccuguggaauu

SEQ ID NO: 7853 - RNA, 19 nt, artificial
  Oligomer
uugcaagguaacaucugua

SEQ ID NO: 7854 - RNA, 19 nt, artificial
  Oligomer
guucugguccacaugguga

SEQ ID NO: 7855 - RNA, 19 nt, artificial
  Oligomer
agaggagagcaagccuguu

SEQ ID NO: 7856 - RNA, 19 nt, artificial
  Oligomer
ccucagacagcacauuccu

SEQ ID NO: 7857 - RNA, 19 nt, artificial
  Oligomer
uuucccaaauuaucuacua

SEQ ID NO: 7858 - RNA, 19 nt, artificial
  Oligomer
ucaaaucuuccacaccaca

SEQ ID NO: 7859 - RNA, 19 nt, artificial
  Oligomer
aacugcaggcaaaauauuu

SEQ ID NO: 7860 - RNA, 19 nt, artificial
  Oligomer
aaaacagcugaguucagau

SEQ ID NO: 7861 - RNA, 19 nt, artificial
  Oligomer
caguuauacacgagaucag

SEQ ID NO: 7862 - RNA, 19 nt, artificial
  Oligomer
gaaaugguucugaacuuga

SEQ ID NO: 7863 - RNA, 19 nt, artificial
  Oligomer
uucagagaguauucuugga

SEQ ID NO: 7864 - RNA, 19 nt, artificial
  Oligomer
caccaucuuugaaauuuuc

SEQ ID NO: 7865 - RNA, 19 nt, artificial
  Oligomer
caugacacgauauuucuau

SEQ ID NO: 7866 - RNA, 19 nt, artificial
  Oligomer
auguauuaaauacagauga

SEQ ID NO: 7867 - RNA, 19 nt, artificial
  Oligomer
ggagucaucaucuagagga

SEQ ID NO: 7868 - RNA, 19 nt, artificial
  Oligomer
uaggaaaaugucuaaaguu

SEQ ID NO: 7869 - RNA, 19 nt, artificial
  Oligomer
aaaaccugguugaugauau

SEQ ID NO: 7870 - RNA, 19 nt, artificial
  Oligomer
gaguauucuuggagucauc

SEQ ID NO: 7871 - RNA, 19 nt, artificial
  Oligomer
ugauggaaaauaauguauu

SEQ ID NO: 7872 - RNA, 19 nt, artificial
  Oligomer
aagcaguuauacacgagau

SEQ ID NO: 7873 - RNA, 19 nt, artificial
  Oligomer
augacaccaucuuugaaau

SEQ ID NO: 7874 - RNA, 19 nt, artificial
  Oligomer
accauugaaagacuaucca

SEQ ID NO: 7875 - RNA, 19 nt, artificial
  Oligomer
aaaccugguugaugauauc

SEQ ID NO: 7876 - RNA, 19 nt, artificial
  Oligomer
aauggaaacagcacuaagg

SEQ ID NO: 7877 - RNA, 19 nt, artificial
  Oligomer
acagcacauuccugguguu

SEQ ID NO: 7878 - RNA, 19 nt, artificial
  Oligomer
agucugaaagacaaaccca

SEQ ID NO: 7879 - RNA, 19 nt, artificial
  Oligomer
gcucauguggaaaaggacu

SEQ ID NO: 7880 - RNA, 19 nt, artificial
  Oligomer
guaauaucaacaagcuggu

SEQ ID NO: 7881 - RNA, 19 nt, artificial
  Oligomer
ucuacuugaaaaccuugga

SEQ ID NO: 7882 - RNA, 19 nt, artificial
  Oligomer
cuucauuucccaaauuauc

SEQ ID NO: 7883 - RNA, 19 nt, artificial
  Oligomer
aauggugcugggauuguuu

SEQ ID NO: 7884 - RNA, 19 nt, artificial
  Oligomer
gcaagccuguugaaauugu

SEQ ID NO: 7885 - RNA, 19 nt, artificial
  Oligomer
cuuugaaauuuucaacaac

SEQ ID NO: 7886 - RNA, 19 nt, artificial
  Oligomer
acucauaagaagcaacuca

SEQ ID NO: 7887 - RNA, 19 nt, artificial
  Oligomer
gaaagacuauccaugacac

SEQ ID NO: 7888 - RNA, 19 nt, artificial
  Oligomer
gagaucagagucuaauuuu

SEQ ID NO: 7889 - RNA, 19 nt, artificial
  Oligomer
gauguucuucacgaugaca

SEQ ID NO: 7890 - RNA, 19 nt, artificial
  Oligomer
gaggaaauuuuucaaaagg

SEQ ID NO: 7891 - RNA, 19 nt, artificial
  Oligomer
aggaaauggaaacagcacu

SEQ ID NO: 7892 - RNA, 19 nt, artificial
  Oligomer
gaaaaggacuucauugcuu

SEQ ID NO: 7893 - RNA, 19 nt, artificial
  Oligomer
gggaauuuuccauucaggg

SEQ ID NO: 7894 - RNA, 19 nt, artificial
  Oligomer
ugaugagaaaccauccaac

SEQ ID NO: 7895 - RNA, 19 nt, artificial
  Oligomer
ugcccaccauugaaagacu

SEQ ID NO: 7896 - RNA, 19 nt, artificial
  Oligomer
acaccuuauaggaaaaugu

SEQ ID NO: 7897 - RNA, 19 nt, artificial
  Oligomer
uauuaaauacagaugagau

SEQ ID NO: 7898 - RNA, 19 nt, artificial
  Oligomer
cauuuuugaugauuugaug

SEQ ID NO: 7899 - RNA, 19 nt, artificial
  Oligomer
aagagaggcgaacaugccu

SEQ ID NO: 7900 - RNA, 19 nt, artificial
  Oligomer
uguaaugaugcuguuacaa

SEQ ID NO: 7901 - RNA, 19 nt, artificial
  Oligomer
cuacuugaaaaccuuggau

SEQ ID NO: 7902 - RNA, 19 nt, artificial
  Oligomer
uguuuaugucacauagcau

SEQ ID NO: 7903 - RNA, 19 nt, artificial
  Oligomer
cgauauuucuaucucuuuc

SEQ ID NO: 7904 - RNA, 19 nt, artificial
  Oligomer
uauauccagugauggagaa

SEQ ID NO: 7905 - RNA, 19 nt, artificial
  Oligomer
uguauuaaauacagaugag

SEQ ID NO: 7906 - RNA, 19 nt, artificial
  Oligomer
acauccgcaacaaagaauu

SEQ ID NO: 7907 - RNA, 19 nt, artificial
  Oligomer
guuugguucaccacugaca

SEQ ID NO: 7908 - RNA, 19 nt, artificial
  Oligomer
gagacagcucaaacugcag

SEQ ID NO: 7909 - RNA, 19 nt, artificial
  Oligomer
agcucaggaaauggaaaca

SEQ ID NO: 7910 - RNA, 19 nt, artificial
  Oligomer
agguucaacauucauuuga

SEQ ID NO: 7911 - RNA, 19 nt, artificial
  Oligomer
gaaaaagagaauuugagga

SEQ ID NO: 7912 - RNA, 19 nt, artificial
  Oligomer
guggugagcaaugcugaaa

SEQ ID NO: 7913 - RNA, 19 nt, artificial
  Oligomer
caaugcugaaaaccugguu

SEQ ID NO: 7914 - RNA, 19 nt, artificial
  Oligomer
aaauuuuucaaaagguuca

SEQ ID NO: 7915 - RNA, 19 nt, artificial
  Oligomer
acuaucuucauaaucgaaa

SEQ ID NO: 7916 - RNA, 19 nt, artificial
  Oligomer
ccuuggauacucagugguu

SEQ ID NO: 7917 - RNA, 19 nt, artificial
  Oligomer
uauaaaagagaaucucaca

SEQ ID NO: 7918 - RNA, 19 nt, artificial
  Oligomer
uuggauacucagugguuau

SEQ ID NO: 7919 - RNA, 19 nt, artificial
  Oligomer
gcaguuauacacgagauca

SEQ ID NO: 7920 - RNA, 19 nt, artificial
  Oligomer
gaaagagaggcgaacaugc

SEQ ID NO: 7921 - RNA, 19 nt, artificial
  Oligomer
ugggaauuuuccauucagg

SEQ ID NO: 7922 - RNA, 19 nt, artificial
  Oligomer
augucacauagcauccuga

SEQ ID NO: 7923 - RNA, 19 nt, artificial
  Oligomer
ggcucugucuucauuuccc

SEQ ID NO: 7924 - RNA, 19 nt, artificial
  Oligomer
gcacuaaggcaguuugcug

SEQ ID NO: 7925 - RNA, 19 nt, artificial
  Oligomer
aggacugggaauuuuccau

SEQ ID NO: 7926 - RNA, 19 nt, artificial
  Oligomer
cauguggaaaaggacuuca

SEQ ID NO: 7927 - RNA, 19 nt, artificial
  Oligomer
ucaccacugacaguggaaa

SEQ ID NO: 7928 - RNA, 19 nt, artificial
  Oligomer
ucuacuacuucagagagua

SEQ ID NO: 7929 - RNA, 19 nt, artificial
  Oligomer
ugucuucauuucccaaauu

SEQ ID NO: 7930 - RNA, 19 nt, artificial
  Oligomer
gucaucaucuagaggaaau

SEQ ID NO: 7931 - RNA, 19 nt, artificial
  Oligomer
uaacaucuguaaugaugcu

SEQ ID NO: 7932 - RNA, 19 nt, artificial
  Oligomer
aaagacaaacccaagguca

SEQ ID NO: 7933 - RNA, 19 nt, artificial
  Oligomer
agcacauuccugguguuua

SEQ ID NO: 7934 - RNA, 19 nt, artificial
  Oligomer
cagagucuaauuuuaucuu

SEQ ID NO: 7935 - RNA, 19 nt, artificial
  Oligomer
gaaauuguuuuugcuuuca

SEQ ID NO: 7936 - RNA, 19 nt, artificial
  Oligomer
ugcugaucaagaccuuucu

SEQ ID NO: 7937 - RNA, 19 nt, artificial
  Oligomer
uacacgagaucagagucua

SEQ ID NO: 7938 - RNA, 19 nt, artificial
  Oligomer
gaaaaccugguugaugaua

SEQ ID NO: 7939 - RNA, 19 nt, artificial
  Oligomer
ugagcaaugcugaaaaccu

SEQ ID NO: 7940 - RNA, 19 nt, artificial
  Oligomer
cucaaacugcaggcaaaau

SEQ ID NO: 7941 - RNA, 19 nt, artificial
  Oligomer
ucaggguaauaucaacaag

SEQ ID NO: 7942 - RNA, 19 nt, artificial
  Oligomer
uuucaaaucuuccacacca

SEQ ID NO: 7943 - RNA, 19 nt, artificial
  Oligomer
uggauacucagugguuaua

SEQ ID NO: 7944 - RNA, 19 nt, artificial
  Oligomer
uaaauacagaugagauaca

SEQ ID NO: 7945 - RNA, 19 nt, artificial
  Oligomer
agaguauucuuggagucau

SEQ ID NO: 7946 - RNA, 19 nt, artificial
  Oligomer
ugguuauaaaagagaaucu

SEQ ID NO: 7947 - RNA, 19 nt, artificial
  Oligomer
caaaauauuuagggaacac

SEQ ID NO: 7948 - RNA, 19 nt, artificial
  Oligomer
auggaaucugugggaccaa

SEQ ID NO: 7949 - RNA, 19 nt, artificial
  Oligomer
cucaggaaauggaaacagc

SEQ ID NO: 7950 - RNA, 19 nt, artificial
  Oligomer
auaagaagcaacucaggua

SEQ ID NO: 7951 - RNA, 19 nt, artificial
  Oligomer
guauucuuggagucaucau

SEQ ID NO: 7952 - RNA, 19 nt, artificial
  Oligomer
ggacugggaauuuuccauu

SEQ ID NO: 7953 - RNA, 19 nt, artificial
  Oligomer
ggugaaguugcugaucaag

SEQ ID NO: 7954 - RNA, 19 nt, artificial
  Oligomer
ugguugaugauaucacuga

SEQ ID NO: 7955 - RNA, 19 nt, artificial
  Oligomer
aacgguguucugguccaca

SEQ ID NO: 7956 - RNA, 19 nt, artificial
  Oligomer
ccuauuuuccaaaggaaag

SEQ ID NO: 7957 - RNA, 19 nt, artificial
  Oligomer
caucuagaggaaauuuuuc

SEQ ID NO: 7958 - RNA, 19 nt, artificial
  Oligomer
caucaucuagaggaaauuu

SEQ ID NO: 7959 - RNA, 19 nt, artificial
  Oligomer
uuguuugguucaccacuga

SEQ ID NO: 7960 - RNA, 19 nt, artificial
  Oligomer
aaacccaaggucaucauca

SEQ ID NO: 7961 - RNA, 19 nt, artificial
  Oligomer
uuguggugagcaaugcuga

SEQ ID NO: 7962 - RNA, 19 nt, artificial
  Oligomer
cacauggugaaguugcuga

SEQ ID NO: 7963 - RNA, 19 nt, artificial
  Oligomer
aucuagaggaaauuuuuca

SEQ ID NO: 7964 - RNA, 19 nt, artificial
  Oligomer
gugcugggauuguuugguu

SEQ ID NO: 7965 - RNA, 19 nt, artificial
  Oligomer
gagaucuacuugaaaaccu

SEQ ID NO: 7966 - RNA, 19 nt, artificial
  Oligomer
guacaugauuucauucugu

SEQ ID NO: 7967 - RNA, 19 nt, artificial
  Oligomer
ucgaaaugguucugaacuu

SEQ ID NO: 7968 - RNA, 19 nt, artificial
  Oligomer
cacugacaguggaaaagcc

SEQ ID NO: 7969 - RNA, 19 nt, artificial
  Oligomer
gguaacaucuguaaugaug

SEQ ID NO: 7970 - RNA, 19 nt, artificial
  Oligomer
guucagauauauccaguga

SEQ ID NO: 7971 - RNA, 19 nt, artificial
  Oligomer
cucauaagaagcaacucag

SEQ ID NO: 7972 - RNA, 19 nt, artificial
  Oligomer
aaaaacagcugaguucaga

SEQ ID NO: 7973 - RNA, 19 nt, artificial
  Oligomer
augucaaaaagaagaaaac

SEQ ID NO: 7974 - RNA, 19 nt, artificial
  Oligomer
ucagugguuauaaaagaga

SEQ ID NO: 7975 - RNA, 19 nt, artificial
  Oligomer
caaagaaaaagagaauuug

SEQ ID NO: 7976 - RNA, 19 nt, artificial
  Oligomer
aaaagguucaacauucauu

SEQ ID NO: 7977 - RNA, 19 nt, artificial
  Oligomer
aaagcaguuauacacgaga

SEQ ID NO: 7978 - RNA, 19 nt, artificial
  Oligomer
uuacaaaggcucaugugga

SEQ ID NO: 7979 - RNA, 19 nt, artificial
  Oligomer
auugcuuucaaaucuucca

SEQ ID NO: 7980 - RNA, 19 nt, artificial
  Oligomer
auaucaacaagcuggucca

SEQ ID NO: 7981 - RNA, 19 nt, artificial
  Oligomer
uuuccauucaggguaauau

SEQ ID NO: 7982 - RNA, 19 nt, artificial
  Oligomer
cugaauggaaucuguggga

SEQ ID NO: 7983 - RNA, 19 nt, artificial
  Oligomer
cuauccaugacacgauauu

SEQ ID NO: 7984 - RNA, 19 nt, artificial
  Oligomer
ucacagcucaggaaaugga

SEQ ID NO: 7985 - RNA, 19 nt, artificial
  Oligomer
aagaaaaagagaauuugag

SEQ ID NO: 7986 - RNA, 19 nt, artificial
  Oligomer
aacaaagaauucaacuauc

SEQ ID NO: 7987 - RNA, 19 nt, artificial
  Oligomer
aaacagcugaguucagaua

SEQ ID NO: 7988 - RNA, 19 nt, artificial
  Oligomer
ccuucugcuuccuauuuuc

SEQ ID NO: 7989 - RNA, 19 nt, artificial
  Oligomer
acgauauuucuaucucuuu

SEQ ID NO: 7990 - RNA, 19 nt, artificial
  Oligomer
cagcacuaaggcaguuugc

SEQ ID NO: 7991 - RNA, 19 nt, artificial
  Oligomer
uagggaacaccuguggaau

SEQ ID NO: 7992 - RNA, 19 nt, artificial
  Oligomer
agagaaucucacagcucag

SEQ ID NO: 7993 - RNA, 19 nt, artificial
  Oligomer
uuaucuacuacuucagaga

SEQ ID NO: 7994 - RNA, 19 nt, artificial
  Oligomer
aaauauuuagggaacaccu

SEQ ID NO: 7995 - RNA, 19 nt, artificial
  Oligomer
acuuuguuaugucaaaaag

SEQ ID NO: 7996 - RNA, 19 nt, artificial
  Oligomer
aaaugguucugaacuugac

SEQ ID NO: 7997 - RNA, 19 nt, artificial
  Oligomer
gaaaccauccaacgguguu

SEQ ID NO: 7998 - RNA, 19 nt, artificial
  Oligomer
cauugaaagacuauccaug

SEQ ID NO: 7999 - RNA, 19 nt, artificial
  Oligomer
ugaaagacuauccaugaca

SEQ ID NO: 8000 - RNA, 19 nt, artificial
  Oligomer
agcacuaaggcaguuugcu

SEQ ID NO: 8001 - RNA, 19 nt, artificial
  Oligomer
ugaaauuuucaacaaccgu

SEQ ID NO: 8002 - RNA, 19 nt, artificial
  Oligomer
gagaaaccauccaacggug

SEQ ID NO: 8003 - RNA, 19 nt, artificial
  Oligomer
gauuugauggaaaauaaug

SEQ ID NO: 8004 - RNA, 19 nt, artificial
  Oligomer
augcugaaaaccugguuga

SEQ ID NO: 8005 - RNA, 19 nt, artificial
  Oligomer
aucacugagacagcucaaa

SEQ ID NO: 8006 - RNA, 19 nt, artificial
  Oligomer
ucaucaucuagaggaaauu

SEQ ID NO: 8007 - RNA, 19 nt, artificial
  Oligomer
uuauaggaaaaugucuaaa

SEQ ID NO: 8008 - RNA, 19 nt, artificial
  Oligomer
aaaaggacuucauugcuuu

SEQ ID NO: 8009 - RNA, 19 nt, artificial
  Oligomer
caugauuucauucuguuca

SEQ ID NO: 8010 - RNA, 19 nt, artificial
  Oligomer
accaucuuugaaauuuuca

SEQ ID NO: 8011 - RNA, 19 nt, artificial
  Oligomer
aucucacagcucaggaaau

SEQ ID NO: 8012 - RNA, 19 nt, artificial
  Oligomer
auuugauggaaaauaaugu

SEQ ID NO: 8013 - RNA, 19 nt, artificial
  Oligomer
cuucauugcuuucaaaucu

SEQ ID NO: 8014 - RNA, 19 nt, artificial
  Oligomer
ucugucuucauuucccaaa

SEQ ID NO: 8015 - RNA, 19 nt, artificial
  Oligomer
uugaucagcaacuucacca

SEQ ID NO: 8016 - RNA, 19 nt, artificial
  Oligomer
uucucuuuuauaaccacug

SEQ ID NO: 8017 - RNA, 19 nt, artificial
  Oligomer
uuuauaaccacugaguauc

SEQ ID NO: 8018 - RNA, 19 nt, artificial
  Oligomer
uaauacauuauuuuccauc

SEQ ID NO: 8019 - RNA, 19 nt, artificial
  Oligomer
uucuuuguugcggauguug

SEQ ID NO: 8020 - RNA, 19 nt, artificial
  Oligomer
uucaaagauggugucaucg

SEQ ID NO: 8021 - RNA, 19 nt, artificial
  Oligomer
uuccucuagaugaugacuc

SEQ ID NO: 8022 - RNA, 19 nt, artificial
  Oligomer
uucuuaugaguuuuaauuc

SEQ ID NO: 8023 - RNA, 19 nt, artificial
  Oligomer
uuugaaagcaaugaagucc

SEQ ID NO: 8024 - RNA, 19 nt, artificial
  Oligomer
ucgauuaugaagauaguug

SEQ ID NO: 8025 - RNA, 19 nt, artificial
  Oligomer
uucaacaggcuugcucucc

SEQ ID NO: 8026 - RNA, 19 nt, artificial
  Oligomer
auaaacaccaggaaugugc

SEQ ID NO: 8027 - RNA, 19 nt, artificial
  Oligomer
uuugucuuucagacucugg

SEQ ID NO: 8028 - RNA, 19 nt, artificial
  Oligomer
uuuuuuggaauuccacagg

SEQ ID NO: 8029 - RNA, 19 nt, artificial
  Oligomer
ugcaugaugaugaccuugg

SEQ ID NO: 8030 - RNA, 19 nt, artificial
  Oligomer
uugaaaauuucaaagaugg

SEQ ID NO: 8031 - RNA, 19 nt, artificial
  Oligomer
uugcaugaugaugaccuug

SEQ ID NO: 8032 - RNA, 19 nt, artificial
  Oligomer
ucccuaaauauuuugccug

SEQ ID NO: 8033 - RNA, 19 nt, artificial
  Oligomer
uuuguugcggauguugagg

SEQ ID NO: 8034 - RNA, 19 nt, artificial
  Oligomer
uugauauuacccugaaugg

SEQ ID NO: 8035 - RNA, 19 nt, artificial
  Oligomer
uuugccugcaguuugagcu

SEQ ID NO: 8036 - RNA, 19 nt, artificial
  Oligomer
uaaaauuagacucugaucu

SEQ ID NO: 8037 - RNA, 19 nt, artificial
  Oligomer
uguaacagcaucauuacag

SEQ ID NO: 8038 - RNA, 19 nt, artificial
  Oligomer
uuguugcggauguugaggc

SEQ ID NO: 8039 - RNA, 19 nt, artificial
  Oligomer
uuuaauucccaggaaagag

SEQ ID NO: 8040 - RNA, 19 nt, artificial
  Oligomer
uuauuuuccaucaaaucau

SEQ ID NO: 8041 - RNA, 19 nt, artificial
  Oligomer
uuagacucugaucucgugu

SEQ ID NO: 8042 - RNA, 19 nt, artificial
  Oligomer
auauuuugccugcaguuug

SEQ ID NO: 8043 - RNA, 19 nt, artificial
  Oligomer
uugaauucuuuguugcgga

SEQ ID NO: 8044 - RNA, 19 nt, artificial
  Oligomer
uucaaguagaucucacauc

SEQ ID NO: 8045 - RNA, 19 nt, artificial
  Oligomer
uuuguuucaugucuccaag

SEQ ID NO: 8046 - RNA, 19 nt, artificial
  Oligomer
uauaagguguaucucaucu

SEQ ID NO: 8047 - RNA, 19 nt, artificial
  Oligomer
uagugcuguuuccauuucc

SEQ ID NO: 8048 - RNA, 19 nt, artificial
  Oligomer
uguuuuuuggaauuccaca

SEQ ID NO: 8049 - RNA, 19 nt, artificial
  Oligomer
agugauaucaucaaccagg

SEQ ID NO: 8050 - RNA, 19 nt, artificial
  Oligomer
uuuugccugcaguuugagc

SEQ ID NO: 8051 - RNA, 19 nt, artificial
  Oligomer
ucaucaaccagguuuucag

SEQ ID NO: 8052 - RNA, 19 nt, artificial
  Oligomer
ucaaguagaucucacaucc

SEQ ID NO: 8053 - RNA, 19 nt, artificial
  Oligomer
auuucgauuaugaagauag

SEQ ID NO: 8054 - RNA, 19 nt, artificial
  Oligomer
uaucgugucauggauaguc

SEQ ID NO: 8055 - RNA, 19 nt, artificial
  Oligomer
uuaugaguuuuaauuccca

SEQ ID NO: 8056 - RNA, 19 nt, artificial
  Oligomer
augaguuuuaauucccagg

SEQ ID NO: 8057 - RNA, 19 nt, artificial
  Oligomer
uuggguuugucuuucagac

SEQ ID NO: 8058 - RNA, 19 nt, artificial
  Oligomer
uaguugaauucuuuguugc

SEQ ID NO: 8059 - RNA, 19 nt, artificial
  Oligomer
uagaaauaucgugucaugg

SEQ ID NO: 8060 - RNA, 19 nt, artificial
  Oligomer
uuccauuuccugagcugug

SEQ ID NO: 8061 - RNA, 19 nt, artificial
  Oligomer
uuaccuugcaagagccgac

SEQ ID NO: 8062 - RNA, 19 nt, artificial
  Oligomer
uuuuccacugucaguggug

SEQ ID NO: 8063 - RNA, 19 nt, artificial
  Oligomer
uaugaguuuuaauucccag

SEQ ID NO: 8064 - RNA, 19 nt, artificial
  Oligomer
uucagcauugcucaccaca

SEQ ID NO: 8065 - RNA, 19 nt, artificial
  Oligomer
uuuuugacauaacaaagug

SEQ ID NO: 8066 - RNA, 19 nt, artificial
  Oligomer
uugaaagcaaugaaguccu

SEQ ID NO: 8067 - RNA, 19 nt, artificial
  Oligomer
uugaucccagugcuugguc

SEQ ID NO: 8068 - RNA, 19 nt, artificial
  Oligomer
ucuuaugaguuuuaauucc

SEQ ID NO: 8069 - RNA, 19 nt, artificial
  Oligomer
auuauuuuccaucaaauca

SEQ ID NO: 8070 - RNA, 19 nt, artificial
  Oligomer
ucuuuuugacauaacaaag

SEQ ID NO: 8071 - RNA, 19 nt, artificial
  Oligomer
uuucaugucuccaagaaac

SEQ ID NO: 8072 - RNA, 19 nt, artificial
  Oligomer
aauuucaacaggcuugcuc

SEQ ID NO: 8073 - RNA, 19 nt, artificial
  Oligomer
uuuggaauuccacaggugu

SEQ ID NO: 8074 - RNA, 19 nt, artificial
  Oligomer
augaugaugaccuuggguu

SEQ ID NO: 8075 - RNA, 19 nt, artificial
  Oligomer
uauaucugaacucagcugu

SEQ ID NO: 8076 - RNA, 19 nt, artificial
  Oligomer
augaguaucugcaccggcu

SEQ ID NO: 8077 - RNA, 19 nt, artificial
  Oligomer
ugucucagugauaucauca

SEQ ID NO: 8078 - RNA, 19 nt, artificial
  Oligomer
auaguugaauucuuuguug

SEQ ID NO: 8079 - RNA, 19 nt, artificial
  Oligomer
uauaacugcuuuccuuugg

SEQ ID NO: 8080 - RNA, 19 nt, artificial
  Oligomer
ugggaaaugaagacagagc

SEQ ID NO: 8081 - RNA, 19 nt, artificial
  Oligomer
uuuuccuauaagguguauc

SEQ ID NO: 8082 - RNA, 19 nt, artificial
  Oligomer
uucagaaccauuucgauua

SEQ ID NO: 8083 - RNA, 19 nt, artificial
  Oligomer
ugcuguuuccauuuccuga

SEQ ID NO: 8084 - RNA, 19 nt, artificial
  Oligomer
auaagguguaucucaucug

SEQ ID NO: 8085 - RNA, 19 nt, artificial
  Oligomer
uuauaaccacugaguaucc

SEQ ID NO: 8086 - RNA, 19 nt, artificial
  Oligomer
ucucaaaugaauguugaac

SEQ ID NO: 8087 - RNA, 19 nt, artificial
  Oligomer
uuuuggaauuccacaggug

SEQ ID NO: 8088 - RNA, 19 nt, artificial
  Oligomer
ugaauguugaaccuuuuga

SEQ ID NO: 8089 - RNA, 19 nt, artificial
  Oligomer
ucuuuguugcggauguuga

SEQ ID NO: 8090 - RNA, 19 nt, artificial
  Oligomer
uucuuuuugacauaacaaa

SEQ ID NO: 8091 - RNA, 19 nt, artificial
  Oligomer
guugaauucuuuguugcgg

SEQ ID NO: 8092 - RNA, 19 nt, artificial
  Oligomer
accaugaguaucugcaccg

SEQ ID NO: 8093 - RNA, 19 nt, artificial
  Oligomer
uuuugaaaaauuuccucua

SEQ ID NO: 8094 - RNA, 19 nt, artificial
  Oligomer
ugaaguaguagauaauuug

SEQ ID NO: 8095 - RNA, 19 nt, artificial
  Oligomer
ucuuuuauaaccacugagu

SEQ ID NO: 8096 - RNA, 19 nt, artificial
  Oligomer
guugauauuacccugaaug

SEQ ID NO: 8097 - RNA, 19 nt, artificial
  Oligomer
aaccuuuugaaaaauuucc

SEQ ID NO: 8098 - RNA, 19 nt, artificial
  Oligomer
ucaaauucucuuuuucuuu

SEQ ID NO: 8099 - RNA, 19 nt, artificial
  Oligomer
cucaaaugaauguugaacc

SEQ ID NO: 8100 - RNA, 19 nt, artificial
  Oligomer
uuaauucccaggaaagaga

SEQ ID NO: 8101 - RNA, 19 nt, artificial
  Oligomer
aucauuacagauguuaccu

SEQ ID NO: 8102 - RNA, 19 nt, artificial
  Oligomer
uaucugcaccggcuuuucc

SEQ ID NO: 8103 - RNA, 19 nt, artificial
  Oligomer
uuuucagcauugcucacca

SEQ ID NO: 8104 - RNA, 19 nt, artificial
  Oligomer
uuaugugguguggaagauu

SEQ ID NO: 8105 - RNA, 19 nt, artificial
  Oligomer
uggaauuccacagguguuc

SEQ ID NO: 8106 - RNA, 19 nt, artificial
  Oligomer
ucuagaaaggucuugauca

SEQ ID NO: 8107 - RNA, 19 nt, artificial
  Oligomer
cucagugauaucaucaacc

SEQ ID NO: 8108 - RNA, 19 nt, artificial
  Oligomer
uugcucaccacaaacuuua

SEQ ID NO: 8109 - RNA, 19 nt, artificial
  Oligomer
uagucuuucaauggugggc

SEQ ID NO: 8110 - RNA, 19 nt, artificial
  Oligomer
uguauaacugcuuuccuuu

SEQ ID NO: 8111 - RNA, 19 nt, artificial
  Oligomer
uucccuaaauauuuugccu

SEQ ID NO: 8112 - RNA, 19 nt, artificial
  Oligomer
auuugggaaaugaagacag

SEQ ID NO: 8113 - RNA, 19 nt, artificial
  Oligomer
ucaucgugaagaacaucug

SEQ ID NO: 8114 - RNA, 19 nt, artificial
  Oligomer
aagauaguugaauucuuug

SEQ ID NO: 8115 - RNA, 19 nt, artificial
  Oligomer
auaaaauuagacucugauc

SEQ ID NO: 8116 - RNA, 19 nt, artificial
  Oligomer
uuucaauggugggcagcug

SEQ ID NO: 8117 - RNA, 19 nt, artificial
  Oligomer
uuagacauuuuccuauaag

SEQ ID NO: 8118 - RNA, 19 nt, artificial
  Oligomer
uguucgccucucuuucucc

SEQ ID NO: 8119 - RNA, 19 nt, artificial
  Oligomer
uuuccuuuggaaaauagga

SEQ ID NO: 8120 - RNA, 19 nt, artificial
  Oligomer
uguuaccuugcaagagccg

SEQ ID NO: 8121 - RNA, 19 nt, artificial
  Oligomer
uuccacaugagccuuugua

SEQ ID NO: 8122 - RNA, 19 nt, artificial
  Oligomer
auguucgccucucuuucuc

SEQ ID NO: 8123 - RNA, 19 nt, artificial
  Oligomer
ucucuuucuccaucacugg

SEQ ID NO: 8124 - RNA, 19 nt, artificial
  Oligomer
ucuugaucccagugcuugg

SEQ ID NO: 8125 - RNA, 19 nt, artificial
  Oligomer
uuacgguuguugaaaauuu

SEQ ID NO: 8126 - RNA, 19 nt, artificial
  Oligomer
uuugaaaaauuuccucuag

SEQ ID NO: 8127 - RNA, 19 nt, artificial
  Oligomer
augaauguugaaccuuuug

SEQ ID NO: 8128 - RNA, 19 nt, artificial
  Oligomer
uguucccuaaauauuuugc

SEQ ID NO: 8129 - RNA, 19 nt, artificial
  Oligomer
uaugugguguggaagauuu

SEQ ID NO: 8130 - RNA, 19 nt, artificial
  Oligomer
uugcucuccucucagugga

SEQ ID NO: 8131 - RNA, 19 nt, artificial
  Oligomer
uuuuccacaugagccuuug

SEQ ID NO: 8132 - RNA, 19 nt, artificial
  Oligomer
uaaauauuuugccugcagu

SEQ ID NO: 8133 - RNA, 19 nt, artificial
  Oligomer
uuuccuauaagguguaucu

SEQ ID NO: 8134 - RNA, 19 nt, artificial
  Oligomer
aacaauuucaacaggcuug

SEQ ID NO: 8135 - RNA, 19 nt, artificial
  Oligomer
ucuuucuccaucacuggau

SEQ ID NO: 8136 - RNA, 19 nt, artificial
  Oligomer
uccuuuuccacaugagccu

SEQ ID NO: 8137 - RNA, 19 nt, artificial
  Oligomer
uugaaaaauuuccucuaga

SEQ ID NO: 8138 - RNA, 19 nt, artificial
  Oligomer
aaguaguagauaauuuggg

SEQ ID NO: 8139 - RNA, 19 nt, artificial
  Oligomer
ugugaaagcaaaaacaauu

SEQ ID NO: 8140 - RNA, 19 nt, artificial
  Oligomer
ucaguggaccagcuuguug

SEQ ID NO: 8141 - RNA, 19 nt, artificial
  Oligomer
uuuuuggaauuccacaggu

SEQ ID NO: 8142 - RNA, 19 nt, artificial
  Oligomer
uuuucaaguagaucucaca

SEQ ID NO: 8143 - RNA, 19 nt, artificial
  Oligomer
auaauuugggaaaugaaga

SEQ ID NO: 8144 - RNA, 19 nt, artificial
  Oligomer
uccaagaaacauuaugugg

SEQ ID NO: 8145 - RNA, 19 nt, artificial
  Oligomer
uuucaaguagaucucacau

SEQ ID NO: 8146 - RNA, 19 nt, artificial
  Oligomer
uucaccauguggaccagaa

SEQ ID NO: 8147 - RNA, 19 nt, artificial
  Oligomer
auucucuuuuauaaccacu

SEQ ID NO: 8148 - RNA, 19 nt, artificial
  Oligomer
auggauagucuuucaaugg

SEQ ID NO: 8149 - RNA, 19 nt, artificial
  Oligomer
uugggaaaugaagacagag

SEQ ID NO: 8150 - RNA, 19 nt, artificial
  Oligomer
uuccuauaagguguaucuc

SEQ ID NO: 8151 - RNA, 19 nt, artificial
  Oligomer
auuacagauguuaccuugc

SEQ ID NO: 8152 - RNA, 19 nt, artificial
  Oligomer
uuaugaagauaguugaauu

SEQ ID NO: 8153 - RNA, 19 nt, artificial
  Oligomer
uucuucuuuuugacauaac

SEQ ID NO: 8154 - RNA, 19 nt, artificial
  Oligomer
cuuaugaguuuuaauuccc

SEQ ID NO: 8155 - RNA, 19 nt, artificial
  Oligomer
aucugcaccggcuuuucca

SEQ ID NO: 8156 - RNA, 19 nt, artificial
  Oligomer
uucaggaugcuaugugaca

SEQ ID NO: 8157 - RNA, 19 nt, artificial
  Oligomer
auauaucugaacucagcug

SEQ ID NO: 8158 - RNA, 19 nt, artificial
  Oligomer
uuagugcuguuuccauuuc

SEQ ID NO: 8159 - RNA, 19 nt, artificial
  Oligomer
uuccugagcugugagauuc

SEQ ID NO: 8160 - RNA, 19 nt, artificial
  Oligomer
uagacauuuuccuauaagg

SEQ ID NO: 8161 - RNA, 19 nt, artificial
  Oligomer
aacuucaccauguggacca

SEQ ID NO: 8162 - RNA, 19 nt, artificial
  Oligomer
uaugaagauaguugaauuc

SEQ ID NO: 8163 - RNA, 19 nt, artificial
  Oligomer
uagaaaggucuugaucagc

SEQ ID NO: 8164 - RNA, 19 nt, artificial
  Oligomer
auuucaacaggcuugcucu

SEQ ID NO: 8165 - RNA, 19 nt, artificial
  Oligomer
aguugaauucuuuguugcg

SEQ ID NO: 8166 - RNA, 19 nt, artificial
  Oligomer
aaaauuucaaagauggugu

SEQ ID NO: 8167 - RNA, 19 nt, artificial
  Oligomer
uuccuuuggaaaauaggaa

SEQ ID NO: 8168 - RNA, 19 nt, artificial
  Oligomer
ucuagaugaugacuccaag

SEQ ID NO: 8169 - RNA, 19 nt, artificial
  Oligomer
uuacccugaauggaaaauu

SEQ ID NO: 8170 - RNA, 19 nt, artificial
  Oligomer
cucucuuucuccaucacug

SEQ ID NO: 8171 - RNA, 19 nt, artificial
  Oligomer
uuuccauuuccugagcugu

SEQ ID NO: 8172 - RNA, 19 nt, artificial
  Oligomer
auguggaccagaacaccgu

SEQ ID NO: 8173 - RNA, 19 nt, artificial
  Oligomer
aaugaaguccuuuuccaca

SEQ ID NO: 8174 - RNA, 19 nt, artificial
  Oligomer
uccuauaagguguaucuca

SEQ ID NO: 8175 - RNA, 19 nt, artificial
  Oligomer
aaucccagcaccauugccu

SEQ ID NO: 8176 - RNA, 19 nt, artificial
  Oligomer
uugccugcaguuugagcug

SEQ ID NO: 8177 - RNA, 19 nt, artificial
  Oligomer
uuggaaaauaggaagcaga

SEQ ID NO: 8178 - RNA, 19 nt, artificial
  Oligomer
aagguuuucaaguagaucu

SEQ ID NO: 8179 - RNA, 19 nt, artificial
  Oligomer
uuugacauaacaaagugaa

SEQ ID NO: 8180 - RNA, 19 nt, artificial
  Oligomer
uggugaaccaaacaauccc

SEQ ID NO: 8181 - RNA, 19 nt, artificial
  Oligomer
aucaucaaccagguuuuca

SEQ ID NO: 8182 - RNA, 19 nt, artificial
  Oligomer
uuggaugguuucucaucag

SEQ ID NO: 8183 - RNA, 19 nt, artificial
  Oligomer
aaaaauuuccucuagauga

SEQ ID NO: 8184 - RNA, 19 nt, artificial
  Oligomer
ugcuuggucccacagauuc

SEQ ID NO: 8185 - RNA, 19 nt, artificial
  Oligomer
uuggaauuccacagguguu

SEQ ID NO: 8186 - RNA, 19 nt, artificial
  Oligomer
augaccuuggguuugucuu

SEQ ID NO: 8187 - RNA, 19 nt, artificial
  Oligomer
cuguuuuuuggaauuccac

SEQ ID NO: 8188 - RNA, 19 nt, artificial
  Oligomer
auguuaccuugcaagagcc

SEQ ID NO: 8189 - RNA, 19 nt, artificial
  Oligomer
uucgauuaugaagauaguu

SEQ ID NO: 8190 - RNA, 19 nt, artificial
  Oligomer
uuuuccaucaaaucaucaa

SEQ ID NO: 8191 - RNA, 19 nt, artificial
  Oligomer
ugaguauccaagguuuuca

SEQ ID NO: 8192 - RNA, 19 nt, artificial
  Oligomer
uuuuauaaccacugaguau

SEQ ID NO: 8193 - RNA, 19 nt, artificial
  Oligomer
aacagcaucauuacagaug

SEQ ID NO: 8194 - RNA, 19 nt, artificial
  Oligomer
ugccuuagugcuguuucca

SEQ ID NO: 8195 - RNA, 19 nt, artificial
  Oligomer
uccaucacuggauauaucu

SEQ ID NO: 8196 - RNA, 19 nt, artificial
  Oligomer
uauuuuccaucaaaucauc

SEQ ID NO: 8197 - RNA, 19 nt, artificial
  Oligomer
uucccaguccucaaauucu

SEQ ID NO: 8198 - RNA, 19 nt, artificial
  Oligomer
uggaaaauucccaguccuc

SEQ ID NO: 8199 - RNA, 19 nt, artificial
  Oligomer
uggaugguuucucaucagc

SEQ ID NO: 8200 - RNA, 19 nt, artificial
  Oligomer
uaaccacugaguauccaag

SEQ ID NO: 8201 - RNA, 19 nt, artificial
  Oligomer
guccuuuuccacaugagcc

SEQ ID NO: 8202 - RNA, 19 nt, artificial
  Oligomer
ucaacaggcuugcucuccu

SEQ ID NO: 8203 - RNA, 19 nt, artificial
  Oligomer
aacaaucccagcaccauug

SEQ ID NO: 8204 - RNA, 19 nt, artificial
  Oligomer
ucucaguggaccagcuugu

SEQ ID NO: 8205 - RNA, 19 nt, artificial
  Oligomer
auuuguuucaugucuccaa

SEQ ID NO: 8206 - RNA, 19 nt, artificial
  Oligomer
guuuuuuggaauuccacag

SEQ ID NO: 8207 - RNA, 19 nt, artificial
  Oligomer
uuucaacaggcuugcucuc

SEQ ID NO: 8208 - RNA, 19 nt, artificial
  Oligomer
aauuagacucugaucucgu

SEQ ID NO: 8209 - RNA, 19 nt, artificial
  Oligomer
cugaauggaaaauucccag

SEQ ID NO: 8210 - RNA, 19 nt, artificial
  Oligomer
uuuguaacagcaucauuac

SEQ ID NO: 8211 - RNA, 19 nt, artificial
  Oligomer
ugcuaugugacauaaacac

SEQ ID NO: 8212 - RNA, 19 nt, artificial
  Oligomer
ucguguauaacugcuuucc

SEQ ID NO: 8213 - RNA, 19 nt, artificial
  Oligomer
uaauuugggaaaugaagac

SEQ ID NO: 8214 - RNA, 19 nt, artificial
  Oligomer
agcugggucaguauauuug

SEQ ID NO: 8215 - RNA, 19 nt, artificial
  Oligomer
agcaacuucaccaugugga

SEQ ID NO: 8216 - RNA, 19 nt, artificial
  Oligomer
uacgguuguugaaaauuuc

SEQ ID NO: 8217 - RNA, 19 nt, artificial
  Oligomer
cagguuuucagcauugcuc

SEQ ID NO: 8218 - RNA, 19 nt, artificial
  Oligomer
cuuuugaaaaauuuccucu

SEQ ID NO: 8219 - RNA, 19 nt, artificial
  Oligomer
uuucaaagauggugucauc

SEQ ID NO: 8220 - RNA, 19 nt, artificial
  Oligomer
uuuugacauaacaaaguga

SEQ ID NO: 8221 - RNA, 19 nt, artificial
  Oligomer
auuaugaagauaguugaau

SEQ ID NO: 8222 - RNA, 19 nt, artificial
  Oligomer
uccuuuggaaaauaggaag

SEQ ID NO: 8223 - RNA, 19 nt, artificial
  Oligomer
aagagauagaaauaucgug

SEQ ID NO: 8224 - RNA, 19 nt, artificial
  Oligomer
acccugaauggaaaauucc

SEQ ID NO: 8225 - RNA, 19 nt, artificial
  Oligomer
uuacagauguuaccuugca

SEQ ID NO: 8226 - RNA, 19 nt, artificial
  Oligomer
uuguugaaaauuucaaaga

SEQ ID NO: 8227 - RNA, 19 nt, artificial
  Oligomer
gucaucgugaagaacaucu

SEQ ID NO: 8228 - RNA, 19 nt, artificial
  Oligomer
acagauuccauucaggaug

SEQ ID NO: 8229 - RNA, 19 nt, artificial
  Oligomer
ucugaucucguguauaacu

SEQ ID NO: 8230 - RNA, 19 nt, artificial
  Oligomer
uggauauaucugaacucag

SEQ ID NO: 8231 - RNA, 19 nt, artificial
  Oligomer
aaauuagacucugaucucg

SEQ ID NO: 8232 - RNA, 19 nt, artificial
  Oligomer
ugcaguuugagcugucuca

SEQ ID NO: 8233 - RNA, 19 nt, artificial
  Oligomer
augaagauaguugaauucu

SEQ ID NO: 8234 - RNA, 19 nt, artificial
  Oligomer
uguuuucuucuuuuugaca

SEQ ID NO: 8235 - RNA, 19 nt, artificial
  Oligomer
agcuuguugauauuacccu

SEQ ID NO: 8236 - RNA, 19 nt, artificial
  Oligomer
ucaaagauggugucaucgu

SEQ ID NO: 8237 - RNA, 19 nt, artificial
  Oligomer
uuccauucaggaugcuaug

SEQ ID NO: 8238 - RNA, 19 nt, artificial
  Oligomer
ucuccaagaaacauuaugu

SEQ ID NO: 8239 - RNA, 19 nt, artificial
  Oligomer
ugugacauaaacaccagga

SEQ ID NO: 8240 - RNA, 19 nt, artificial
  Oligomer
ucauuacagauguuaccuu

SEQ ID NO: 8241 - RNA, 19 nt, artificial
  Oligomer
ucuuucaauggugggcagc

SEQ ID NO: 8242 - RNA, 19 nt, artificial
  Oligomer
aucuagaaaggucuugauc

SEQ ID NO: 8243 - RNA, 19 nt, artificial
  Oligomer
uucgccucucuuucuccau

SEQ ID NO: 8244 - RNA, 19 nt, artificial
  Oligomer
cuucuuaugaguuuuaauu

SEQ ID NO: 8245 - RNA, 19 nt, artificial
  Oligomer
ucccaguccucaaauucuc

SEQ ID NO: 8246 - RNA, 19 nt, artificial
  Oligomer
aaaugaauguugaaccuuu

SEQ ID NO: 8247 - RNA, 19 nt, artificial
  Oligomer
uuuuaauucccaggaaaga

SEQ ID NO: 8248 - RNA, 19 nt, artificial
  Oligomer
ucuucuuuuugacauaaca

SEQ ID NO: 8249 - RNA, 19 nt, artificial
  Oligomer
acaaacuuuagacauuuuc

SEQ ID NO: 8250 - RNA, 19 nt, artificial
  Oligomer
accuuuugaaaaauuuccu

SEQ ID NO: 8251 - RNA, 19 nt, artificial
  Oligomer
uaacaaagugaacagaaug

SEQ ID NO: 8252 - RNA, 19 nt, artificial
  Oligomer
auucccaggaaagagauag

SEQ ID NO: 8253 - RNA, 19 nt, artificial
  Oligomer
uaucucaucuguauuuaau

SEQ ID NO: 8254 - RNA, 19 nt, artificial
  Oligomer
gugcuguuuccauuuccug

SEQ ID NO: 8255 - RNA, 19 nt, artificial
  Oligomer
uuuccaucaaaucaucaaa

SEQ ID NO: 8256 - RNA, 19 nt, artificial
  Oligomer
guuuucagcauugcucacc

SEQ ID NO: 8257 - RNA, 19 nt, artificial
  Oligomer
augugguguggaagauuug

SEQ ID NO: 8258 - RNA, 19 nt, artificial
  Oligomer
auguugaaccuuuugaaaa

SEQ ID NO: 8259 - RNA, 19 nt, artificial
  Oligomer
aucaaccagguuuucagca

SEQ ID NO: 8260 - RNA, 19 nt, artificial
  Oligomer
ugaguaucugcaccggcuu

SEQ ID NO: 8261 - RNA, 19 nt, artificial
  Oligomer
ugaguuuuaauucccagga

SEQ ID NO: 8262 - RNA, 19 nt, artificial
  Oligomer
augaaguccuuuuccacau

SEQ ID NO: 8263 - RNA, 19 nt, artificial
  Oligomer
ucuugaucagcaacuucac

SEQ ID NO: 8264 - RNA, 19 nt, artificial
  Oligomer
acagauguuaccuugcaag

SEQ ID NO: 8265 - RNA, 19 nt, artificial
  Oligomer
uacccugaauggaaaauuc

SEQ ID NO: 8266 - RNA, 19 nt, artificial
  Oligomer
agagauagaaauaucgugu

SEQ ID NO: 8267 - RNA, 19 nt, artificial
  Oligomer
uucaugucuccaagaaaca

SEQ ID NO: 8268 - RNA, 19 nt, artificial
  Oligomer
acuuuagacauuuuccuau

SEQ ID NO: 8269 - RNA, 19 nt, artificial
  Oligomer
ugacauaacaaagugaaca

SEQ ID NO: 8270 - RNA, 19 nt, artificial
  Oligomer
auuuuccaucaaaucauca

SEQ ID NO: 8271 - RNA, 19 nt, artificial
  Oligomer
ugagcugugagauucucuu

SEQ ID NO: 8272 - RNA, 19 nt, artificial
  Oligomer
accauguggaccagaacac

SEQ ID NO: 8273 - RNA, 19 nt, artificial
  Oligomer
aguuugagcugucucagug

SEQ ID NO: 8274 - RNA, 19 nt, artificial
  Oligomer
auuagacucugaucucgug

SEQ ID NO: 8275 - RNA, 19 nt, artificial
  Oligomer
augugacauaaacaccagg

SEQ ID NO: 8276 - RNA, 19 nt, artificial
  Oligomer
accagaacaccguuggaug

SEQ ID NO: 8277 - RNA, 19 nt, artificial
  Oligomer
ugaacucagcuguuuuuug

SEQ ID NO: 8278 - RNA, 19 nt, artificial
  Oligomer
agcaaugaaguccuuuucc

SEQ ID NO: 8279 - RNA, 19 nt, artificial
  Oligomer
aaacuuuagacauuuuccu

SEQ ID NO: 8280 - RNA, 19 nt, artificial
  Oligomer
uugcuucuuaugaguuuua

SEQ ID NO: 8281 - RNA, 19 nt, artificial
  Oligomer
ugaaccaaacaaucccagc

SEQ ID NO: 8282 - RNA, 19 nt, artificial
  Oligomer
uuuggaaaauaggaagcag

SEQ ID NO: 8283 - RNA, 19 nt, artificial
  Oligomer
ucucagugauaucaucaac

SEQ ID NO: 8284 - RNA, 19 nt, artificial
  Oligomer
uugagcugucucagugaua

SEQ ID NO: 8285 - RNA, 19 nt, artificial
  Oligomer
ucauggauagucuuucaau

SEQ ID NO: 8286 - RNA, 19 nt, artificial
  Oligomer
aucagcaacuucaccaugu

SEQ ID NO: 8287 - RNA, 19 nt, artificial
  Oligomer
uauuuugccugcaguuuga

SEQ ID NO: 8288 - RNA, 19 nt, artificial
  Oligomer
aauucucuuuuucuuugcc

SEQ ID NO: 8289 - RNA, 19 nt, artificial
  Oligomer
uaagguguaucucaucugu

SEQ ID NO: 8290 - RNA, 19 nt, artificial
  Oligomer
aucaaaucaucaaaaaugc

SEQ ID NO: 8291 - RNA, 19 nt, artificial
  Oligomer
uugcaagagccgaccauga

SEQ ID NO: 8292 - RNA, 19 nt, artificial
  Oligomer
uacauuauuuuccaucaaa

SEQ ID NO: 8293 - RNA, 19 nt, artificial
  Oligomer
auagucuuucaaugguggg

SEQ ID NO: 8294 - RNA, 19 nt, artificial
  Oligomer
uuuccucuagaugaugacu

SEQ ID NO: 8295 - RNA, 19 nt, artificial
  Oligomer
uuccacagguguucccuaa

SEQ ID NO: 8296 - RNA, 19 nt, artificial
  Oligomer
uugaaccuuuugaaaaauu

SEQ ID NO: 8297 - RNA, 19 nt, artificial
  Oligomer
ugaagauaguugaauucuu

SEQ ID NO: 8298 - RNA, 19 nt, artificial
  Oligomer
auacucucugaaguaguag

SEQ ID NO: 8299 - RNA, 19 nt, artificial
  Oligomer
aauauuuugccugcaguuu

SEQ ID NO: 8300 - RNA, 19 nt, artificial
  Oligomer
aaaaacaauuucaacaggc

SEQ ID NO: 8301 - RNA, 19 nt, artificial
  Oligomer
auuccauucaggaugcuau

SEQ ID NO: 8302 - RNA, 19 nt, artificial
  Oligomer
uuccaucaaaucaucaaaa

SEQ ID NO: 8303 - RNA, 19 nt, artificial
  Oligomer
ugaauggaaaauucccagu

SEQ ID NO: 8304 - RNA, 19 nt, artificial
  Oligomer
ucucaucuguauuuaauac

SEQ ID NO: 8305 - RNA, 19 nt, artificial
  Oligomer
auucaggaugcuaugugac

SEQ ID NO: 8306 - RNA, 19 nt, artificial
  Oligomer
acugccuuagugcuguuuc

SEQ ID NO: 8307 - RNA, 19 nt, artificial
  Oligomer
ucgccucucuuucuccauc

SEQ ID NO: 8308 - RNA, 19 nt, artificial
  Oligomer
uuucuucuuuuugacauaa

SEQ ID NO: 8309 - RNA, 19 nt, artificial
  Oligomer
cuuagugcuguuuccauuu

SEQ ID NO: 8310 - RNA, 19 nt, artificial
  Oligomer
ucaaaucaucaaaaaugcc

SEQ ID NO: 8311 - RNA, 19 nt, artificial
  Oligomer
cuaugugacauaaacacca

SEQ ID NO: 8312 - RNA, 19 nt, artificial
  Oligomer
ggaugguuucucaucagcc

SEQ ID NO: 8313 - RNA, 19 nt, artificial
  Oligomer
aaauucucuuuuucuuugc

SEQ ID NO: 8314 - RNA, 19 nt, artificial
  Oligomer
uagauaauuugggaaauga

SEQ ID NO: 8315 - RNA, 19 nt, artificial
  Oligomer
acuccaagaauacucucug

SEQ ID NO: 8316 - RNA, 19 nt, artificial
  Oligomer
aucgugucauggauagucu

SEQ ID NO: 8317 - RNA, 19 nt, artificial
  Oligomer
uaugugacauaaacaccag

SEQ ID NO: 8318 - RNA, 19 nt, artificial
  Oligomer
uuuucuucuuuuugacaua

SEQ ID NO: 8319 - RNA, 19 nt, artificial
  Oligomer
auucccaguccucaaauuc

SEQ ID NO: 8320 - RNA, 19 nt, artificial
  Oligomer
agcaaaaacaauuucaaca

SEQ ID NO: 8321 - RNA, 19 nt, artificial
  Oligomer
aaagauggugucaucguga

SEQ ID NO: 8322 - RNA, 19 nt, artificial
  Oligomer
aaggucuugaucagcaacu

SEQ ID NO: 8323 - RNA, 19 nt, artificial
  Oligomer
gucuugaucagcaacuuca

SEQ ID NO: 8324 - RNA, 19 nt, artificial
  Oligomer
ugauauuacccugaaugga

SEQ ID NO: 8325 - RNA, 19 nt, artificial
  Oligomer
aaccauuucgauuaugaag

SEQ ID NO: 8326 - RNA, 19 nt, artificial
  Oligomer
gcuugcaugaugaugaccu

SEQ ID NO: 8327 - RNA, 19 nt, artificial
  Oligomer
cagcuuguugauauuaccc

SEQ ID NO: 8328 - RNA, 19 nt, artificial
  Oligomer
guucccuaaauauuuugcc

SEQ ID NO: 8329 - RNA, 19 nt, artificial
  Oligomer
cuuuguaacagcaucauua

SEQ ID NO: 8330 - RNA, 19 nt, artificial
  Oligomer
agguguuuucuucuuuuug

SEQ ID NO: 8331 - RNA, 19 nt, artificial
  Oligomer
aguaucugcaccggcuuuu

SEQ ID NO: 8332 - RNA, 19 nt, artificial
  Oligomer
cucuugaucccagugcuug

SEQ ID NO: 8333 - RNA, 19 nt, artificial
  Oligomer
accaggaaugugcugucug

SEQ ID NO: 8334 - RNA, 19 nt, artificial
  Oligomer
cuaaauauuuugccugcag

SEQ ID NO: 8335 - RNA, 19 nt, artificial
  Oligomer
augugcugucugaggacug

SEQ ID NO: 8336 - RNA, 19 nt, artificial
  Oligomer
uugacauaacaaagugaac

SEQ ID NO: 8337 - RNA, 19 nt, artificial
  Oligomer
agcuguuuuuuggaauucc

SEQ ID NO: 8338 - RNA, 19 nt, artificial
  Oligomer
caaacuuuagacauuuucc

SEQ ID NO: 8339 - RNA, 19 nt, artificial
  Oligomer
ucugaaguaguagauaauu

SEQ ID NO: 8340 - RNA, 19 nt, artificial
  Oligomer
accauuucgauuaugaaga

SEQ ID NO: 8341 - RNA, 19 nt, artificial
  Oligomer
uuguugauauuacccugaa

SEQ ID NO: 8342 - RNA, 19 nt, artificial
  Oligomer
uagaugaugacuccaagaa

SEQ ID NO: 8343 - RNA, 19 nt, artificial
  Oligomer
cuauaagguguaucucauc

SEQ ID NO: 8344 - RNA, 19 nt, artificial
  Oligomer
cucuuuuauaaccacugag

SEQ ID NO: 8345 - RNA, 19 nt, artificial
  Oligomer
cauuacagauguuaccuug

SEQ ID NO: 8346 - RNA, 19 nt, artificial
  Oligomer
agauaguugaauucuuugu

SEQ ID NO: 8347 - RNA, 19 nt, artificial
  Oligomer
acauuaugugguguggaag

SEQ ID NO: 8348 - RNA, 19 nt, artificial
  Oligomer
uccacugucaguggugaac

SEQ ID NO: 8349 - RNA, 19 nt, artificial
  Oligomer
uuguuucaugucuccaaga

SEQ ID NO: 8350 - RNA, 19 nt, artificial
  Oligomer
agaaacauuauguggugug

SEQ ID NO: 8351 - RNA, 19 nt, artificial
  Oligomer
ugagauucucuuuuauaac

SEQ ID NO: 8352 - RNA, 19 nt, artificial
  Oligomer
aauuccacagguguucccu

SEQ ID NO: 8353 - RNA, 19 nt, artificial
  Oligomer
uacagauguuaccuugcaa

SEQ ID NO: 8354 - RNA, 19 nt, artificial
  Oligomer
ucaccauguggaccagaac

SEQ ID NO: 8355 - RNA, 19 nt, artificial
  Oligomer
aacaggcuugcucuccucu

SEQ ID NO: 8356 - RNA, 19 nt, artificial
  Oligomer
aggaaugugcugucugagg

SEQ ID NO: 8357 - RNA, 19 nt, artificial
  Oligomer
uaguagauaauuugggaaa

SEQ ID NO: 8358 - RNA, 19 nt, artificial
  Oligomer
ugugguguggaagauuuga

SEQ ID NO: 8359 - RNA, 19 nt, artificial
  Oligomer
aaauauuuugccugcaguu

SEQ ID NO: 8360 - RNA, 19 nt, artificial
  Oligomer
aucugaacucagcuguuuu

SEQ ID NO: 8361 - RNA, 19 nt, artificial
  Oligomer
cugaucucguguauaacug

SEQ ID NO: 8362 - RNA, 19 nt, artificial
  Oligomer
ucaaguucagaaccauuuc

SEQ ID NO: 8363 - RNA, 19 nt, artificial
  Oligomer
uccaagaauacucucugaa

SEQ ID NO: 8364 - RNA, 19 nt, artificial
  Oligomer
gaaaauuucaaagauggug

SEQ ID NO: 8365 - RNA, 19 nt, artificial
  Oligomer
auagaaauaucgugucaug

SEQ ID NO: 8366 - RNA, 19 nt, artificial
  Oligomer
ucaucuguauuuaauacau

SEQ ID NO: 8367 - RNA, 19 nt, artificial
  Oligomer
uccucuagaugaugacucc

SEQ ID NO: 8368 - RNA, 19 nt, artificial
  Oligomer
aacuuuagacauuuuccua

SEQ ID NO: 8369 - RNA, 19 nt, artificial
  Oligomer
auaucaucaaccagguuuu

SEQ ID NO: 8370 - RNA, 19 nt, artificial
  Oligomer
gaugacuccaagaauacuc

SEQ ID NO: 8371 - RNA, 19 nt, artificial
  Oligomer
aauacauuauuuuccauca

SEQ ID NO: 8372 - RNA, 19 nt, artificial
  Oligomer
aucucguguauaacugcuu

SEQ ID NO: 8373 - RNA, 19 nt, artificial
  Oligomer
auuucaaagauggugucau

SEQ ID NO: 8374 - RNA, 19 nt, artificial
  Oligomer
uggauagucuuucaauggu

SEQ ID NO: 8375 - RNA, 19 nt, artificial
  Oligomer
gauaucaucaaccagguuu

SEQ ID NO: 8376 - RNA, 19 nt, artificial
  Oligomer
ccuuagugcuguuuccauu

SEQ ID NO: 8377 - RNA, 19 nt, artificial
  Oligomer
aacaccaggaaugugcugu

SEQ ID NO: 8378 - RNA, 19 nt, artificial
  Oligomer
uggguuugucuuucagacu

SEQ ID NO: 8379 - RNA, 19 nt, artificial
  Oligomer
aguccuuuuccacaugagc

SEQ ID NO: 8380 - RNA, 19 nt, artificial
  Oligomer
accagcuuguugauauuac

SEQ ID NO: 8381 - RNA, 19 nt, artificial
  Oligomer
uccaagguuuucaaguaga

SEQ ID NO: 8382 - RNA, 19 nt, artificial
  Oligomer
gauaauuugggaaaugaag

SEQ ID NO: 8383 - RNA, 19 nt, artificial
  Oligomer
aaacaaucccagcaccauu

SEQ ID NO: 8384 - RNA, 19 nt, artificial
  Oligomer
acaauuucaacaggcuugc

SEQ ID NO: 8385 - RNA, 19 nt, artificial
  Oligomer
guuguugaaaauuucaaag

SEQ ID NO: 8386 - RNA, 19 nt, artificial
  Oligomer
ugaguugcuucuuaugagu

SEQ ID NO: 8387 - RNA, 19 nt, artificial
  Oligomer
gugucauggauagucuuuc

SEQ ID NO: 8388 - RNA, 19 nt, artificial
  Oligomer
aaaauuagacucugaucuc

SEQ ID NO: 8389 - RNA, 19 nt, artificial
  Oligomer
ugucaucgugaagaacauc

SEQ ID NO: 8390 - RNA, 19 nt, artificial
  Oligomer
ccuuuugaaaaauuuccuc

SEQ ID NO: 8391 - RNA, 19 nt, artificial
  Oligomer
agugcuguuuccauuuccu

SEQ ID NO: 8392 - RNA, 19 nt, artificial
  Oligomer
aagcaaugaaguccuuuuc

SEQ ID NO: 8393 - RNA, 19 nt, artificial
  Oligomer
cccugaauggaaaauuccc

SEQ ID NO: 8394 - RNA, 19 nt, artificial
  Oligomer
guuggaugguuucucauca

SEQ ID NO: 8395 - RNA, 19 nt, artificial
  Oligomer
agucuuucaauggugggca

SEQ ID NO: 8396 - RNA, 19 nt, artificial
  Oligomer
acauuuuccuauaaggugu

SEQ ID NO: 8397 - RNA, 19 nt, artificial
  Oligomer
aucucaucuguauuuaaua

SEQ ID NO: 8398 - RNA, 19 nt, artificial
  Oligomer
caucaaaucaucaaaaaug

SEQ ID NO: 8399 - RNA, 19 nt, artificial
  Oligomer
aggcauguucgccucucuu

SEQ ID NO: 8400 - RNA, 19 nt, artificial
  Oligomer
uuguaacagcaucauuaca

SEQ ID NO: 8401 - RNA, 19 nt, artificial
  Oligomer
auccaagguuuucaaguag

SEQ ID NO: 8402 - RNA, 19 nt, artificial
  Oligomer
augcuaugugacauaaaca

SEQ ID NO: 8403 - RNA, 19 nt, artificial
  Oligomer
gaaagagauagaaauaucg

SEQ ID NO: 8404 - RNA, 19 nt, artificial
  Oligomer
uucuccaucacuggauaua

SEQ ID NO: 8405 - RNA, 19 nt, artificial
  Oligomer
cucaucuguauuuaauaca

SEQ ID NO: 8406 - RNA, 19 nt, artificial
  Oligomer
aauucuuuguugcggaugu

SEQ ID NO: 8407 - RNA, 19 nt, artificial
  Oligomer
ugucaguggugaaccaaac

SEQ ID NO: 8408 - RNA, 19 nt, artificial
  Oligomer
cugcaguuugagcugucuc

SEQ ID NO: 8409 - RNA, 19 nt, artificial
  Oligomer
uguuuccauuuccugagcu

SEQ ID NO: 8410 - RNA, 19 nt, artificial
  Oligomer
ucaaaugaauguugaaccu

SEQ ID NO: 8411 - RNA, 19 nt, artificial
  Oligomer
uccucaaauucucuuuuuc

SEQ ID NO: 8412 - RNA, 19 nt, artificial
  Oligomer
uuucagcauugcucaccac

SEQ ID NO: 8413 - RNA, 19 nt, artificial
  Oligomer
aaccagguuuucagcauug

SEQ ID NO: 8414 - RNA, 19 nt, artificial
  Oligomer
ugaaccuuuugaaaaauuu

SEQ ID NO: 8415 - RNA, 19 nt, artificial
  Oligomer
uuucgauuaugaagauagu

SEQ ID NO: 8416 - RNA, 19 nt, artificial
  Oligomer
aaccacugaguauccaagg

SEQ ID NO: 8417 - RNA, 19 nt, artificial
  Oligomer
ugugagauucucuuuuaua

SEQ ID NO: 8418 - RNA, 19 nt, artificial
  Oligomer
auaaccacugaguauccaa

SEQ ID NO: 8419 - RNA, 19 nt, artificial
  Oligomer
ugaucucguguauaacugc

SEQ ID NO: 8420 - RNA, 19 nt, artificial
  Oligomer
gcauguucgccucucuuuc

SEQ ID NO: 8421 - RNA, 19 nt, artificial
  Oligomer
ccugaauggaaaauuccca

SEQ ID NO: 8422 - RNA, 19 nt, artificial
  Oligomer
ucaggaugcuaugugacau

SEQ ID NO: 8423 - RNA, 19 nt, artificial
  Oligomer
gggaaaugaagacagagcc

SEQ ID NO: 8424 - RNA, 19 nt, artificial
  Oligomer
cagcaaacugccuuagugc

SEQ ID NO: 8425 - RNA, 19 nt, artificial
  Oligomer
auggaaaauucccaguccu

SEQ ID NO: 8426 - RNA, 19 nt, artificial
  Oligomer
ugaaguccuuuuccacaug

SEQ ID NO: 8427 - RNA, 19 nt, artificial
  Oligomer
uuuccacugucagugguga

SEQ ID NO: 8428 - RNA, 19 nt, artificial
  Oligomer
uacucucugaaguaguaga

SEQ ID NO: 8429 - RNA, 19 nt, artificial
  Oligomer
aauuugggaaaugaagaca

SEQ ID NO: 8430 - RNA, 19 nt, artificial
  Oligomer
auuuccucuagaugaugac

SEQ ID NO: 8431 - RNA, 19 nt, artificial
  Oligomer
agcaucauuacagauguua

SEQ ID NO: 8432 - RNA, 19 nt, artificial
  Oligomer
ugaccuuggguuugucuuu

SEQ ID NO: 8433 - RNA, 19 nt, artificial
  Oligomer
uaaacaccaggaaugugcu

SEQ ID NO: 8434 - RNA, 19 nt, artificial
  Oligomer
aagauaaaauuagacucug

SEQ ID NO: 8435 - RNA, 19 nt, artificial
  Oligomer
ugaaagcaaaaacaauuuc

SEQ ID NO: 8436 - RNA, 19 nt, artificial
  Oligomer
agaaaggucuugaucagca

SEQ ID NO: 8437 - RNA, 19 nt, artificial
  Oligomer
uagacucugaucucgugua

SEQ ID NO: 8438 - RNA, 19 nt, artificial
  Oligomer
uaucaucaaccagguuuuc

SEQ ID NO: 8439 - RNA, 19 nt, artificial
  Oligomer
agguuuucagcauugcuca

SEQ ID NO: 8440 - RNA, 19 nt, artificial
  Oligomer
auuuugccugcaguuugag

SEQ ID NO: 8441 - RNA, 19 nt, artificial
  Oligomer
cuuguugauauuacccuga

SEQ ID NO: 8442 - RNA, 19 nt, artificial
  Oligomer
ugguguggaagauuugaaa

SEQ ID NO: 8443 - RNA, 19 nt, artificial
  Oligomer
uauaaccacugaguaucca

SEQ ID NO: 8444 - RNA, 19 nt, artificial
  Oligomer
uguaucucaucuguauuua

SEQ ID NO: 8445 - RNA, 19 nt, artificial
  Oligomer
augacuccaagaauacucu

SEQ ID NO: 8446 - RNA, 19 nt, artificial
  Oligomer
agauucucuuuuauaacca

SEQ ID NO: 8447 - RNA, 19 nt, artificial
  Oligomer
guguucccuaaauauuuug

SEQ ID NO: 8448 - RNA, 19 nt, artificial
  Oligomer
uuggucccacagauuccau

SEQ ID NO: 8449 - RNA, 19 nt, artificial
  Oligomer
gcuguuuccauuuccugag

SEQ ID NO: 8450 - RNA, 19 nt, artificial
  Oligomer
uaccugaguugcuucuuau

SEQ ID NO: 8451 - RNA, 19 nt, artificial
  Oligomer
augaugacuccaagaauac

SEQ ID NO: 8452 - RNA, 19 nt, artificial
  Oligomer
aauggaaaauucccagucc

SEQ ID NO: 8453 - RNA, 19 nt, artificial
  Oligomer
cuugaucagcaacuucacc

SEQ ID NO: 8454 - RNA, 19 nt, artificial
  Oligomer
ucagugauaucaucaacca

SEQ ID NO: 8455 - RNA, 19 nt, artificial
  Oligomer
uguggaccagaacaccguu

SEQ ID NO: 8456 - RNA, 19 nt, artificial
  Oligomer
cuuuccuuuggaaaauagg

SEQ ID NO: 8457 - RNA, 19 nt, artificial
  Oligomer
gaaaaauuuccucuagaug

SEQ ID NO: 8458 - RNA, 19 nt, artificial
  Oligomer
aaauuuccucuagaugaug

SEQ ID NO: 8459 - RNA, 19 nt, artificial
  Oligomer
ucaguggugaaccaaacaa

SEQ ID NO: 8460 - RNA, 19 nt, artificial
  Oligomer
ugaugaugaccuuggguuu

SEQ ID NO: 8461 - RNA, 19 nt, artificial
  Oligomer
ucagcauugcucaccacaa

SEQ ID NO: 8462 - RNA, 19 nt, artificial
  Oligomer
ucagcaacuucaccaugug

SEQ ID NO: 8463 - RNA, 19 nt, artificial
  Oligomer
ugaaaaauuuccucuagau

SEQ ID NO: 8464 - RNA, 19 nt, artificial
  Oligomer
aaccaaacaaucccagcac

SEQ ID NO: 8465 - RNA, 19 nt, artificial
  Oligomer
agguuuucaaguagaucuc

SEQ ID NO: 8466 - RNA, 19 nt, artificial
  Oligomer
acagaaugaaaucauguac

SEQ ID NO: 8467 - RNA, 19 nt, artificial
  Oligomer
aaguucagaaccauuucga

SEQ ID NO: 8468 - RNA, 19 nt, artificial
  Oligomer
ggcuuuuccacugucagug

SEQ ID NO: 8469 - RNA, 19 nt, artificial
  Oligomer
caucauuacagauguuacc

SEQ ID NO: 8470 - RNA, 19 nt, artificial
  Oligomer
ucacuggauauaucugaac

SEQ ID NO: 8471 - RNA, 19 nt, artificial
  Oligomer
cugaguugcuucuuaugag

SEQ ID NO: 8472 - RNA, 19 nt, artificial
  Oligomer
ucugaacucagcuguuuuu

SEQ ID NO: 8473 - RNA, 19 nt, artificial
  Oligomer
guuuucuucuuuuugacau

SEQ ID NO: 8474 - RNA, 19 nt, artificial
  Oligomer
ucucuuuuauaaccacuga

SEQ ID NO: 8475 - RNA, 19 nt, artificial
  Oligomer
caaauucucuuuuucuuug

SEQ ID NO: 8476 - RNA, 19 nt, artificial
  Oligomer
aaugaauguugaaccuuuu

SEQ ID NO: 8477 - RNA, 19 nt, artificial
  Oligomer
ucucguguauaacugcuuu

SEQ ID NO: 8478 - RNA, 19 nt, artificial
  Oligomer
uccacaugagccuuuguaa

SEQ ID NO: 8479 - RNA, 19 nt, artificial
  Oligomer
uggaagauuugaaagcaau

SEQ ID NO: 8480 - RNA, 19 nt, artificial
  Oligomer
uggaccagcuuguugauau

SEQ ID NO: 8481 - RNA, 19 nt, artificial
  Oligomer
auauuacccugaauggaaa

SEQ ID NO: 8482 - RNA, 19 nt, artificial
  Oligomer
ucccacagauuccauucag

SEQ ID NO: 8483 - RNA, 19 nt, artificial
  Oligomer
aauaucgugucauggauag

SEQ ID NO: 8484 - RNA, 19 nt, artificial
  Oligomer
uccauuuccugagcuguga

SEQ ID NO: 8485 - RNA, 19 nt, artificial
  Oligomer
cucaaauucucuuuuucuu

SEQ ID NO: 8486 - RNA, 19 nt, artificial
  Oligomer
gauaguugaauucuuuguu

SEQ ID NO: 8487 - RNA, 19 nt, artificial
  Oligomer
uaucugaacucagcuguuu

SEQ ID NO: 8488 - RNA, 19 nt, artificial
  Oligomer
gaaaauaggaagcagaagg

SEQ ID NO: 8489 - RNA, 19 nt, artificial
  Oligomer
aaagagauagaaauaucgu

SEQ ID NO: 8490 - RNA, 19 nt, artificial
  Oligomer
gcaaacugccuuagugcug

SEQ ID NO: 8491 - RNA, 19 nt, artificial
  Oligomer
auuccacagguguucccua

SEQ ID NO: 8492 - RNA, 19 nt, artificial
  Oligomer
cugagcugugagauucucu

SEQ ID NO: 8493 - RNA, 19 nt, artificial
  Oligomer
ucucugaaguaguagauaa

SEQ ID NO: 8494 - RNA, 19 nt, artificial
  Oligomer
agguguucccuaaauauuu

SEQ ID NO: 8495 - RNA, 19 nt, artificial
  Oligomer
cuuuuugacauaacaaagu

SEQ ID NO: 8496 - RNA, 19 nt, artificial
  Oligomer
gucaaguucagaaccauuu

SEQ ID NO: 8497 - RNA, 19 nt, artificial
  Oligomer
aacaccguuggaugguuuc

SEQ ID NO: 8498 - RNA, 19 nt, artificial
  Oligomer
cauggauagucuuucaaug

SEQ ID NO: 8499 - RNA, 19 nt, artificial
  Oligomer
ugucauggauagucuuuca

SEQ ID NO: 8500 - RNA, 19 nt, artificial
  Oligomer
agcaaacugccuuagugcu

SEQ ID NO: 8501 - RNA, 19 nt, artificial
  Oligomer
acgguuguugaaaauuuca

SEQ ID NO: 8502 - RNA, 19 nt, artificial
  Oligomer
caccguuggaugguuucuc

SEQ ID NO: 8503 - RNA, 19 nt, artificial
  Oligomer
cauuauuuuccaucaaauc

SEQ ID NO: 8504 - RNA, 19 nt, artificial
  Oligomer
ucaaccagguuuucagcau

SEQ ID NO: 8505 - RNA, 19 nt, artificial
  Oligomer
uuugagcugucucagugau

SEQ ID NO: 8506 - RNA, 19 nt, artificial
  Oligomer
aauuuccucuagaugauga

SEQ ID NO: 8507 - RNA, 19 nt, artificial
  Oligomer
uuuagacauuuuccuauaa

SEQ ID NO: 8508 - RNA, 19 nt, artificial
  Oligomer
aaagcaaugaaguccuuuu

SEQ ID NO: 8509 - RNA, 19 nt, artificial
  Oligomer
ugaacagaaugaaaucaug

SEQ ID NO: 8510 - RNA, 19 nt, artificial
  Oligomer
ugaaaauuucaaagauggu

SEQ ID NO: 8511 - RNA, 19 nt, artificial
  Oligomer
auuuccugagcugugagau

SEQ ID NO: 8512 - RNA, 19 nt, artificial
  Oligomer
acauuauuuuccaucaaau

SEQ ID NO: 8513 - RNA, 19 nt, artificial
  Oligomer
agauuugaaagcaaugaag

SEQ ID NO: 8514 - RNA, 19 nt, artificial
  Oligomer
uuugggaaaugaagacaga

SEQ ID NO: 8515 - RNA, 19 nt, artificial
  Oligomer
gagugaugccgguaaagaa

SEQ ID NO: 8516 - RNA, 19 nt, artificial
  Oligomer
ggaagguguccaaauuuaa

SEQ ID NO: 8517 - RNA, 19 nt, artificial
  Oligomer
gggucgacauaguauggaa

SEQ ID NO: 8518 - RNA, 19 nt, artificial
  Oligomer
ggagagugaugccgguaaa

SEQ ID NO: 8519 - RNA, 19 nt, artificial
  Oligomer
caucgaggcucuugcucaa

SEQ ID NO: 8520 - RNA, 19 nt, artificial
  Oligomer
ggaucauguaaaugcucaa

SEQ ID NO: 8521 - RNA, 19 nt, artificial
  Oligomer
aggugaacgcacuuaucaa

SEQ ID NO: 8522 - RNA, 19 nt, artificial
  Oligomer
ccaggauuugguuguuuaa

SEQ ID NO: 8523 - RNA, 19 nt, artificial
  Oligomer
caaucaaccugcacuucau

SEQ ID NO: 8524 - RNA, 19 nt, artificial
  Oligomer
cacaggaaaugcaagagaa

SEQ ID NO: 8525 - RNA, 19 nt, artificial
  Oligomer
gcccaagccuacagaacaa

SEQ ID NO: 8526 - RNA, 19 nt, artificial
  Oligomer
ugaccagacugcacaggaa

SEQ ID NO: 8527 - RNA, 19 nt, artificial
  Oligomer
caaggaucgggaagguuau

SEQ ID NO: 8528 - RNA, 19 nt, artificial
  Oligomer
caacuucccuguucuuuaa

SEQ ID NO: 8529 - RNA, 19 nt, artificial
  Oligomer
ggauuugguuguuuaaaua

SEQ ID NO: 8530 - RNA, 19 nt, artificial
  Oligomer
ccaccaaaucugucuagaa

SEQ ID NO: 8531 - RNA, 19 nt, artificial
  Oligomer
ccuacagaacaaaccaaaa

SEQ ID NO: 8532 - RNA, 19 nt, artificial
  Oligomer
caggaaacucuaaaaaaga

SEQ ID NO: 8533 - RNA, 19 nt, artificial
  Oligomer
caucaucaggaaacucuaa

SEQ ID NO: 8534 - RNA, 19 nt, artificial
  Oligomer
acaggaaaugcaagagaaa

SEQ ID NO: 8535 - RNA, 19 nt, artificial
  Oligomer
aggaaacucuaaaaaagaa

SEQ ID NO: 8536 - RNA, 19 nt, artificial
  Oligomer
gaagguguccaaauuuaau

SEQ ID NO: 8537 - RNA, 19 nt, artificial
  Oligomer
gcauccucaucaucaggaa

SEQ ID NO: 8538 - RNA, 19 nt, artificial
  Oligomer
gaguuuggaagguguccaa

SEQ ID NO: 8539 - RNA, 19 nt, artificial
  Oligomer
ugcccauggaagucucaaa

SEQ ID NO: 8540 - RNA, 19 nt, artificial
  Oligomer
ggacaucaucaccuuggaa

SEQ ID NO: 8541 - RNA, 19 nt, artificial
  Oligomer
ccugacaagugaaguugua

SEQ ID NO: 8542 - RNA, 19 nt, artificial
  Oligomer
ugguguccuucuuccucaa

SEQ ID NO: 8543 - RNA, 19 nt, artificial
  Oligomer
cguccaucucucucccuua

SEQ ID NO: 8544 - RNA, 19 nt, artificial
  Oligomer
cuaugguguggaugggaaa

SEQ ID NO: 8545 - RNA, 19 nt, artificial
  Oligomer
caauauacacggauuauua

SEQ ID NO: 8546 - RNA, 19 nt, artificial
  Oligomer
cguugagcugugacuacga

SEQ ID NO: 8547 - RNA, 19 nt, artificial
  Oligomer
ucauguaaaugcucaaaga

SEQ ID NO: 8548 - RNA, 19 nt, artificial
  Oligomer
agugaugccgguaaagaaa

SEQ ID NO: 8549 - RNA, 19 nt, artificial
  Oligomer
acuccugaauuuuaucaaa

SEQ ID NO: 8550 - RNA, 19 nt, artificial
  Oligomer
gcacuucacuggagagaaa

SEQ ID NO: 8551 - RNA, 19 nt, artificial
  Oligomer
cuacaauccuaccuuuuga

SEQ ID NO: 8552 - RNA, 19 nt, artificial
  Oligomer
gaccagacugcacaggaaa

SEQ ID NO: 8553 - RNA, 19 nt, artificial
  Oligomer
aagcaaacaugacuagaga

SEQ ID NO: 8554 - RNA, 19 nt, artificial
  Oligomer
cccucauuuaaaauguaaa

SEQ ID NO: 8555 - RNA, 19 nt, artificial
  Oligomer
cuaugacguccauguucua

SEQ ID NO: 8556 - RNA, 19 nt, artificial
  Oligomer
aggacaucaucaccuugga

SEQ ID NO: 8557 - RNA, 19 nt, artificial
  Oligomer
ucaucaucaggaaacucua

SEQ ID NO: 8558 - RNA, 19 nt, artificial
  Oligomer
gcagaauuuugcacaguua

SEQ ID NO: 8559 - RNA, 19 nt, artificial
  Oligomer
gacugcacaggaaaugcaa

SEQ ID NO: 8560 - RNA, 19 nt, artificial
  Oligomer
ccaucucucucccuuacua

SEQ ID NO: 8561 - RNA, 19 nt, artificial
  Oligomer
cugccuuugggucgacaua

SEQ ID NO: 8562 - RNA, 19 nt, artificial
  Oligomer
ugacaagugaaguuguaaa

SEQ ID NO: 8563 - RNA, 19 nt, artificial
  Oligomer
cugucugccuucaggugaa

SEQ ID NO: 8564 - RNA, 19 nt, artificial
  Oligomer
ggauguggaccacaguacu

SEQ ID NO: 8565 - RNA, 19 nt, artificial
  Oligomer
uagucaaggugcucaauaa

SEQ ID NO: 8566 - RNA, 19 nt, artificial
  Oligomer
ccuuugggucgacauagua

SEQ ID NO: 8567 - RNA, 19 nt, artificial
  Oligomer
gcaaggagaugucugaaua

SEQ ID NO: 8568 - RNA, 19 nt, artificial
  Oligomer
ccauggaagucucaaagau

SEQ ID NO: 8569 - RNA, 19 nt, artificial
  Oligomer
gaagaagcaaacaugacua

SEQ ID NO: 8570 - RNA, 19 nt, artificial
  Oligomer
ccagcuccuuuucugugaa

SEQ ID NO: 8571 - RNA, 19 nt, artificial
  Oligomer
gaagagccugacaagugaa

SEQ ID NO: 8572 - RNA, 19 nt, artificial
  Oligomer
uccucaacuugcugccuaa

SEQ ID NO: 8573 - RNA, 19 nt, artificial
  Oligomer
cauagugggccuucauuaa

SEQ ID NO: 8574 - RNA, 19 nt, artificial
  Oligomer
caucaggaaacucuaaaaa

SEQ ID NO: 8575 - RNA, 19 nt, artificial
  Oligomer
ccguggagaugagacugau

SEQ ID NO: 8576 - RNA, 19 nt, artificial
  Oligomer
ucaucaggaaacucuaaaa

SEQ ID NO: 8577 - RNA, 19 nt, artificial
  Oligomer
agucaaggugcucaauaaa

SEQ ID NO: 8578 - RNA, 19 nt, artificial
  Oligomer
ggugcaaggagaugucuga

SEQ ID NO: 8579 - RNA, 19 nt, artificial
  Oligomer
ugaagagccugacaaguga

SEQ ID NO: 8580 - RNA, 19 nt, artificial
  Oligomer
gccuacagaacaaaccaaa

SEQ ID NO: 8581 - RNA, 19 nt, artificial
  Oligomer
aauccuaccuuuugauaaa

SEQ ID NO: 8582 - RNA, 19 nt, artificial
  Oligomer
gccuuugggucgacauagu

SEQ ID NO: 8583 - RNA, 19 nt, artificial
  Oligomer
caggaauguuucagcugca

SEQ ID NO: 8584 - RNA, 19 nt, artificial
  Oligomer
gaagcccuuugccuguaga

SEQ ID NO: 8585 - RNA, 19 nt, artificial
  Oligomer
gggagagggcauauaaauu

SEQ ID NO: 8586 - RNA, 19 nt, artificial
  Oligomer
ccaucaucucugccuuuga

SEQ ID NO: 8587 - RNA, 19 nt, artificial
  Oligomer
uggaagguguccaaauuua

SEQ ID NO: 8588 - RNA, 19 nt, artificial
  Oligomer
cucccuagacaauaaagau

SEQ ID NO: 8589 - RNA, 19 nt, artificial
  Oligomer
aaacgagguuccugguaca

SEQ ID NO: 8590 - RNA, 19 nt, artificial
  Oligomer
cauccucaucaucaggaaa

SEQ ID NO: 8591 - RNA, 19 nt, artificial
  Oligomer
ccaacuucccuguucuuua

SEQ ID NO: 8592 - RNA, 19 nt, artificial
  Oligomer
cucuagucacccucuucaa

SEQ ID NO: 8593 - RNA, 19 nt, artificial
  Oligomer
caaggugcucaauaaauau

SEQ ID NO: 8594 - RNA, 19 nt, artificial
  Oligomer
cuugcugcaguguccagaa

SEQ ID NO: 8595 - RNA, 19 nt, artificial
  Oligomer
cgacagauacuguggaaca

SEQ ID NO: 8596 - RNA, 19 nt, artificial
  Oligomer
gaacccuucugcuuucuau

SEQ ID NO: 8597 - RNA, 19 nt, artificial
  Oligomer
gaccaucuccuaucuuuua

SEQ ID NO: 8598 - RNA, 19 nt, artificial
  Oligomer
uguggaccacaguacucua

SEQ ID NO: 8599 - RNA, 19 nt, artificial
  Oligomer
aacacucccuagacaauaa

SEQ ID NO: 8600 - RNA, 19 nt, artificial
  Oligomer
gaaacugcuccagcuccaa

SEQ ID NO: 8601 - RNA, 19 nt, artificial
  Oligomer
agugauugcuuuuauuaca

SEQ ID NO: 8602 - RNA, 19 nt, artificial
  Oligomer
ccuccagucuguucucaca

SEQ ID NO: 8603 - RNA, 19 nt, artificial
  Oligomer
uguuccuuuugacaauaua

SEQ ID NO: 8604 - RNA, 19 nt, artificial
  Oligomer
aagcacugagggagaccaa

SEQ ID NO: 8605 - RNA, 19 nt, artificial
  Oligomer
cagcuguuguugagcgaau

SEQ ID NO: 8606 - RNA, 19 nt, artificial
  Oligomer
caaauuuaauguagacauu

SEQ ID NO: 8607 - RNA, 19 nt, artificial
  Oligomer
uguccaaauuuaauguaga

SEQ ID NO: 8608 - RNA, 19 nt, artificial
  Oligomer
gcuucagcauguacuccca

SEQ ID NO: 8609 - RNA, 19 nt, artificial
  Oligomer
caaaaauguucuucaucca

SEQ ID NO: 8610 - RNA, 19 nt, artificial
  Oligomer
gaaguauuugagagagaga

SEQ ID NO: 8611 - RNA, 19 nt, artificial
  Oligomer
gaagccuugcacuccugaa

SEQ ID NO: 8612 - RNA, 19 nt, artificial
  Oligomer
aauggugauuucuugcuaa

SEQ ID NO: 8613 - RNA, 19 nt, artificial
  Oligomer
gcauuuuuagcuccuugaa

SEQ ID NO: 8614 - RNA, 19 nt, artificial
  Oligomer
ggcucugaagaagcaaaca

SEQ ID NO: 8615 - RNA, 19 nt, artificial
  Oligomer
uccugaauuuuaucaaaca

SEQ ID NO: 8616 - RNA, 19 nt, artificial
  Oligomer
ccgacaugcugguuaaggu

SEQ ID NO: 8617 - RNA, 19 nt, artificial
  Oligomer
uggagagaaagaacuggaa

SEQ ID NO: 8618 - RNA, 19 nt, artificial
  Oligomer
cuaggccuguaguagucaa

SEQ ID NO: 8619 - RNA, 19 nt, artificial
  Oligomer
gagauaacuuccuucacau

SEQ ID NO: 8620 - RNA, 19 nt, artificial
  Oligomer
cucccuucuuuaccuucau

SEQ ID NO: 8621 - RNA, 19 nt, artificial
  Oligomer
cuacagaacaaaccaaaaa

SEQ ID NO: 8622 - RNA, 19 nt, artificial
  Oligomer
caggauuugguuguuuaaa

SEQ ID NO: 8623 - RNA, 19 nt, artificial
  Oligomer
cucugagcuuuguuacuga

SEQ ID NO: 8624 - RNA, 19 nt, artificial
  Oligomer
uaucccugcuuaucugaaa

SEQ ID NO: 8625 - RNA, 19 nt, artificial
  Oligomer
gggccuucauuaaauguuu

SEQ ID NO: 8626 - RNA, 19 nt, artificial
  Oligomer
gcuuuacaggaucauguaa

SEQ ID NO: 8627 - RNA, 19 nt, artificial
  Oligomer
cuagagugagaguuuggaa

SEQ ID NO: 8628 - RNA, 19 nt, artificial
  Oligomer
ggcuguaaaugagggcaga

SEQ ID NO: 8629 - RNA, 19 nt, artificial
  Oligomer
cgacuugagucucccuuuu

SEQ ID NO: 8630 - RNA, 19 nt, artificial
  Oligomer
ccuugaaccucauuaaaug

SEQ ID NO: 8631 - RNA, 19 nt, artificial
  Oligomer
aaccaaaaauguucuucau

SEQ ID NO: 8632 - RNA, 19 nt, artificial
  Oligomer
ccagucuguucucacauaa

SEQ ID NO: 8633 - RNA, 19 nt, artificial
  Oligomer
cugacaagugaaguuguaa

SEQ ID NO: 8634 - RNA, 19 nt, artificial
  Oligomer
caugcauccucaucaucag

SEQ ID NO: 8635 - RNA, 19 nt, artificial
  Oligomer
gaggauauguugcucacca

SEQ ID NO: 8636 - RNA, 19 nt, artificial
  Oligomer
gguugaccaacaagaugga

SEQ ID NO: 8637 - RNA, 19 nt, artificial
  Oligomer
ccugcacuucauaucuaga

SEQ ID NO: 8638 - RNA, 19 nt, artificial
  Oligomer
cacuccugaauuuuaucaa

SEQ ID NO: 8639 - RNA, 19 nt, artificial
  Oligomer
gaaacugcagaauuuugca

SEQ ID NO: 8640 - RNA, 19 nt, artificial
  Oligomer
ggcucuugcucaaguguuu

SEQ ID NO: 8641 - RNA, 19 nt, artificial
  Oligomer
ucugaagaagcaaacauga

SEQ ID NO: 8642 - RNA, 19 nt, artificial
  Oligomer
gcuccuugaagacauauca

SEQ ID NO: 8643 - RNA, 19 nt, artificial
  Oligomer
guauuaaacucuccuuuga

SEQ ID NO: 8644 - RNA, 19 nt, artificial
  Oligomer
gagcgaauuguuagaacau

SEQ ID NO: 8645 - RNA, 19 nt, artificial
  Oligomer
ccaaauaaaugcucauauu

SEQ ID NO: 8646 - RNA, 19 nt, artificial
  Oligomer
gugaugccgguaaagaaaa

SEQ ID NO: 8647 - RNA, 19 nt, artificial
  Oligomer
cuucauaucuagauuucua

SEQ ID NO: 8648 - RNA, 19 nt, artificial
  Oligomer
ccuugcauuuguaccuuau

SEQ ID NO: 8649 - RNA, 19 nt, artificial
  Oligomer
aaaccuuuaucccugcuua

SEQ ID NO: 8650 - RNA, 19 nt, artificial
  Oligomer
guaaaugcucaaagaugua

SEQ ID NO: 8651 - RNA, 19 nt, artificial
  Oligomer
acaugcugguuaaggugaa

SEQ ID NO: 8652 - RNA, 19 nt, artificial
  Oligomer
ccgcccuuuuuguccuaga

SEQ ID NO: 8653 - RNA, 19 nt, artificial
  Oligomer
cuuuuuccuuccugagaaa

SEQ ID NO: 8654 - RNA, 19 nt, artificial
  Oligomer
ucauuaaauguuuguugaa

SEQ ID NO: 8655 - RNA, 19 nt, artificial
  Oligomer
gacauaguauggaaguauu

SEQ ID NO: 8656 - RNA, 19 nt, artificial
  Oligomer
gggcuaugacguccauguu

SEQ ID NO: 8657 - RNA, 19 nt, artificial
  Oligomer
gauaaaauguuccuuuuga

SEQ ID NO: 8658 - RNA, 19 nt, artificial
  Oligomer
ccaguggaaggacacucuu

SEQ ID NO: 8659 - RNA, 19 nt, artificial
  Oligomer
gugugauagagccuuugau

SEQ ID NO: 8660 - RNA, 19 nt, artificial
  Oligomer
aucaggaaacucuaaaaaa

SEQ ID NO: 8661 - RNA, 19 nt, artificial
  Oligomer
agcugugacuacgacuuga

SEQ ID NO: 8662 - RNA, 19 nt, artificial
  Oligomer
cagaauuccaccggugcaa

SEQ ID NO: 8663 - RNA, 19 nt, artificial
  Oligomer
caaugugcacuucacugga

SEQ ID NO: 8664 - RNA, 19 nt, artificial
  Oligomer
cauguaaaugcucaaagau

SEQ ID NO: 8665 - RNA, 19 nt, artificial
  Oligomer
cccuugaaccucauuaaau

SEQ ID NO: 8666 - RNA, 19 nt, artificial
  Oligomer
ugguguugagcaaugugca

SEQ ID NO: 8667 - RNA, 19 nt, artificial
  Oligomer
caauccuaccuuuugauaa

SEQ ID NO: 8668 - RNA, 19 nt, artificial
  Oligomer
uggaaaugagggagcucau

SEQ ID NO: 8669 - RNA, 19 nt, artificial
  Oligomer
ugcuuuacaggaucaugua

SEQ ID NO: 8670 - RNA, 19 nt, artificial
  Oligomer
guuguugagcgaauuguua

SEQ ID NO: 8671 - RNA, 19 nt, artificial
  Oligomer
gcauuuguaccuuauugau

SEQ ID NO: 8672 - RNA, 19 nt, artificial
  Oligomer
aaucaaccugcacuucaua

SEQ ID NO: 8673 - RNA, 19 nt, artificial
  Oligomer
aggauuugguuguuuaaau

SEQ ID NO: 8674 - RNA, 19 nt, artificial
  Oligomer
aagagaaacugcagaauuu

SEQ ID NO: 8675 - RNA, 19 nt, artificial
  Oligomer
aaccuuagcuacaauccua

SEQ ID NO: 8676 - RNA, 19 nt, artificial
  Oligomer
uguuucagcugcaguugaa

SEQ ID NO: 8677 - RNA, 19 nt, artificial
  Oligomer
cauuuauugcaguuuauau

SEQ ID NO: 8678 - RNA, 19 nt, artificial
  Oligomer
gauugcuuuuauuacauua

SEQ ID NO: 8679 - RNA, 19 nt, artificial
  Oligomer
caccaaaucugucuagaau

SEQ ID NO: 8680 - RNA, 19 nt, artificial
  Oligomer
acuuaucaaggaucgggaa

SEQ ID NO: 8681 - RNA, 19 nt, artificial
  Oligomer
ccacaggaggugugauaga

SEQ ID NO: 8682 - RNA, 19 nt, artificial
  Oligomer
ugcucaaagauguaaugua

SEQ ID NO: 8683 - RNA, 19 nt, artificial
  Oligomer
cuuugaucuucaggaugca

SEQ ID NO: 8684 - RNA, 19 nt, artificial
  Oligomer
gcuacuuuuacuuguucau

SEQ ID NO: 8685 - RNA, 19 nt, artificial
  Oligomer
ugucuagaauccugcuuua

SEQ ID NO: 8686 - RNA, 19 nt, artificial
  Oligomer
ucaccuugguuuaugagaa

SEQ ID NO: 8687 - RNA, 19 nt, artificial
  Oligomer
aaccuuuaucccugcuuau

SEQ ID NO: 8688 - RNA, 19 nt, artificial
  Oligomer
ggagagaaagaacuggaau

SEQ ID NO: 8689 - RNA, 19 nt, artificial
  Oligomer
gagguuccugguacaucga

SEQ ID NO: 8690 - RNA, 19 nt, artificial
  Oligomer
gucgacagauacuguggaa

SEQ ID NO: 8691 - RNA, 19 nt, artificial
  Oligomer
gcaguuuauauauaugcua

SEQ ID NO: 8692 - RNA, 19 nt, artificial
  Oligomer
cacuuaucaaggaucggga

SEQ ID NO: 8693 - RNA, 19 nt, artificial
  Oligomer
agccuacagaacaaaccaa

SEQ ID NO: 8694 - RNA, 19 nt, artificial
  Oligomer
acacucccuagacaauaaa

SEQ ID NO: 8695 - RNA, 19 nt, artificial
  Oligomer
acauugccuugcauuugua

SEQ ID NO: 8696 - RNA, 19 nt, artificial
  Oligomer
cuugcacuccugaauuuua

SEQ ID NO: 8697 - RNA, 19 nt, artificial
  Oligomer
acaucaucaccuuggaaau

SEQ ID NO: 8698 - RNA, 19 nt, artificial
  Oligomer
cacgcgcucagacaugaua

SEQ ID NO: 8699 - RNA, 19 nt, artificial
  Oligomer
cuggagaaggacaucauca

SEQ ID NO: 8700 - RNA, 19 nt, artificial
  Oligomer
ccuuauugaucuuugccca

SEQ ID NO: 8701 - RNA, 19 nt, artificial
  Oligomer
ggaacacucccuagacaau

SEQ ID NO: 8702 - RNA, 19 nt, artificial
  Oligomer
cccugagcagucuacuucu

SEQ ID NO: 8703 - RNA, 19 nt, artificial
  Oligomer
caugcggaacaccaaacga

SEQ ID NO: 8704 - RNA, 19 nt, artificial
  Oligomer
uaguagucaaggugcucaa

SEQ ID NO: 8705 - RNA, 19 nt, artificial
  Oligomer
ccugcuuucucuuucagua

SEQ ID NO: 8706 - RNA, 19 nt, artificial
  Oligomer
caguugaagagccugacaa

SEQ ID NO: 8707 - RNA, 19 nt, artificial
  Oligomer
uggaaagaaccacgcagga

SEQ ID NO: 8708 - RNA, 19 nt, artificial
  Oligomer
uguuguugagcgaauuguu

SEQ ID NO: 8709 - RNA, 19 nt, artificial
  Oligomer
gugcaaggagaugucugaa

SEQ ID NO: 8710 - RNA, 19 nt, artificial
  Oligomer
uuuacaggaucauguaaau

SEQ ID NO: 8711 - RNA, 19 nt, artificial
  Oligomer
caggaugcacgguuucugu

SEQ ID NO: 8712 - RNA, 19 nt, artificial
  Oligomer
cauaucucucccuucuuua

SEQ ID NO: 8713 - RNA, 19 nt, artificial
  Oligomer
cccauggucccuagcaaaa

SEQ ID NO: 8714 - RNA, 19 nt, artificial
  Oligomer
ucaaggugcucaauaaaua

SEQ ID NO: 8715 - RNA, 19 nt, artificial
  Oligomer
agaaggacaucaucaccuu

SEQ ID NO: 8716 - RNA, 19 nt, artificial
  Oligomer
cccauggaagucucaaaga

SEQ ID NO: 8717 - RNA, 19 nt, artificial
  Oligomer
acuggaauuucgcucugga

SEQ ID NO: 8718 - RNA, 19 nt, artificial
  Oligomer
ucugagcuuuguuacugaa

SEQ ID NO: 8719 - RNA, 19 nt, artificial
  Oligomer
gcauuuauugcaguuuaua

SEQ ID NO: 8720 - RNA, 19 nt, artificial
  Oligomer
guuuggaagguguccaaau

SEQ ID NO: 8721 - RNA, 19 nt, artificial
  Oligomer
aagaaaaguugccgaagau

SEQ ID NO: 8722 - RNA, 19 nt, artificial
  Oligomer
cauuaguuaagaugucuga

SEQ ID NO: 8723 - RNA, 19 nt, artificial
  Oligomer
gcagaaaccuuguuuguuu

SEQ ID NO: 8724 - RNA, 19 nt, artificial
  Oligomer
aacucuccuuugauauuau

SEQ ID NO: 8725 - RNA, 19 nt, artificial
  Oligomer
aaauguuccuuuugacaau

SEQ ID NO: 8726 - RNA, 19 nt, artificial
  Oligomer
gcaaaaugcuaggccugua

SEQ ID NO: 8727 - RNA, 19 nt, artificial
  Oligomer
gcacaggaaaugcaagaga

SEQ ID NO: 8728 - RNA, 19 nt, artificial
  Oligomer
gcacauagugggccuucau

SEQ ID NO: 8729 - RNA, 19 nt, artificial
  Oligomer
agcuuaucucccugcuuca

SEQ ID NO: 8730 - RNA, 19 nt, artificial
  Oligomer
uauuguuuucaaccuagaa

SEQ ID NO: 8731 - RNA, 19 nt, artificial
  Oligomer
guggaacacucccuagaca

SEQ ID NO: 8732 - RNA, 19 nt, artificial
  Oligomer
cucccugcuucauaucucu

SEQ ID NO: 8733 - RNA, 19 nt, artificial
  Oligomer
cauuuaaaauguaaacucu

SEQ ID NO: 8734 - RNA, 19 nt, artificial
  Oligomer
cgacauaguauggaaguau

SEQ ID NO: 8735 - RNA, 19 nt, artificial
  Oligomer
aauguuuguugaauaaaag

SEQ ID NO: 8736 - RNA, 19 nt, artificial
  Oligomer
ccaaauuuaauguagacau

SEQ ID NO: 8737 - RNA, 19 nt, artificial
  Oligomer
ugagauaacuuccuucaca

SEQ ID NO: 8738 - RNA, 19 nt, artificial
  Oligomer
gagccuuugaucuucagga

SEQ ID NO: 8739 - RNA, 19 nt, artificial
  Oligomer
ccuuuaucccugcuuaucu

SEQ ID NO: 8740 - RNA, 19 nt, artificial
  Oligomer
cgaauuguuagaacaucuu

SEQ ID NO: 8741 - RNA, 19 nt, artificial
  Oligomer
cuuucucuuucaguauuaa

SEQ ID NO: 8742 - RNA, 19 nt, artificial
  Oligomer
gagagagagaaccuuucca

SEQ ID NO: 8743 - RNA, 19 nt, artificial
  Oligomer
cugagcuuuguuacugaaa

SEQ ID NO: 8744 - RNA, 19 nt, artificial
  Oligomer
auguuuguugaauaaaaga

SEQ ID NO: 8745 - RNA, 19 nt, artificial
  Oligomer
aguuaagaugucugagaga

SEQ ID NO: 8746 - RNA, 19 nt, artificial
  Oligomer
cuuccucaagucuugacaa

SEQ ID NO: 8747 - RNA, 19 nt, artificial
  Oligomer
cuccuaucuuuuauuucau

SEQ ID NO: 8748 - RNA, 19 nt, artificial
  Oligomer
ggugugauagagccuuuga

SEQ ID NO: 8749 - RNA, 19 nt, artificial
  Oligomer
gggcagaaaccuuguuugu

SEQ ID NO: 8750 - RNA, 19 nt, artificial
  Oligomer
gagaugucugaauacugca

SEQ ID NO: 8751 - RNA, 19 nt, artificial
  Oligomer
cccacuuucauucaaucaa

SEQ ID NO: 8752 - RNA, 19 nt, artificial
  Oligomer
ccacuuucauucaaucaac

SEQ ID NO: 8753 - RNA, 19 nt, artificial
  Oligomer
caucucucucccuuacuau

SEQ ID NO: 8754 - RNA, 19 nt, artificial
  Oligomer
ugagcgaauuguuagaaca

SEQ ID NO: 8755 - RNA, 19 nt, artificial
  Oligomer
uuagcuccuugaagacaua

SEQ ID NO: 8756 - RNA, 19 nt, artificial
  Oligomer
acaguuaccugcacaccga

SEQ ID NO: 8757 - RNA, 19 nt, artificial
  Oligomer
acaggaucauguaaaugcu

SEQ ID NO: 8758 - RNA, 19 nt, artificial
  Oligomer
cguucccuucaguacugca

SEQ ID NO: 8759 - RNA, 19 nt, artificial
  Oligomer
aaaugcuaggccuguagua

SEQ ID NO: 8760 - RNA, 19 nt, artificial
  Oligomer
guguggaugggaaacugcu

SEQ ID NO: 8761 - RNA, 19 nt, artificial
  Oligomer
cugucuuuuuccuuccuga

SEQ ID NO: 8762 - RNA, 19 nt, artificial
  Oligomer
ccuagacaauaaagauggu

SEQ ID NO: 8763 - RNA, 19 nt, artificial
  Oligomer
uggaaguauuugagagaga

SEQ ID NO: 8764 - RNA, 19 nt, artificial
  Oligomer
cagccuugguuggaccuau

SEQ ID NO: 8765 - RNA, 19 nt, artificial
  Oligomer
gaacgcacuuaucaaggau

SEQ ID NO: 8766 - RNA, 19 nt, artificial
  Oligomer
gcgaauuguuagaacaucu

SEQ ID NO: 8767 - RNA, 19 nt, artificial
  Oligomer
aagccuacagaacaaacca

SEQ ID NO: 8768 - RNA, 19 nt, artificial
  Oligomer
cgcccuuuuuguccuagag

SEQ ID NO: 8769 - RNA, 19 nt, artificial
  Oligomer
gagccugacaagugaaguu

SEQ ID NO: 8770 - RNA, 19 nt, artificial
  Oligomer
gccugacaagugaaguugu

SEQ ID NO: 8771 - RNA, 19 nt, artificial
  Oligomer
gcuguaaaugagggcagaa

SEQ ID NO: 8772 - RNA, 19 nt, artificial
  Oligomer
uguugagcgaauuguuaga

SEQ ID NO: 8773 - RNA, 19 nt, artificial
  Oligomer
agcuguuguugagcgaauu

SEQ ID NO: 8774 - RNA, 19 nt, artificial
  Oligomer
cugugcguucccuucagua

SEQ ID NO: 8775 - RNA, 19 nt, artificial
  Oligomer
uagcacugguguugagcaa

SEQ ID NO: 8776 - RNA, 19 nt, artificial
  Oligomer
cguccauguucuaugugac

SEQ ID NO: 8777 - RNA, 19 nt, artificial
  Oligomer
agaccaucuccuaucuuuu

SEQ ID NO: 8778 - RNA, 19 nt, artificial
  Oligomer
gcuuuuauuacauuaguua

SEQ ID NO: 8779 - RNA, 19 nt, artificial
  Oligomer
agccuuugaucuucaggau

SEQ ID NO: 8780 - RNA, 19 nt, artificial
  Oligomer
ggucccuagcaaaaugcua

SEQ ID NO: 8781 - RNA, 19 nt, artificial
  Oligomer
cauuaaauggugauuucuu

SEQ ID NO: 8782 - RNA, 19 nt, artificial
  Oligomer
caaccuuagcuacaauccu

SEQ ID NO: 8783 - RNA, 19 nt, artificial
  Oligomer
gcaguugaagagccugaca

SEQ ID NO: 8784 - RNA, 19 nt, artificial
  Oligomer
cagaaaccuuguuuguuuu

SEQ ID NO: 8785 - RNA, 19 nt, artificial
  Oligomer
caucuucuggagaaggaca

SEQ ID NO: 8786 - RNA, 19 nt, artificial
  Oligomer
cuuugagugugggacucca

SEQ ID NO: 8787 - RNA, 19 nt, artificial
  Oligomer
ugcauuuauugcaguuuau

SEQ ID NO: 8788 - RNA, 19 nt, artificial
  Oligomer
gaaccucauuaaaugguga

SEQ ID NO: 8789 - RNA, 19 nt, artificial
  Oligomer
cguugguuguuucucugag

SEQ ID NO: 8790 - RNA, 19 nt, artificial
  Oligomer
ugacaauauacacggauua

SEQ ID NO: 8791 - RNA, 19 nt, artificial
  Oligomer
gccuugcauuuguaccuua

SEQ ID NO: 8792 - RNA, 19 nt, artificial
  Oligomer
ucuucaccuugguuuauga

SEQ ID NO: 8793 - RNA, 19 nt, artificial
  Oligomer
ucaggaaacucuaaaaaag

SEQ ID NO: 8794 - RNA, 19 nt, artificial
  Oligomer
ucuccuaucuuuuauuuca

SEQ ID NO: 8795 - RNA, 19 nt, artificial
  Oligomer
ggaucgggaagguuaugcu

SEQ ID NO: 8796 - RNA, 19 nt, artificial
  Oligomer
agucuguucucacauaaca

SEQ ID NO: 8797 - RNA, 19 nt, artificial
  Oligomer
aaguauuugagagagagaa

SEQ ID NO: 8798 - RNA, 19 nt, artificial
  Oligomer
aaaugagggagcucaucca

SEQ ID NO: 8799 - RNA, 19 nt, artificial
  Oligomer
guuccugcuuucucuuuca

SEQ ID NO: 8800 - RNA, 19 nt, artificial
  Oligomer
ugaauaaaagagggaagaa

SEQ ID NO: 8801 - RNA, 19 nt, artificial
  Oligomer
gagcaaugugcacuucacu

SEQ ID NO: 8802 - RNA, 19 nt, artificial
  Oligomer
cuuugggucgacauaguau

SEQ ID NO: 8803 - RNA, 19 nt, artificial
  Oligomer
gagaaacguccaucucucu

SEQ ID NO: 8804 - RNA, 19 nt, artificial
  Oligomer
uaucuagauuucuagaaaa

SEQ ID NO: 8805 - RNA, 19 nt, artificial
  Oligomer
ugagcuuuguuacugaaau

SEQ ID NO: 8806 - RNA, 19 nt, artificial
  Oligomer
gaucauguaaaugcucaaa

SEQ ID NO: 8807 - RNA, 19 nt, artificial
  Oligomer
gcucaaagauguaauguag

SEQ ID NO: 8808 - RNA, 19 nt, artificial
  Oligomer
ccaucuccuaucuuuuauu

SEQ ID NO: 8809 - RNA, 19 nt, artificial
  Oligomer
ggccuguaguagucaaggu

SEQ ID NO: 8810 - RNA, 19 nt, artificial
  Oligomer
gaccacaggaggugugaua

SEQ ID NO: 8811 - RNA, 19 nt, artificial
  Oligomer
agguuuuucagcucuuuga

SEQ ID NO: 8812 - RNA, 19 nt, artificial
  Oligomer
gguuaaggugaacgcacuu

SEQ ID NO: 8813 - RNA, 19 nt, artificial
  Oligomer
cuaccaggcuguaaaugag

SEQ ID NO: 8814 - RNA, 19 nt, artificial
  Oligomer
guuucccuagacucuguaa

SEQ ID NO: 8815 - RNA, 19 nt, artificial
  Oligomer
aggagagugaugccgguaa

SEQ ID NO: 8816 - RNA, 19 nt, artificial
  Oligomer
ucccauggucccuagcaaa

SEQ ID NO: 8817 - RNA, 19 nt, artificial
  Oligomer
cuguaaaugagggcagaaa

SEQ ID NO: 8818 - RNA, 19 nt, artificial
  Oligomer
gagagaaagaacuggaauu

SEQ ID NO: 8819 - RNA, 19 nt, artificial
  Oligomer
ccauggucccuagcaaaau

SEQ ID NO: 8820 - RNA, 19 nt, artificial
  Oligomer
gugguguccuucuuccuca

SEQ ID NO: 8821 - RNA, 19 nt, artificial
  Oligomer
gcuccaagagguuuuucag

SEQ ID NO: 8822 - RNA, 19 nt, artificial
  Oligomer
cauguucuaugugaccaga

SEQ ID NO: 8823 - RNA, 19 nt, artificial
  Oligomer
uuguuugggugguuuguga

SEQ ID NO: 8824 - RNA, 19 nt, artificial
  Oligomer
gaaaaguugccgaagauga

SEQ ID NO: 8825 - RNA, 19 nt, artificial
  Oligomer
auaguauggaaguauuuga

SEQ ID NO: 8826 - RNA, 19 nt, artificial
  Oligomer
caccguugagcugugacua

SEQ ID NO: 8827 - RNA, 19 nt, artificial
  Oligomer
cuuuagugauugcuuuuau

SEQ ID NO: 8828 - RNA, 19 nt, artificial
  Oligomer
cuuuacaggaucauguaaa

SEQ ID NO: 8829 - RNA, 19 nt, artificial
  Oligomer
aaaccuuguuuguuuuauu

SEQ ID NO: 8830 - RNA, 19 nt, artificial
  Oligomer
gaagcaaacaugacuagag

SEQ ID NO: 8831 - RNA, 19 nt, artificial
  Oligomer
uugcacuccugaauuuuau

SEQ ID NO: 8832 - RNA, 19 nt, artificial
  Oligomer
gccugucgacagauacugu

SEQ ID NO: 8833 - RNA, 19 nt, artificial
  Oligomer
gcaugcauccucaucauca

SEQ ID NO: 8834 - RNA, 19 nt, artificial
  Oligomer
ccuaccaggcuguaaauga

SEQ ID NO: 8835 - RNA, 19 nt, artificial
  Oligomer
acugcccaagccuacagaa

SEQ ID NO: 8836 - RNA, 19 nt, artificial
  Oligomer
ugugaagcacugagggaga

SEQ ID NO: 8837 - RNA, 19 nt, artificial
  Oligomer
aguuuggaagguguccaaa

SEQ ID NO: 8838 - RNA, 19 nt, artificial
  Oligomer
acugagggagaccaagcaa

SEQ ID NO: 8839 - RNA, 19 nt, artificial
  Oligomer
gacaucaucaccuuggaaa

SEQ ID NO: 8840 - RNA, 19 nt, artificial
  Oligomer
ggucgacauaguauggaag

SEQ ID NO: 8841 - RNA, 19 nt, artificial
  Oligomer
aacucuucaccuugguuua

SEQ ID NO: 8842 - RNA, 19 nt, artificial
  Oligomer
cugagagaccaucuccuau

SEQ ID NO: 8843 - RNA, 19 nt, artificial
  Oligomer
caauaaagaugguccuguc

SEQ ID NO: 8844 - RNA, 19 nt, artificial
  Oligomer
uuuggaagguguccaaauu

SEQ ID NO: 8845 - RNA, 19 nt, artificial
  Oligomer
agccuugguuggaccuauu

SEQ ID NO: 8846 - RNA, 19 nt, artificial
  Oligomer
gaauguuucagcugcaguu

SEQ ID NO: 8847 - RNA, 19 nt, artificial
  Oligomer
gcucugaagaagcaaacau

SEQ ID NO: 8848 - RNA, 19 nt, artificial
  Oligomer
cugugacuacgacuugagu

SEQ ID NO: 8849 - RNA, 19 nt, artificial
  Oligomer
cuugcauuuguaccuuauu

SEQ ID NO: 8850 - RNA, 19 nt, artificial
  Oligomer
uuaucucccugcuucauau

SEQ ID NO: 8851 - RNA, 19 nt, artificial
  Oligomer
gaucuuugcccauggaagu

SEQ ID NO: 8852 - RNA, 19 nt, artificial
  Oligomer
ccuuuuuguccuagaguga

SEQ ID NO: 8853 - RNA, 19 nt, artificial
  Oligomer
gugggaaucucccagacuu

SEQ ID NO: 8854 - RNA, 19 nt, artificial
  Oligomer
cuccuugaagacauaucau

SEQ ID NO: 8855 - RNA, 19 nt, artificial
  Oligomer
cauguacucccaccguuga

SEQ ID NO: 8856 - RNA, 19 nt, artificial
  Oligomer
auuaaacucuccuuugaua

SEQ ID NO: 8857 - RNA, 19 nt, artificial
  Oligomer
caagugaaguuguaaacac

SEQ ID NO: 8858 - RNA, 19 nt, artificial
  Oligomer
gcuuucucuuucaguauua

SEQ ID NO: 8859 - RNA, 19 nt, artificial
  Oligomer
ccuagaaaccuuuaucccu

SEQ ID NO: 8860 - RNA, 19 nt, artificial
  Oligomer
gcccauggaagucucaaag

SEQ ID NO: 8861 - RNA, 19 nt, artificial
  Oligomer
gcacuuuagugauugcuuu

SEQ ID NO: 8862 - RNA, 19 nt, artificial
  Oligomer
cauuaaauguuuguugaau

SEQ ID NO: 8863 - RNA, 19 nt, artificial
  Oligomer
ugcccaagccuacagaaca

SEQ ID NO: 8864 - RNA, 19 nt, artificial
  Oligomer
gaggugugauagagccuuu

SEQ ID NO: 8865 - RNA, 19 nt, artificial
  Oligomer
caagcuuuugggcuaugac

SEQ ID NO: 8866 - RNA, 19 nt, artificial
  Oligomer
ccuuccugagaaacgucca

SEQ ID NO: 8867 - RNA, 19 nt, artificial
  Oligomer
ccugaauuuuaucaaacac

SEQ ID NO: 8868 - RNA, 19 nt, artificial
  Oligomer
gagaccaucuccuaucuuu

SEQ ID NO: 8869 - RNA, 19 nt, artificial
  Oligomer
cugcacaggaaaugcaaga

SEQ ID NO: 8870 - RNA, 19 nt, artificial
  Oligomer
gucccugagcagucuacuu

SEQ ID NO: 8871 - RNA, 19 nt, artificial
  Oligomer
ggaaguauuugagagagag

SEQ ID NO: 8872 - RNA, 19 nt, artificial
  Oligomer
cacggauuauuauuuguac

SEQ ID NO: 8873 - RNA, 19 nt, artificial
  Oligomer
ucaaggaucgggaagguua

SEQ ID NO: 8874 - RNA, 19 nt, artificial
  Oligomer
ggugauuucuugcuaagcu

SEQ ID NO: 8875 - RNA, 19 nt, artificial
  Oligomer
gagagaccaucuccuaucu

SEQ ID NO: 8876 - RNA, 19 nt, artificial
  Oligomer
aaauggugauuucuugcua

SEQ ID NO: 8877 - RNA, 19 nt, artificial
  Oligomer
cucaggugguguccuucuu

SEQ ID NO: 8878 - RNA, 19 nt, artificial
  Oligomer
agaaaagcuuccuagcuua

SEQ ID NO: 8879 - RNA, 19 nt, artificial
  Oligomer
ccaacaagauggaaagaac

SEQ ID NO: 8880 - RNA, 19 nt, artificial
  Oligomer
gguguccaaauuuaaugua

SEQ ID NO: 8881 - RNA, 19 nt, artificial
  Oligomer
caaggagaugucugaauac

SEQ ID NO: 8882 - RNA, 19 nt, artificial
  Oligomer
ggcauuuuuagcuccuuga

SEQ ID NO: 8883 - RNA, 19 nt, artificial
  Oligomer
ugacguccauguucuaugu

SEQ ID NO: 8884 - RNA, 19 nt, artificial
  Oligomer
gugauugcuuuuauuacau

SEQ ID NO: 8885 - RNA, 19 nt, artificial
  Oligomer
caagagaaacugcagaauu

SEQ ID NO: 8886 - RNA, 19 nt, artificial
  Oligomer
ccaacauugccuugcauuu

SEQ ID NO: 8887 - RNA, 19 nt, artificial
  Oligomer
ucgacauaguauggaagua

SEQ ID NO: 8888 - RNA, 19 nt, artificial
  Oligomer
gcugguuaaggugaacgca

SEQ ID NO: 8889 - RNA, 19 nt, artificial
  Oligomer
uagugggccuucauuaaau

SEQ ID NO: 8890 - RNA, 19 nt, artificial
  Oligomer
aaagaaaaguugccgaaga

SEQ ID NO: 8891 - RNA, 19 nt, artificial
  Oligomer
cuagaauccugcuuuacag

SEQ ID NO: 8892 - RNA, 19 nt, artificial
  Oligomer
agagugaugccgguaaaga

SEQ ID NO: 8893 - RNA, 19 nt, artificial
  Oligomer
agaagcaaacaugacuaga

SEQ ID NO: 8894 - RNA, 19 nt, artificial
  Oligomer
ugcuacuuuuacuuguuca

SEQ ID NO: 8895 - RNA, 19 nt, artificial
  Oligomer
uacauguuauuguuuucaa

SEQ ID NO: 8896 - RNA, 19 nt, artificial
  Oligomer
acauaguauggaaguauuu

SEQ ID NO: 8897 - RNA, 19 nt, artificial
  Oligomer
aguugaagagccugacaag

SEQ ID NO: 8898 - RNA, 19 nt, artificial
  Oligomer
augggaaacugcuccagcu

SEQ ID NO: 8899 - RNA, 19 nt, artificial
  Oligomer
uggaacacucccuagacaa

SEQ ID NO: 8900 - RNA, 19 nt, artificial
  Oligomer
agaauguggaacuccucaa

SEQ ID NO: 8901 - RNA, 19 nt, artificial
  Oligomer
ucuuuuuccuuccugagaa

SEQ ID NO: 8902 - RNA, 19 nt, artificial
  Oligomer
ccuugaagacauaucaugu

SEQ ID NO: 8903 - RNA, 19 nt, artificial
  Oligomer
aaacaugacuagagacgca

SEQ ID NO: 8904 - RNA, 19 nt, artificial
  Oligomer
ccucucagcuucuaauuuu

SEQ ID NO: 8905 - RNA, 19 nt, artificial
  Oligomer
gacaauauacacggauuau

SEQ ID NO: 8906 - RNA, 19 nt, artificial
  Oligomer
auaucuagauuucuagaaa

SEQ ID NO: 8907 - RNA, 19 nt, artificial
  Oligomer
ccuagagugagaguuugga

SEQ ID NO: 8908 - RNA, 19 nt, artificial
  Oligomer
uucugagcgggcuugugau

SEQ ID NO: 8909 - RNA, 19 nt, artificial
  Oligomer
gacgcaggauauugggagu

SEQ ID NO: 8910 - RNA, 19 nt, artificial
  Oligomer
ggugcucaauaaauauuug

SEQ ID NO: 8911 - RNA, 19 nt, artificial
  Oligomer
cuguggaacacucccuaga

SEQ ID NO: 8912 - RNA, 19 nt, artificial
  Oligomer
agagaaacugcagaauuuu

SEQ ID NO: 8913 - RNA, 19 nt, artificial
  Oligomer
uguugaauaaaagagggaa

SEQ ID NO: 8914 - RNA, 19 nt, artificial
  Oligomer
gagagagaaccuuuccacu

SEQ ID NO: 8915 - RNA, 19 nt, artificial
  Oligomer
ugaacgcacuuaucaagga

SEQ ID NO: 8916 - RNA, 19 nt, artificial
  Oligomer
acgcgcucagacaugauau

SEQ ID NO: 8917 - RNA, 19 nt, artificial
  Oligomer
cuucacuggagagaaagaa

SEQ ID NO: 8918 - RNA, 19 nt, artificial
  Oligomer
ccuuguuuguuuuauucac

SEQ ID NO: 8919 - RNA, 19 nt, artificial
  Oligomer
agaacaaaccaaaaauguu

SEQ ID NO: 8920 - RNA, 19 nt, artificial
  Oligomer
cguggagaugagacugauc

SEQ ID NO: 8921 - RNA, 19 nt, artificial
  Oligomer
cacugguguugagcaaugu

SEQ ID NO: 8922 - RNA, 19 nt, artificial
  Oligomer
uguaaaugcucaaagaugu

SEQ ID NO: 8923 - RNA, 19 nt, artificial
  Oligomer
caucaucucugccuuugag

SEQ ID NO: 8924 - RNA, 19 nt, artificial
  Oligomer
cuaccuuuugauaaaaugu

SEQ ID NO: 8925 - RNA, 19 nt, artificial
  Oligomer
aaggugaacgcacuuauca

SEQ ID NO: 8926 - RNA, 19 nt, artificial
  Oligomer
gaacacucccuagacaaua

SEQ ID NO: 8927 - RNA, 19 nt, artificial
  Oligomer
accagacugcacaggaaau

SEQ ID NO: 8928 - RNA, 19 nt, artificial
  Oligomer
acaagugaaguuguaaaca

SEQ ID NO: 8929 - RNA, 19 nt, artificial
  Oligomer
cauucuuucuuccuccagu

SEQ ID NO: 8930 - RNA, 19 nt, artificial
  Oligomer
cagacaugauaugcggcua

SEQ ID NO: 8931 - RNA, 19 nt, artificial
  Oligomer
caaccugcacuucauaucu

SEQ ID NO: 8932 - RNA, 19 nt, artificial
  Oligomer
cuuuguuccugcuuucucu

SEQ ID NO: 8933 - RNA, 19 nt, artificial
  Oligomer
cuucuuuaccuucauuuca

SEQ ID NO: 8934 - RNA, 19 nt, artificial
  Oligomer
aacccuucugcuuucuauu

SEQ ID NO: 8935 - RNA, 19 nt, artificial
  Oligomer
acuucacuggagagaaaga

SEQ ID NO: 8936 - RNA, 19 nt, artificial
  Oligomer
gucuccucucagcuucuaa

SEQ ID NO: 8937 - RNA, 19 nt, artificial
  Oligomer
ggaaagaaccacgcaggau

SEQ ID NO: 8938 - RNA, 19 nt, artificial
  Oligomer
acucccuagacaauaaaga

SEQ ID NO: 8939 - RNA, 19 nt, artificial
  Oligomer
guaaagaaaaguugccgaa

SEQ ID NO: 8940 - RNA, 19 nt, artificial
  Oligomer
cuaucuuuuauuucauuca

SEQ ID NO: 8941 - RNA, 19 nt, artificial
  Oligomer
aaccugcacuucauaucua

SEQ ID NO: 8942 - RNA, 19 nt, artificial
  Oligomer
agcgggcuugugauaugca

SEQ ID NO: 8943 - RNA, 19 nt, artificial
  Oligomer
ugcaagagaaacugcagaa

SEQ ID NO: 8944 - RNA, 19 nt, artificial
  Oligomer
cuggagagaaagaacugga

SEQ ID NO: 8945 - RNA, 19 nt, artificial
  Oligomer
aauauacacggauuauuau

SEQ ID NO: 8946 - RNA, 19 nt, artificial
  Oligomer
ucugagagaccaucuccua

SEQ ID NO: 8947 - RNA, 19 nt, artificial
  Oligomer
ucuaugguguggaugggaa

SEQ ID NO: 8948 - RNA, 19 nt, artificial
  Oligomer
cagaauguggaacuccuca

SEQ ID NO: 8949 - RNA, 19 nt, artificial
  Oligomer
acagaauuccaccggugca

SEQ ID NO: 8950 - RNA, 19 nt, artificial
  Oligomer
cuuacuauucccacuuuca

SEQ ID NO: 8951 - RNA, 19 nt, artificial
  Oligomer
gcaagagaaacugcagaau

SEQ ID NO: 8952 - RNA, 19 nt, artificial
  Oligomer
gaaucucccagacuuguuu

SEQ ID NO: 8953 - RNA, 19 nt, artificial
  Oligomer
uggagaaggacaucaucac

SEQ ID NO: 8954 - RNA, 19 nt, artificial
  Oligomer
gagaaccuuuccacuccca

SEQ ID NO: 8955 - RNA, 19 nt, artificial
  Oligomer
acuucccuguucuuuaaga

SEQ ID NO: 8956 - RNA, 19 nt, artificial
  Oligomer
guguuucccuagacucugu

SEQ ID NO: 8957 - RNA, 19 nt, artificial
  Oligomer
aggaaaugcaagagaaacu

SEQ ID NO: 8958 - RNA, 19 nt, artificial
  Oligomer
uucaguuccagcuuuugua

SEQ ID NO: 8959 - RNA, 19 nt, artificial
  Oligomer
cgcgcucagacaugauaug

SEQ ID NO: 8960 - RNA, 19 nt, artificial
  Oligomer
augucugaauacugcagca

SEQ ID NO: 8961 - RNA, 19 nt, artificial
  Oligomer
ugguuaaggugaacgcacu

SEQ ID NO: 8962 - RNA, 19 nt, artificial
  Oligomer
ugcauuuguaccuuauuga

SEQ ID NO: 8963 - RNA, 19 nt, artificial
  Oligomer
cccaagccuacagaacaaa

SEQ ID NO: 8964 - RNA, 19 nt, artificial
  Oligomer
cuuucuuccuccagucugu

SEQ ID NO: 8965 - RNA, 19 nt, artificial
  Oligomer
aagaugucugagagaccau

SEQ ID NO: 8966 - RNA, 19 nt, artificial
  Oligomer
gccuugcacuccugaauuu

SEQ ID NO: 8967 - RNA, 19 nt, artificial
  Oligomer
cuuuaucccugcuuaucug

SEQ ID NO: 8968 - RNA, 19 nt, artificial
  Oligomer
uguuauuguuuucaaccua

SEQ ID NO: 8969 - RNA, 19 nt, artificial
  Oligomer
aaaagagggaagaaggcaa

SEQ ID NO: 8970 - RNA, 19 nt, artificial
  Oligomer
gaaccuuuccacucccacu

SEQ ID NO: 8971 - RNA, 19 nt, artificial
  Oligomer
guccaaauuuaauguagac

SEQ ID NO: 8972 - RNA, 19 nt, artificial
  Oligomer
aguuccagcuuuuguagau

SEQ ID NO: 8973 - RNA, 19 nt, artificial
  Oligomer
ggagaugucugaauacugc

SEQ ID NO: 8974 - RNA, 19 nt, artificial
  Oligomer
acagcuguuguugagcgaa

SEQ ID NO: 8975 - RNA, 19 nt, artificial
  Oligomer
caucuccuaucuuuuauuu

SEQ ID NO: 8976 - RNA, 19 nt, artificial
  Oligomer
cccugcuuaucugaaacuu

SEQ ID NO: 8977 - RNA, 19 nt, artificial
  Oligomer
ggugaacgcacuuaucaag

SEQ ID NO: 8978 - RNA, 19 nt, artificial
  Oligomer
aacugcuccagcuccaaga

SEQ ID NO: 8979 - RNA, 19 nt, artificial
  Oligomer
ugagcaaugugcacuucac

SEQ ID NO: 8980 - RNA, 19 nt, artificial
  Oligomer
caucauguaccaagugcuu

SEQ ID NO: 8981 - RNA, 19 nt, artificial
  Oligomer
ugaagaagcaaacaugacu

SEQ ID NO: 8982 - RNA, 19 nt, artificial
  Oligomer
uacagaacaaaccaaaaau

SEQ ID NO: 8983 - RNA, 19 nt, artificial
  Oligomer
guacaucgaggcucuugcu

SEQ ID NO: 8984 - RNA, 19 nt, artificial
  Oligomer
gagcuuuguuacugaaaug

SEQ ID NO: 8985 - RNA, 19 nt, artificial
  Oligomer
acccuucugcuuucuauua

SEQ ID NO: 8986 - RNA, 19 nt, artificial
  Oligomer
uuuagugauugcuuuuauu

SEQ ID NO: 8987 - RNA, 19 nt, artificial
  Oligomer
aacagcuguuguugagcga

SEQ ID NO: 8988 - RNA, 19 nt, artificial
  Oligomer
guuucucugagcuuuguua

SEQ ID NO: 8989 - RNA, 19 nt, artificial
  Oligomer
cucuaaaaaagaaccgagu

SEQ ID NO: 8990 - RNA, 19 nt, artificial
  Oligomer
gagagugaugccgguaaag

SEQ ID NO: 8991 - RNA, 19 nt, artificial
  Oligomer
agagguuuuucagcucuuu

SEQ ID NO: 8992 - RNA, 19 nt, artificial
  Oligomer
aggauauguugcucaccac

SEQ ID NO: 8993 - RNA, 19 nt, artificial
  Oligomer
ccuuuucugugaagcccuu

SEQ ID NO: 8994 - RNA, 19 nt, artificial
  Oligomer
ugaugccgguaaagaaaag

SEQ ID NO: 8995 - RNA, 19 nt, artificial
  Oligomer
ccuucuuccucaagucuug

SEQ ID NO: 8996 - RNA, 19 nt, artificial
  Oligomer
cugagaaacguccaucucu

SEQ ID NO: 8997 - RNA, 19 nt, artificial
  Oligomer
gauuugguuguuuaaauau

SEQ ID NO: 8998 - RNA, 19 nt, artificial
  Oligomer
uauuaaacucuccuuugau

SEQ ID NO: 8999 - RNA, 19 nt, artificial
  Oligomer
uucuggagaaggacaucau

SEQ ID NO: 9000 - RNA, 19 nt, artificial
  Oligomer
agacugcacaggaaaugca

SEQ ID NO: 9001 - RNA, 19 nt, artificial
  Oligomer
gcucaauaaauauuuguuu

SEQ ID NO: 9002 - RNA, 19 nt, artificial
  Oligomer
aaaccaaaaauguucuuca

SEQ ID NO: 9003 - RNA, 19 nt, artificial
  Oligomer
cucugaagaagcaaacaug

SEQ ID NO: 9004 - RNA, 19 nt, artificial
  Oligomer
cuguaguagucaaggugcu

SEQ ID NO: 9005 - RNA, 19 nt, artificial
  Oligomer
ugcuuuuauuacauuaguu

SEQ ID NO: 9006 - RNA, 19 nt, artificial
  Oligomer
gugcguucccuucaguacu

SEQ ID NO: 9007 - RNA, 19 nt, artificial
  Oligomer
caguuccagcuuuuguaga

SEQ ID NO: 9008 - RNA, 19 nt, artificial
  Oligomer
gacaagugaaguuguaaac

SEQ ID NO: 9009 - RNA, 19 nt, artificial
  Oligomer
uugcccauggaagucucaa

SEQ ID NO: 9010 - RNA, 19 nt, artificial
  Oligomer
uagcuacaauccuaccuuu

SEQ ID NO: 9011 - RNA, 19 nt, artificial
  Oligomer
ccauguucuaugugaccag

SEQ ID NO: 9012 - RNA, 19 nt, artificial
  Oligomer
guagucaaggugcucaaua

SEQ ID NO: 9013 - RNA, 19 nt, artificial
  Oligomer
ccaccuggaggauauguug

SEQ ID NO: 9014 - RNA, 19 nt, artificial
  Oligomer
ucugagcgggcuugugaua

SEQ ID NO: 9015 - RNA, 19 nt, artificial
  Oligomer
gccagaauguggaacuccu

SEQ ID NO: 9016 - RNA, 19 nt, artificial
  Oligomer
uucuuuaccggcaucacuc

SEQ ID NO: 9017 - RNA, 19 nt, artificial
  Oligomer
uuaaauuuggacaccuucc

SEQ ID NO: 9018 - RNA, 19 nt, artificial
  Oligomer
uuccauacuaugucgaccc

SEQ ID NO: 9019 - RNA, 19 nt, artificial
  Oligomer
uuuaccggcaucacucucc

SEQ ID NO: 9020 - RNA, 19 nt, artificial
  Oligomer
uugagcaagagccucgaug

SEQ ID NO: 9021 - RNA, 19 nt, artificial
  Oligomer
uugagcauuuacaugaucc

SEQ ID NO: 9022 - RNA, 19 nt, artificial
  Oligomer
uugauaagugcguucaccu

SEQ ID NO: 9023 - RNA, 19 nt, artificial
  Oligomer
uuaaacaaccaaauccugg

SEQ ID NO: 9024 - RNA, 19 nt, artificial
  Oligomer
augaagugcagguugauug

SEQ ID NO: 9025 - RNA, 19 nt, artificial
  Oligomer
uucucuugcauuuccugug

SEQ ID NO: 9026 - RNA, 19 nt, artificial
  Oligomer
uuguucuguaggcuugggc

SEQ ID NO: 9027 - RNA, 19 nt, artificial
  Oligomer
uuccugugcagucugguca

SEQ ID NO: 9028 - RNA, 19 nt, artificial
  Oligomer
auaaccuucccgauccuug

SEQ ID NO: 9029 - RNA, 19 nt, artificial
  Oligomer
uuaaagaacagggaaguug

SEQ ID NO: 9030 - RNA, 19 nt, artificial
  Oligomer
uauuuaaacaaccaaaucc

SEQ ID NO: 9031 - RNA, 19 nt, artificial
  Oligomer
uucuagacagauuuggugg

SEQ ID NO: 9032 - RNA, 19 nt, artificial
  Oligomer
uuuugguuuguucuguagg

SEQ ID NO: 9033 - RNA, 19 nt, artificial
  Oligomer
ucuuuuuuagaguuuccug

SEQ ID NO: 9034 - RNA, 19 nt, artificial
  Oligomer
uuagaguuuccugaugaug

SEQ ID NO: 9035 - RNA, 19 nt, artificial
  Oligomer
uuucucuugcauuuccugu

SEQ ID NO: 9036 - RNA, 19 nt, artificial
  Oligomer
uucuuuuuuagaguuuccu

SEQ ID NO: 9037 - RNA, 19 nt, artificial
  Oligomer
auuaaauuuggacaccuuc

SEQ ID NO: 9038 - RNA, 19 nt, artificial
  Oligomer
uuccugaugaugaggaugc

SEQ ID NO: 9039 - RNA, 19 nt, artificial
  Oligomer
uuggacaccuuccaaacuc

SEQ ID NO: 9040 - RNA, 19 nt, artificial
  Oligomer
uuugagacuuccaugggca

SEQ ID NO: 9041 - RNA, 19 nt, artificial
  Oligomer
uuccaaggugaugaugucc

SEQ ID NO: 9042 - RNA, 19 nt, artificial
  Oligomer
uacaacuucacuugucagg

SEQ ID NO: 9043 - RNA, 19 nt, artificial
  Oligomer
uugaggaagaaggacacca

SEQ ID NO: 9044 - RNA, 19 nt, artificial
  Oligomer
uaagggagagagauggacg

SEQ ID NO: 9045 - RNA, 19 nt, artificial
  Oligomer
uuucccauccacaccauag

SEQ ID NO: 9046 - RNA, 19 nt, artificial
  Oligomer
uaauaauccguguauauug

SEQ ID NO: 9047 - RNA, 19 nt, artificial
  Oligomer
ucguagucacagcucaacg

SEQ ID NO: 9048 - RNA, 19 nt, artificial
  Oligomer
ucuuugagcauuuacauga

SEQ ID NO: 9049 - RNA, 19 nt, artificial
  Oligomer
uuucuuuaccggcaucacu

SEQ ID NO: 9050 - RNA, 19 nt, artificial
  Oligomer
uuugauaaaauucaggagu

SEQ ID NO: 9051 - RNA, 19 nt, artificial
  Oligomer
uuucucuccagugaagugc

SEQ ID NO: 9052 - RNA, 19 nt, artificial
  Oligomer
ucaaaagguaggauuguag

SEQ ID NO: 9053 - RNA, 19 nt, artificial
  Oligomer
uuuccugugcagucugguc

SEQ ID NO: 9054 - RNA, 19 nt, artificial
  Oligomer
ucucuagucauguuugcuu

SEQ ID NO: 9055 - RNA, 19 nt, artificial
  Oligomer
uuuacauuuuaaaugaggg

SEQ ID NO: 9056 - RNA, 19 nt, artificial
  Oligomer
uagaacauggacgucauag

SEQ ID NO: 9057 - RNA, 19 nt, artificial
  Oligomer
uccaaggugaugauguccu

SEQ ID NO: 9058 - RNA, 19 nt, artificial
  Oligomer
uagaguuuccugaugauga

SEQ ID NO: 9059 - RNA, 19 nt, artificial
  Oligomer
uaacugugcaaaauucugc

SEQ ID NO: 9060 - RNA, 19 nt, artificial
  Oligomer
uugcauuuccugugcaguc

SEQ ID NO: 9061 - RNA, 19 nt, artificial
  Oligomer
uaguaagggagagagaugg

SEQ ID NO: 9062 - RNA, 19 nt, artificial
  Oligomer
uaugucgacccaaaggcag

SEQ ID NO: 9063 - RNA, 19 nt, artificial
  Oligomer
uuuacaacuucacuuguca

SEQ ID NO: 9064 - RNA, 19 nt, artificial
  Oligomer
uucaccugaaggcagacag

SEQ ID NO: 9065 - RNA, 19 nt, artificial
  Oligomer
aguacugugguccacaucc

SEQ ID NO: 9066 - RNA, 19 nt, artificial
  Oligomer
uuauugagcaccuugacua

SEQ ID NO: 9067 - RNA, 19 nt, artificial
  Oligomer
uacuaugucgacccaaagg

SEQ ID NO: 9068 - RNA, 19 nt, artificial
  Oligomer
uauucagacaucuccuugc

SEQ ID NO: 9069 - RNA, 19 nt, artificial
  Oligomer
aucuuugagacuuccaugg

SEQ ID NO: 9070 - RNA, 19 nt, artificial
  Oligomer
uagucauguuugcuucuuc

SEQ ID NO: 9071 - RNA, 19 nt, artificial
  Oligomer
uucacagaaaaggagcugg

SEQ ID NO: 9072 - RNA, 19 nt, artificial
  Oligomer
uucacuugucaggcucuuc

SEQ ID NO: 9073 - RNA, 19 nt, artificial
  Oligomer
uuaggcagcaaguugagga

SEQ ID NO: 9074 - RNA, 19 nt, artificial
  Oligomer
uuaaugaaggcccacuaug

SEQ ID NO: 9075 - RNA, 19 nt, artificial
  Oligomer
uuuuuagaguuuccugaug

SEQ ID NO: 9076 - RNA, 19 nt, artificial
  Oligomer
aucagucucaucuccacgg

SEQ ID NO: 9077 - RNA, 19 nt, artificial
  Oligomer
uuuuagaguuuccugauga

SEQ ID NO: 9078 - RNA, 19 nt, artificial
  Oligomer
uuuauugagcaccuugacu

SEQ ID NO: 9079 - RNA, 19 nt, artificial
  Oligomer
ucagacaucuccuugcacc

SEQ ID NO: 9080 - RNA, 19 nt, artificial
  Oligomer
ucacuugucaggcucuuca

SEQ ID NO: 9081 - RNA, 19 nt, artificial
  Oligomer
uuugguuuguucuguaggc

SEQ ID NO: 9082 - RNA, 19 nt, artificial
  Oligomer
uuuaucaaaagguaggauu

SEQ ID NO: 9083 - RNA, 19 nt, artificial
  Oligomer
acuaugucgacccaaaggc

SEQ ID NO: 9084 - RNA, 19 nt, artificial
  Oligomer
ugcagcugaaacauuccug

SEQ ID NO: 9085 - RNA, 19 nt, artificial
  Oligomer
ucuacaggcaaagggcuuc

SEQ ID NO: 9086 - RNA, 19 nt, artificial
  Oligomer
aauuuauaugcccucuccc

SEQ ID NO: 9087 - RNA, 19 nt, artificial
  Oligomer
ucaaaggcagagaugaugg

SEQ ID NO: 9088 - RNA, 19 nt, artificial
  Oligomer
uaaauuuggacaccuucca

SEQ ID NO: 9089 - RNA, 19 nt, artificial
  Oligomer
aucuuuauugucuagggag

SEQ ID NO: 9090 - RNA, 19 nt, artificial
  Oligomer
uguaccaggaaccucguuu

SEQ ID NO: 9091 - RNA, 19 nt, artificial
  Oligomer
uuuccugaugaugaggaug

SEQ ID NO: 9092 - RNA, 19 nt, artificial
  Oligomer
uaaagaacagggaaguugg

SEQ ID NO: 9093 - RNA, 19 nt, artificial
  Oligomer
uugaagagggugacuagag

SEQ ID NO: 9094 - RNA, 19 nt, artificial
  Oligomer
auauuuauugagcaccuug

SEQ ID NO: 9095 - RNA, 19 nt, artificial
  Oligomer
uucuggacacugcagcaag

SEQ ID NO: 9096 - RNA, 19 nt, artificial
  Oligomer
uguuccacaguaucugucg

SEQ ID NO: 9097 - RNA, 19 nt, artificial
  Oligomer
auagaaagcagaaggguuc

SEQ ID NO: 9098 - RNA, 19 nt, artificial
  Oligomer
uaaaagauaggagaugguc

SEQ ID NO: 9099 - RNA, 19 nt, artificial
  Oligomer
uagaguacugugguccaca

SEQ ID NO: 9100 - RNA, 19 nt, artificial
  Oligomer
uuauugucuagggaguguu

SEQ ID NO: 9101 - RNA, 19 nt, artificial
  Oligomer
uuggagcuggagcaguuuc

SEQ ID NO: 9102 - RNA, 19 nt, artificial
  Oligomer
uguaauaaaagcaaucacu

SEQ ID NO: 9103 - RNA, 19 nt, artificial
  Oligomer
ugugagaacagacuggagg

SEQ ID NO: 9104 - RNA, 19 nt, artificial
  Oligomer
uauauugucaaaaggaaca

SEQ ID NO: 9105 - RNA, 19 nt, artificial
  Oligomer
uuggucucccucagugcuu

SEQ ID NO: 9106 - RNA, 19 nt, artificial
  Oligomer
auucgcucaacaacagcug

SEQ ID NO: 9107 - RNA, 19 nt, artificial
  Oligomer
aaugucuacauuaaauuug

SEQ ID NO: 9108 - RNA, 19 nt, artificial
  Oligomer
ucuacauuaaauuuggaca

SEQ ID NO: 9109 - RNA, 19 nt, artificial
  Oligomer
ugggaguacaugcugaagc

SEQ ID NO: 9110 - RNA, 19 nt, artificial
  Oligomer
uggaugaagaacauuuuug

SEQ ID NO: 9111 - RNA, 19 nt, artificial
  Oligomer
ucucucucucaaauacuuc

SEQ ID NO: 9112 - RNA, 19 nt, artificial
  Oligomer
uucaggagugcaaggcuuc

SEQ ID NO: 9113 - RNA, 19 nt, artificial
  Oligomer
uuagcaagaaaucaccauu

SEQ ID NO: 9114 - RNA, 19 nt, artificial
  Oligomer
uucaaggagcuaaaaaugc

SEQ ID NO: 9115 - RNA, 19 nt, artificial
  Oligomer
uguuugcuucuucagagcc

SEQ ID NO: 9116 - RNA, 19 nt, artificial
  Oligomer
uguuugauaaaauucagga

SEQ ID NO: 9117 - RNA, 19 nt, artificial
  Oligomer
accuuaaccagcaugucgg

SEQ ID NO: 9118 - RNA, 19 nt, artificial
  Oligomer
uuccaguucuuucucucca

SEQ ID NO: 9119 - RNA, 19 nt, artificial
  Oligomer
uugacuacuacaggccuag

SEQ ID NO: 9120 - RNA, 19 nt, artificial
  Oligomer
augugaaggaaguuaucuc

SEQ ID NO: 9121 - RNA, 19 nt, artificial
  Oligomer
augaagguaaagaagggag

SEQ ID NO: 9122 - RNA, 19 nt, artificial
  Oligomer
uuuuugguuuguucuguag

SEQ ID NO: 9123 - RNA, 19 nt, artificial
  Oligomer
uuuaaacaaccaaauccug

SEQ ID NO: 9124 - RNA, 19 nt, artificial
  Oligomer
ucaguaacaaagcucagag

SEQ ID NO: 9125 - RNA, 19 nt, artificial
  Oligomer
uuucagauaagcagggaua

SEQ ID NO: 9126 - RNA, 19 nt, artificial
  Oligomer
aaacauuuaaugaaggccc

SEQ ID NO: 9127 - RNA, 19 nt, artificial
  Oligomer
uuacaugauccuguaaagc

SEQ ID NO: 9128 - RNA, 19 nt, artificial
  Oligomer
uuccaaacucucacucuag

SEQ ID NO: 9129 - RNA, 19 nt, artificial
  Oligomer
ucugcccucauuuacagcc

SEQ ID NO: 9130 - RNA, 19 nt, artificial
  Oligomer
aaaagggagacucaagucg

SEQ ID NO: 9131 - RNA, 19 nt, artificial
  Oligomer
cauuuaaugagguucaagg

SEQ ID NO: 9132 - RNA, 19 nt, artificial
  Oligomer
augaagaacauuuuugguu

SEQ ID NO: 9133 - RNA, 19 nt, artificial
  Oligomer
uuaugugagaacagacugg

SEQ ID NO: 9134 - RNA, 19 nt, artificial
  Oligomer
uuacaacuucacuugucag

SEQ ID NO: 9135 - RNA, 19 nt, artificial
  Oligomer
cugaugaugaggaugcaug

SEQ ID NO: 9136 - RNA, 19 nt, artificial
  Oligomer
uggugagcaacauauccuc

SEQ ID NO: 9137 - RNA, 19 nt, artificial
  Oligomer
uccaucuuguuggucaacc

SEQ ID NO: 9138 - RNA, 19 nt, artificial
  Oligomer
ucuagauaugaagugcagg

SEQ ID NO: 9139 - RNA, 19 nt, artificial
  Oligomer
uugauaaaauucaggagug

SEQ ID NO: 9140 - RNA, 19 nt, artificial
  Oligomer
ugcaaaauucugcaguuuc

SEQ ID NO: 9141 - RNA, 19 nt, artificial
  Oligomer
aaacacuugagcaagagcc

SEQ ID NO: 9142 - RNA, 19 nt, artificial
  Oligomer
ucauguuugcuucuucaga

SEQ ID NO: 9143 - RNA, 19 nt, artificial
  Oligomer
ugauaugucuucaaggagc

SEQ ID NO: 9144 - RNA, 19 nt, artificial
  Oligomer
ucaaaggagaguuuaauac

SEQ ID NO: 9145 - RNA, 19 nt, artificial
  Oligomer
auguucuaacaauucgcuc

SEQ ID NO: 9146 - RNA, 19 nt, artificial
  Oligomer
aauaugagcauuuauuugg

SEQ ID NO: 9147 - RNA, 19 nt, artificial
  Oligomer
uuuucuuuaccggcaucac

SEQ ID NO: 9148 - RNA, 19 nt, artificial
  Oligomer
uagaaaucuagauaugaag

SEQ ID NO: 9149 - RNA, 19 nt, artificial
  Oligomer
auaagguacaaaugcaagg

SEQ ID NO: 9150 - RNA, 19 nt, artificial
  Oligomer
uaagcagggauaaagguuu

SEQ ID NO: 9151 - RNA, 19 nt, artificial
  Oligomer
uacaucuuugagcauuuac

SEQ ID NO: 9152 - RNA, 19 nt, artificial
  Oligomer
uucaccuuaaccagcaugu

SEQ ID NO: 9153 - RNA, 19 nt, artificial
  Oligomer
ucuaggacaaaaagggcgg

SEQ ID NO: 9154 - RNA, 19 nt, artificial
  Oligomer
uuucucaggaaggaaaaag

SEQ ID NO: 9155 - RNA, 19 nt, artificial
  Oligomer
uucaacaaacauuuaauga

SEQ ID NO: 9156 - RNA, 19 nt, artificial
  Oligomer
aauacuuccauacuauguc

SEQ ID NO: 9157 - RNA, 19 nt, artificial
  Oligomer
aacauggacgucauagccc

SEQ ID NO: 9158 - RNA, 19 nt, artificial
  Oligomer
ucaaaaggaacauuuuauc

SEQ ID NO: 9159 - RNA, 19 nt, artificial
  Oligomer
aagaguguccuuccacugg

SEQ ID NO: 9160 - RNA, 19 nt, artificial
  Oligomer
aucaaaggcucuaucacac

SEQ ID NO: 9161 - RNA, 19 nt, artificial
  Oligomer
uuuuuuagaguuuccugau

SEQ ID NO: 9162 - RNA, 19 nt, artificial
  Oligomer
ucaagucguagucacagcu

SEQ ID NO: 9163 - RNA, 19 nt, artificial
  Oligomer
uugcaccgguggaauucug

SEQ ID NO: 9164 - RNA, 19 nt, artificial
  Oligomer
uccagugaagugcacauug

SEQ ID NO: 9165 - RNA, 19 nt, artificial
  Oligomer
aucuuugagcauuuacaug

SEQ ID NO: 9166 - RNA, 19 nt, artificial
  Oligomer
auuuaaugagguucaaggg

SEQ ID NO: 9167 - RNA, 19 nt, artificial
  Oligomer
ugcacauugcucaacacca

SEQ ID NO: 9168 - RNA, 19 nt, artificial
  Oligomer
uuaucaaaagguaggauug

SEQ ID NO: 9169 - RNA, 19 nt, artificial
  Oligomer
augagcucccucauuucca

SEQ ID NO: 9170 - RNA, 19 nt, artificial
  Oligomer
uacaugauccuguaaagca

SEQ ID NO: 9171 - RNA, 19 nt, artificial
  Oligomer
uaacaauucgcucaacaac

SEQ ID NO: 9172 - RNA, 19 nt, artificial
  Oligomer
aucaauaagguacaaaugc

SEQ ID NO: 9173 - RNA, 19 nt, artificial
  Oligomer
uaugaagugcagguugauu

SEQ ID NO: 9174 - RNA, 19 nt, artificial
  Oligomer
auuuaaacaaccaaauccu

SEQ ID NO: 9175 - RNA, 19 nt, artificial
  Oligomer
aaauucugcaguuucucuu

SEQ ID NO: 9176 - RNA, 19 nt, artificial
  Oligomer
uaggauuguagcuaagguu

SEQ ID NO: 9177 - RNA, 19 nt, artificial
  Oligomer
uucaacugcagcugaaaca

SEQ ID NO: 9178 - RNA, 19 nt, artificial
  Oligomer
auauaaacugcaauaaaug

SEQ ID NO: 9179 - RNA, 19 nt, artificial
  Oligomer
uaauguaauaaaagcaauc

SEQ ID NO: 9180 - RNA, 19 nt, artificial
  Oligomer
auucuagacagauuuggug

SEQ ID NO: 9181 - RNA, 19 nt, artificial
  Oligomer
uucccgauccuugauaagu

SEQ ID NO: 9182 - RNA, 19 nt, artificial
  Oligomer
ucuaucacaccuccugugg

SEQ ID NO: 9183 - RNA, 19 nt, artificial
  Oligomer
uacauuacaucuuugagca

SEQ ID NO: 9184 - RNA, 19 nt, artificial
  Oligomer
ugcauccugaagaucaaag

SEQ ID NO: 9185 - RNA, 19 nt, artificial
  Oligomer
augaacaaguaaaaguagc

SEQ ID NO: 9186 - RNA, 19 nt, artificial
  Oligomer
uaaagcaggauucuagaca

SEQ ID NO: 9187 - RNA, 19 nt, artificial
  Oligomer
uucucauaaaccaagguga

SEQ ID NO: 9188 - RNA, 19 nt, artificial
  Oligomer
auaagcagggauaaagguu

SEQ ID NO: 9189 - RNA, 19 nt, artificial
  Oligomer
auuccaguucuuucucucc

SEQ ID NO: 9190 - RNA, 19 nt, artificial
  Oligomer
ucgauguaccaggaaccuc

SEQ ID NO: 9191 - RNA, 19 nt, artificial
  Oligomer
uuccacaguaucugucgac

SEQ ID NO: 9192 - RNA, 19 nt, artificial
  Oligomer
uagcauauauauaaacugc

SEQ ID NO: 9193 - RNA, 19 nt, artificial
  Oligomer
ucccgauccuugauaagug

SEQ ID NO: 9194 - RNA, 19 nt, artificial
  Oligomer
uugguuuguucuguaggcu

SEQ ID NO: 9195 - RNA, 19 nt, artificial
  Oligomer
uuuauugucuagggagugu

SEQ ID NO: 9196 - RNA, 19 nt, artificial
  Oligomer
uacaaaugcaaggcaaugu

SEQ ID NO: 9197 - RNA, 19 nt, artificial
  Oligomer
uaaaauucaggagugcaag

SEQ ID NO: 9198 - RNA, 19 nt, artificial
  Oligomer
auuuccaaggugaugaugu

SEQ ID NO: 9199 - RNA, 19 nt, artificial
  Oligomer
uaucaugucugagcgcgug

SEQ ID NO: 9200 - RNA, 19 nt, artificial
  Oligomer
ugaugauguccuucuccag

SEQ ID NO: 9201 - RNA, 19 nt, artificial
  Oligomer
ugggcaaagaucaauaagg

SEQ ID NO: 9202 - RNA, 19 nt, artificial
  Oligomer
auugucuagggaguguucc

SEQ ID NO: 9203 - RNA, 19 nt, artificial
  Oligomer
agaaguagacugcucaggg

SEQ ID NO: 9204 - RNA, 19 nt, artificial
  Oligomer
ucguuugguguuccgcaug

SEQ ID NO: 9205 - RNA, 19 nt, artificial
  Oligomer
uugagcaccuugacuacua

SEQ ID NO: 9206 - RNA, 19 nt, artificial
  Oligomer
uacugaaagagaaagcagg

SEQ ID NO: 9207 - RNA, 19 nt, artificial
  Oligomer
uugucaggcucuucaacug

SEQ ID NO: 9208 - RNA, 19 nt, artificial
  Oligomer
uccugcgugguucuuucca

SEQ ID NO: 9209 - RNA, 19 nt, artificial
  Oligomer
aacaauucgcucaacaaca

SEQ ID NO: 9210 - RNA, 19 nt, artificial
  Oligomer
uucagacaucuccuugcac

SEQ ID NO: 9211 - RNA, 19 nt, artificial
  Oligomer
auuuacaugauccuguaaa

SEQ ID NO: 9212 - RNA, 19 nt, artificial
  Oligomer
acagaaaccgugcauccug

SEQ ID NO: 9213 - RNA, 19 nt, artificial
  Oligomer
uaaagaagggagagauaug

SEQ ID NO: 9214 - RNA, 19 nt, artificial
  Oligomer
uuuugcuagggaccauggg

SEQ ID NO: 9215 - RNA, 19 nt, artificial
  Oligomer
uauuuauugagcaccuuga

SEQ ID NO: 9216 - RNA, 19 nt, artificial
  Oligomer
aaggugaugauguccuucu

SEQ ID NO: 9217 - RNA, 19 nt, artificial
  Oligomer
ucuuugagacuuccauggg

SEQ ID NO: 9218 - RNA, 19 nt, artificial
  Oligomer
uccagagcgaaauuccagu

SEQ ID NO: 9219 - RNA, 19 nt, artificial
  Oligomer
uucaguaacaaagcucaga

SEQ ID NO: 9220 - RNA, 19 nt, artificial
  Oligomer
uauaaacugcaauaaaugc

SEQ ID NO: 9221 - RNA, 19 nt, artificial
  Oligomer
auuuggacaccuuccaaac

SEQ ID NO: 9222 - RNA, 19 nt, artificial
  Oligomer
aucuucggcaacuuuucuu

SEQ ID NO: 9223 - RNA, 19 nt, artificial
  Oligomer
ucagacaucuuaacuaaug

SEQ ID NO: 9224 - RNA, 19 nt, artificial
  Oligomer
aaacaaacaagguuucugc

SEQ ID NO: 9225 - RNA, 19 nt, artificial
  Oligomer
auaauaucaaaggagaguu

SEQ ID NO: 9226 - RNA, 19 nt, artificial
  Oligomer
auugucaaaaggaacauuu

SEQ ID NO: 9227 - RNA, 19 nt, artificial
  Oligomer
uacaggccuagcauuuugc

SEQ ID NO: 9228 - RNA, 19 nt, artificial
  Oligomer
ucucuugcauuuccugugc

SEQ ID NO: 9229 - RNA, 19 nt, artificial
  Oligomer
augaaggcccacuaugugc

SEQ ID NO: 9230 - RNA, 19 nt, artificial
  Oligomer
ugaagcagggagauaagcu

SEQ ID NO: 9231 - RNA, 19 nt, artificial
  Oligomer
uucuagguugaaaacaaua

SEQ ID NO: 9232 - RNA, 19 nt, artificial
  Oligomer
ugucuagggaguguuccac

SEQ ID NO: 9233 - RNA, 19 nt, artificial
  Oligomer
agagauaugaagcagggag

SEQ ID NO: 9234 - RNA, 19 nt, artificial
  Oligomer
agaguuuacauuuuaaaug

SEQ ID NO: 9235 - RNA, 19 nt, artificial
  Oligomer
auacuuccauacuaugucg

SEQ ID NO: 9236 - RNA, 19 nt, artificial
  Oligomer
cuuuuauucaacaaacauu

SEQ ID NO: 9237 - RNA, 19 nt, artificial
  Oligomer
augucuacauuaaauuugg

SEQ ID NO: 9238 - RNA, 19 nt, artificial
  Oligomer
ugugaaggaaguuaucuca

SEQ ID NO: 9239 - RNA, 19 nt, artificial
  Oligomer
uccugaagaucaaaggcuc

SEQ ID NO: 9240 - RNA, 19 nt, artificial
  Oligomer
agauaagcagggauaaagg

SEQ ID NO: 9241 - RNA, 19 nt, artificial
  Oligomer
aagauguucuaacaauucg

SEQ ID NO: 9242 - RNA, 19 nt, artificial
  Oligomer
uuaauacugaaagagaaag

SEQ ID NO: 9243 - RNA, 19 nt, artificial
  Oligomer
uggaaagguucucucucuc

SEQ ID NO: 9244 - RNA, 19 nt, artificial
  Oligomer
uuucaguaacaaagcucag

SEQ ID NO: 9245 - RNA, 19 nt, artificial
  Oligomer
ucuuuuauucaacaaacau

SEQ ID NO: 9246 - RNA, 19 nt, artificial
  Oligomer
ucucucagacaucuuaacu

SEQ ID NO: 9247 - RNA, 19 nt, artificial
  Oligomer
uugucaagacuugaggaag

SEQ ID NO: 9248 - RNA, 19 nt, artificial
  Oligomer
augaaauaaaagauaggag

SEQ ID NO: 9249 - RNA, 19 nt, artificial
  Oligomer
ucaaaggcucuaucacacc

SEQ ID NO: 9250 - RNA, 19 nt, artificial
  Oligomer
acaaacaagguuucugccc

SEQ ID NO: 9251 - RNA, 19 nt, artificial
  Oligomer
ugcaguauucagacaucuc

SEQ ID NO: 9252 - RNA, 19 nt, artificial
  Oligomer
uugauugaaugaaaguggg

SEQ ID NO: 9253 - RNA, 19 nt, artificial
  Oligomer
guugauugaaugaaagugg

SEQ ID NO: 9254 - RNA, 19 nt, artificial
  Oligomer
auaguaagggagagagaug

SEQ ID NO: 9255 - RNA, 19 nt, artificial
  Oligomer
uguucuaacaauucgcuca

SEQ ID NO: 9256 - RNA, 19 nt, artificial
  Oligomer
uaugucuucaaggagcuaa

SEQ ID NO: 9257 - RNA, 19 nt, artificial
  Oligomer
ucggugugcagguaacugu

SEQ ID NO: 9258 - RNA, 19 nt, artificial
  Oligomer
agcauuuacaugauccugu

SEQ ID NO: 9259 - RNA, 19 nt, artificial
  Oligomer
ugcaguacugaagggaacg

SEQ ID NO: 9260 - RNA, 19 nt, artificial
  Oligomer
uacuacaggccuagcauuu

SEQ ID NO: 9261 - RNA, 19 nt, artificial
  Oligomer
agcaguuucccauccacac

SEQ ID NO: 9262 - RNA, 19 nt, artificial
  Oligomer
ucaggaaggaaaaagacag

SEQ ID NO: 9263 - RNA, 19 nt, artificial
  Oligomer
accaucuuuauugucuagg

SEQ ID NO: 9264 - RNA, 19 nt, artificial
  Oligomer
ucucucucaaauacuucca

SEQ ID NO: 9265 - RNA, 19 nt, artificial
  Oligomer
auagguccaaccaaggcug

SEQ ID NO: 9266 - RNA, 19 nt, artificial
  Oligomer
auccuugauaagugcguuc

SEQ ID NO: 9267 - RNA, 19 nt, artificial
  Oligomer
agauguucuaacaauucgc

SEQ ID NO: 9268 - RNA, 19 nt, artificial
  Oligomer
ugguuuguucuguaggcuu

SEQ ID NO: 9269 - RNA, 19 nt, artificial
  Oligomer
cucuaggacaaaaagggcg

SEQ ID NO: 9270 - RNA, 19 nt, artificial
  Oligomer
aacuucacuugucaggcuc

SEQ ID NO: 9271 - RNA, 19 nt, artificial
  Oligomer
acaacuucacuugucaggc

SEQ ID NO: 9272 - RNA, 19 nt, artificial
  Oligomer
uucugcccucauuuacagc

SEQ ID NO: 9273 - RNA, 19 nt, artificial
  Oligomer
ucuaacaauucgcucaaca

SEQ ID NO: 9274 - RNA, 19 nt, artificial
  Oligomer
aauucgcucaacaacagcu

SEQ ID NO: 9275 - RNA, 19 nt, artificial
  Oligomer
uacugaagggaacgcacag

SEQ ID NO: 9276 - RNA, 19 nt, artificial
  Oligomer
uugcucaacaccagugcua

SEQ ID NO: 9277 - RNA, 19 nt, artificial
  Oligomer
gucacauagaacauggacg

SEQ ID NO: 9278 - RNA, 19 nt, artificial
  Oligomer
aaaagauaggagauggucu

SEQ ID NO: 9279 - RNA, 19 nt, artificial
  Oligomer
uaacuaauguaauaaaagc

SEQ ID NO: 9280 - RNA, 19 nt, artificial
  Oligomer
auccugaagaucaaaggcu

SEQ ID NO: 9281 - RNA, 19 nt, artificial
  Oligomer
uagcauuuugcuagggacc

SEQ ID NO: 9282 - RNA, 19 nt, artificial
  Oligomer
aagaaaucaccauuuaaug

SEQ ID NO: 9283 - RNA, 19 nt, artificial
  Oligomer
aggauuguagcuaagguug

SEQ ID NO: 9284 - RNA, 19 nt, artificial
  Oligomer
ugucaggcucuucaacugc

SEQ ID NO: 9285 - RNA, 19 nt, artificial
  Oligomer
aaaacaaacaagguuucug

SEQ ID NO: 9286 - RNA, 19 nt, artificial
  Oligomer
uguccuucuccagaagaug

SEQ ID NO: 9287 - RNA, 19 nt, artificial
  Oligomer
uggagucccacacucaaag

SEQ ID NO: 9288 - RNA, 19 nt, artificial
  Oligomer
auaaacugcaauaaaugca

SEQ ID NO: 9289 - RNA, 19 nt, artificial
  Oligomer
ucaccauuuaaugagguuc

SEQ ID NO: 9290 - RNA, 19 nt, artificial
  Oligomer
cucagagaaacaaccaacg

SEQ ID NO: 9291 - RNA, 19 nt, artificial
  Oligomer
uaauccguguauauuguca

SEQ ID NO: 9292 - RNA, 19 nt, artificial
  Oligomer
uaagguacaaaugcaaggc

SEQ ID NO: 9293 - RNA, 19 nt, artificial
  Oligomer
ucauaaaccaaggugaaga

SEQ ID NO: 9294 - RNA, 19 nt, artificial
  Oligomer
cuuuuuuagaguuuccuga

SEQ ID NO: 9295 - RNA, 19 nt, artificial
  Oligomer
ugaaauaaaagauaggaga

SEQ ID NO: 9296 - RNA, 19 nt, artificial
  Oligomer
agcauaaccuucccgaucc

SEQ ID NO: 9297 - RNA, 19 nt, artificial
  Oligomer
uguuaugugagaacagacu

SEQ ID NO: 9298 - RNA, 19 nt, artificial
  Oligomer
uucucucucucaaauacuu

SEQ ID NO: 9299 - RNA, 19 nt, artificial
  Oligomer
uggaugagcucccucauuu

SEQ ID NO: 9300 - RNA, 19 nt, artificial
  Oligomer
ugaaagagaaagcaggaac

SEQ ID NO: 9301 - RNA, 19 nt, artificial
  Oligomer
uucuucccucuuuuauuca

SEQ ID NO: 9302 - RNA, 19 nt, artificial
  Oligomer
agugaagugcacauugcuc

SEQ ID NO: 9303 - RNA, 19 nt, artificial
  Oligomer
auacuaugucgacccaaag

SEQ ID NO: 9304 - RNA, 19 nt, artificial
  Oligomer
agagagauggacguuucuc

SEQ ID NO: 9305 - RNA, 19 nt, artificial
  Oligomer
uuuucuagaaaucuagaua

SEQ ID NO: 9306 - RNA, 19 nt, artificial
  Oligomer
auuucaguaacaaagcuca

SEQ ID NO: 9307 - RNA, 19 nt, artificial
  Oligomer
uuugagcauuuacaugauc

SEQ ID NO: 9308 - RNA, 19 nt, artificial
  Oligomer
cuacauuacaucuuugagc

SEQ ID NO: 9309 - RNA, 19 nt, artificial
  Oligomer
aauaaaagauaggagaugg

SEQ ID NO: 9310 - RNA, 19 nt, artificial
  Oligomer
accuugacuacuacaggcc

SEQ ID NO: 9311 - RNA, 19 nt, artificial
  Oligomer
uaucacaccuccugugguc

SEQ ID NO: 9312 - RNA, 19 nt, artificial
  Oligomer
ucaaagagcugaaaaaccu

SEQ ID NO: 9313 - RNA, 19 nt, artificial
  Oligomer
aagugcguucaccuuaacc

SEQ ID NO: 9314 - RNA, 19 nt, artificial
  Oligomer
cucauuuacagccugguag

SEQ ID NO: 9315 - RNA, 19 nt, artificial
  Oligomer
uuacagagucuagggaaac

SEQ ID NO: 9316 - RNA, 19 nt, artificial
  Oligomer
uuaccggcaucacucuccu

SEQ ID NO: 9317 - RNA, 19 nt, artificial
  Oligomer
uuugcuagggaccauggga

SEQ ID NO: 9318 - RNA, 19 nt, artificial
  Oligomer
uuucugcccucauuuacag

SEQ ID NO: 9319 - RNA, 19 nt, artificial
  Oligomer
aauuccaguucuuucucuc

SEQ ID NO: 9320 - RNA, 19 nt, artificial
  Oligomer
auuuugcuagggaccaugg

SEQ ID NO: 9321 - RNA, 19 nt, artificial
  Oligomer
ugaggaagaaggacaccac

SEQ ID NO: 9322 - RNA, 19 nt, artificial
  Oligomer
cugaaaaaccucuuggagc

SEQ ID NO: 9323 - RNA, 19 nt, artificial
  Oligomer
ucuggucacauagaacaug

SEQ ID NO: 9324 - RNA, 19 nt, artificial
  Oligomer
ucacaaaccacccaaacaa

SEQ ID NO: 9325 - RNA, 19 nt, artificial
  Oligomer
ucaucuucggcaacuuuuc

SEQ ID NO: 9326 - RNA, 19 nt, artificial
  Oligomer
ucaaauacuuccauacuau

SEQ ID NO: 9327 - RNA, 19 nt, artificial
  Oligomer
uagucacagcucaacggug

SEQ ID NO: 9328 - RNA, 19 nt, artificial
  Oligomer
auaaaagcaaucacuaaag

SEQ ID NO: 9329 - RNA, 19 nt, artificial
  Oligomer
uuuacaugauccuguaaag

SEQ ID NO: 9330 - RNA, 19 nt, artificial
  Oligomer
aauaaaacaaacaagguuu

SEQ ID NO: 9331 - RNA, 19 nt, artificial
  Oligomer
cucuagucauguuugcuuc

SEQ ID NO: 9332 - RNA, 19 nt, artificial
  Oligomer
auaaaauucaggagugcaa

SEQ ID NO: 9333 - RNA, 19 nt, artificial
  Oligomer
acaguaucugucgacaggc

SEQ ID NO: 9334 - RNA, 19 nt, artificial
  Oligomer
ugaugaugaggaugcaugc

SEQ ID NO: 9335 - RNA, 19 nt, artificial
  Oligomer
ucauuuacagccugguagg

SEQ ID NO: 9336 - RNA, 19 nt, artificial
  Oligomer
uucuguaggcuugggcagu

SEQ ID NO: 9337 - RNA, 19 nt, artificial
  Oligomer
ucucccucagugcuucaca

SEQ ID NO: 9338 - RNA, 19 nt, artificial
  Oligomer
uuuggacaccuuccaaacu

SEQ ID NO: 9339 - RNA, 19 nt, artificial
  Oligomer
uugcuuggucucccucagu

SEQ ID NO: 9340 - RNA, 19 nt, artificial
  Oligomer
uuuccaaggugaugauguc

SEQ ID NO: 9341 - RNA, 19 nt, artificial
  Oligomer
cuuccauacuaugucgacc

SEQ ID NO: 9342 - RNA, 19 nt, artificial
  Oligomer
uaaaccaaggugaagaguu

SEQ ID NO: 9343 - RNA, 19 nt, artificial
  Oligomer
auaggagauggucucucag

SEQ ID NO: 9344 - RNA, 19 nt, artificial
  Oligomer
gacaggaccaucuuuauug

SEQ ID NO: 9345 - RNA, 19 nt, artificial
  Oligomer
aauuuggacaccuuccaaa

SEQ ID NO: 9346 - RNA, 19 nt, artificial
  Oligomer
aauagguccaaccaaggcu

SEQ ID NO: 9347 - RNA, 19 nt, artificial
  Oligomer
aacugcagcugaaacauuc

SEQ ID NO: 9348 - RNA, 19 nt, artificial
  Oligomer
auguuugcuucuucagagc

SEQ ID NO: 9349 - RNA, 19 nt, artificial
  Oligomer
acucaagucguagucacag

SEQ ID NO: 9350 - RNA, 19 nt, artificial
  Oligomer
aauaagguacaaaugcaag

SEQ ID NO: 9351 - RNA, 19 nt, artificial
  Oligomer
auaugaagcagggagauaa

SEQ ID NO: 9352 - RNA, 19 nt, artificial
  Oligomer
acuuccaugggcaaagauc

SEQ ID NO: 9353 - RNA, 19 nt, artificial
  Oligomer
ucacucuaggacaaaaagg

SEQ ID NO: 9354 - RNA, 19 nt, artificial
  Oligomer
aagucugggagauucccac

SEQ ID NO: 9355 - RNA, 19 nt, artificial
  Oligomer
augauaugucuucaaggag

SEQ ID NO: 9356 - RNA, 19 nt, artificial
  Oligomer
ucaacggugggaguacaug

SEQ ID NO: 9357 - RNA, 19 nt, artificial
  Oligomer
uaucaaaggagaguuuaau

SEQ ID NO: 9358 - RNA, 19 nt, artificial
  Oligomer
guguuuacaacuucacuug

SEQ ID NO: 9359 - RNA, 19 nt, artificial
  Oligomer
uaauacugaaagagaaagc

SEQ ID NO: 9360 - RNA, 19 nt, artificial
  Oligomer
agggauaaagguuucuagg

SEQ ID NO: 9361 - RNA, 19 nt, artificial
  Oligomer
cuuugagacuuccaugggc

SEQ ID NO: 9362 - RNA, 19 nt, artificial
  Oligomer
aaagcaaucacuaaagugc

SEQ ID NO: 9363 - RNA, 19 nt, artificial
  Oligomer
auucaacaaacauuuaaug

SEQ ID NO: 9364 - RNA, 19 nt, artificial
  Oligomer
uguucuguaggcuugggca

SEQ ID NO: 9365 - RNA, 19 nt, artificial
  Oligomer
aaaggcucuaucacaccuc

SEQ ID NO: 9366 - RNA, 19 nt, artificial
  Oligomer
gucauagcccaaaagcuug

SEQ ID NO: 9367 - RNA, 19 nt, artificial
  Oligomer
uggacguuucucaggaagg

SEQ ID NO: 9368 - RNA, 19 nt, artificial
  Oligomer
guguuugauaaaauucagg

SEQ ID NO: 9369 - RNA, 19 nt, artificial
  Oligomer
aaagauaggagauggucuc

SEQ ID NO: 9370 - RNA, 19 nt, artificial
  Oligomer
ucuugcauuuccugugcag

SEQ ID NO: 9371 - RNA, 19 nt, artificial
  Oligomer
aaguagacugcucagggac

SEQ ID NO: 9372 - RNA, 19 nt, artificial
  Oligomer
cucucucucaaauacuucc

SEQ ID NO: 9373 - RNA, 19 nt, artificial
  Oligomer
guacaaauaauaauccgug

SEQ ID NO: 9374 - RNA, 19 nt, artificial
  Oligomer
uaaccuucccgauccuuga

SEQ ID NO: 9375 - RNA, 19 nt, artificial
  Oligomer
agcuuagcaagaaaucacc

SEQ ID NO: 9376 - RNA, 19 nt, artificial
  Oligomer
agauaggagauggucucuc

SEQ ID NO: 9377 - RNA, 19 nt, artificial
  Oligomer
uagcaagaaaucaccauuu

SEQ ID NO: 9378 - RNA, 19 nt, artificial
  Oligomer
aagaaggacaccaccugag

SEQ ID NO: 9379 - RNA, 19 nt, artificial
  Oligomer
uaagcuaggaagcuuuucu

SEQ ID NO: 9380 - RNA, 19 nt, artificial
  Oligomer
guucuuuccaucuuguugg

SEQ ID NO: 9381 - RNA, 19 nt, artificial
  Oligomer
uacauuaaauuuggacacc

SEQ ID NO: 9382 - RNA, 19 nt, artificial
  Oligomer
guauucagacaucuccuug

SEQ ID NO: 9383 - RNA, 19 nt, artificial
  Oligomer
ucaaggagcuaaaaaugcc

SEQ ID NO: 9384 - RNA, 19 nt, artificial
  Oligomer
acauagaacauggacguca

SEQ ID NO: 9385 - RNA, 19 nt, artificial
  Oligomer
auguaauaaaagcaaucac

SEQ ID NO: 9386 - RNA, 19 nt, artificial
  Oligomer
aauucugcaguuucucuug

SEQ ID NO: 9387 - RNA, 19 nt, artificial
  Oligomer
aaaugcaaggcaauguugg

SEQ ID NO: 9388 - RNA, 19 nt, artificial
  Oligomer
uacuuccauacuaugucga

SEQ ID NO: 9389 - RNA, 19 nt, artificial
  Oligomer
ugcguucaccuuaaccagc

SEQ ID NO: 9390 - RNA, 19 nt, artificial
  Oligomer
auuuaaugaaggcccacua

SEQ ID NO: 9391 - RNA, 19 nt, artificial
  Oligomer
ucuucggcaacuuuucuuu

SEQ ID NO: 9392 - RNA, 19 nt, artificial
  Oligomer
cuguaaagcaggauucuag

SEQ ID NO: 9393 - RNA, 19 nt, artificial
  Oligomer
ucuuuaccggcaucacucu

SEQ ID NO: 9394 - RNA, 19 nt, artificial
  Oligomer
ucuagucauguuugcuucu

SEQ ID NO: 9395 - RNA, 19 nt, artificial
  Oligomer
ugaacaaguaaaaguagca

SEQ ID NO: 9396 - RNA, 19 nt, artificial
  Oligomer
uugaaaacaauaacaugua

SEQ ID NO: 9397 - RNA, 19 nt, artificial
  Oligomer
aaauacuuccauacuaugu

SEQ ID NO: 9398 - RNA, 19 nt, artificial
  Oligomer
cuugucaggcucuucaacu

SEQ ID NO: 9399 - RNA, 19 nt, artificial
  Oligomer
agcuggagcaguuucccau

SEQ ID NO: 9400 - RNA, 19 nt, artificial
  Oligomer
uugucuagggaguguucca

SEQ ID NO: 9401 - RNA, 19 nt, artificial
  Oligomer
uugaggaguuccacauucu

SEQ ID NO: 9402 - RNA, 19 nt, artificial
  Oligomer
uucucaggaaggaaaaaga

SEQ ID NO: 9403 - RNA, 19 nt, artificial
  Oligomer
acaugauaugucuucaagg

SEQ ID NO: 9404 - RNA, 19 nt, artificial
  Oligomer
ugcgucucuagucauguuu

SEQ ID NO: 9405 - RNA, 19 nt, artificial
  Oligomer
aaaauuagaagcugagagg

SEQ ID NO: 9406 - RNA, 19 nt, artificial
  Oligomer
auaauccguguauauuguc

SEQ ID NO: 9407 - RNA, 19 nt, artificial
  Oligomer
uuucuagaaaucuagauau

SEQ ID NO: 9408 - RNA, 19 nt, artificial
  Oligomer
uccaaacucucacucuagg

SEQ ID NO: 9409 - RNA, 19 nt, artificial
  Oligomer
aucacaagcccgcucagaa

SEQ ID NO: 9410 - RNA, 19 nt, artificial
  Oligomer
acucccaauauccugcguc

SEQ ID NO: 9411 - RNA, 19 nt, artificial
  Oligomer
caaauauuuauugagcacc

SEQ ID NO: 9412 - RNA, 19 nt, artificial
  Oligomer
ucuagggaguguuccacag

SEQ ID NO: 9413 - RNA, 19 nt, artificial
  Oligomer
aaaauucugcaguuucucu

SEQ ID NO: 9414 - RNA, 19 nt, artificial
  Oligomer
uucccucuuuuauucaaca

SEQ ID NO: 9415 - RNA, 19 nt, artificial
  Oligomer
aguggaaagguucucucuc

SEQ ID NO: 9416 - RNA, 19 nt, artificial
  Oligomer
uccuugauaagugcguuca

SEQ ID NO: 9417 - RNA, 19 nt, artificial
  Oligomer
auaucaugucugagcgcgu

SEQ ID NO: 9418 - RNA, 19 nt, artificial
  Oligomer
uucuuucucuccagugaag

SEQ ID NO: 9419 - RNA, 19 nt, artificial
  Oligomer
gugaauaaaacaaacaagg

SEQ ID NO: 9420 - RNA, 19 nt, artificial
  Oligomer
aacauuuuugguuuguucu

SEQ ID NO: 9421 - RNA, 19 nt, artificial
  Oligomer
gaucagucucaucuccacg

SEQ ID NO: 9422 - RNA, 19 nt, artificial
  Oligomer
acauugcucaacaccagug

SEQ ID NO: 9423 - RNA, 19 nt, artificial
  Oligomer
acaucuuugagcauuuaca

SEQ ID NO: 9424 - RNA, 19 nt, artificial
  Oligomer
cucaaaggcagagaugaug

SEQ ID NO: 9425 - RNA, 19 nt, artificial
  Oligomer
acauuuuaucaaaagguag

SEQ ID NO: 9426 - RNA, 19 nt, artificial
  Oligomer
ugauaagugcguucaccuu

SEQ ID NO: 9427 - RNA, 19 nt, artificial
  Oligomer
uauugucuagggaguguuc

SEQ ID NO: 9428 - RNA, 19 nt, artificial
  Oligomer
auuuccugugcagucuggu

SEQ ID NO: 9429 - RNA, 19 nt, artificial
  Oligomer
uguuuacaacuucacuugu

SEQ ID NO: 9430 - RNA, 19 nt, artificial
  Oligomer
acuggaggaagaaagaaug

SEQ ID NO: 9431 - RNA, 19 nt, artificial
  Oligomer
uagccgcauaucaugucug

SEQ ID NO: 9432 - RNA, 19 nt, artificial
  Oligomer
agauaugaagugcagguug

SEQ ID NO: 9433 - RNA, 19 nt, artificial
  Oligomer
agagaaagcaggaacaaag

SEQ ID NO: 9434 - RNA, 19 nt, artificial
  Oligomer
ugaaaugaagguaaagaag

SEQ ID NO: 9435 - RNA, 19 nt, artificial
  Oligomer
aauagaaagcagaaggguu

SEQ ID NO: 9436 - RNA, 19 nt, artificial
  Oligomer
ucuuucucuccagugaagu

SEQ ID NO: 9437 - RNA, 19 nt, artificial
  Oligomer
uuagaagcugagaggagac

SEQ ID NO: 9438 - RNA, 19 nt, artificial
  Oligomer
auccugcgugguucuuucc

SEQ ID NO: 9439 - RNA, 19 nt, artificial
  Oligomer
ucuuuauugucuagggagu

SEQ ID NO: 9440 - RNA, 19 nt, artificial
  Oligomer
uucggcaacuuuucuuuac

SEQ ID NO: 9441 - RNA, 19 nt, artificial
  Oligomer
ugaaugaaauaaaagauag

SEQ ID NO: 9442 - RNA, 19 nt, artificial
  Oligomer
uagauaugaagugcagguu

SEQ ID NO: 9443 - RNA, 19 nt, artificial
  Oligomer
ugcauaucacaagcccgcu

SEQ ID NO: 9444 - RNA, 19 nt, artificial
  Oligomer
uucugcaguuucucuugca

SEQ ID NO: 9445 - RNA, 19 nt, artificial
  Oligomer
uccaguucuuucucuccag

SEQ ID NO: 9446 - RNA, 19 nt, artificial
  Oligomer
auaauaauccguguauauu

SEQ ID NO: 9447 - RNA, 19 nt, artificial
  Oligomer
uaggagauggucucucaga

SEQ ID NO: 9448 - RNA, 19 nt, artificial
  Oligomer
uucccauccacaccauaga

SEQ ID NO: 9449 - RNA, 19 nt, artificial
  Oligomer
ugaggaguuccacauucug

SEQ ID NO: 9450 - RNA, 19 nt, artificial
  Oligomer
ugcaccgguggaauucugu

SEQ ID NO: 9451 - RNA, 19 nt, artificial
  Oligomer
ugaaagugggaauaguaag

SEQ ID NO: 9452 - RNA, 19 nt, artificial
  Oligomer
auucugcaguuucucuugc

SEQ ID NO: 9453 - RNA, 19 nt, artificial
  Oligomer
aaacaagucugggagauuc

SEQ ID NO: 9454 - RNA, 19 nt, artificial
  Oligomer
gugaugauguccuucucca

SEQ ID NO: 9455 - RNA, 19 nt, artificial
  Oligomer
ugggaguggaaagguucuc

SEQ ID NO: 9456 - RNA, 19 nt, artificial
  Oligomer
ucuuaaagaacagggaagu

SEQ ID NO: 9457 - RNA, 19 nt, artificial
  Oligomer
acagagucuagggaaacac

SEQ ID NO: 9458 - RNA, 19 nt, artificial
  Oligomer
aguuucucuugcauuuccu

SEQ ID NO: 9459 - RNA, 19 nt, artificial
  Oligomer
uacaaaagcuggaacugaa

SEQ ID NO: 9460 - RNA, 19 nt, artificial
  Oligomer
cauaucaugucugagcgcg

SEQ ID NO: 9461 - RNA, 19 nt, artificial
  Oligomer
ugcugcaguauucagacau

SEQ ID NO: 9462 - RNA, 19 nt, artificial
  Oligomer
agugcguucaccuuaacca

SEQ ID NO: 9463 - RNA, 19 nt, artificial
  Oligomer
ucaauaagguacaaaugca

SEQ ID NO: 9464 - RNA, 19 nt, artificial
  Oligomer
uuuguucuguaggcuuggg

SEQ ID NO: 9465 - RNA, 19 nt, artificial
  Oligomer
acagacuggaggaagaaag

SEQ ID NO: 9466 - RNA, 19 nt, artificial
  Oligomer
auggucucucagacaucuu

SEQ ID NO: 9467 - RNA, 19 nt, artificial
  Oligomer
aaauucaggagugcaaggc

SEQ ID NO: 9468 - RNA, 19 nt, artificial
  Oligomer
cagauaagcagggauaaag

SEQ ID NO: 9469 - RNA, 19 nt, artificial
  Oligomer
uagguugaaaacaauaaca

SEQ ID NO: 9470 - RNA, 19 nt, artificial
  Oligomer
uugccuucuucccucuuuu

SEQ ID NO: 9471 - RNA, 19 nt, artificial
  Oligomer
agugggaguggaaagguuc

SEQ ID NO: 9472 - RNA, 19 nt, artificial
  Oligomer
gucuacauuaaauuuggac

SEQ ID NO: 9473 - RNA, 19 nt, artificial
  Oligomer
aucuacaaaagcuggaacu

SEQ ID NO: 9474 - RNA, 19 nt, artificial
  Oligomer
gcaguauucagacaucucc

SEQ ID NO: 9475 - RNA, 19 nt, artificial
  Oligomer
uucgcucaacaacagcugu

SEQ ID NO: 9476 - RNA, 19 nt, artificial
  Oligomer
aaauaaaagauaggagaug

SEQ ID NO: 9477 - RNA, 19 nt, artificial
  Oligomer
aaguuucagauaagcaggg

SEQ ID NO: 9478 - RNA, 19 nt, artificial
  Oligomer
cuugauaagugcguucacc

SEQ ID NO: 9479 - RNA, 19 nt, artificial
  Oligomer
ucuuggagcuggagcaguu

SEQ ID NO: 9480 - RNA, 19 nt, artificial
  Oligomer
gugaagugcacauugcuca

SEQ ID NO: 9481 - RNA, 19 nt, artificial
  Oligomer
aagcacuugguacaugaug

SEQ ID NO: 9482 - RNA, 19 nt, artificial
  Oligomer
agucauguuugcuucuuca

SEQ ID NO: 9483 - RNA, 19 nt, artificial
  Oligomer
auuuuugguuuguucugua

SEQ ID NO: 9484 - RNA, 19 nt, artificial
  Oligomer
agcaagagccucgauguac

SEQ ID NO: 9485 - RNA, 19 nt, artificial
  Oligomer
cauuucaguaacaaagcuc

SEQ ID NO: 9486 - RNA, 19 nt, artificial
  Oligomer
uaauagaaagcagaagggu

SEQ ID NO: 9487 - RNA, 19 nt, artificial
  Oligomer
aauaaaagcaaucacuaaa

SEQ ID NO: 9488 - RNA, 19 nt, artificial
  Oligomer
ucgcucaacaacagcuguu

SEQ ID NO: 9489 - RNA, 19 nt, artificial
  Oligomer
uaacaaagcucagagaaac

SEQ ID NO: 9490 - RNA, 19 nt, artificial
  Oligomer
acucgguucuuuuuuagag

SEQ ID NO: 9491 - RNA, 19 nt, artificial
  Oligomer
cuuuaccggcaucacucuc

SEQ ID NO: 9492 - RNA, 19 nt, artificial
  Oligomer
aaagagcugaaaaaccucu

SEQ ID NO: 9493 - RNA, 19 nt, artificial
  Oligomer
guggugagcaacauauccu

SEQ ID NO: 9494 - RNA, 19 nt, artificial
  Oligomer
aagggcuucacagaaaagg

SEQ ID NO: 9495 - RNA, 19 nt, artificial
  Oligomer
cuuuucuuuaccggcauca

SEQ ID NO: 9496 - RNA, 19 nt, artificial
  Oligomer
caagacuugaggaagaagg

SEQ ID NO: 9497 - RNA, 19 nt, artificial
  Oligomer
agagauggacguuucucag

SEQ ID NO: 9498 - RNA, 19 nt, artificial
  Oligomer
auauuuaaacaaccaaauc

SEQ ID NO: 9499 - RNA, 19 nt, artificial
  Oligomer
aucaaaggagaguuuaaua

SEQ ID NO: 9500 - RNA, 19 nt, artificial
  Oligomer
augauguccuucuccagaa

SEQ ID NO: 9501 - RNA, 19 nt, artificial
  Oligomer
ugcauuuccugugcagucu

SEQ ID NO: 9502 - RNA, 19 nt, artificial
  Oligomer
aaacaaauauuuauugagc

SEQ ID NO: 9503 - RNA, 19 nt, artificial
  Oligomer
ugaagaacauuuuugguuu

SEQ ID NO: 9504 - RNA, 19 nt, artificial
  Oligomer
cauguuugcuucuucagag

SEQ ID NO: 9505 - RNA, 19 nt, artificial
  Oligomer
agcaccuugacuacuacag

SEQ ID NO: 9506 - RNA, 19 nt, artificial
  Oligomer
aacuaauguaauaaaagca

SEQ ID NO: 9507 - RNA, 19 nt, artificial
  Oligomer
aguacugaagggaacgcac

SEQ ID NO: 9508 - RNA, 19 nt, artificial
  Oligomer
ucuacaaaagcuggaacug

SEQ ID NO: 9509 - RNA, 19 nt, artificial
  Oligomer
guuuacaacuucacuuguc

SEQ ID NO: 9510 - RNA, 19 nt, artificial
  Oligomer
uugagacuuccaugggcaa

SEQ ID NO: 9511 - RNA, 19 nt, artificial
  Oligomer
aaagguaggauuguagcua

SEQ ID NO: 9512 - RNA, 19 nt, artificial
  Oligomer
cuggucacauagaacaugg

SEQ ID NO: 9513 - RNA, 19 nt, artificial
  Oligomer
uauugagcaccuugacuac

SEQ ID NO: 9514 - RNA, 19 nt, artificial
  Oligomer
caacauauccuccaggugg

SEQ ID NO: 9515 - RNA, 19 nt, artificial
  Oligomer
uaucacaagcccgcucaga

SEQ ID NO: 9516 - RNA, 19 nt, Artificial
  Oligomer
aggaguuccacauucuggc

SEQ ID NO: 9517 - RNA, 19 nt, artificial
  Oligomer
gguggugaggcaauaaaaa

SEQ ID NO: 9518 - RNA, 19 nt, artificial
  Oligomer
ggaacauaugaaaauacaa

SEQ ID NO: 9519 - RNA, 19 nt, artificial
  Oligomer
ccuggacaacaguuauaaa

SEQ ID NO: 9520 - RNA, 19 nt, artificial
  Oligomer
gguuguagaaguuaauaaa

SEQ ID NO: 9521 - RNA, 19 nt, artificial
  Oligomer
gauucaaaauccauuaaaa

SEQ ID NO: 9522 - RNA, 19 nt, artificial
  Oligomer
agguggugaggcaauaaaa

SEQ ID NO: 9523 - RNA, 19 nt, artificial
  Oligomer
ggcgguuguagaaguuaau

SEQ ID NO: 9524 - RNA, 19 nt, artificial
  Oligomer
gcgugauguuucuaaagaa

SEQ ID NO: 9525 - RNA, 19 nt, artificial
  Oligomer
gguggaguuuuaacuguaa

SEQ ID NO: 9526 - RNA, 19 nt, artificial
  Oligomer
cacuuuuguuguaaaaaaa

SEQ ID NO: 9527 - RNA, 19 nt, artificial
  Oligomer
cuggaauaucccuggacaa

SEQ ID NO: 9528 - RNA, 19 nt, artificial
  Oligomer
gcauguaaugguaucuuaa

SEQ ID NO: 9529 - RNA, 19 nt, artificial
  Oligomer
gaucguuguagaagucuaa

SEQ ID NO: 9530 - RNA, 19 nt, artificial
  Oligomer
cagcuuucaugauuagcaa

SEQ ID NO: 9531 - RNA, 19 nt, artificial
  Oligomer
caaugauuguuaauuuaca

SEQ ID NO: 9532 - RNA, 19 nt, artificial
  Oligomer
aggcgguuguagaaguuaa

SEQ ID NO: 9533 - RNA, 19 nt, artificial
  Oligomer
gaauaaaaaugaucuuaca

SEQ ID NO: 9534 - RNA, 19 nt, artificial
  Oligomer
ggcuaaaacuuaacauuca

SEQ ID NO: 9535 - RNA, 19 nt, artificial
  Oligomer
ggaucuaccagcauaaaua

SEQ ID NO: 9536 - RNA, 19 nt, artificial
  Oligomer
ccuggaucuaccagcauaa

SEQ ID NO: 9537 - RNA, 19 nt, artificial
  Oligomer
gcugcagaggguacuuuaa

SEQ ID NO: 9538 - RNA, 19 nt, artificial
  Oligomer
cgguuguagaaguuaauaa

SEQ ID NO: 9539 - RNA, 19 nt, artificial
  Oligomer
gaagagcuauuauauaaaa

SEQ ID NO: 9540 - RNA, 19 nt, artificial
  Oligomer
ucagguaguugcaauugaa

SEQ ID NO: 9541 - RNA, 19 nt, artificial
  Oligomer
cauguaaugguaucuuaaa

SEQ ID NO: 9542 - RNA, 19 nt, artificial
  Oligomer
ccagguaaugugaauaaau

SEQ ID NO: 9543 - RNA, 19 nt, artificial
  Oligomer
ggaaaauaguaauguuuua

SEQ ID NO: 9544 - RNA, 19 nt, artificial
  Oligomer
gaugcgugauguuucuaaa

SEQ ID NO: 9545 - RNA, 19 nt, artificial
  Oligomer
gagagaaagugugagcaaa

SEQ ID NO: 9546 - RNA, 19 nt, artificial
  Oligomer
ccgacaagcuugaauuuau

SEQ ID NO: 9547 - RNA, 19 nt, artificial
  Oligomer
gaauaauuuuuggaacaaa

SEQ ID NO: 9548 - RNA, 19 nt, artificial
  Oligomer
gaaagugugagcaaacuaa

SEQ ID NO: 9549 - RNA, 19 nt, artificial
  Oligomer
ggcaaugauuguuaauuua

SEQ ID NO: 9550 - RNA, 19 nt, artificial
  Oligomer
aaaugaucuuacacgugaa

SEQ ID NO: 9551 - RNA, 19 nt, artificial
  Oligomer
cuguuuacugaaagaaaaa

SEQ ID NO: 9552 - RNA, 19 nt, artificial
  Oligomer
acuguuuacugaaagaaaa

SEQ ID NO: 9553 - RNA, 19 nt, artificial
  Oligomer
ggguggaguuuuaacugua

SEQ ID NO: 9554 - RNA, 19 nt, artificial
  Oligomer
ggaucguuguagaagucua

SEQ ID NO: 9555 - RNA, 19 nt, artificial
  Oligomer
gagauggguuuauguauaa

SEQ ID NO: 9556 - RNA, 19 nt, artificial
  Oligomer
gaaucaauggacucuggaa

SEQ ID NO: 9557 - RNA, 19 nt, artificial
  Oligomer
auggguuuauguauaauaa

SEQ ID NO: 9558 - RNA, 19 nt, artificial
  Oligomer
gagaggcaaugauuguuaa

SEQ ID NO: 9559 - RNA, 19 nt, artificial
  Oligomer
gaggguacuuuaagacaua

SEQ ID NO: 9560 - RNA, 19 nt, artificial
  Oligomer
cuggacaacaguuauaaaa

SEQ ID NO: 9561 - RNA, 19 nt, artificial
  Oligomer
cgacaagcuugaauuuaug

SEQ ID NO: 9562 - RNA, 19 nt, artificial
  Oligomer
caaauagaaccacuaugaa

SEQ ID NO: 9563 - RNA, 19 nt, artificial
  Oligomer
ccuuuauuuuagaauugau

SEQ ID NO: 9564 - RNA, 19 nt, artificial
  Oligomer
ggaauauaaggaaagcaau

SEQ ID NO: 9565 - RNA, 19 nt, artificial
  Oligomer
ccuguugaccugaaaaaaa

SEQ ID NO: 9566 - RNA, 19 nt, artificial
  Oligomer
gaucauacauggaagcgaa

SEQ ID NO: 9567 - RNA, 19 nt, artificial
  Oligomer
uguugaaguuuacaaucaa

SEQ ID NO: 9568 - RNA, 19 nt, artificial
  Oligomer
gaacacuuuuguuguaaaa

SEQ ID NO: 9569 - RNA, 19 nt, artificial
  Oligomer
gcagcaaaccucagggaaa

SEQ ID NO: 9570 - RNA, 19 nt, artificial
  Oligomer
cagguaaugugaauaaauu

SEQ ID NO: 9571 - RNA, 19 nt, artificial
  Oligomer
cagaaacuugaaauaugaa

SEQ ID NO: 9572 - RNA, 19 nt, artificial
  Oligomer
gaauauaaggaaagcaaua

SEQ ID NO: 9573 - RNA, 19 nt, artificial
  Oligomer
cugucaguaugacauuuca

SEQ ID NO: 9574 - RNA, 19 nt, artificial
  Oligomer
gaaagugaagcaaaucaga

SEQ ID NO: 9575 - RNA, 19 nt, artificial
  Oligomer
caauauaucugaagagcua

SEQ ID NO: 9576 - RNA, 19 nt, artificial
  Oligomer
guugaaguuuacaaucaaa

SEQ ID NO: 9577 - RNA, 19 nt, artificial
  Oligomer
ggagaacacugaaaacuca

SEQ ID NO: 9578 - RNA, 19 nt, artificial
  Oligomer
guuuaauauugagaaagaa

SEQ ID NO: 9579 - RNA, 19 nt, artificial
  Oligomer
ccauggugaagaaggaaua

SEQ ID NO: 9580 - RNA, 19 nt, artificial
  Oligomer
cccuggacaacaguuauaa

SEQ ID NO: 9581 - RNA, 19 nt, artificial
  Oligomer
cacggaugacuuaacugca

SEQ ID NO: 9582 - RNA, 19 nt, artificial
  Oligomer
cugaagagcuauuauauaa

SEQ ID NO: 9583 - RNA, 19 nt, artificial
  Oligomer
cauggugaagaaggaauaa

SEQ ID NO: 9584 - RNA, 19 nt, artificial
  Oligomer
acacuuuuguuguaaaaaa

SEQ ID NO: 9585 - RNA, 19 nt, artificial
  Oligomer
cuccuuccaucaaauagaa

SEQ ID NO: 9586 - RNA, 19 nt, artificial
  Oligomer
ggaauaucccuggacaaca

SEQ ID NO: 9587 - RNA, 19 nt, artificial
  Oligomer
caauaaaaaucauaguacu

SEQ ID NO: 9588 - RNA, 19 nt, artificial
  Oligomer
ugacuuaacugcauuuuua

SEQ ID NO: 9589 - RNA, 19 nt, artificial
  Oligomer
aagugaagcaaaucagaaa

SEQ ID NO: 9590 - RNA, 19 nt, artificial
  Oligomer
gacagacagugguguugau

SEQ ID NO: 9591 - RNA, 19 nt, artificial
  Oligomer
cagucauuaugagaggcaa

SEQ ID NO: 9592 - RNA, 19 nt, artificial
  Oligomer
gagauuucuuguugcucaa

SEQ ID NO: 9593 - RNA, 19 nt, artificial
  Oligomer
ggaccuguugaccugaaaa

SEQ ID NO: 9594 - RNA, 19 nt, artificial
  Oligomer
ugaucuuacacgugaagaa

SEQ ID NO: 9595 - RNA, 19 nt, artificial
  Oligomer
gauggguuuauguauaaua

SEQ ID NO: 9596 - RNA, 19 nt, artificial
  Oligomer
cucuauuuuuaucacuaaa

SEQ ID NO: 9597 - RNA, 19 nt, artificial
  Oligomer
gaccuguaacuuuuguaaa

SEQ ID NO: 9598 - RNA, 19 nt, artificial
  Oligomer
ggauucaaaauccauuaaa

SEQ ID NO: 9599 - RNA, 19 nt, artificial
  Oligomer
ccauggagaacacugaaaa

SEQ ID NO: 9600 - RNA, 19 nt, artificial
  Oligomer
caucugugggcauggucaa

SEQ ID NO: 9601 - RNA, 19 nt, artificial
  Oligomer
gaaggaauaauuuuuggaa

SEQ ID NO: 9602 - RNA, 19 nt, artificial
  Oligomer
ggaauaauuuuuggaacaa

SEQ ID NO: 9603 - RNA, 19 nt, artificial
  Oligomer
gugagaagaugguauauuu

SEQ ID NO: 9604 - RNA, 19 nt, artificial
  Oligomer
aaacuaacuugacuuuuaa

SEQ ID NO: 9605 - RNA, 19 nt, artificial
  Oligomer
ccgacuucuuguaugcaua

SEQ ID NO: 9606 - RNA, 19 nt, artificial
  Oligomer
aaaugaugauguggaagaa

SEQ ID NO: 9607 - RNA, 19 nt, artificial
  Oligomer
guagcaaaauucuuaagua

SEQ ID NO: 9608 - RNA, 19 nt, artificial
  Oligomer
caaucaaaggaaaauagua

SEQ ID NO: 9609 - RNA, 19 nt, artificial
  Oligomer
cuauuuuuaucacuaaaga

SEQ ID NO: 9610 - RNA, 19 nt, artificial
  Oligomer
aauaaacaguggaauauaa

SEQ ID NO: 9611 - RNA, 19 nt, artificial
  Oligomer
cagugaugcugugcuauga

SEQ ID NO: 9612 - RNA, 19 nt, artificial
  Oligomer
cccuaugcauaucaguuga

SEQ ID NO: 9613 - RNA, 19 nt, artificial
  Oligomer
aggaacauaugaaaauaca

SEQ ID NO: 9614 - RNA, 19 nt, artificial
  Oligomer
gcuaaaacuuaacauucau

SEQ ID NO: 9615 - RNA, 19 nt, artificial
  Oligomer
gaaguggaaauguucuaaa

SEQ ID NO: 9616 - RNA, 19 nt, artificial
  Oligomer
uuuuaaggcuaaaacuuaa

SEQ ID NO: 9617 - RNA, 19 nt, artificial
  Oligomer
ccagcaauauaucugaaga

SEQ ID NO: 9618 - RNA, 19 nt, artificial
  Oligomer
cuguugaccugaaaaaaau

SEQ ID NO: 9619 - RNA, 19 nt, artificial
  Oligomer
cuauaggaacauaugaaaa

SEQ ID NO: 9620 - RNA, 19 nt, artificial
  Oligomer
caauugaauuaaauuagga

SEQ ID NO: 9621 - RNA, 19 nt, artificial
  Oligomer
cuggaucuaccagcauaaa

SEQ ID NO: 9622 - RNA, 19 nt, artificial
  Oligomer
accugaaaaaaauaacaaa

SEQ ID NO: 9623 - RNA, 19 nt, artificial
  Oligomer
aaagaagaucacagcaaaa

SEQ ID NO: 9624 - RNA, 19 nt, artificial
  Oligomer
gaucuuacacgugaagaaa

SEQ ID NO: 9625 - RNA, 19 nt, artificial
  Oligomer
aguacucuuuguagcaaaa

SEQ ID NO: 9626 - RNA, 19 nt, artificial
  Oligomer
aggaauaaauaaaaaugga

SEQ ID NO: 9627 - RNA, 19 nt, artificial
  Oligomer
aagaaauuguggaauugau

SEQ ID NO: 9628 - RNA, 19 nt, artificial
  Oligomer
guagaagucuaacuggaaa

SEQ ID NO: 9629 - RNA, 19 nt, artificial
  Oligomer
ggugaagaaggaauaauuu

SEQ ID NO: 9630 - RNA, 19 nt, artificial
  Oligomer
cacuaugaagcuaccucaa

SEQ ID NO: 9631 - RNA, 19 nt, artificial
  Oligomer
guaagaaagugaagcaaau

SEQ ID NO: 9632 - RNA, 19 nt, artificial
  Oligomer
ggguuuauguauaauaauu

SEQ ID NO: 9633 - RNA, 19 nt, artificial
  Oligomer
agaccuguaacuuuuguaa

SEQ ID NO: 9634 - RNA, 19 nt, artificial
  Oligomer
aaacauucagaaacuugaa

SEQ ID NO: 9635 - RNA, 19 nt, artificial
  Oligomer
aguuuacaaucaaaggaaa

SEQ ID NO: 9636 - RNA, 19 nt, artificial
  Oligomer
cccuggaucuaccagcaua

SEQ ID NO: 9637 - RNA, 19 nt, artificial
  Oligomer
gugaggcaauaaaaaucau

SEQ ID NO: 9638 - RNA, 19 nt, artificial
  Oligomer
caaacuaacuugacuuuua

SEQ ID NO: 9639 - RNA, 19 nt, artificial
  Oligomer
ugagcugccuguaacuuga

SEQ ID NO: 9640 - RNA, 19 nt, artificial
  Oligomer
aagguggugaggcaauaaa

SEQ ID NO: 9641 - RNA, 19 nt, artificial
  Oligomer
ugaagagcuauuauauaaa

SEQ ID NO: 9642 - RNA, 19 nt, artificial
  Oligomer
uaaagaagaucacagcaaa

SEQ ID NO: 9643 - RNA, 19 nt, artificial
  Oligomer
caagugagaagaugguaua

SEQ ID NO: 9644 - RNA, 19 nt, artificial
  Oligomer
aaggaaagcaauaaaugaa

SEQ ID NO: 9645 - RNA, 19 nt, artificial
  Oligomer
ggcucaaaccuuuauuuua

SEQ ID NO: 9646 - RNA, 19 nt, artificial
  Oligomer
cacagcaccugguuauuau

SEQ ID NO: 9647 - RNA, 19 nt, artificial
  Oligomer
auuucuuguugcucaaaaa

SEQ ID NO: 9648 - RNA, 19 nt, artificial
  Oligomer
uagaaaugaugauguggaa

SEQ ID NO: 9649 - RNA, 19 nt, artificial
  Oligomer
ggcaauaaaaaucauagua

SEQ ID NO: 9650 - RNA, 19 nt, artificial
  Oligomer
cagguaguugcaauugaau

SEQ ID NO: 9651 - RNA, 19 nt, artificial
  Oligomer
gaaaaaguuaaacauugaa

SEQ ID NO: 9652 - RNA, 19 nt, artificial
  Oligomer
cugugcuaugaauuuucaa

SEQ ID NO: 9653 - RNA, 19 nt, artificial
  Oligomer
gucuaacuggaaaacccaa

SEQ ID NO: 9654 - RNA, 19 nt, artificial
  Oligomer
uacuguuuacugaaagaaa

SEQ ID NO: 9655 - RNA, 19 nt, artificial
  Oligomer
uaaggaaagcaauaaauga

SEQ ID NO: 9656 - RNA, 19 nt, artificial
  Oligomer
uugugaggcgguuguagaa

SEQ ID NO: 9657 - RNA, 19 nt, artificial
  Oligomer
guggugaggcaauaaaaau

SEQ ID NO: 9658 - RNA, 19 nt, artificial
  Oligomer
ugcagaggguacuuuaaga

SEQ ID NO: 9659 - RNA, 19 nt, artificial
  Oligomer
uacuuuucaugcaaagaaa

SEQ ID NO: 9660 - RNA, 19 nt, artificial
  Oligomer
uggguuuauguauaauaau

SEQ ID NO: 9661 - RNA, 19 nt, artificial
  Oligomer
ucagaaacuugaaauauga

SEQ ID NO: 9662 - RNA, 19 nt, artificial
  Oligomer
gcgguuguagaaguuaaua

SEQ ID NO: 9663 - RNA, 19 nt, artificial
  Oligomer
ggauacuggugcagucauu

SEQ ID NO: 9664 - RNA, 19 nt, artificial
  Oligomer
gaucuaccagcauaaauau

SEQ ID NO: 9665 - RNA, 19 nt, artificial
  Oligomer
uugugauguuuguccugaa

SEQ ID NO: 9666 - RNA, 19 nt, artificial
  Oligomer
agugaugcugugcuaugaa

SEQ ID NO: 9667 - RNA, 19 nt, artificial
  Oligomer
aguuaaacauugaaguaau

SEQ ID NO: 9668 - RNA, 19 nt, artificial
  Oligomer
aguugcaauugaauuaaau

SEQ ID NO: 9669 - RNA, 19 nt, artificial
  Oligomer
ggacaacaguuauaaaaug

SEQ ID NO: 9670 - RNA, 19 nt, artificial
  Oligomer
aaaacucaguggauucaaa

SEQ ID NO: 9671 - RNA, 19 nt, artificial
  Oligomer
cuaguuuugucaaacugua

SEQ ID NO: 9672 - RNA, 19 nt, artificial
  Oligomer
caacaguuauaaaauggau

SEQ ID NO: 9673 - RNA, 19 nt, artificial
  Oligomer
uggaauauaaggaaagcaa

SEQ ID NO: 9674 - RNA, 19 nt, artificial
  Oligomer
gaaacagauuccauguauu

SEQ ID NO: 9675 - RNA, 19 nt, artificial
  Oligomer
gacucagccuguuccauga

SEQ ID NO: 9676 - RNA, 19 nt, artificial
  Oligomer
uggacaacaguuauaaaau

SEQ ID NO: 9677 - RNA, 19 nt, artificial
  Oligomer
ugauguuucuaaagaagau

SEQ ID NO: 9678 - RNA, 19 nt, artificial
  Oligomer
uaugaagucaggaauaaaa

SEQ ID NO: 9679 - RNA, 19 nt, artificial
  Oligomer
ugaauaaauucuauaggaa

SEQ ID NO: 9680 - RNA, 19 nt, artificial
  Oligomer
gugaauaaauucuauagga

SEQ ID NO: 9681 - RNA, 19 nt, artificial
  Oligomer
ucaugauuagcaaguuaca

SEQ ID NO: 9682 - RNA, 19 nt, artificial
  Oligomer
gguuuuuuuuaguuuguau

SEQ ID NO: 9683 - RNA, 19 nt, artificial
  Oligomer
uaaagguauccauggagaa

SEQ ID NO: 9684 - RNA, 19 nt, artificial
  Oligomer
ccugaacacuuuuguugua

SEQ ID NO: 9685 - RNA, 19 nt, artificial
  Oligomer
gaccugaaaaaaauaacaa

SEQ ID NO: 9686 - RNA, 19 nt, artificial
  Oligomer
uauugagaaagaaacuaau

SEQ ID NO: 9687 - RNA, 19 nt, artificial
  Oligomer
acucuauuuuuaucacuaa

SEQ ID NO: 9688 - RNA, 19 nt, artificial
  Oligomer
aguugagcuucauauacca

SEQ ID NO: 9689 - RNA, 19 nt, artificial
  Oligomer
augaagucaggaauaaaaa

SEQ ID NO: 9690 - RNA, 19 nt, artificial
  Oligomer
ccaucaaauagaaccacua

SEQ ID NO: 9691 - RNA, 19 nt, artificial
  Oligomer
cggaugacuuaacugcauu

SEQ ID NO: 9692 - RNA, 19 nt, artificial
  Oligomer
uaguugcaauugaauuaaa

SEQ ID NO: 9693 - RNA, 19 nt, artificial
  Oligomer
ccuguaacuuuuguaaaua

SEQ ID NO: 9694 - RNA, 19 nt, artificial
  Oligomer
ggugaggcaauaaaaauca

SEQ ID NO: 9695 - RNA, 19 nt, artificial
  Oligomer
gcuucauauaccagcaaua

SEQ ID NO: 9696 - RNA, 19 nt, artificial
  Oligomer
cgaaucaauggacucugga

SEQ ID NO: 9697 - RNA, 19 nt, artificial
  Oligomer
ugagauggguuuauguaua

SEQ ID NO: 9698 - RNA, 19 nt, artificial
  Oligomer
ugguauauuugguacugua

SEQ ID NO: 9699 - RNA, 19 nt, artificial
  Oligomer
agaaacuugugaaguggaa

SEQ ID NO: 9700 - RNA, 19 nt, artificial
  Oligomer
ggcgugucauaaaauacca

SEQ ID NO: 9701 - RNA, 19 nt, artificial
  Oligomer
auauaaggaaagcaauaaa

SEQ ID NO: 9702 - RNA, 19 nt, artificial
  Oligomer
aaagguggugaggcaauaa

SEQ ID NO: 9703 - RNA, 19 nt, artificial
  Oligomer
accuguaacuuuuguaaau

SEQ ID NO: 9704 - RNA, 19 nt, artificial
  Oligomer
uguuuaauauugagaaaga

SEQ ID NO: 9705 - RNA, 19 nt, artificial
  Oligomer
gacgcuacuuuucaugcaa

SEQ ID NO: 9706 - RNA, 19 nt, artificial
  Oligomer
ugagagaaagugugagcaa

SEQ ID NO: 9707 - RNA, 19 nt, artificial
  Oligomer
cuaugaauuuucaaguaau

SEQ ID NO: 9708 - RNA, 19 nt, artificial
  Oligomer
ugaacacuuuuguuguaaa

SEQ ID NO: 9709 - RNA, 19 nt, artificial
  Oligomer
cagcauaaauaucuucuga

SEQ ID NO: 9710 - RNA, 19 nt, artificial
  Oligomer
gauauacacggaugacuua

SEQ ID NO: 9711 - RNA, 19 nt, artificial
  Oligomer
ugaugauguggaagaacuu

SEQ ID NO: 9712 - RNA, 19 nt, artificial
  Oligomer
gaaacauucagaaacuuga

SEQ ID NO: 9713 - RNA, 19 nt, artificial
  Oligomer
uggugaagaaggaauaauu

SEQ ID NO: 9714 - RNA, 19 nt, artificial
  Oligomer
acgugaagaaauuguggaa

SEQ ID NO: 9715 - RNA, 19 nt, artificial
  Oligomer
cauucagaaacuugaaaua

SEQ ID NO: 9716 - RNA, 19 nt, artificial
  Oligomer
gaauuuaugcacauucuua

SEQ ID NO: 9717 - RNA, 19 nt, artificial
  Oligomer
caaaagaacucuauuuuua

SEQ ID NO: 9718 - RNA, 19 nt, artificial
  Oligomer
ccugagauggguuuaugua

SEQ ID NO: 9719 - RNA, 19 nt, artificial
  Oligomer
agcauguaaugguaucuua

SEQ ID NO: 9720 - RNA, 19 nt, artificial
  Oligomer
caggaauaaaaaugaucuu

SEQ ID NO: 9721 - RNA, 19 nt, artificial
  Oligomer
gaaagaaaaagaccuauga

SEQ ID NO: 9722 - RNA, 19 nt, artificial
  Oligomer
uguugaccugaaaaaaaua

SEQ ID NO: 9723 - RNA, 19 nt, artificial
  Oligomer
uguagaagucuaacuggaa

SEQ ID NO: 9724 - RNA, 19 nt, artificial
  Oligomer
ucugaagagcuauuauaua

SEQ ID NO: 9725 - RNA, 19 nt, artificial
  Oligomer
gcauaucaguugagcuuca

SEQ ID NO: 9726 - RNA, 19 nt, artificial
  Oligomer
ccuguaacuugagaguaga

SEQ ID NO: 9727 - RNA, 19 nt, artificial
  Oligomer
ccuguuccaugaaggcaga

SEQ ID NO: 9728 - RNA, 19 nt, artificial
  Oligomer
uggaccuguugaccugaaa

SEQ ID NO: 9729 - RNA, 19 nt, artificial
  Oligomer
caguggauucaaaauccau

SEQ ID NO: 9730 - RNA, 19 nt, artificial
  Oligomer
gaccuguugaccugaaaaa

SEQ ID NO: 9731 - RNA, 19 nt, artificial
  Oligomer
gaccuacucucaugcugca

SEQ ID NO: 9732 - RNA, 19 nt, artificial
  Oligomer
gguaguugcaauugaauua

SEQ ID NO: 9733 - RNA, 19 nt, artificial
  Oligomer
cucaaaccuuuauuuuaga

SEQ ID NO: 9734 - RNA, 19 nt, artificial
  Oligomer
acggaugacuuaacugcau

SEQ ID NO: 9735 - RNA, 19 nt, artificial
  Oligomer
aggcaauaaaaaucauagu

SEQ ID NO: 9736 - RNA, 19 nt, artificial
  Oligomer
aaagugaagcaaaucagaa

SEQ ID NO: 9737 - RNA, 19 nt, artificial
  Oligomer
ugaggcaauaaaaaucaua

SEQ ID NO: 9738 - RNA, 19 nt, artificial
  Oligomer
ugaaaaaguuaaacauuga

SEQ ID NO: 9739 - RNA, 19 nt, artificial
  Oligomer
cuaccagcauaaauaucuu

SEQ ID NO: 9740 - RNA, 19 nt, artificial
  Oligomer
agacagugguguugaugau

SEQ ID NO: 9741 - RNA, 19 nt, artificial
  Oligomer
guuuuauacuguuuacuga

SEQ ID NO: 9742 - RNA, 19 nt, artificial
  Oligomer
gaagaucacagcaaaagga

SEQ ID NO: 9743 - RNA, 19 nt, artificial
  Oligomer
uuaaaaauuuggaaccaaa

SEQ ID NO: 9744 - RNA, 19 nt, artificial
  Oligomer
ccaaacuuuucauuauuca

SEQ ID NO: 9745 - RNA, 19 nt, artificial
  Oligomer
acuugacuuuuaaggcuaa

SEQ ID NO: 9746 - RNA, 19 nt, artificial
  Oligomer
auaugaagucaggaauaaa

SEQ ID NO: 9747 - RNA, 19 nt, artificial
  Oligomer
ucuggaauaucccuggaca

SEQ ID NO: 9748 - RNA, 19 nt, artificial
  Oligomer
cacauagcauguaauggua

SEQ ID NO: 9749 - RNA, 19 nt, artificial
  Oligomer
aguuaauaaagguauccau

SEQ ID NO: 9750 - RNA, 19 nt, artificial
  Oligomer
gaccuaugagcacauagga

SEQ ID NO: 9751 - RNA, 19 nt, artificial
  Oligomer
aaguaauugugaaaaaguu

SEQ ID NO: 9752 - RNA, 19 nt, artificial
  Oligomer
cuuuuaaggcuaaaacuua

SEQ ID NO: 9753 - RNA, 19 nt, artificial
  Oligomer
cgcauuugucaaugacagu

SEQ ID NO: 9754 - RNA, 19 nt, artificial
  Oligomer
augugacaauuuuguacaa

SEQ ID NO: 9755 - RNA, 19 nt, artificial
  Oligomer
cugagauggguuuauguau

SEQ ID NO: 9756 - RNA, 19 nt, artificial
  Oligomer
gaagaaauuguggaauuga

SEQ ID NO: 9757 - RNA, 19 nt, artificial
  Oligomer
ucuauaggaacauaugaaa

SEQ ID NO: 9758 - RNA, 19 nt, artificial
  Oligomer
agucuaacuggaaaaccca

SEQ ID NO: 9759 - RNA, 19 nt, artificial
  Oligomer
gaauaucccuggacaacag

SEQ ID NO: 9760 - RNA, 19 nt, artificial
  Oligomer
gugacaauuuuguacaaau

SEQ ID NO: 9761 - RNA, 19 nt, artificial
  Oligomer
gcaaaauucuuaaguaugu

SEQ ID NO: 9762 - RNA, 19 nt, artificial
  Oligomer
gcccauuucuccauacgca

SEQ ID NO: 9763 - RNA, 19 nt, artificial
  Oligomer
acaguggaauauaaggaaa

SEQ ID NO: 9764 - RNA, 19 nt, artificial
  Oligomer
gagcacauaggacucuaga

SEQ ID NO: 9765 - RNA, 19 nt, artificial
  Oligomer
acuggugcagucauuauga

SEQ ID NO: 9766 - RNA, 19 nt, artificial
  Oligomer
guggauucaaaauccauua

SEQ ID NO: 9767 - RNA, 19 nt, artificial
  Oligomer
agaaagugugagcaaacua

SEQ ID NO: 9768 - RNA, 19 nt, artificial
  Oligomer
guaauugugaaaaaguuaa

SEQ ID NO: 9769 - RNA, 19 nt, artificial
  Oligomer
ccacuaugaagcuaccuca

SEQ ID NO: 9770 - RNA, 19 nt, artificial
  Oligomer
accuguugaccugaaaaaa

SEQ ID NO: 9771 - RNA, 19 nt, artificial
  Oligomer
cuggaaaacccaaacuuuu

SEQ ID NO: 9772 - RNA, 19 nt, artificial
  Oligomer
ggagauuucuuguugcuca

SEQ ID NO: 9773 - RNA, 19 nt, artificial
  Oligomer
cuuugacgcuacuuuucau

SEQ ID NO: 9774 - RNA, 19 nt, artificial
  Oligomer
ugcugcagaggguacuuua

SEQ ID NO: 9775 - RNA, 19 nt, artificial
  Oligomer
gcugugcuaugaauuuuca

SEQ ID NO: 9776 - RNA, 19 nt, artificial
  Oligomer
auaggaacauaugaaaaua

SEQ ID NO: 9777 - RNA, 19 nt, artificial
  Oligomer
gaauuugaguccuuuuccu

SEQ ID NO: 9778 - RNA, 19 nt, artificial
  Oligomer
aaaacuuaacauucauaga

SEQ ID NO: 9779 - RNA, 19 nt, artificial
  Oligomer
guauucuaguuuugucaaa

SEQ ID NO: 9780 - RNA, 19 nt, artificial
  Oligomer
gcaaagaaacagauuccau

SEQ ID NO: 9781 - RNA, 19 nt, artificial
  Oligomer
gcuaugaauuuucaaguaa

SEQ ID NO: 9782 - RNA, 19 nt, artificial
  Oligomer
cucagggaaacauucagaa

SEQ ID NO: 9783 - RNA, 19 nt, artificial
  Oligomer
cauacuccuuccaucaaau

SEQ ID NO: 9784 - RNA, 19 nt, artificial
  Oligomer
aggaauaauuuuuggaaca

SEQ ID NO: 9785 - RNA, 19 nt, artificial
  Oligomer
guggaaauguucuaaaggu

SEQ ID NO: 9786 - RNA, 19 nt, artificial
  Oligomer
cagacagugguguugauga

SEQ ID NO: 9787 - RNA, 19 nt, artificial
  Oligomer
cuuuguagcaaaauucuua

SEQ ID NO: 9788 - RNA, 19 nt, artificial
  Oligomer
agucaggaauaaaaaugau

SEQ ID NO: 9789 - RNA, 19 nt, artificial
  Oligomer
ugaccugaaaaaaauaaca

SEQ ID NO: 9790 - RNA, 19 nt, artificial
  Oligomer
acauacuccuuccaucaaa

SEQ ID NO: 9791 - RNA, 19 nt, artificial
  Oligomer
ggaauaaauaaaaauggau

SEQ ID NO: 9792 - RNA, 19 nt, artificial
  Oligomer
gcaccugguuauuauucuu

SEQ ID NO: 9793 - RNA, 19 nt, artificial
  Oligomer
ugaagucaggaauaaaaau

SEQ ID NO: 9794 - RNA, 19 nt, artificial
  Oligomer
uguagaaguuaauaaaggu

SEQ ID NO: 9795 - RNA, 19 nt, artificial
  Oligomer
gauuucuuguugcucaaaa

SEQ ID NO: 9796 - RNA, 19 nt, artificial
  Oligomer
gaugauguggaagaacuua

SEQ ID NO: 9797 - RNA, 19 nt, artificial
  Oligomer
cuugacuuuuaaggcuaaa

SEQ ID NO: 9798 - RNA, 19 nt, artificial
  Oligomer
aucaguugagcuucauaua

SEQ ID NO: 9799 - RNA, 19 nt, artificial
  Oligomer
ggauuauccugagaugggu

SEQ ID NO: 9800 - RNA, 19 nt, artificial
  Oligomer
guugguuggugguuuuuuu

SEQ ID NO: 9801 - RNA, 19 nt, artificial
  Oligomer
cucgcauuugucaaugaca

SEQ ID NO: 9802 - RNA, 19 nt, artificial
  Oligomer
aauccauuaaaaauuugga

SEQ ID NO: 9803 - RNA, 19 nt, artificial
  Oligomer
uaaacauugaaguaaugaa

SEQ ID NO: 9804 - RNA, 19 nt, artificial
  Oligomer
gucagguaguugcaauuga

SEQ ID NO: 9805 - RNA, 19 nt, artificial
  Oligomer
aguaauugugaaaaaguua

SEQ ID NO: 9806 - RNA, 19 nt, artificial
  Oligomer
ggaauugaugcgugauguu

SEQ ID NO: 9807 - RNA, 19 nt, artificial
  Oligomer
ggaaaacccaaacuuuuca

SEQ ID NO: 9808 - RNA, 19 nt, artificial
  Oligomer
ggaugacuuaacugcauuu

SEQ ID NO: 9809 - RNA, 19 nt, artificial
  Oligomer
uaguacucuuuguagcaaa

SEQ ID NO: 9810 - RNA, 19 nt, artificial
  Oligomer
cgugauguuucuaaagaag

SEQ ID NO: 9811 - RNA, 19 nt, artificial
  Oligomer
aggaaagcaauaaaugaau

SEQ ID NO: 9812 - RNA, 19 nt, artificial
  Oligomer
aacaguggaauauaaggaa

SEQ ID NO: 9813 - RNA, 19 nt, artificial
  Oligomer
gagaaagugugagcaaacu

SEQ ID NO: 9814 - RNA, 19 nt, artificial
  Oligomer
gcauuuuuagaccauuuau

SEQ ID NO: 9815 - RNA, 19 nt, artificial
  Oligomer
aaacucaguggauucaaaa

SEQ ID NO: 9816 - RNA, 19 nt, artificial
  Oligomer
aggcaaugauuguuaauuu

SEQ ID NO: 9817 - RNA, 19 nt, artificial
  Oligomer
gaggcaauaaaaaucauag

SEQ ID NO: 9818 - RNA, 19 nt, artificial
  Oligomer
uauguuauuuucuguugaa

SEQ ID NO: 9819 - RNA, 19 nt, artificial
  Oligomer
cccaaacuguugauuauua

SEQ ID NO: 9820 - RNA, 19 nt, artificial
  Oligomer
gucacugcaccaagucuca

SEQ ID NO: 9821 - RNA, 19 nt, artificial
  Oligomer
caugacucagccuguucca

SEQ ID NO: 9822 - RNA, 19 nt, artificial
  Oligomer
guagaaguuaauaaaggua

SEQ ID NO: 9823 - RNA, 19 nt, artificial
  Oligomer
uaaagguggugaggcaaua

SEQ ID NO: 9824 - RNA, 19 nt, artificial
  Oligomer
gugaaguggaaauguucua

SEQ ID NO: 9825 - RNA, 19 nt, artificial
  Oligomer
gaacaaauggaccuguuga

SEQ ID NO: 9826 - RNA, 19 nt, artificial
  Oligomer
guaaugugaauaaauucua

SEQ ID NO: 9827 - RNA, 19 nt, artificial
  Oligomer
cagaugucgaugcagcaaa

SEQ ID NO: 9828 - RNA, 19 nt, artificial
  Oligomer
gcauaaauaucuucugauu

SEQ ID NO: 9829 - RNA, 19 nt, artificial
  Oligomer
uaccagcaauauaucugaa

SEQ ID NO: 9830 - RNA, 19 nt, artificial
  Oligomer
caucaaauagaaccacuau

SEQ ID NO: 9831 - RNA, 19 nt, artificial
  Oligomer
auauuuuaugugagagaaa

SEQ ID NO: 9832 - RNA, 19 nt, artificial
  Oligomer
caaacuguagaaaugauga

SEQ ID NO: 9833 - RNA, 19 nt, artificial
  Oligomer
cgugguacagaacuggacu

SEQ ID NO: 9834 - RNA, 19 nt, artificial
  Oligomer
acgcuacuuuucaugcaaa

SEQ ID NO: 9835 - RNA, 19 nt, artificial
  Oligomer
gucgaugcagcaaaccuca

SEQ ID NO: 9836 - RNA, 19 nt, artificial
  Oligomer
auauugagaaagaaacuaa

SEQ ID NO: 9837 - RNA, 19 nt, artificial
  Oligomer
auccauuaaaaauuuggaa

SEQ ID NO: 9838 - RNA, 19 nt, artificial
  Oligomer
uagcaaaauucuuaaguau

SEQ ID NO: 9839 - RNA, 19 nt, artificial
  Oligomer
cugauuugucccuaugcau

SEQ ID NO: 9840 - RNA, 19 nt, artificial
  Oligomer
agauggguuuauguauaau

SEQ ID NO: 9841 - RNA, 19 nt, artificial
  Oligomer
auugagaaagaaacuaaua

SEQ ID NO: 9842 - RNA, 19 nt, artificial
  Oligomer
gguauauuugguacuguau

SEQ ID NO: 9843 - RNA, 19 nt, artificial
  Oligomer
cauaguacucuuuguagca

SEQ ID NO: 9844 - RNA, 19 nt, artificial
  Oligomer
guuuacaaucaaaggaaaa

SEQ ID NO: 9845 - RNA, 19 nt, artificial
  Oligomer
caacagaauuugaguccuu

SEQ ID NO: 9846 - RNA, 19 nt, artificial
  Oligomer
gagcuucauauaccagcaa

SEQ ID NO: 9847 - RNA, 19 nt, artificial
  Oligomer
cuaaaacuuaacauucaua

SEQ ID NO: 9848 - RNA, 19 nt, artificial
  Oligomer
cagaggguacuuuaagaca

SEQ ID NO: 9849 - RNA, 19 nt, artificial
  Oligomer
gauacuggugcagucauua

SEQ ID NO: 9850 - RNA, 19 nt, artificial
  Oligomer
gugaugcugugcuaugaau

SEQ ID NO: 9851 - RNA, 19 nt, artificial
  Oligomer
gaagaugguauauuuggua

SEQ ID NO: 9852 - RNA, 19 nt, artificial
  Oligomer
aagucaggaauaaaaauga

SEQ ID NO: 9853 - RNA, 19 nt, artificial
  Oligomer
caaguaauugugaaaaagu

SEQ ID NO: 9854 - RNA, 19 nt, artificial
  Oligomer
ugacaauuuuguacaaauu

SEQ ID NO: 9855 - RNA, 19 nt, artificial
  Oligomer
ugggauuaugguuuuguga

SEQ ID NO: 9856 - RNA, 19 nt, artificial
  Oligomer
gacaguuucuuuuuucuua

SEQ ID NO: 9857 - RNA, 19 nt, artificial
  Oligomer
aacccaaacuuuucauuau

SEQ ID NO: 9858 - RNA, 19 nt, artificial
  Oligomer
gacauacuccuuccaucaa

SEQ ID NO: 9859 - RNA, 19 nt, artificial
  Oligomer
caacuuaaauaauaaacag

SEQ ID NO: 9860 - RNA, 19 nt, artificial
  Oligomer
gaaacuugugaaguggaaa

SEQ ID NO: 9861 - RNA, 19 nt, artificial
  Oligomer
cagucagguaguugcaauu

SEQ ID NO: 9862 - RNA, 19 nt, artificial
  Oligomer
cuagcggaugggugcuauu

SEQ ID NO: 9863 - RNA, 19 nt, artificial
  Oligomer
ccaagugagaagaugguau

SEQ ID NO: 9864 - RNA, 19 nt, artificial
  Oligomer
guuuacugaaagaaaaaga

SEQ ID NO: 9865 - RNA, 19 nt, artificial
  Oligomer
gucaaacuguagaaaugau

SEQ ID NO: 9866 - RNA, 19 nt, artificial
  Oligomer
caguuauaaaauggauuau

SEQ ID NO: 9867 - RNA, 19 nt, artificial
  Oligomer
ccagucagguaguugcaau

SEQ ID NO: 9868 - RNA, 19 nt, artificial
  Oligomer
aaaggaaaauaguaauguu

SEQ ID NO: 9869 - RNA, 19 nt, artificial
  Oligomer
cuacuuuucaugcaaagaa

SEQ ID NO: 9870 - RNA, 19 nt, artificial
  Oligomer
gauuugucccuaugcauau

SEQ ID NO: 9871 - RNA, 19 nt, artificial
  Oligomer
caaugacaguuucuuuuuu

SEQ ID NO: 9872 - RNA, 19 nt, artificial
  Oligomer
uaauaaagguauccaugga

SEQ ID NO: 9873 - RNA, 19 nt, artificial
  Oligomer
guugcaauugaauuaaauu

SEQ ID NO: 9874 - RNA, 19 nt, artificial
  Oligomer
aaucaaaggaaaauaguaa

SEQ ID NO: 9875 - RNA, 19 nt, artificial
  Oligomer
gacuuaacugcauuuuuag

SEQ ID NO: 9876 - RNA, 19 nt, artificial
  Oligomer
cuguaacuugagaguagau

SEQ ID NO: 9877 - RNA, 19 nt, artificial
  Oligomer
acagcaccugguuauuauu

SEQ ID NO: 9878 - RNA, 19 nt, artificial
  Oligomer
ggucaaaggcucaaaccuu

SEQ ID NO: 9879 - RNA, 19 nt, artificial
  Oligomer
gacuuuuaaggcuaaaacu

SEQ ID NO: 9880 - RNA, 19 nt, artificial
  Oligomer
auccauggagaacacugaa

SEQ ID NO: 9881 - RNA, 19 nt, artificial
  Oligomer
cagugguguugaugaugac

SEQ ID NO: 9882 - RNA, 19 nt, artificial
  Oligomer
cagcaaaaggagcaguuuu

SEQ ID NO: 9883 - RNA, 19 nt, artificial
  Oligomer
ugagaaagaaacuaauauu

SEQ ID NO: 9884 - RNA, 19 nt, artificial
  Oligomer
agaggguacuuuaagacau

SEQ ID NO: 9885 - RNA, 19 nt, artificial
  Oligomer
aagugugagcaaacuaacu

SEQ ID NO: 9886 - RNA, 19 nt, artificial
  Oligomer
cugggauuaugguuuugug

SEQ ID NO: 9887 - RNA, 19 nt, artificial
  Oligomer
uuguuuccaugcucacaaa

SEQ ID NO: 9888 - RNA, 19 nt, artificial
  Oligomer
ucccuggacaacaguuaua

SEQ ID NO: 9889 - RNA, 19 nt, artificial
  Oligomer
uuuuauacuguuuacugaa

SEQ ID NO: 9890 - RNA, 19 nt, artificial
  Oligomer
cacugaaaacucaguggau

SEQ ID NO: 9891 - RNA, 19 nt, artificial
  Oligomer
aaguuuacaaucaaaggaa

SEQ ID NO: 9892 - RNA, 19 nt, artificial
  Oligomer
ccucagggaaacauucaga

SEQ ID NO: 9893 - RNA, 19 nt, artificial
  Oligomer
ggucugguacagaugucga

SEQ ID NO: 9894 - RNA, 19 nt, artificial
  Oligomer
ggcugucaguaugacauuu

SEQ ID NO: 9895 - RNA, 19 nt, artificial
  Oligomer
gaggcgguuguagaaguua

SEQ ID NO: 9896 - RNA, 19 nt, artificial
  Oligomer
cagaaacuugugaagugga

SEQ ID NO: 9897 - RNA, 19 nt, artificial
  Oligomer
aaguggaaauguucuaaag

SEQ ID NO: 9898 - RNA, 19 nt, artificial
  Oligomer
caaaauucuuaaguauguu

SEQ ID NO: 9899 - RNA, 19 nt, artificial
  Oligomer
ucagggaaacauucagaaa

SEQ ID NO: 9900 - RNA, 19 nt, artificial
  Oligomer
uguaacuuuuguaaauaca

SEQ ID NO: 9901 - RNA, 19 nt, artificial
  Oligomer
ugcuaugaauuuucaagua

SEQ ID NO: 9902 - RNA, 19 nt, artificial
  Oligomer
ugagcuucauauaccagca

SEQ ID NO: 9903 - RNA, 19 nt, artificial
  Oligomer
gucugguacagaugucgau

SEQ ID NO: 9904 - RNA, 19 nt, artificial
  Oligomer
caaaucagaaacuugugaa

SEQ ID NO: 9905 - RNA, 19 nt, artificial
  Oligomer
aguaagaaagugaagcaaa

SEQ ID NO: 9906 - RNA, 19 nt, artificial
  Oligomer
uggugcagucauuaugaga

SEQ ID NO: 9907 - RNA, 19 nt, artificial
  Oligomer
gcauggucaaaggcucaaa

SEQ ID NO: 9908 - RNA, 19 nt, artificial
  Oligomer
gggaaacauucagaaacuu

SEQ ID NO: 9909 - RNA, 19 nt, artificial
  Oligomer
cauuaugagaggcaaugau

SEQ ID NO: 9910 - RNA, 19 nt, artificial
  Oligomer
ucaguggauucaaaaucca

SEQ ID NO: 9911 - RNA, 19 nt, artificial
  Oligomer
agggaaacauucagaaacu

SEQ ID NO: 9912 - RNA, 19 nt, artificial
  Oligomer
uauacuguuuacugaaaga

SEQ ID NO: 9913 - RNA, 19 nt, artificial
  Oligomer
aauugauauacacggauga

SEQ ID NO: 9914 - RNA, 19 nt, artificial
  Oligomer
guauguuauuuucuguuga

SEQ ID NO: 9915 - RNA, 19 nt, artificial
  Oligomer
uucuauaggaacauaugaa

SEQ ID NO: 9916 - RNA, 19 nt, artificial
  Oligomer
cuuguugcucaaaaaauga

SEQ ID NO: 9917 - RNA, 19 nt, artificial
  Oligomer
cgggagauuucuuguugcu

SEQ ID NO: 9918 - RNA, 19 nt, artificial
  Oligomer
aucugaagagcuauuauau

SEQ ID NO: 9919 - RNA, 19 nt, artificial
  Oligomer
ucugauuugucccuaugca

SEQ ID NO: 9920 - RNA, 19 nt, artificial
  Oligomer
gagaaagaaacuaauauuu

SEQ ID NO: 9921 - RNA, 19 nt, artificial
  Oligomer
uaucugaagagcuauuaua

SEQ ID NO: 9922 - RNA, 19 nt, artificial
  Oligomer
aucccuggacaacaguuau

SEQ ID NO: 9923 - RNA, 19 nt, artificial
  Oligomer
aauuuuuggaacaaaugga

SEQ ID NO: 9924 - RNA, 19 nt, artificial
  Oligomer
ggaggccgacuucuuguau

SEQ ID NO: 9925 - RNA, 19 nt, artificial
  Oligomer
uagaauugauauacacgga

SEQ ID NO: 9926 - RNA, 19 nt, artificial
  Oligomer
agaagaugguauauuuggu

SEQ ID NO: 9927 - RNA, 19 nt, artificial
  Oligomer
ucauauaccagcaauauau

SEQ ID NO: 9928 - RNA, 19 nt, artificial
  Oligomer
cggaugggugcuauuguga

SEQ ID NO: 9929 - RNA, 19 nt, artificial
  Oligomer
uuacccggguuaaccgaaa

SEQ ID NO: 9930 - RNA, 19 nt, artificial
  Oligomer
uucaaguaauugugaaaaa

SEQ ID NO: 9931 - RNA, 19 nt, artificial
  Oligomer
caaaccucagggaaacauu

SEQ ID NO: 9932 - RNA, 19 nt, artificial
  Oligomer
gaauuuucauaaaagcacu

SEQ ID NO: 9933 - RNA, 19 nt, artificial
  Oligomer
ugagcagagacaugacuca

SEQ ID NO: 9934 - RNA, 19 nt, artificial
  Oligomer
uggauucaaaauccauuaa

SEQ ID NO: 9935 - RNA, 19 nt, artificial
  Oligomer
ugaugcgugauguuucuaa

SEQ ID NO: 9936 - RNA, 19 nt, artificial
  Oligomer
cuuuucaugcaaagaaaca

SEQ ID NO: 9937 - RNA, 19 nt, artificial
  Oligomer
ugguuuuuuuuaguuugua

SEQ ID NO: 9938 - RNA, 19 nt, artificial
  Oligomer
acuaauauuuuaugugaga

SEQ ID NO: 9939 - RNA, 19 nt, artificial
  Oligomer
gaaacaguaugccgacaag

SEQ ID NO: 9940 - RNA, 19 nt, artificial
  Oligomer
guaugccgacaagcuugaa

SEQ ID NO: 9941 - RNA, 19 nt, artificial
  Oligomer
ggaaccaaagaucauacau

SEQ ID NO: 9942 - RNA, 19 nt, artificial
  Oligomer
agaaacagauuccauguau

SEQ ID NO: 9943 - RNA, 19 nt, artificial
  Oligomer
acaguuauaaaauggauua

SEQ ID NO: 9944 - RNA, 19 nt, artificial
  Oligomer
caaguaagaaagugaagca

SEQ ID NO: 9945 - RNA, 19 nt, artificial
  Oligomer
acucuggaauaucccugga

SEQ ID NO: 9946 - RNA, 19 nt, artificial
  Oligomer
gggauuaugguuuugugau

SEQ ID NO: 9947 - RNA, 19 nt, artificial
  Oligomer
aaaaauuuggaaccaaaga

SEQ ID NO: 9948 - RNA, 19 nt, artificial
  Oligomer
guugaccugaaaaaaauaa

SEQ ID NO: 9949 - RNA, 19 nt, artificial
  Oligomer
guuucuaugugacaauuuu

SEQ ID NO: 9950 - RNA, 19 nt, artificial
  Oligomer
aacuguaaggugcuacaau

SEQ ID NO: 9951 - RNA, 19 nt, artificial
  Oligomer
ccaaagaucauacauggaa

SEQ ID NO: 9952 - RNA, 19 nt, artificial
  Oligomer
ugaaguggaaauguucuaa

SEQ ID NO: 9953 - RNA, 19 nt, artificial
  Oligomer
gcacauucuuacccggguu

SEQ ID NO: 9954 - RNA, 19 nt, artificial
  Oligomer
agcuugaauuuaugcacau

SEQ ID NO: 9955 - RNA, 19 nt, artificial
  Oligomer
cauacauggaagcgaauca

SEQ ID NO: 9956 - RNA, 19 nt, artificial
  Oligomer
agaggcaaugauuguuaau

SEQ ID NO: 9957 - RNA, 19 nt, artificial
  Oligomer
cauggagaacacugaaaac

SEQ ID NO: 9958 - RNA, 19 nt, artificial
  Oligomer
agacauacuccuuccauca

SEQ ID NO: 9959 - RNA, 19 nt, artificial
  Oligomer
cauaugaaaauacaacuua

SEQ ID NO: 9960 - RNA, 19 nt, artificial
  Oligomer
ugauuugucccuaugcaua

SEQ ID NO: 9961 - RNA, 19 nt, artificial
  Oligomer
cgcuacuuuucaugcaaag

SEQ ID NO: 9962 - RNA, 19 nt, artificial
  Oligomer
guuuugucaaacuguagaa

SEQ ID NO: 9963 - RNA, 19 nt, artificial
  Oligomer
guagaugguuugagccuga

SEQ ID NO: 9964 - RNA, 19 nt, artificial
  Oligomer
gcaauugaauuaaauuagg

SEQ ID NO: 9965 - RNA, 19 nt, artificial
  Oligomer
acuggaaaacccaaacuuu

SEQ ID NO: 9966 - RNA, 19 nt, artificial
  Oligomer
gaaguuuacaaucaaagga

SEQ ID NO: 9967 - RNA, 19 nt, artificial
  Oligomer
uuuguagcaaaauucuuaa

SEQ ID NO: 9968 - RNA, 19 nt, artificial
  Oligomer
aaaucauaguacucuuugu

SEQ ID NO: 9969 - RNA, 19 nt, artificial
  Oligomer
cuugugaaguggaaauguu

SEQ ID NO: 9970 - RNA, 19 nt, artificial
  Oligomer
aagcuugaauuuaugcaca

SEQ ID NO: 9971 - RNA, 19 nt, artificial
  Oligomer
gaugcugugcuaugaauuu

SEQ ID NO: 9972 - RNA, 19 nt, artificial
  Oligomer
ugguacagaugucgaugca

SEQ ID NO: 9973 - RNA, 19 nt, artificial
  Oligomer
acuccuuccaucaaauaga

SEQ ID NO: 9974 - RNA, 19 nt, artificial
  Oligomer
uggaucuaccagcauaaau

SEQ ID NO: 9975 - RNA, 19 nt, artificial
  Oligomer
acuuaacugcauuuuuaga

SEQ ID NO: 9976 - RNA, 19 nt, artificial
  Oligomer
guaguugcaauugaauuaa

SEQ ID NO: 9977 - RNA, 19 nt, artificial
  Oligomer
caauuuuguacaaauuugu

SEQ ID NO: 9978 - RNA, 19 nt, artificial
  Oligomer
agaaggaauaauuuuugga

SEQ ID NO: 9979 - RNA, 19 nt, artificial
  Oligomer
gcucaaaccuuuauuuuag

SEQ ID NO: 9980 - RNA, 19 nt, artificial
  Oligomer
agagaaagugugagcaaac

SEQ ID NO: 9981 - RNA, 19 nt, artificial
  Oligomer
ccacagcaccugguuauua

SEQ ID NO: 9982 - RNA, 19 nt, artificial
  Oligomer
uuuccaugcucacaaaaga

SEQ ID NO: 9983 - RNA, 19 nt, artificial
  Oligomer
caaauuuguuauuuuccau

SEQ ID NO: 9984 - RNA, 19 nt, artificial
  Oligomer
cagauuccauguauuguuu

SEQ ID NO: 9985 - RNA, 19 nt, artificial
  Oligomer
aaacauugaaguaaugaau

SEQ ID NO: 9986 - RNA, 19 nt, artificial
  Oligomer
gaaaacucaguggauucaa

SEQ ID NO: 9987 - RNA, 19 nt, artificial
  Oligomer
gccgacuucuuguaugcau

SEQ ID NO: 9988 - RNA, 19 nt, artificial
  Oligomer
uuccaugcucacaaaagaa

SEQ ID NO: 9989 - RNA, 19 nt, artificial
  Oligomer
acaacaguuauaaaaugga

SEQ ID NO: 9990 - RNA, 19 nt, artificial
  Oligomer
uuacagugaugcugugcua

SEQ ID NO: 9991 - RNA, 19 nt, artificial
  Oligomer
cauuuugaccuacucucau

SEQ ID NO: 9992 - RNA, 19 nt, artificial
  Oligomer
uggaggccgacuucuugua

SEQ ID NO: 9993 - RNA, 19 nt, artificial
  Oligomer
aauauuuuaugugagagaa

SEQ ID NO: 9994 - RNA, 19 nt, artificial
  Oligomer
aaaguuaaacauugaagua

SEQ ID NO: 9995 - RNA, 19 nt, artificial
  Oligomer
ugaggcgguuguagaaguu

SEQ ID NO: 9996 - RNA, 19 nt, artificial
  Oligomer
uacagaugucgaugcagca

SEQ ID NO: 9997 - RNA, 19 nt, artificial
  Oligomer
gucauaaaauaccagugga

SEQ ID NO: 9998 - RNA, 19 nt, artificial
  Oligomer
gugaagaaauuguggaauu

SEQ ID NO: 9999 - RNA, 19 nt, artificial
  Oligomer
gauuguuaauuuacagcuu

SEQ ID NO: 10000 - RNA, 19 nt, artificial
  Oligomer
gguuggugguuuuuuuuag

SEQ ID NO: 10001 - RNA, 19 nt, artificial
  Oligomer
agaugucgaugcagcaaac

SEQ ID NO: 10002 - RNA, 19 nt, artificial
  Oligomer
gcaaaaggagcaguuuugu

SEQ ID NO: 10003 - RNA, 19 nt, artificial
  Oligomer
agucauuaugagaggcaau

SEQ ID NO: 10004 - RNA, 19 nt, artificial
  Oligomer
uuucauaaaagcacuggaa

SEQ ID NO: 10005 - RNA, 19 nt, artificial
  Oligomer
augacaucucggucuggua

SEQ ID NO: 10006 - RNA, 19 nt, artificial
  Oligomer
aauaugaagucaggaauaa

SEQ ID NO: 10007 - RNA, 19 nt, artificial
  Oligomer
gugauguuucuaaagaaga

SEQ ID NO: 10008 - RNA, 19 nt, artificial
  Oligomer
ucuaacuggaaaacccaaa

SEQ ID NO: 10009 - RNA, 19 nt, artificial
  Oligomer
uucuaaagguggugaggca

SEQ ID NO: 10010 - RNA, 19 nt, artificial
  Oligomer
uugagaaagaaacuaauau

SEQ ID NO: 10011 - RNA, 19 nt, artificial
  Oligomer
gaccauuuaucugggauua

SEQ ID NO: 10012 - RNA, 19 nt, artificial
  Oligomer
accuuuauuuuagaauuga

SEQ ID NO: 10013 - RNA, 19 nt, artificial
  Oligomer
cuauugugaggcgguugua

SEQ ID NO: 10014 - RNA, 19 nt, artificial
  Oligomer
aauaauaaacaguggaaua

SEQ ID NO: 10015 - RNA, 19 nt, artificial
  Oligomer
gagacaugacucagccugu

SEQ ID NO: 10016 - RNA, 19 nt, artificial
  Oligomer
auaucaguugagcuucaua

SEQ ID NO: 10017 - RNA, 19 nt, artificial
  Oligomer
uuuuuauugccucaccacc

SEQ ID NO: 10018 - RNA, 19 nt, artificial
  Oligomer
uuguauuuucauauguucc

SEQ ID NO: 10019 - RNA, 19 nt, artificial
  Oligomer
uuuauaacuguuguccagg

SEQ ID NO: 10020 - RNA, 19 nt, artificial
  Oligomer
uuuauuaacuucuacaacc

SEQ ID NO: 10021 - RNA, 19 nt, artificial
  Oligomer
uuuuaauggauuuugaauc

SEQ ID NO: 10022 - RNA, 19 nt, artificial
  Oligomer
uuuuauugccucaccaccu

SEQ ID NO: 10023 - RNA, 19 nt, artificial
  Oligomer
auuaacuucuacaaccgcc

SEQ ID NO: 10024 - RNA, 19 nt, artificial
  Oligomer
uucuuuagaaacaucacgc

SEQ ID NO: 10025 - RNA, 19 nt, artificial
  Oligomer
uuacaguuaaaacuccacc

SEQ ID NO: 10026 - RNA, 19 nt, artificial
  Oligomer
uuuuuuuacaacaaaagug

SEQ ID NO: 10027 - RNA, 19 nt, artificial
  Oligomer
uuguccagggauauuccag

SEQ ID NO: 10028 - RNA, 19 nt, artificial
  Oligomer
uuaagauaccauuacaugc

SEQ ID NO: 10029 - RNA, 19 nt, artificial
  Oligomer
uuagacuucuacaacgauc

SEQ ID NO: 10030 - RNA, 19 nt, artificial
  Oligomer
uugcuaaucaugaaagcug

SEQ ID NO: 10031 - RNA, 19 nt, artificial
  Oligomer
uguaaauuaacaaucauug

SEQ ID NO: 10032 - RNA, 19 nt, artificial
  Oligomer
uuaacuucuacaaccgccu

SEQ ID NO: 10033 - RNA, 19 nt, artificial
  Oligomer
uguaagaucauuuuuauuc

SEQ ID NO: 10034 - RNA, 19 nt, artificial
  Oligomer
ugaauguuaaguuuuagcc

SEQ ID NO: 10035 - RNA, 19 nt, artificial
  Oligomer
uauuuaugcugguagaucc

SEQ ID NO: 10036 - RNA, 19 nt, artificial
  Oligomer
uuaugcugguagauccagg

SEQ ID NO: 10037 - RNA, 19 nt, artificial
  Oligomer
uuaaaguacccucugcagc

SEQ ID NO: 10038 - RNA, 19 nt, artificial
  Oligomer
uuauuaacuucuacaaccg

SEQ ID NO: 10039 - RNA, 19 nt, artificial
  Oligomer
uuuuauauaauagcucuuc

SEQ ID NO: 10040 - RNA, 19 nt, artificial
  Oligomer
uucaauugcaacuaccuga

SEQ ID NO: 10041 - RNA, 19 nt, artificial
  Oligomer
uuuaagauaccauuacaug

SEQ ID NO: 10042 - RNA, 19 nt, artificial
  Oligomer
auuuauucacauuaccugg

SEQ ID NO: 10043 - RNA, 19 nt, artificial
  Oligomer
uaaaacauuacuauuuucc

SEQ ID NO: 10044 - RNA, 19 nt, artificial
  Oligomer
uuuagaaacaucacgcauc

SEQ ID NO: 10045 - RNA, 19 nt, artificial
  Oligomer
uuugcucacacuuucucuc

SEQ ID NO: 10046 - RNA, 19 nt, artificial
  Oligomer
auaaauucaagcuugucgg

SEQ ID NO: 10047 - RNA, 19 nt, artificial
  Oligomer
uuuguuccaaaaauuauuc

SEQ ID NO: 10048 - RNA, 19 nt, artificial
  Oligomer
uuaguuugcucacacuuuc

SEQ ID NO: 10049 - RNA, 19 nt, artificial
  Oligomer
uaaauuaacaaucauugcc

SEQ ID NO: 10050 - RNA, 19 nt, artificial
  Oligomer
uucacguguaagaucauuu

SEQ ID NO: 10051 - RNA, 19 nt, artificial
  Oligomer
uuuuucuuucaguaaacag

SEQ ID NO: 10052 - RNA, 19 nt, artificial
  Oligomer
uuuucuuucaguaaacagu

SEQ ID NO: 10053 - RNA, 19 nt, artificial
  Oligomer
uacaguuaaaacuccaccc

SEQ ID NO: 10054 - RNA, 19 nt, artificial
  Oligomer
uagacuucuacaacgaucc

SEQ ID NO: 10055 - RNA, 19 nt, artificial
  Oligomer
uuauacauaaacccaucuc

SEQ ID NO: 10056 - RNA, 19 nt, artificial
  Oligomer
uuccagaguccauugauuc

SEQ ID NO: 10057 - RNA, 19 nt, artificial
  Oligomer
uuauuauacauaaacccau

SEQ ID NO: 10058 - RNA, 19 nt, artificial
  Oligomer
uuaacaaucauugccucuc

SEQ ID NO: 10059 - RNA, 19 nt, artificial
  Oligomer
uaugucuuaaaguacccuc

SEQ ID NO: 10060 - RNA, 19 nt, artificial
  Oligomer
uuuuauaacuguuguccag

SEQ ID NO: 10061 - RNA, 19 nt, artificial
  Oligomer
cauaaauucaagcuugucg

SEQ ID NO: 10062 - RNA, 19 nt, artificial
  Oligomer
uucauagugguucuauuug

SEQ ID NO: 10063 - RNA, 19 nt, artificial
  Oligomer
aucaauucuaaaauaaagg

SEQ ID NO: 10064 - RNA, 19 nt, artificial
  Oligomer
auugcuuuccuuauauucc

SEQ ID NO: 10065 - RNA, 19 nt, artificial
  Oligomer
uuuuuuucaggucaacagg

SEQ ID NO: 10066 - RNA, 19 nt, artificial
  Oligomer
uucgcuuccauguaugauc

SEQ ID NO: 10067 - RNA, 19 nt, artificial
  Oligomer
uugauuguaaacuucaaca

SEQ ID NO: 10068 - RNA, 19 nt, artificial
  Oligomer
uuuuacaacaaaaguguuc

SEQ ID NO: 10069 - RNA, 19 nt, artificial
  Oligomer
uuucccugagguuugcugc

SEQ ID NO: 10070 - RNA, 19 nt, artificial
  Oligomer
aauuuauucacauuaccug

SEQ ID NO: 10071 - RNA, 19 nt, artificial
  Oligomer
uucauauuucaaguuucug

SEQ ID NO: 10072 - RNA, 19 nt, artificial
  Oligomer
uauugcuuuccuuauauuc

SEQ ID NO: 10073 - RNA, 19 nt, artificial
  Oligomer
ugaaaugucauacugacag

SEQ ID NO: 10074 - RNA, 19 nt, artificial
  Oligomer
ucugauuugcuucacuuuc

SEQ ID NO: 10075 - RNA, 19 nt, artificial
  Oligomer
uagcucuucagauauauug

SEQ ID NO: 10076 - RNA, 19 nt, artificial
  Oligomer
uuugauuguaaacuucaac

SEQ ID NO: 10077 - RNA, 19 nt, artificial
  Oligomer
ugaguuuucaguguucucc

SEQ ID NO: 10078 - RNA, 19 nt, artificial
  Oligomer
uucuuucucaauauuaaac

SEQ ID NO: 10079 - RNA, 19 nt, artificial
  Oligomer
uauuccuucuucaccaugg

SEQ ID NO: 10080 - RNA, 19 nt, artificial
  Oligomer
uuauaacuguuguccaggg

SEQ ID NO: 10081 - RNA, 19 nt, artificial
  Oligomer
ugcaguuaagucauccgug

SEQ ID NO: 10082 - RNA, 19 nt, artificial
  Oligomer
uuauauaauagcucuucag

SEQ ID NO: 10083 - RNA, 19 nt, artificial
  Oligomer
uuauuccuucuucaccaug

SEQ ID NO: 10084 - RNA, 19 nt, artificial
  Oligomer
uuuuuuacaacaaaagugu

SEQ ID NO: 10085 - RNA, 19 nt, artificial
  Oligomer
uucuauuugauggaaggag

SEQ ID NO: 10086 - RNA, 19 nt, artificial
  Oligomer
uguuguccagggauauucc

SEQ ID NO: 10087 - RNA, 19 nt, artificial
  Oligomer
aguacuaugauuuuuauug

SEQ ID NO: 10088 - RNA, 19 nt, artificial
  Oligomer
uaaaaaugcaguuaaguca

SEQ ID NO: 10089 - RNA, 19 nt, artificial
  Oligomer
uuucugauuugcuucacuu

SEQ ID NO: 10090 - RNA, 19 nt, artificial
  Oligomer
aucaacaccacugucuguc

SEQ ID NO: 10091 - RNA, 19 nt, artificial
  Oligomer
uugccucucauaaugacug

SEQ ID NO: 10092 - RNA, 19 nt, artificial
  Oligomer
uugagcaacaagaaaucuc

SEQ ID NO: 10093 - RNA, 19 nt, artificial
  Oligomer
uuuucaggucaacaggucc

SEQ ID NO: 10094 - RNA, 19 nt, artificial
  Oligomer
uucuucacguguaagauca

SEQ ID NO: 10095 - RNA, 19 nt, artificial
  Oligomer
uauuauacauaaacccauc

SEQ ID NO: 10096 - RNA, 19 nt, artificial
  Oligomer
uuuagugauaaaaauagag

SEQ ID NO: 10097 - RNA, 19 nt, artificial
  Oligomer
uuuacaaaaguuacagguc

SEQ ID NO: 10098 - RNA, 19 nt, artificial
  Oligomer
uuuaauggauuuugaaucc

SEQ ID NO: 10099 - RNA, 19 nt, artificial
  Oligomer
uuuucaguguucuccaugg

SEQ ID NO: 10100 - RNA, 19 nt, artificial
  Oligomer
uugaccaugcccacagaug

SEQ ID NO: 10101 - RNA, 19 nt, artificial
  Oligomer
uuccaaaaauuauuccuuc

SEQ ID NO: 10102 - RNA, 19 nt, artificial
  Oligomer
uuguuccaaaaauuauucc

SEQ ID NO: 10103 - RNA, 19 nt, artificial
  Oligomer
aaauauaccaucuucucac

SEQ ID NO: 10104 - RNA, 19 nt, artificial
  Oligomer
uuaaaagucaaguuaguuu

SEQ ID NO: 10105 - RNA, 19 nt, artificial
  Oligomer
uaugcauacaagaagucgg

SEQ ID NO: 10106 - RNA, 19 nt, artificial
  Oligomer
uucuuccacaucaucauuu

SEQ ID NO: 10107 - RNA, 19 nt, artificial
  Oligomer
uacuuaagaauuuugcuac

SEQ ID NO: 10108 - RNA, 19 nt, artificial
  Oligomer
uacuauuuuccuuugauug

SEQ ID NO: 10109 - RNA, 19 nt, artificial
  Oligomer
ucuuuagugauaaaaauag

SEQ ID NO: 10110 - RNA, 19 nt, artificial
  Oligomer
uuauauuccacuguuuauu

SEQ ID NO: 10111 - RNA, 19 nt, artificial
  Oligomer
ucauagcacagcaucacug

SEQ ID NO: 10112 - RNA, 19 nt, artificial
  Oligomer
ucaacugauaugcauaggg

SEQ ID NO: 10113 - RNA, 19 nt, artificial
  Oligomer
uguauuuucauauguuccu

SEQ ID NO: 10114 - RNA, 19 nt, artificial
  Oligomer
augaauguuaaguuuuagc

SEQ ID NO: 10115 - RNA, 19 nt, artificial
  Oligomer
uuuagaacauuuccacuuc

SEQ ID NO: 10116 - RNA, 19 nt, artificial
  Oligomer
uuaaguuuuagccuuaaaa

SEQ ID NO: 10117 - RNA, 19 nt, artificial
  Oligomer
ucuucagauauauugcugg

SEQ ID NO: 10118 - RNA, 19 nt, artificial
  Oligomer
auuuuuuucaggucaacag

SEQ ID NO: 10119 - RNA, 19 nt, artificial
  Oligomer
uuuucauauguuccuauag

SEQ ID NO: 10120 - RNA, 19 nt, artificial
  Oligomer
uccuaauuuaauucaauug

SEQ ID NO: 10121 - RNA, 19 nt, artificial
  Oligomer
uuuaugcugguagauccag

SEQ ID NO: 10122 - RNA, 19 nt, artificial
  Oligomer
uuuguuauuuuuuucaggu

SEQ ID NO: 10123 - RNA, 19 nt, artificial
  Oligomer
uuuugcugugaucuucuuu

SEQ ID NO: 10124 - RNA, 19 nt, artificial
  Oligomer
uuucuucacguguaagauc

SEQ ID NO: 10125 - RNA, 19 nt, artificial
  Oligomer
uuuugcuacaaagaguacu

SEQ ID NO: 10126 - RNA, 19 nt, artificial
  Oligomer
uccauuuuuauuuauuccu

SEQ ID NO: 10127 - RNA, 19 nt, artificial
  Oligomer
aucaauuccacaauuucuu

SEQ ID NO: 10128 - RNA, 19 nt, artificial
  Oligomer
uuuccaguuagacuucuac

SEQ ID NO: 10129 - RNA, 19 nt, artificial
  Oligomer
aaauuauuccuucuucacc

SEQ ID NO: 10130 - RNA, 19 nt, artificial
  Oligomer
uugagguagcuucauagug

SEQ ID NO: 10131 - RNA, 19 nt, artificial
  Oligomer
auuugcuucacuuucuuac

SEQ ID NO: 10132 - RNA, 19 nt, artificial
  Oligomer
aauuauuauacauaaaccc

SEQ ID NO: 10133 - RNA, 19 nt, artificial
  Oligomer
uuacaaaaguuacaggucu

SEQ ID NO: 10134 - RNA, 19 nt, artificial
  Oligomer
uucaaguuucugaauguuu

SEQ ID NO: 10135 - RNA, 19 nt, artificial
  Oligomer
uuuccuuugauuguaaacu

SEQ ID NO: 10136 - RNA, 19 nt, artificial
  Oligomer
uaugcugguagauccaggg

SEQ ID NO: 10137 - RNA, 19 nt, artificial
  Oligomer
augauuuuuauugccucac

SEQ ID NO: 10138 - RNA, 19 nt, artificial
  Oligomer
uaaaagucaaguuaguuug

SEQ ID NO: 10139 - RNA, 19 nt, artificial
  Oligomer
ucaaguuacaggcagcuca

SEQ ID NO: 10140 - RNA, 19 nt, artificial
  Oligomer
uuuauugccucaccaccuu

SEQ ID NO: 10141 - RNA, 19 nt, artificial
  Oligomer
uuuauauaauagcucuuca

SEQ ID NO: 10142 - RNA, 19 nt, artificial
  Oligomer
uuugcugugaucuucuuua

SEQ ID NO: 10143 - RNA, 19 nt, artificial
  Oligomer
uauaccaucuucucacuug

SEQ ID NO: 10144 - RNA, 19 nt, artificial
  Oligomer
uucauuuauugcuuuccuu

SEQ ID NO: 10145 - RNA, 19 nt, artificial
  Oligomer
uaaaauaaagguuugagcc

SEQ ID NO: 10146 - RNA, 19 nt, artificial
  Oligomer
auaauaaccaggugcugug

SEQ ID NO: 10147 - RNA, 19 nt, artificial
  Oligomer
uuuuugagcaacaagaaau

SEQ ID NO: 10148 - RNA, 19 nt, artificial
  Oligomer
uuccacaucaucauuucua

SEQ ID NO: 10149 - RNA, 19 nt, artificial
  Oligomer
uacuaugauuuuuauugcc

SEQ ID NO: 10150 - RNA, 19 nt, artificial
  Oligomer
auucaauugcaacuaccug

SEQ ID NO: 10151 - RNA, 19 nt, artificial
  Oligomer
uucaauguuuaacuuuuuc

SEQ ID NO: 10152 - RNA, 19 nt, artificial
  Oligomer
uugaaaauucauagcacag

SEQ ID NO: 10153 - RNA, 19 nt, artificial
  Oligomer
uuggguuuuccaguuagac

SEQ ID NO: 10154 - RNA, 19 nt, artificial
  Oligomer
uuucuuucaguaaacagua

SEQ ID NO: 10155 - RNA, 19 nt, artificial
  Oligomer
ucauuuauugcuuuccuua

SEQ ID NO: 10156 - RNA, 19 nt, artificial
  Oligomer
uucuacaaccgccucacaa

SEQ ID NO: 10157 - RNA, 19 nt, artificial
  Oligomer
auuuuuauugccucaccac

SEQ ID NO: 10158 - RNA, 19 nt, artificial
  Oligomer
ucuuaaaguacccucugca

SEQ ID NO: 10159 - RNA, 19 nt, artificial
  Oligomer
uuucuuugcaugaaaagua

SEQ ID NO: 10160 - RNA, 19 nt, artificial
  Oligomer
auuauuauacauaaaccca

SEQ ID NO: 10161 - RNA, 19 nt, artificial
  Oligomer
ucauauuucaaguuucuga

SEQ ID NO: 10162 - RNA, 19 nt, artificial
  Oligomer
uauuaacuucuacaaccgc

SEQ ID NO: 10163 - RNA, 19 nt, artificial
  Oligomer
aaugacugcaccaguaucc

SEQ ID NO: 10164 - RNA, 19 nt, artificial
  Oligomer
auauuuaugcugguagauc

SEQ ID NO: 10165 - RNA, 19 nt, artificial
  Oligomer
uucaggacaaacaucacaa

SEQ ID NO: 10166 - RNA, 19 nt, artificial
  Oligomer
uucauagcacagcaucacu

SEQ ID NO: 10167 - RNA, 19 nt, artificial
  Oligomer
auuacuucaauguuuaacu

SEQ ID NO: 10168 - RNA, 19 nt, artificial
  Oligomer
auuuaauucaauugcaacu

SEQ ID NO: 10169 - RNA, 19 nt, artificial
  Oligomer
cauuuuauaacuguugucc

SEQ ID NO: 10170 - RNA, 19 nt, artificial
  Oligomer
uuugaauccacugaguuuu

SEQ ID NO: 10171 - RNA, 19 nt, artificial
  Oligomer
uacaguuugacaaaacuag

SEQ ID NO: 10172 - RNA, 19 nt, artificial
  Oligomer
auccauuuuauaacuguug

SEQ ID NO: 10173 - RNA, 19 nt, artificial
  Oligomer
uugcuuuccuuauauucca

SEQ ID NO: 10174 - RNA, 19 nt, artificial
  Oligomer
aauacauggaaucuguuuc

SEQ ID NO: 10175 - RNA, 19 nt, artificial
  Oligomer
ucauggaacaggcugaguc

SEQ ID NO: 10176 - RNA, 19 nt, artificial
  Oligomer
auuuuauaacuguugucca

SEQ ID NO: 10177 - RNA, 19 nt, artificial
  Oligomer
aucuucuuuagaaacauca

SEQ ID NO: 10178 - RNA, 19 nt, artificial
  Oligomer
uuuuauuccugacuucaua

SEQ ID NO: 10179 - RNA, 19 nt, artificial
  Oligomer
uuccuauagaauuuauuca

SEQ ID NO: 10180 - RNA, 19 nt, artificial
  Oligomer
uccuauagaauuuauucac

SEQ ID NO: 10181 - RNA, 19 nt, artificial
  Oligomer
uguaacuugcuaaucauga

SEQ ID NO: 10182 - RNA, 19 nt, artificial
  Oligomer
auacaaacuaaaaaaaacc

SEQ ID NO: 10183 - RNA, 19 nt, artificial
  Oligomer
uucuccauggauaccuuua

SEQ ID NO: 10184 - RNA, 19 nt, artificial
  Oligomer
uacaacaaaaguguucagg

SEQ ID NO: 10185 - RNA, 19 nt, artificial
  Oligomer
uuguuauuuuuuucagguc

SEQ ID NO: 10186 - RNA, 19 nt, artificial
  Oligomer
auuaguuucuuucucaaua

SEQ ID NO: 10187 - RNA, 19 nt, artificial
  Oligomer
uuagugauaaaaauagagu

SEQ ID NO: 10188 - RNA, 19 nt, artificial
  Oligomer
ugguauaugaagcucaacu

SEQ ID NO: 10189 - RNA, 19 nt, artificial
  Oligomer
uuuuuauuccugacuucau

SEQ ID NO: 10190 - RNA, 19 nt, artificial
  Oligomer
uagugguucuauuugaugg

SEQ ID NO: 10191 - RNA, 19 nt, artificial
  Oligomer
aaugcaguuaagucauccg

SEQ ID NO: 10192 - RNA, 19 nt, artificial
  Oligomer
uuuaauucaauugcaacua

SEQ ID NO: 10193 - RNA, 19 nt, artificial
  Oligomer
uauuuacaaaaguuacagg

SEQ ID NO: 10194 - RNA, 19 nt, artificial
  Oligomer
ugauuuuuauugccucacc

SEQ ID NO: 10195 - RNA, 19 nt, artificial
  Oligomer
uauugcugguauaugaagc

SEQ ID NO: 10196 - RNA, 19 nt, artificial
  Oligomer
uccagaguccauugauucg

SEQ ID NO: 10197 - RNA, 19 nt, artificial
  Oligomer
uauacauaaacccaucuca

SEQ ID NO: 10198 - RNA, 19 nt, artificial
  Oligomer
uacaguaccaaauauacca

SEQ ID NO: 10199 - RNA, 19 nt, artificial
  Oligomer
uuccacuucacaaguuucu

SEQ ID NO: 10200 - RNA, 19 nt, artificial
  Oligomer
ugguauuuuaugacacgcc

SEQ ID NO: 10201 - RNA, 19 nt, artificial
  Oligomer
uuuauugcuuuccuuauau

SEQ ID NO: 10202 - RNA, 19 nt, artificial
  Oligomer
uuauugccucaccaccuuu

SEQ ID NO: 10203 - RNA, 19 nt, artificial
  Oligomer
auuuacaaaaguuacaggu

SEQ ID NO: 10204 - RNA, 19 nt, artificial
  Oligomer
ucuuucucaauauuaaaca

SEQ ID NO: 10205 - RNA, 19 nt, artificial
  Oligomer
uugcaugaaaaguagcguc

SEQ ID NO: 10206 - RNA, 19 nt, artificial
  Oligomer
uugcucacacuuucucuca

SEQ ID NO: 10207 - RNA, 19 nt, artificial
  Oligomer
auuacuugaaaauucauag

SEQ ID NO: 10208 - RNA, 19 nt, artificial
  Oligomer
uuuacaacaaaaguguuca

SEQ ID NO: 10209 - RNA, 19 nt, artificial
  Oligomer
ucagaagauauuuaugcug

SEQ ID NO: 10210 - RNA, 19 nt, artificial
  Oligomer
uaagucauccguguauauc

SEQ ID NO: 10211 - RNA, 19 nt, artificial
  Oligomer
aaguucuuccacaucauca

SEQ ID NO: 10212 - RNA, 19 nt, artificial
  Oligomer
ucaaguuucugaauguuuc

SEQ ID NO: 10213 - RNA, 19 nt, artificial
  Oligomer
aauuauuccuucuucacca

SEQ ID NO: 10214 - RNA, 19 nt, artificial
  Oligomer
uuccacaauuucuucacgu

SEQ ID NO: 10215 - RNA, 19 nt, artificial
  Oligomer
uauuucaaguuucugaaug

SEQ ID NO: 10216 - RNA, 19 nt, artificial
  Oligomer
uaagaaugugcauaaauuc

SEQ ID NO: 10217 - RNA, 19 nt, artificial
  Oligomer
uaaaaauagaguucuuuug

SEQ ID NO: 10218 - RNA, 19 nt, artificial
  Oligomer
uacauaaacccaucucagg

SEQ ID NO: 10219 - RNA, 19 nt, artificial
  Oligomer
uaagauaccauuacaugcu

SEQ ID NO: 10220 - RNA, 19 nt, artificial
  Oligomer
aagaucauuuuuauuccug

SEQ ID NO: 10221 - RNA, 19 nt, artificial
  Oligomer
ucauaggucuuuuucuuuc

SEQ ID NO: 10222 - RNA, 19 nt, artificial
  Oligomer
uauuuuuuucaggucaaca

SEQ ID NO: 10223 - RNA, 19 nt, artificial
  Oligomer
uuccaguuagacuucuaca

SEQ ID NO: 10224 - RNA, 19 nt, artificial
  Oligomer
uauauaauagcucuucaga

SEQ ID NO: 10225 - RNA, 19 nt, artificial
  Oligomer
ugaagcucaacugauaugc

SEQ ID NO: 10226 - RNA, 19 nt, artificial
  Oligomer
ucuacucucaaguuacagg

SEQ ID NO: 10227 - RNA, 19 nt, artificial
  Oligomer
ucugccuucauggaacagg

SEQ ID NO: 10228 - RNA, 19 nt, artificial
  Oligomer
uuucaggucaacaggucca

SEQ ID NO: 10229 - RNA, 19 nt, artificial
  Oligomer
auggauuuugaauccacug

SEQ ID NO: 10230 - RNA, 19 nt, artificial
  Oligomer
uuuuucaggucaacagguc

SEQ ID NO: 10231 - RNA, 19 nt, artificial
  Oligomer
ugcagcaugagaguagguc

SEQ ID NO: 10232 - RNA, 19 nt, artificial
  Oligomer
uaauucaauugcaacuacc

SEQ ID NO: 10233 - RNA, 19 nt, artificial
  Oligomer
ucuaaaauaaagguuugag

SEQ ID NO: 10234 - RNA, 19 nt, artificial
  Oligomer
augcaguuaagucauccgu

SEQ ID NO: 10235 - RNA, 19 nt, artificial
  Oligomer
acuaugauuuuuauugccu

SEQ ID NO: 10236 - RNA, 19 nt, artificial
  Oligomer
uucugauuugcuucacuuu

SEQ ID NO: 10237 - RNA, 19 nt, artificial
  Oligomer
uaugauuuuuauugccuca

SEQ ID NO: 10238 - RNA, 19 nt, artificial
  Oligomer
ucaauguuuaacuuuuuca

SEQ ID NO: 10239 - RNA, 19 nt, artificial
  Oligomer
aagauauuuaugcugguag

SEQ ID NO: 10240 - RNA, 19 nt, artificial
  Oligomer
aucaucaacaccacugucu

SEQ ID NO: 10241 - RNA, 19 nt, artificial
  Oligomer
ucaguaaacaguauaaaac

SEQ ID NO: 10242 - RNA, 19 nt, artificial
  Oligomer
uccuuuugcugugaucuuc

SEQ ID NO: 10243 - RNA, 19 nt, artificial
  Oligomer
uuugguuccaaauuuuuaa

SEQ ID NO: 10244 - RNA, 19 nt, artificial
  Oligomer
ugaauaaugaaaaguuugg

SEQ ID NO: 10245 - RNA, 19 nt, artificial
  Oligomer
uuagccuuaaaagucaagu

SEQ ID NO: 10246 - RNA, 19 nt, artificial
  Oligomer
uuuauuccugacuucauau

SEQ ID NO: 10247 - RNA, 19 nt, artificial
  Oligomer
uguccagggauauuccaga

SEQ ID NO: 10248 - RNA, 19 nt, artificial
  Oligomer
uaccauuacaugcuaugug

SEQ ID NO: 10249 - RNA, 19 nt, artificial
  Oligomer
auggauaccuuuauuaacu

SEQ ID NO: 10250 - RNA, 19 nt, artificial
  Oligomer
uccuaugugcucauagguc

SEQ ID NO: 10251 - RNA, 19 nt, artificial
  Oligomer
aacuuuuucacaauuacuu

SEQ ID NO: 10252 - RNA, 19 nt, artificial
  Oligomer
uaaguuuuagccuuaaaag

SEQ ID NO: 10253 - RNA, 19 nt, artificial
  Oligomer
acugucauugacaaaugcg

SEQ ID NO: 10254 - RNA, 19 nt, artificial
  Oligomer
uuguacaaaauugucacau

SEQ ID NO: 10255 - RNA, 19 nt, artificial
  Oligomer
auacauaaacccaucucag

SEQ ID NO: 10256 - RNA, 19 nt, artificial
  Oligomer
ucaauuccacaauuucuuc

SEQ ID NO: 10257 - RNA, 19 nt, artificial
  Oligomer
uuucauauguuccuauaga

SEQ ID NO: 10258 - RNA, 19 nt, artificial
  Oligomer
uggguuuuccaguuagacu

SEQ ID NO: 10259 - RNA, 19 nt, artificial
  Oligomer
cuguuguccagggauauuc

SEQ ID NO: 10260 - RNA, 19 nt, artificial
  Oligomer
auuuguacaaaauugucac

SEQ ID NO: 10261 - RNA, 19 nt, artificial
  Oligomer
acauacuuaagaauuuugc

SEQ ID NO: 10262 - RNA, 19 nt, artificial
  Oligomer
ugcguauggagaaaugggc

SEQ ID NO: 10263 - RNA, 19 nt, artificial
  Oligomer
uuuccuuauauuccacugu

SEQ ID NO: 10264 - RNA, 19 nt, artificial
  Oligomer
ucuagaguccuaugugcuc

SEQ ID NO: 10265 - RNA, 19 nt, artificial
  Oligomer
ucauaaugacugcaccagu

SEQ ID NO: 10266 - RNA, 19 nt, artificial
  Oligomer
uaauggauuuugaauccac

SEQ ID NO: 10267 - RNA, 19 nt, artificial
  Oligomer
uaguuugcucacacuuucu

SEQ ID NO: 10268 - RNA, 19 nt, artificial
  Oligomer
uuaacuuuuucacaauuac

SEQ ID NO: 10269 - RNA, 19 nt, artificial
  Oligomer
ugagguagcuucauagugg

SEQ ID NO: 10270 - RNA, 19 nt, artificial
  Oligomer
uuuuuucaggucaacaggu

SEQ ID NO: 10271 - RNA, 19 nt, artificial
  Oligomer
aaaaguuuggguuuuccag

SEQ ID NO: 10272 - RNA, 19 nt, artificial
  Oligomer
ugagcaacaagaaaucucc

SEQ ID NO: 10273 - RNA, 19 nt, artificial
  Oligomer
augaaaaguagcgucaaag

SEQ ID NO: 10274 - RNA, 19 nt, artificial
  Oligomer
uaaaguacccucugcagca

SEQ ID NO: 10275 - RNA, 19 nt, artificial
  Oligomer
ugaaaauucauagcacagc

SEQ ID NO: 10276 - RNA, 19 nt, artificial
  Oligomer
uauuuucauauguuccuau

SEQ ID NO: 10277 - RNA, 19 nt, artificial
  Oligomer
aggaaaaggacucaaauuc

SEQ ID NO: 10278 - RNA, 19 nt, artificial
  Oligomer
ucuaugaauguuaaguuuu

SEQ ID NO: 10279 - RNA, 19 nt, artificial
  Oligomer
uuugacaaaacuagaauac

SEQ ID NO: 10280 - RNA, 19 nt, artificial
  Oligomer
auggaaucuguuucuuugc

SEQ ID NO: 10281 - RNA, 19 nt, artificial
  Oligomer
uuacuugaaaauucauagc

SEQ ID NO: 10282 - RNA, 19 nt, artificial
  Oligomer
uucugaauguuucccugag

SEQ ID NO: 10283 - RNA, 19 nt, artificial
  Oligomer
auuugauggaaggaguaug

SEQ ID NO: 10284 - RNA, 19 nt, artificial
  Oligomer
uguuccaaaaauuauuccu

SEQ ID NO: 10285 - RNA, 19 nt, artificial
  Oligomer
accuuuagaacauuuccac

SEQ ID NO: 10286 - RNA, 19 nt, artificial
  Oligomer
ucaucaacaccacugucug

SEQ ID NO: 10287 - RNA, 19 nt, artificial
  Oligomer
uaagaauuuugcuacaaag

SEQ ID NO: 10288 - RNA, 19 nt, artificial
  Oligomer
aucauuuuuauuccugacu

SEQ ID NO: 10289 - RNA, 19 nt, artificial
  Oligomer
uguuauuuuuuucagguca

SEQ ID NO: 10290 - RNA, 19 nt, artificial
  Oligomer
uuugauggaaggaguaugu

SEQ ID NO: 10291 - RNA, 19 nt, artificial
  Oligomer
auccauuuuuauuuauucc

SEQ ID NO: 10292 - RNA, 19 nt, artificial
  Oligomer
aagaauaauaaccaggugc

SEQ ID NO: 10293 - RNA, 19 nt, artificial
  Oligomer
auuuuuauuccugacuuca

SEQ ID NO: 10294 - RNA, 19 nt, artificial
  Oligomer
accuuuauuaacuucuaca

SEQ ID NO: 10295 - RNA, 19 nt, artificial
  Oligomer
uuuugagcaacaagaaauc

SEQ ID NO: 10296 - RNA, 19 nt, artificial
  Oligomer
uaaguucuuccacaucauc

SEQ ID NO: 10297 - RNA, 19 nt, artificial
  Oligomer
uuuagccuuaaaagucaag

SEQ ID NO: 10298 - RNA, 19 nt, artificial
  Oligomer
uauaugaagcucaacugau

SEQ ID NO: 10299 - RNA, 19 nt, artificial
  Oligomer
acccaucucaggauaaucc

SEQ ID NO: 10300 - RNA, 19 nt, artificial
  Oligomer
aaaaaaaccaccaaccaac

SEQ ID NO: 10301 - RNA, 19 nt, artificial
  Oligomer
ugucauugacaaaugcgag

SEQ ID NO: 10302 - RNA, 19 nt, artificial
  Oligomer
uccaaauuuuuaauggauu

SEQ ID NO: 10303 - RNA, 19 nt, artificial
  Oligomer
uucauuacuucaauguuua

SEQ ID NO: 10304 - RNA, 19 nt, artificial
  Oligomer
ucaauugcaacuaccugac

SEQ ID NO: 10305 - RNA, 19 nt, artificial
  Oligomer
uaacuuuuucacaauuacu

SEQ ID NO: 10306 - RNA, 19 nt, artificial
  Oligomer
aacaucacgcaucaauucc

SEQ ID NO: 10307 - RNA, 19 nt, artificial
  Oligomer
ugaaaaguuuggguuuucc

SEQ ID NO: 10308 - RNA, 19 nt, artificial
  Oligomer
aaaugcaguuaagucaucc

SEQ ID NO: 10309 - RNA, 19 nt, artificial
  Oligomer
uuugcuacaaagaguacua

SEQ ID NO: 10310 - RNA, 19 nt, artificial
  Oligomer
cuucuuuagaaacaucacg

SEQ ID NO: 10311 - RNA, 19 nt, artificial
  Oligomer
auucauuuauugcuuuccu

SEQ ID NO: 10312 - RNA, 19 nt, artificial
  Oligomer
uuccuuauauuccacuguu

SEQ ID NO: 10313 - RNA, 19 nt, artificial
  Oligomer
aguuugcucacacuuucuc

SEQ ID NO: 10314 - RNA, 19 nt, artificial
  Oligomer
auaaauggucuaaaaaugc

SEQ ID NO: 10315 - RNA, 19 nt, artificial
  Oligomer
uuuugaauccacugaguuu

SEQ ID NO: 10316 - RNA, 19 nt, artificial
  Oligomer
aaauuaacaaucauugccu

SEQ ID NO: 10317 - RNA, 19 nt, artificial
  Oligomer
cuaugauuuuuauugccuc

SEQ ID NO: 10318 - RNA, 19 nt, artificial
  Oligomer
uucaacagaaaauaacaua

SEQ ID NO: 10319 - RNA, 19 nt, artificial
  Oligomer
uaauaaucaacaguuuggg

SEQ ID NO: 10320 - RNA, 19 nt, artificial
  Oligomer
ugagacuuggugcagugac

SEQ ID NO: 10321 - RNA, 19 nt, artificial
  Oligomer
uggaacaggcugagucaug

SEQ ID NO: 10322 - RNA, 19 nt, artificial
  Oligomer
uaccuuuauuaacuucuac

SEQ ID NO: 10323 - RNA, 19 nt, artificial
  Oligomer
uauugccucaccaccuuua

SEQ ID NO: 10324 - RNA, 19 nt, artificial
  Oligomer
uagaacauuuccacuucac

SEQ ID NO: 10325 - RNA, 19 nt, artificial
  Oligomer
ucaacagguccauuuguuc

SEQ ID NO: 10326 - RNA, 19 nt, artificial
  Oligomer
uagaauuuauucacauuac

SEQ ID NO: 10327 - RNA, 19 nt, artificial
  Oligomer
uuugcugcaucgacaucug

SEQ ID NO: 10328 - RNA, 19 nt, artificial
  Oligomer
aaucagaagauauuuaugc

SEQ ID NO: 10329 - RNA, 19 nt, artificial
  Oligomer
uucagauauauugcuggua

SEQ ID NO: 10330 - RNA, 19 nt, artificial
  Oligomer
auagugguucuauuugaug

SEQ ID NO: 10331 - RNA, 19 nt, artificial
  Oligomer
uuucucucacauaaaauau

SEQ ID NO: 10332 - RNA, 19 nt, artificial
  Oligomer
ucaucauuucuacaguuug

SEQ ID NO: 10333 - RNA, 19 nt, artificial
  Oligomer
aguccaguucuguaccacg

SEQ ID NO: 10334 - RNA, 19 nt, artificial
  Oligomer
uuugcaugaaaaguagcgu

SEQ ID NO: 10335 - RNA, 19 nt, artificial
  Oligomer
ugagguuugcugcaucgac

SEQ ID NO: 10336 - RNA, 19 nt, artificial
  Oligomer
uuaguuucuuucucaauau

SEQ ID NO: 10337 - RNA, 19 nt, artificial
  Oligomer
uuccaaauuuuuaauggau

SEQ ID NO: 10338 - RNA, 19 nt, artificial
  Oligomer
auacuuaagaauuuugcua

SEQ ID NO: 10339 - RNA, 19 nt, artificial
  Oligomer
augcauagggacaaaucag

SEQ ID NO: 10340 - RNA, 19 nt, artificial
  Oligomer
auuauacauaaacccaucu

SEQ ID NO: 10341 - RNA, 19 nt, artificial
  Oligomer
uauuaguuucuuucucaau

SEQ ID NO: 10342 - RNA, 19 nt, artificial
  Oligomer
auacaguaccaaauauacc

SEQ ID NO: 10343 - RNA, 19 nt, artificial
  Oligomer
ugcuacaaagaguacuaug

SEQ ID NO: 10344 - RNA, 19 nt, artificial
  Oligomer
uuuuccuuugauuguaaac

SEQ ID NO: 10345 - RNA, 19 nt, artificial
  Oligomer
aaggacucaaauucuguug

SEQ ID NO: 10346 - RNA, 19 nt, artificial
  Oligomer
uugcugguauaugaagcuc

SEQ ID NO: 10347 - RNA, 19 nt, artificial
  Oligomer
uaugaauguuaaguuuuag

SEQ ID NO: 10348 - RNA, 19 nt, artificial
  Oligomer
ugucuuaaaguacccucug

SEQ ID NO: 10349 - RNA, 19 nt, artificial
  Oligomer
uaaugacugcaccaguauc

SEQ ID NO: 10350 - RNA, 19 nt, artificial
  Oligomer
auucauagcacagcaucac

SEQ ID NO: 10351 - RNA, 19 nt, artificial
  Oligomer
uaccaaauauaccaucuuc

SEQ ID NO: 10352 - RNA, 19 nt, artificial
  Oligomer
ucauuuuuauuccugacuu

SEQ ID NO: 10353 - RNA, 19 nt, artificial
  Oligomer
acuuuuucacaauuacuug

SEQ ID NO: 10354 - RNA, 19 nt, artificial
  Oligomer
aauuuguacaaaauuguca

SEQ ID NO: 10355 - RNA, 19 nt, artificial
  Oligomer
ucacaaaaccauaauccca

SEQ ID NO: 10356 - RNA, 19 nt, artificial
  Oligomer
uaagaaaaaagaaacuguc

SEQ ID NO: 10357 - RNA, 19 nt, artificial
  Oligomer
auaaugaaaaguuuggguu

SEQ ID NO: 10358 - RNA, 19 nt, artificial
  Oligomer
uugauggaaggaguauguc

SEQ ID NO: 10359 - RNA, 19 nt, artificial
  Oligomer
cuguuuauuauuuaaguug

SEQ ID NO: 10360 - RNA, 19 nt, artificial
  Oligomer
uuuccacuucacaaguuuc

SEQ ID NO: 10361 - RNA, 19 nt, artificial
  Oligomer
aauugcaacuaccugacug

SEQ ID NO: 10362 - RNA, 19 nt, artificial
  Oligomer
aauagcacccauccgcuag

SEQ ID NO: 10363 - RNA, 19 nt, artificial
  Oligomer
auaccaucuucucacuugg

SEQ ID NO: 10364 - RNA, 19 nt, artificial
  Oligomer
ucuuuuucuuucaguaaac

SEQ ID NO: 10365 - RNA, 19 nt, artificial
  Oligomer
aucauuucuacaguuugac

SEQ ID NO: 10366 - RNA, 19 nt, artificial
  Oligomer
auaauccauuuuauaacug

SEQ ID NO: 10367 - RNA, 19 nt, artificial
  Oligomer
auugcaacuaccugacugg

SEQ ID NO: 10368 - RNA, 19 nt, artificial
  Oligomer
aacauuacuauuuuccuuu

SEQ ID NO: 10369 - RNA, 19 nt, artificial
  Oligomer
uucuuugcaugaaaaguag

SEQ ID NO: 10370 - RNA, 19 nt, artificial
  Oligomer
auaugcauagggacaaauc

SEQ ID NO: 10371 - RNA, 19 nt, artificial
  Oligomer
aaaaaagaaacugucauug

SEQ ID NO: 10372 - RNA, 19 nt, artificial
  Oligomer
uccauggauaccuuuauua

SEQ ID NO: 10373 - RNA, 19 nt, artificial
  Oligomer
aauuuaauucaauugcaac

SEQ ID NO: 10374 - RNA, 19 nt, artificial
  Oligomer
uuacuauuuuccuuugauu

SEQ ID NO: 10375 - RNA, 19 nt, artificial
  Oligomer
cuaaaaaugcaguuaaguc

SEQ ID NO: 10376 - RNA, 19 nt, artificial
  Oligomer
aucuacucucaaguuacag

SEQ ID NO: 10377 - RNA, 19 nt, artificial
  Oligomer
aauaauaaccaggugcugu

SEQ ID NO: 10378 - RNA, 19 nt, artificial
  Oligomer
aagguuugagccuuugacc

SEQ ID NO: 10379 - RNA, 19 nt, artificial
  Oligomer
aguuuuagccuuaaaaguc

SEQ ID NO: 10380 - RNA, 19 nt, artificial
  Oligomer
uucaguguucuccauggau

SEQ ID NO: 10381 - RNA, 19 nt, artificial
  Oligomer
gucaucaucaacaccacug

SEQ ID NO: 10382 - RNA, 19 nt, artificial
  Oligomer
aaaacugcuccuuuugcug

SEQ ID NO: 10383 - RNA, 19 nt, artificial
  Oligomer
aauauuaguuucuuucuca

SEQ ID NO: 10384 - RNA, 19 nt, artificial
  Oligomer
augucuuaaaguacccucu

SEQ ID NO: 10385 - RNA, 19 nt, artificial
  Oligomer
aguuaguuugcucacacuu

SEQ ID NO: 10386 - RNA, 19 nt, artificial
  Oligomer
cacaaaaccauaaucccag

SEQ ID NO: 10387 - RNA, 19 nt, artificial
  Oligomer
uuugugagcauggaaacaa

SEQ ID NO: 10388 - RNA, 19 nt, artificial
  Oligomer
uauaacuguuguccaggga

SEQ ID NO: 10389 - RNA, 19 nt, artificial
  Oligomer
uucaguaaacaguauaaaa

SEQ ID NO: 10390 - RNA, 19 nt, artificial
  Oligomer
auccacugaguuuucagug

SEQ ID NO: 10391 - RNA, 19 nt, artificial
  Oligomer
uuccuuugauuguaaacuu

SEQ ID NO: 10392 - RNA, 19 nt, artificial
  Oligomer
ucugaauguuucccugagg

SEQ ID NO: 10393 - RNA, 19 nt, artificial
  Oligomer
ucgacaucuguaccagacc

SEQ ID NO: 10394 - RNA, 19 nt, artificial
  Oligomer
aaaugucauacugacagcc

SEQ ID NO: 10395 - RNA, 19 nt, artificial
  Oligomer
uaacuucuacaaccgccuc

SEQ ID NO: 10396 - RNA, 19 nt, artificial
  Oligomer
uccacuucacaaguuucug

SEQ ID NO: 10397 - RNA, 19 nt, artificial
  Oligomer
cuuuagaacauuuccacuu

SEQ ID NO: 10398 - RNA, 19 nt, artificial
  Oligomer
aacauacuuaagaauuuug

SEQ ID NO: 10399 - RNA, 19 nt, artificial
  Oligomer
uuucugaauguuucccuga

SEQ ID NO: 10400 - RNA, 19 nt, artificial
  Oligomer
uguauuuacaaaaguuaca

SEQ ID NO: 10401 - RNA, 19 nt, artificial
  Oligomer
uacuugaaaauucauagca

SEQ ID NO: 10402 - RNA, 19 nt, artificial
  Oligomer
ugcugguauaugaagcuca

SEQ ID NO: 10403 - RNA, 19 nt, artificial
  Oligomer
aucgacaucuguaccagac

SEQ ID NO: 10404 - RNA, 19 nt, artificial
  Oligomer
uucacaaguuucugauuug

SEQ ID NO: 10405 - RNA, 19 nt, artificial
  Oligomer
uuugcuucacuuucuuacu

SEQ ID NO: 10406 - RNA, 19 nt, artificial
  Oligomer
ucucauaaugacugcacca

SEQ ID NO: 10407 - RNA, 19 nt, artificial
  Oligomer
uuugagccuuugaccaugc

SEQ ID NO: 10408 - RNA, 19 nt, artificial
  Oligomer
aaguuucugaauguuuccc

SEQ ID NO: 10409 - RNA, 19 nt, artificial
  Oligomer
aucauugccucucauaaug

SEQ ID NO: 10410 - RNA, 19 nt, artificial
  Oligomer
uggauuuugaauccacuga

SEQ ID NO: 10411 - RNA, 19 nt, artificial
  Oligomer
aguuucugaauguuucccu

SEQ ID NO: 10412 - RNA, 19 nt, artificial
  Oligomer
ucuuucaguaaacaguaua

SEQ ID NO: 10413 - RNA, 19 nt, artificial
  Oligomer
ucauccguguauaucaauu

SEQ ID NO: 10414 - RNA, 19 nt, artificial
  Oligomer
ucaacagaaaauaacauac

SEQ ID NO: 10415 - RNA, 19 nt, artificial
  Oligomer
uucauauguuccuauagaa

SEQ ID NO: 10416 - RNA, 19 nt, artificial
  Oligomer
ucauuuuuugagcaacaag

SEQ ID NO: 10417 - RNA, 19 nt, artificial
  Oligomer
agcaacaagaaaucucccg

SEQ ID NO: 10418 - RNA, 19 nt, artificial
  Oligomer
auauaauagcucuucagau

SEQ ID NO: 10419 - RNA, 19 nt, artificial
  Oligomer
ugcauagggacaaaucaga

SEQ ID NO: 10420 - RNA, 19 nt, artificial
  Oligomer
aaauauuaguuucuuucuc

SEQ ID NO: 10421 - RNA, 19 nt, artificial
  Oligomer
uauaauagcucuucagaua

SEQ ID NO: 10422 - RNA, 19 nt, artificial
  Oligomer
auaacuguuguccagggau

SEQ ID NO: 10423 - RNA, 19 nt, artificial
  Oligomer
uccauuuguuccaaaaauu

SEQ ID NO: 10424 - RNA, 19 nt, artificial
  Oligomer
auacaagaagucggccucc

SEQ ID NO: 10425 - RNA, 19 nt, artificial
  Oligomer
uccguguauaucaauucua

SEQ ID NO: 10426 - RNA, 19 nt, artificial
  Oligomer
accaaauauaccaucuucu

SEQ ID NO: 10427 - RNA, 19 nt, artificial
  Oligomer
auauauugcugguauauga

SEQ ID NO: 10428 - RNA, 19 nt, artificial
  Oligomer
ucacaauagcacccauccg

SEQ ID NO: 10429 - RNA, 19 nt, artificial
  Oligomer
uuucgguuaacccggguaa

SEQ ID NO: 10430 - RNA, 19 nt, artificial
  Oligomer
uuuuucacaauuacuugaa

SEQ ID NO: 10431 - RNA, 19 nt, artificial
  Oligomer
aauguuucccugagguuug

SEQ ID NO: 10432 - RNA, 19 nt, artificial
  Oligomer
agugcuuuuaugaaaauuc

SEQ ID NO: 10433 - RNA, 19 nt, artificial
  Oligomer
ugagucaugucucugcuca

SEQ ID NO: 10434 - RNA, 19 nt, artificial
  Oligomer
uuaauggauuuugaaucca

SEQ ID NO: 10435 - RNA, 19 nt, artificial
  Oligomer
uuagaaacaucacgcauca

SEQ ID NO: 10436 - RNA, 19 nt, artificial
  Oligomer
uguuucuuugcaugaaaag

SEQ ID NO: 10437 - RNA, 19 nt, artificial
  Oligomer
uacaaacuaaaaaaaacca

SEQ ID NO: 10438 - RNA, 19 nt, artificial
  Oligomer
ucucacauaaaauauuagu

SEQ ID NO: 10439 - RNA, 19 nt, artificial
  Oligomer
cuugucggcauacuguuuc

SEQ ID NO: 10440 - RNA, 19 nt, artificial
  Oligomer
uucaagcuugucggcauac

SEQ ID NO: 10441 - RNA, 19 nt, artificial
  Oligomer
auguaugaucuuugguucc

SEQ ID NO: 10442 - RNA, 19 nt, artificial
  Oligomer
auacauggaaucuguuucu

SEQ ID NO: 10443 - RNA, 19 nt, artificial
  Oligomer
uaauccauuuuauaacugu

SEQ ID NO: 10444 - RNA, 19 nt, artificial
  Oligomer
ugcuucacuuucuuacuug

SEQ ID NO: 10445 - RNA, 19 nt, artificial
  Oligomer
uccagggauauuccagagu

SEQ ID NO: 10446 - RNA, 19 nt, artificial
  Oligomer
aucacaaaaccauaauccc

SEQ ID NO: 10447 - RNA, 19 nt, artificial
  Oligomer
ucuuugguuccaaauuuuu

SEQ ID NO: 10448 - RNA, 19 nt, artificial
  Oligomer
uuauuuuuuucaggucaac

SEQ ID NO: 10449 - RNA, 19 nt, artificial
  Oligomer
aaaauugucacauagaaac

SEQ ID NO: 10450 - RNA, 19 nt, artificial
  Oligomer
auuguagcaccuuacaguu

SEQ ID NO: 10451 - RNA, 19 nt, artificial
  Oligomer
uuccauguaugaucuuugg

SEQ ID NO: 10452 - RNA, 19 nt, artificial
  Oligomer
uuagaacauuuccacuuca

SEQ ID NO: 10453 - RNA, 19 nt, artificial
  Oligomer
aacccggguaagaaugugc

SEQ ID NO: 10454 - RNA, 19 nt, artificial
  Oligomer
augugcauaaauucaagcu

SEQ ID NO: 10455 - RNA, 19 nt, artificial
  Oligomer
ugauucgcuuccauguaug

SEQ ID NO: 10456 - RNA, 19 nt, artificial
  Oligomer
auuaacaaucauugccucu

SEQ ID NO: 10457 - RNA, 19 nt, artificial
  Oligomer
guuuucaguguucuccaug

SEQ ID NO: 10458 - RNA, 19 nt, artificial
  Oligomer
ugauggaaggaguaugucu

SEQ ID NO: 10459 - RNA, 19 nt, artificial
  Oligomer
uaaguuguauuuucauaug

SEQ ID NO: 10460 - RNA, 19 nt, artificial
  Oligomer
uaugcauagggacaaauca

SEQ ID NO: 10461 - RNA, 19 nt, artificial
  Oligomer
cuuugcaugaaaaguagcg

SEQ ID NO: 10462 - RNA, 19 nt, artificial
  Oligomer
uucuacaguuugacaaaac

SEQ ID NO: 10463 - RNA, 19 nt, artificial
  Oligomer
ucaggcucaaaccaucuac

SEQ ID NO: 10464 - RNA, 19 nt, artificial
  Oligomer
ccuaauuuaauucaauugc

SEQ ID NO: 10465 - RNA, 19 nt, artificial
  Oligomer
aaaguuuggguuuuccagu

SEQ ID NO: 10466 - RNA, 19 nt, artificial
  Oligomer
uccuuugauuguaaacuuc

SEQ ID NO: 10467 - RNA, 19 nt, artificial
  Oligomer
uuaagaauuuugcuacaaa

SEQ ID NO: 10468 - RNA, 19 nt, artificial
  Oligomer
acaaagaguacuaugauuu

SEQ ID NO: 10469 - RNA, 19 nt, artificial
  Oligomer
aacauuuccacuucacaag

SEQ ID NO: 10470 - RNA, 19 nt, artificial
  Oligomer
ugugcauaaauucaagcuu

SEQ ID NO: 10471 - RNA, 19 nt, artificial
  Oligomer
aaauucauagcacagcauc

SEQ ID NO: 10472 - RNA, 19 nt, artificial
  Oligomer
ugcaucgacaucuguacca

SEQ ID NO: 10473 - RNA, 19 nt, artificial
  Oligomer
ucuauuugauggaaggagu

SEQ ID NO: 10474 - RNA, 19 nt, artificial
  Oligomer
auuuaugcugguagaucca

SEQ ID NO: 10475 - RNA, 19 nt, artificial
  Oligomer
ucuaaaaaugcaguuaagu

SEQ ID NO: 10476 - RNA, 19 nt, artificial
  Oligomer
uuaauucaauugcaacuac

SEQ ID NO: 10477 - RNA, 19 nt, artificial
  Oligomer
acaaauuuguacaaaauug

SEQ ID NO: 10478 - RNA, 19 nt, artificial
  Oligomer
uccaaaaauuauuccuucu

SEQ ID NO: 10479 - RNA, 19 nt, artificial
  Oligomer
cuaaaauaaagguuugagc

SEQ ID NO: 10480 - RNA, 19 nt, artificial
  Oligomer
guuugcucacacuuucucu

SEQ ID NO: 10481 - RNA, 19 nt, artificial
  Oligomer
uaauaaccaggugcugugg

SEQ ID NO: 10482 - RNA, 19 nt, artificial
  Oligomer
ucuuuugugagcauggaaa

SEQ ID NO: 10483 - RNA, 19 nt, artificial
  Oligomer
auggaaaauaacaaauuug

SEQ ID NO: 10484 - RNA, 19 nt, artificial
  Oligomer
aaacaauacauggaaucug

SEQ ID NO: 10485 - RNA, 19 nt, artificial
  Oligomer
auucauuacuucaauguuu

SEQ ID NO: 10486 - RNA, 19 nt, artificial
  Oligomer
uugaauccacugaguuuuc

SEQ ID NO: 10487 - RNA, 19 nt, artificial
  Oligomer
augcauacaagaagucggc

SEQ ID NO: 10488 - RNA, 19 nt, artificial
  Oligomer
uucuuuugugagcauggaa

SEQ ID NO: 10489 - RNA, 19 nt, artificial
  Oligomer
uccauuuuauaacuguugu

SEQ ID NO: 10490 - RNA, 19 nt, artificial
  Oligomer
uagcacagcaucacuguaa

SEQ ID NO: 10491 - RNA, 19 nt, artificial
  Oligomer
augagaguaggucaaaaug

SEQ ID NO: 10492 - RNA, 19 nt, artificial
  Oligomer
uacaagaagucggccucca

SEQ ID NO: 10493 - RNA, 19 nt, artificial
  Oligomer
uucucucacauaaaauauu

SEQ ID NO: 10494 - RNA, 19 nt, artificial
  Oligomer
uacuucaauguuuaacuuu

SEQ ID NO: 10495 - RNA, 19 nt, artificial
  Oligomer
aacuucuacaaccgccuca

SEQ ID NO: 10496 - RNA, 19 nt, artificial
  Oligomer
ugcugcaucgacaucugua

SEQ ID NO: 10497 - RNA, 19 nt, artificial
  Oligomer
uccacugguauuuuaugac

SEQ ID NO: 10498 - RNA, 19 nt, artificial
  Oligomer
aauuccacaauuucuucac

SEQ ID NO: 10499 - RNA, 19 nt, artificial
  Oligomer
aagcuguaaauuaacaauc

SEQ ID NO: 10500 - RNA, 19 nt, artificial
  Oligomer
cuaaaaaaaaccaccaacc

SEQ ID NO: 10501 - RNA, 19 nt, artificial
  Oligomer
guuugcugcaucgacaucu

SEQ ID NO: 10502 - RNA, 19 nt, artificial
  Oligomer
acaaaacugcuccuuuugc

SEQ ID NO: 10503 - RNA, 19 nt, artificial
  Oligomer
auugccucucauaaugacu

SEQ ID NO: 10504 - RNA, 19 nt, artificial
  Oligomer
uuccagugcuuuuaugaaa

SEQ ID NO: 10505 - RNA, 19 nt, artificial
  Oligomer
uaccagaccgagaugucau

SEQ ID NO: 10506 - RNA, 19 nt, artificial
  Oligomer
uuauuccugacuucauauu

SEQ ID NO: 10507 - RNA, 19 nt, artificial
  Oligomer
ucuucuuuagaaacaucac

SEQ ID NO: 10508 - RNA, 19 nt, artificial
  Oligomer
uuuggguuuuccaguuaga

SEQ ID NO: 10509 - RNA, 19 nt, artificial
  Oligomer
ugccucaccaccuuuagaa

SEQ ID NO: 10510 - RNA, 19 nt, artificial
  Oligomer
auauuaguuucuuucucaa

SEQ ID NO: 10511 - RNA, 19 nt, artificial
  Oligomer
uaaucccagauaaaugguc

SEQ ID NO: 10512 - RNA, 19 nt, artificial
  Oligomer
ucaauucuaaaauaaaggu

SEQ ID NO: 10513 - RNA, 19 nt, artificial
  Oligomer
uacaaccgccucacaauag

SEQ ID NO: 10514 - RNA, 19 nt, artificial
  Oligomer
uauuccacuguuuauuauu

SEQ ID NO: 10515 - RNA, 19 nt, artificial
  Oligomer
acaggcugagucaugucuc

SEQ ID NO: 10516 - RNA, 19 nt, artificial
  Oligomer
uaugaagcucaacugauau

SEQ ID NO: 10517 - RNA, 19 nt, artificial
  Oligomer
cuugcuggauccaccacaa

SEQ ID NO: 10518 - RNA, 19 nt, artificial
  Oligomer
ccgaggugcucaagaacua

SEQ ID NO: 10519 - RNA, 19 nt, artificial
  Oligomer
ggauccaccacaaguacaa

SEQ ID NO: 10520 - RNA, 19 nt, artificial
  Oligomer
cagcugacauggaaauaca

SEQ ID NO: 10521 - RNA, 19 nt, artificial
  Oligomer
cagacuccaaguauuacaa

SEQ ID NO: 10522 - RNA, 19 nt, artificial
  Oligomer
gcuggauccaccacaagua

SEQ ID NO: 10523 - RNA, 19 nt, artificial
  Oligomer
ccgucuucgacaaccugau

SEQ ID NO: 10524 - RNA, 19 nt, artificial
  Oligomer
cagaggacuacacgcucaa

SEQ ID NO: 10525 - RNA, 19 nt, artificial
  Oligomer
acaaccugaugcagcagaa

SEQ ID NO: 10526 - RNA, 19 nt, artificial
  Oligomer
accugaaugucacccgcaa

SEQ ID NO: 10527 - RNA, 19 nt, artificial
  Oligomer
agaagcugguggaccagaa

SEQ ID NO: 10528 - RNA, 19 nt, artificial
  Oligomer
ccagcaccuacgugaagaa

SEQ ID NO: 10529 - RNA, 19 nt, artificial
  Oligomer
ggcacagacuccaaguauu

SEQ ID NO: 10530 - RNA, 19 nt, artificial
  Oligomer
acugaagcugggaggcaaa

SEQ ID NO: 10531 - RNA, 19 nt, artificial
  Oligomer
agaacuacauggacgccca

SEQ ID NO: 10532 - RNA, 19 nt, artificial
  Oligomer
uguuugaccgugacaacaa

SEQ ID NO: 10533 - RNA, 19 nt, artificial
  Oligomer
gcacagacuccaaguauua

SEQ ID NO: 10534 - RNA, 19 nt, artificial
  Oligomer
acauggacgcccaguacua

SEQ ID NO: 10535 - RNA, 19 nt, artificial
  Oligomer
ccucguuugacauccacua

SEQ ID NO: 10536 - RNA, 19 nt, artificial
  Oligomer
ucuguuucgugcauuggaa

SEQ ID NO: 10537 - RNA, 19 nt, artificial
  Oligomer
guuugaccgugacaacaac

SEQ ID NO: 10538 - RNA, 19 nt, artificial
  Oligomer
ucgacaaccugaugcagca

SEQ ID NO: 10539 - RNA, 19 nt, artificial
  Oligomer
gguucucuguccuaccuga

SEQ ID NO: 10540 - RNA, 19 nt, artificial
  Oligomer
aaugguaccucguuugaca

SEQ ID NO: 10541 - RNA, 19 nt, artificial
  Oligomer
aguccagcaccuacgugaa

SEQ ID NO: 10542 - RNA, 19 nt, artificial
  Oligomer
agaacaucuucuccuucua

SEQ ID NO: 10543 - RNA, 19 nt, artificial
  Oligomer
aggugcucaagaacuacau

SEQ ID NO: 10544 - RNA, 19 nt, artificial
  Oligomer
ugagcuggaaggagugaga

SEQ ID NO: 10545 - RNA, 19 nt, artificial
  Oligomer
gcuucacagucgucuucga

SEQ ID NO: 10546 - RNA, 19 nt, artificial
  Oligomer
gcuucaugggcauggacau

SEQ ID NO: 10547 - RNA, 19 nt, artificial
  Oligomer
guguuugaccgugacaaca

SEQ ID NO: 10548 - RNA, 19 nt, artificial
  Oligomer
ugcucaagaacuacaugga

SEQ ID NO: 10549 - RNA, 19 nt, artificial
  Oligomer
gaggugcucaagaacuaca

SEQ ID NO: 10550 - RNA, 19 nt, artificial
  Oligomer
gaggcaaaggcuacaagcu

SEQ ID NO: 10551 - RNA, 19 nt, artificial
  Oligomer
gugucaaaguggagaggca

SEQ ID NO: 10552 - RNA, 19 nt, artificial
  Oligomer
uucccgaggugcucaagaa

SEQ ID NO: 10553 - RNA, 19 nt, artificial
  Oligomer
gcaucuccgucaacaacgu

SEQ ID NO: 10554 - RNA, 19 nt, artificial
  Oligomer
aggacuacacgcucaaggu

SEQ ID NO: 10555 - RNA, 19 nt, artificial
  Oligomer
acauggaaauacaguuguu

SEQ ID NO: 10556 - RNA, 19 nt, artificial
  Oligomer
ggacaaaacccaccuuguu

SEQ ID NO: 10557 - RNA, 19 nt, artificial
  Oligomer
ggcaaaggcuacaagcugu

SEQ ID NO: 10558 - RNA, 19 nt, artificial
  Oligomer
ugcacaaguucacguccau

SEQ ID NO: 10559 - RNA, 19 nt, artificial
  Oligomer
cgacuugcuguuuuguucu

SEQ ID NO: 10560 - RNA, 19 nt, artificial
  Oligomer
gcugauccagagcacagau

SEQ ID NO: 10561 - RNA, 19 nt, artificial
  Oligomer
cucuguggaggaccugauu

SEQ ID NO: 10562 - RNA, 19 nt, artificial
  Oligomer
cgaggugcucaagaacuac

SEQ ID NO: 10563 - RNA, 19 nt, artificial
  Oligomer
acuacauggacgcccagua

SEQ ID NO: 10564 - RNA, 19 nt, artificial
  Oligomer
agcugauccagagcacaga

SEQ ID NO: 10565 - RNA, 19 nt, artificial
  Oligomer
agcugguggaccagaacau

SEQ ID NO: 10566 - RNA, 19 nt, artificial
  Oligomer
guaccucguuugacaucca

SEQ ID NO: 10567 - RNA, 19 nt, artificial
  Oligomer
guucucuguccuaccugaa

SEQ ID NO: 10568 - RNA, 19 nt, artificial
  Oligomer
gcuguuuuguucugugguu

SEQ ID NO: 10569 - RNA, 19 nt, artificial
  Oligomer
acaaguacaacagcgacaa

SEQ ID NO: 10570 - RNA, 19 nt, artificial
  Oligomer
acugcaaacugcuggacau

SEQ ID NO: 10571 - RNA, 19 nt, artificial
  Oligomer
cccgacuugcuguuuuguu

SEQ ID NO: 10572 - RNA, 19 nt, artificial
  Oligomer
cacagaucuguuucgugca

SEQ ID NO: 10573 - RNA, 19 nt, artificial
  Oligomer
ugauucagggcgaguacau

SEQ ID NO: 10574 - RNA, 19 nt, artificial
  Oligomer
gaaacagaggagaguccca

SEQ ID NO: 10575 - RNA, 19 nt, artificial
  Oligomer
caaguacaacagcgacaag

SEQ ID NO: 10576 - RNA, 19 nt, artificial
  Oligomer
cuguccuaccugaauguca

SEQ ID NO: 10577 - RNA, 19 nt, artificial
  Oligomer
ugggaggcaaaggcuacaa

SEQ ID NO: 10578 - RNA, 19 nt, artificial
  Oligomer
ugguggaccagaacaucuu

SEQ ID NO: 10579 - RNA, 19 nt, artificial
  Oligomer
gggacaaaacccaccuugu

SEQ ID NO: 10580 - RNA, 19 nt, artificial
  Oligomer
gaagaaugguaccucguuu

SEQ ID NO: 10581 - RNA, 19 nt, artificial
  Oligomer
cccagcugacauggaaaua

SEQ ID NO: 10582 - RNA, 19 nt, artificial
  Oligomer
ccagcacagaaacagagga

SEQ ID NO: 10583 - RNA, 19 nt, artificial
  Oligomer
ugaggaugagcuggaagga

SEQ ID NO: 10584 - RNA, 19 nt, artificial
  Oligomer
ccucccuggguucagaaau

SEQ ID NO: 10585 - RNA, 19 nt, artificial
  Oligomer
gcucaagaacuacauggac

SEQ ID NO: 10586 - RNA, 19 nt, artificial
  Oligomer
accagaacaucuucuccuu

SEQ ID NO: 10587 - RNA, 19 nt, artificial
  Oligomer
agagcugauccagagcaca

SEQ ID NO: 10588 - RNA, 19 nt, artificial
  Oligomer
cugauucagggcgaguaca

SEQ ID NO: 10589 - RNA, 19 nt, artificial
  Oligomer
cugcacaaguucacgucca

SEQ ID NO: 10590 - RNA, 19 nt, artificial
  Oligomer
aacagaggagagucccaga

SEQ ID NO: 10591 - RNA, 19 nt, artificial
  Oligomer
aggcaucaccuucaucgca

SEQ ID NO: 10592 - RNA, 19 nt, artificial
  Oligomer
cccuggguucagaaaugcu

SEQ ID NO: 10593 - RNA, 19 nt, artificial
  Oligomer
accugaugcagcagaagcu

SEQ ID NO: 10594 - RNA, 19 nt, artificial
  Oligomer
cgugaagaaugguaccucg

SEQ ID NO: 10595 - RNA, 19 nt, artificial
  Oligomer
aaguggagaggcaggucuu

SEQ ID NO: 10596 - RNA, 19 nt, artificial
  Oligomer
cacccuaccuguucagugu

SEQ ID NO: 10597 - RNA, 19 nt, artificial
  Oligomer
ccgucucaaaguacuccca

SEQ ID NO: 10598 - RNA, 19 nt, artificial
  Oligomer
acagacuccaaguauuaca

SEQ ID NO: 10599 - RNA, 19 nt, artificial
  Oligomer
cgucuucgacaaccugaug

SEQ ID NO: 10600 - RNA, 19 nt, artificial
  Oligomer
gcccgacuugcuguuuugu

SEQ ID NO: 10601 - RNA, 19 nt, artificial
  Oligomer
ccgacuugcuguuuuguuc

SEQ ID NO: 10602 - RNA, 19 nt, artificial
  Oligomer
agcccgacuugcuguuuug

SEQ ID NO: 10603 - RNA, 19 nt, artificial
  Oligomer
cacaaguacaacagcgaca

SEQ ID NO: 10604 - RNA, 19 nt, artificial
  Oligomer
agcugacauggaaauacag

SEQ ID NO: 10605 - RNA, 19 nt, artificial
  Oligomer
uggauccaccacaaguaca

SEQ ID NO: 10606 - RNA, 19 nt, artificial
  Oligomer
ccuccauccacugcaaacu

SEQ ID NO: 10607 - RNA, 19 nt, artificial
  Oligomer
cugacauggaaauacaguu

SEQ ID NO: 10608 - RNA, 19 nt, artificial
  Oligomer
gcaccuacgugaagaaugg

SEQ ID NO: 10609 - RNA, 19 nt, artificial
  Oligomer
ggugcucaagaacuacaug

SEQ ID NO: 10610 - RNA, 19 nt, artificial
  Oligomer
ucuucaucggccgcuacua

SEQ ID NO: 10611 - RNA, 19 nt, artificial
  Oligomer
uguccuaccugaaugucac

SEQ ID NO: 10612 - RNA, 19 nt, artificial
  Oligomer
cucccuggguucagaaaug

SEQ ID NO: 10613 - RNA, 19 nt, artificial
  Oligomer
caaacugcuggacaucgcu

SEQ ID NO: 10614 - RNA, 19 nt, artificial
  Oligomer
caaaacccaccuuguugga

SEQ ID NO: 10615 - RNA, 19 nt, artificial
  Oligomer
ccauccacugcaaacugcu

SEQ ID NO: 10616 - RNA, 19 nt, artificial
  Oligomer
auucagggcgaguacauga

SEQ ID NO: 10617 - RNA, 19 nt, artificial
  Oligomer
uuugaccgugacaacaaca

SEQ ID NO: 10618 - RNA, 19 nt, artificial
  Oligomer
aguggagaggcaggucuuu

SEQ ID NO: 10619 - RNA, 19 nt, artificial
  Oligomer
cuggauccaccacaaguac

SEQ ID NO: 10620 - RNA, 19 nt, artificial
  Oligomer
cucguuugacauccacuau

SEQ ID NO: 10621 - RNA, 19 nt, artificial
  Oligomer
gucugucucuccaucuguu

SEQ ID NO: 10622 - RNA, 19 nt, artificial
  Oligomer
acaaggguucucuguccua

SEQ ID NO: 10623 - RNA, 19 nt, artificial
  Oligomer
ucuucgacaaccugaugca

SEQ ID NO: 10624 - RNA, 19 nt, artificial
  Oligomer
caaccugaugcagcagaag

SEQ ID NO: 10625 - RNA, 19 nt, artificial
  Oligomer
ccagagcacagaucuguuu

SEQ ID NO: 10626 - RNA, 19 nt, artificial
  Oligomer
cacugcaaacugcuggaca

SEQ ID NO: 10627 - RNA, 19 nt, artificial
  Oligomer
ugcuggauccaccacaagu

SEQ ID NO: 10628 - RNA, 19 nt, artificial
  Oligomer
cuccaaguauuacaagggu

SEQ ID NO: 10629 - RNA, 19 nt, artificial
  Oligomer
aggaugagcuggaaggagu

SEQ ID NO: 10630 - RNA, 19 nt, artificial
  Oligomer
agugcuucacagucgucuu

SEQ ID NO: 10631 - RNA, 19 nt, artificial
  Oligomer
aucuguuucgugcauugga

SEQ ID NO: 10632 - RNA, 19 nt, artificial
  Oligomer
accacaaguacaacagcga

SEQ ID NO: 10633 - RNA, 19 nt, artificial
  Oligomer
ccacaaguacaacagcgac

SEQ ID NO: 10634 - RNA, 19 nt, artificial
  Oligomer
aagcccgacuugcuguuuu

SEQ ID NO: 10635 - RNA, 19 nt, artificial
  Oligomer
cugguggaccagaacaucu

SEQ ID NO: 10636 - RNA, 19 nt, artificial
  Oligomer
agaaugguaccucguuuga

SEQ ID NO: 10637 - RNA, 19 nt, artificial
  Oligomer
agaggacuacacgcucaag

SEQ ID NO: 10638 - RNA, 19 nt, artificial
  Oligomer
gauucagggcgaguacaug

SEQ ID NO: 10639 - RNA, 19 nt, artificial
  Oligomer
ugaagaaugguaccucguu

SEQ ID NO: 10640 - RNA, 19 nt, artificial
  Oligomer
acagaucuguuucgugcau

SEQ ID NO: 10641 - RNA, 19 nt, artificial
  Oligomer
gacaaccugaugcagcaga

SEQ ID NO: 10642 - RNA, 19 nt, artificial
  Oligomer
ugaugcagcagaagcuggu

SEQ ID NO: 10643 - RNA, 19 nt, artificial
  Oligomer
cucuguccuaccugaaugu

SEQ ID NO: 10644 - RNA, 19 nt, artificial
  Oligomer
ccaccacaaguacaacagc

SEQ ID NO: 10645 - RNA, 19 nt, artificial
  Oligomer
gcugacauggaaauacagu

SEQ ID NO: 10646 - RNA, 19 nt, artificial
  Oligomer
aagcugguggaccagaaca

SEQ ID NO: 10647 - RNA, 19 nt, artificial
  Oligomer
gguggaccagaacaucuuc

SEQ ID NO: 10648 - RNA, 19 nt, artificial
  Oligomer
gcacagaaacagaggagag

SEQ ID NO: 10649 - RNA, 19 nt, artificial
  Oligomer
gauccaccacaaguacaac

SEQ ID NO: 10650 - RNA, 19 nt, artificial
  Oligomer
gacuacacgcucaaggugu

SEQ ID NO: 10651 - RNA, 19 nt, artificial
  Oligomer
uccagagcacagaucuguu

SEQ ID NO: 10652 - RNA, 19 nt, artificial
  Oligomer
gauccagagcacagaucug

SEQ ID NO: 10653 - RNA, 19 nt, artificial
  Oligomer
cagcaccuacgugaagaau

SEQ ID NO: 10654 - RNA, 19 nt, artificial
  Oligomer
uguuuuguucugugguuuu

SEQ ID NO: 10655 - RNA, 19 nt, artificial
  Oligomer
aggcaaaggcuacaagcug

SEQ ID NO: 10656 - RNA, 19 nt, artificial
  Oligomer
augguaccucguuugacau

SEQ ID NO: 10657 - RNA, 19 nt, artificial
  Oligomer
cagaacaucuucuccuucu

SEQ ID NO: 10658 - RNA, 19 nt, artificial
  Oligomer
gagcacagaucuguuucgu

SEQ ID NO: 10659 - RNA, 19 nt, artificial
  Oligomer
aggguucucuguccuaccu

SEQ ID NO: 10660 - RNA, 19 nt, artificial
  Oligomer
caaguauuacaaggguucu

SEQ ID NO: 10661 - RNA, 19 nt, artificial
  Oligomer
cuguuuuguucugugguuu

SEQ ID NO: 10662 - RNA, 19 nt, artificial
  Oligomer
uucaucggccgcuacuaca

SEQ ID NO: 10663 - RNA, 19 nt, artificial
  Oligomer
ugccugucugucucuccau

SEQ ID NO: 10664 - RNA, 19 nt, artificial
  Oligomer
auccaccacaaguacaaca

SEQ ID NO: 10665 - RNA, 19 nt, artificial
  Oligomer
agcacagaaacagaggaga

SEQ ID NO: 10666 - RNA, 19 nt, artificial
  Oligomer
ugaccgugacaacaacagg

SEQ ID NO: 10667 - RNA, 19 nt, artificial
  Oligomer
cuugcuguuuuguucugug

SEQ ID NO: 10668 - RNA, 19 nt, artificial
  Oligomer
agaucuguuucgugcauug

SEQ ID NO: 10669 - RNA, 19 nt, artificial
  Oligomer
gaucacacugaagcuggga

SEQ ID NO: 10670 - RNA, 19 nt, artificial
  Oligomer
aaguccagcaccuacguga

SEQ ID NO: 10671 - RNA, 19 nt, artificial
  Oligomer
cguuugacauccacuaugg

SEQ ID NO: 10672 - RNA, 19 nt, artificial
  Oligomer
gaugagcuggaaggaguga

SEQ ID NO: 10673 - RNA, 19 nt, artificial
  Oligomer
gacauggaaauacaguugu

SEQ ID NO: 10674 - RNA, 19 nt, artificial
  Oligomer
acaacaacagggugggcuu

SEQ ID NO: 10675 - RNA, 19 nt, artificial
  Oligomer
uucagggcgaguacaugau

SEQ ID NO: 10676 - RNA, 19 nt, artificial
  Oligomer
gaaugguaccucguuugac

SEQ ID NO: 10677 - RNA, 19 nt, artificial
  Oligomer
acaucuucuccuucuaccu

SEQ ID NO: 10678 - RNA, 19 nt, artificial
  Oligomer
caaggguucucuguccuac

SEQ ID NO: 10679 - RNA, 19 nt, artificial
  Oligomer
uccacugcaaacugcugga

SEQ ID NO: 10680 - RNA, 19 nt, artificial
  Oligomer
accuacgugaagaauggua

SEQ ID NO: 10681 - RNA, 19 nt, artificial
  Oligomer
ugcuguuuuguucuguggu

SEQ ID NO: 10682 - RNA, 19 nt, artificial
  Oligomer
cuguuucgugcauuggaag

SEQ ID NO: 10683 - RNA, 19 nt, artificial
  Oligomer
caccuacgugaagaauggu

SEQ ID NO: 10684 - RNA, 19 nt, artificial
  Oligomer
aucuucuccuucuaccuga

SEQ ID NO: 10685 - RNA, 19 nt, artificial
  Oligomer
gaccagaacaucuucuccu

SEQ ID NO: 10686 - RNA, 19 nt, artificial
  Oligomer
guauuacaaggguucucug

SEQ ID NO: 10687 - RNA, 19 nt, artificial
  Oligomer
uucucuguccuaccugaau

SEQ ID NO: 10688 - RNA, 19 nt, artificial
  Oligomer
uguuucgugcauuggaaga

SEQ ID NO: 10689 - RNA, 19 nt, artificial
  Oligomer
ccuggguucagaaaugcug

SEQ ID NO: 10690 - RNA, 19 nt, artificial
  Oligomer
ucugcagcugaccucuguu

SEQ ID NO: 10691 - RNA, 19 nt, artificial
  Oligomer
uggacaucgcuugcuggau

SEQ ID NO: 10692 - RNA, 19 nt, artificial
  Oligomer
cuacgugaagaaugguacc

SEQ ID NO: 10693 - RNA, 19 nt, artificial
  Oligomer
agaaaugcugccugccugu

SEQ ID NO: 10694 - RNA, 19 nt, artificial
  Oligomer
uugcuggauccaccacaag

SEQ ID NO: 10695 - RNA, 19 nt, artificial
  Oligomer
ccagcugacauggaaauac

SEQ ID NO: 10696 - RNA, 19 nt, artificial
  Oligomer
cacagacuccaaguauuac

SEQ ID NO: 10697 - RNA, 19 nt, artificial
  Oligomer
ccuacgugaagaaugguac

SEQ ID NO: 10698 - RNA, 19 nt, artificial
  Oligomer
gacuugcuguuuuguucug

SEQ ID NO: 10699 - RNA, 19 nt, artificial
  Oligomer
gacuccaaguauuacaagg

SEQ ID NO: 10700 - RNA, 19 nt, artificial
  Oligomer
ggaccagaacaucuucucc

SEQ ID NO: 10701 - RNA, 19 nt, artificial
  Oligomer
guagagcugauccagagca

SEQ ID NO: 10702 - RNA, 19 nt, artificial
  Oligomer
cugucugucucuccaucug

SEQ ID NO: 10703 - RNA, 19 nt, artificial
  Oligomer
cagaucuguuucgugcauu

SEQ ID NO: 10704 - RNA, 19 nt, artificial
  Oligomer
ugauccagagcacagaucu

SEQ ID NO: 10705 - RNA, 19 nt, artificial
  Oligomer
cauggaaauacaguuguug

SEQ ID NO: 10706 - RNA, 19 nt, artificial
  Oligomer
acaaguccagcaccuacgu

SEQ ID NO: 10707 - RNA, 19 nt, artificial
  Oligomer
aguacaacagcgacaaguc

SEQ ID NO: 10708 - RNA, 19 nt, artificial
  Oligomer
aucccgcugcacaaguuca

SEQ ID NO: 10709 - RNA, 19 nt, artificial
  Oligomer
uaccugaaugucacccgca

SEQ ID NO: 10710 - RNA, 19 nt, artificial
  Oligomer
acaucgcuugcuggaucca

SEQ ID NO: 10711 - RNA, 19 nt, artificial
  Oligomer
caccacaaguacaacagcg

SEQ ID NO: 10712 - RNA, 19 nt, artificial
  Oligomer
acaacagcgacaaguccag

SEQ ID NO: 10713 - RNA, 19 nt, artificial
  Oligomer
cuucgacaaccugaugcag

SEQ ID NO: 10714 - RNA, 19 nt, artificial
  Oligomer
gugaagaaugguaccucgu

SEQ ID NO: 10715 - RNA, 19 nt, artificial
  Oligomer
agacuccaaguauuacaag

SEQ ID NO: 10716 - RNA, 19 nt, artificial
  Oligomer
gaacaucuucuccuucuac

SEQ ID NO: 10717 - RNA, 19 nt, artificial
  Oligomer
agcugaccucuguuguccu

SEQ ID NO: 10718 - RNA, 19 nt, artificial
  Oligomer
cuggguucagaaaugcugc

SEQ ID NO: 10719 - RNA, 19 nt, artificial
  Oligomer
acuacacgcucaagguguc

SEQ ID NO: 10720 - RNA, 19 nt, artificial
  Oligomer
cacagaaacagaggagagu

SEQ ID NO: 10721 - RNA, 19 nt, artificial
  Oligomer
cuccauccacugcaaacug

SEQ ID NO: 10722 - RNA, 19 nt, artificial
  Oligomer
ucuucuccuucuaccugag

SEQ ID NO: 10723 - RNA, 19 nt, artificial
  Oligomer
auucccgaggugcucaaga

SEQ ID NO: 10724 - RNA, 19 nt, artificial
  Oligomer
ccugucugucucuccaucu

SEQ ID NO: 10725 - RNA, 19 nt, artificial
  Oligomer
cauccacugcaaacugcug

SEQ ID NO: 10726 - RNA, 19 nt, artificial
  Oligomer
uagagcugauccagagcac

SEQ ID NO: 10727 - RNA, 19 nt, artificial
  Oligomer
cagcacagaaacagaggag

SEQ ID NO: 10728 - RNA, 19 nt, artificial
  Oligomer
accgugacaacaacagggu

SEQ ID NO: 10729 - RNA, 19 nt, artificial
  Oligomer
gcacaaguucacguccauc

SEQ ID NO: 10730 - RNA, 19 nt, artificial
  Oligomer
uucacagucgucuucgaca

SEQ ID NO: 10731 - RNA, 19 nt, artificial
  Oligomer
aaguacaacagcgacaagu

SEQ ID NO: 10732 - RNA, 19 nt, artificial
  Oligomer
cucaagaacuacauggacg

SEQ ID NO: 10733 - RNA, 19 nt, artificial
  Oligomer
accucguuugacauccacu

SEQ ID NO: 10734 - RNA, 19 nt, artificial
  Oligomer
uacaacagcgacaagucca

SEQ ID NO: 10735 - RNA, 19 nt, artificial
  Oligomer
caagcccgacuugcuguuu

SEQ ID NO: 10736 - RNA, 19 nt, artificial
  Oligomer
gcaaaggcuacaagcuguc

SEQ ID NO: 10737 - RNA, 19 nt, artificial
  Oligomer
uacauggacgcccaguacu

SEQ ID NO: 10738 - RNA, 19 nt, artificial
  Oligomer
ucuccgucaacaacgugcu

SEQ ID NO: 10739 - RNA, 19 nt, artificial
  Oligomer
agagcacagaucuguuucg

SEQ ID NO: 10740 - RNA, 19 nt, artificial
  Oligomer
ucuccuucuaccugagcag

SEQ ID NO: 10741 - RNA, 19 nt, artificial
  Oligomer
uccaaguauuacaaggguu

SEQ ID NO: 10742 - RNA, 19 nt, artificial
  Oligomer
aaggguucucuguccuacc

SEQ ID NO: 10743 - RNA, 19 nt, artificial
  Oligomer
cgucucaaaguacucccag

SEQ ID NO: 10744 - RNA, 19 nt, artificial
  Oligomer
guggaccagaacaucuucu

SEQ ID NO: 10745 - RNA, 19 nt, artificial
  Oligomer
aacagcgacaaguccagca

SEQ ID NO: 10746 - RNA, 19 nt, artificial
  Oligomer
ugacauggaaauacaguug

SEQ ID NO: 10747 - RNA, 19 nt, artificial
  Oligomer
acuugcuguuuuguucugu

SEQ ID NO: 10748 - RNA, 19 nt, artificial
  Oligomer
uccagcaccuacgugaaga

SEQ ID NO: 10749 - RNA, 19 nt, artificial
  Oligomer
ucacagucgucuucgacac

SEQ ID NO: 10750 - RNA, 19 nt, artificial
  Oligomer
ccaaguauuacaaggguuc

SEQ ID NO: 10751 - RNA, 19 nt, artificial
  Oligomer
gucucuccaucuguuuggu

SEQ ID NO: 10752 - RNA, 19 nt, artificial
  Oligomer
agcacagaucuguuucgug

SEQ ID NO: 10753 - RNA, 19 nt, artificial
  Oligomer
uccaccacaaguacaacag

SEQ ID NO: 10754 - RNA, 19 nt, artificial
  Oligomer
ucaagaacuacauggacgc

SEQ ID NO: 10755 - RNA, 19 nt, artificial
  Oligomer
caucuccgucaacaacgug

SEQ ID NO: 10756 - RNA, 19 nt, artificial
  Oligomer
ugucugucucuccaucugu

SEQ ID NO: 10757 - RNA, 19 nt, artificial
  Oligomer
uucuccuucuaccugagca

SEQ ID NO: 10758 - RNA, 19 nt, artificial
  Oligomer
ccagaacaucuucuccuuc

SEQ ID NO: 10759 - RNA, 19 nt, artificial
  Oligomer
gcacagaucuguuucgugc

SEQ ID NO: 10760 - RNA, 19 nt, artificial
  Oligomer
aaaguggagaggcaggucu

SEQ ID NO: 10761 - RNA, 19 nt, artificial
  Oligomer
ugcagcugaccucuguugu

SEQ ID NO: 10762 - RNA, 19 nt, artificial
  Oligomer
aaaugcugccugccugucu

SEQ ID NO: 10763 - RNA, 19 nt, artificial
  Oligomer
auggaaauacaguuguugg

SEQ ID NO: 10764 - RNA, 19 nt, artificial
  Oligomer
ucagaaaugcugccugccu

SEQ ID NO: 10765 - RNA, 19 nt, artificial
  Oligomer
ucugucucuccaucuguuu

SEQ ID NO: 10766 - RNA, 19 nt, artificial
  Oligomer
guacaacagcgacaagucc

SEQ ID NO: 10767 - RNA, 19 nt, artificial
  Oligomer
gguucagaaaugcugccug

SEQ ID NO: 10768 - RNA, 19 nt, artificial
  Oligomer
gacaaaacccaccuuguug

SEQ ID NO: 10769 - RNA, 19 nt, artificial
  Oligomer
uugaccgugacaacaacag

SEQ ID NO: 10770 - RNA, 19 nt, artificial
  Oligomer
aguauuacaaggguucucu

SEQ ID NO: 10771 - RNA, 19 nt, artificial
  Oligomer
uauuacaaggguucucugu

SEQ ID NO: 10772 - RNA, 19 nt, artificial
  Oligomer
acaaguucacguccauccg

SEQ ID NO: 10773 - RNA, 19 nt, artificial
  Oligomer
gugcucaagaacuacaugg

SEQ ID NO: 10774 - RNA, 19 nt, artificial
  Oligomer
cagugcuucacagucgucu

SEQ ID NO: 10775 - RNA, 19 nt, artificial
  Oligomer
aaacugcuggacaucgcuu

SEQ ID NO: 10776 - RNA, 19 nt, artificial
  Oligomer
guccuaccugaaugucacc

SEQ ID NO: 10777 - RNA, 19 nt, artificial
  Oligomer
gucucaaaguacucccagg

SEQ ID NO: 10778 - RNA, 19 nt, artificial
  Oligomer
caagaacuacauggacgcc

SEQ ID NO: 10779 - RNA, 19 nt, artificial
  Oligomer
aacuacauggacgcccagu

SEQ ID NO: 10780 - RNA, 19 nt, artificial
  Oligomer
cagagcacagaucuguuuc

SEQ ID NO: 10781 - RNA, 19 nt, artificial
  Oligomer
ugucaaaguggagaggcag

SEQ ID NO: 10782 - RNA, 19 nt, artificial
  Oligomer
guucagaaaugcugccugc

SEQ ID NO: 10783 - RNA, 19 nt, artificial
  Oligomer
ucagggcgaguacaugauc

SEQ ID NO: 10784 - RNA, 19 nt, artificial
  Oligomer
ucucuguccuaccugaaug

SEQ ID NO: 10785 - RNA, 19 nt, artificial
  Oligomer
uggaccagaacaucuucuc

SEQ ID NO: 10786 - RNA, 19 nt, artificial
  Oligomer
uacaaggguucucuguccu

SEQ ID NO: 10787 - RNA, 19 nt, artificial
  Oligomer
cagaaacagaggagagucc

SEQ ID NO: 10788 - RNA, 19 nt, artificial
  Oligomer
ucaaaguggagaggcaggu

SEQ ID NO: 10789 - RNA, 19 nt, artificial
  Oligomer
cuucaugggcauggacauc

SEQ ID NO: 10790 - RNA, 19 nt, artificial
  Oligomer
cugcaaacugcuggacauc

SEQ ID NO: 10791 - RNA, 19 nt, artificial
  Oligomer
agcaccuacgugaagaaug

SEQ ID NO: 10792 - RNA, 19 nt, artificial
  Oligomer
aagaaugguaccucguuug

SEQ ID NO: 10793 - RNA, 19 nt, artificial
  Oligomer
uaccucguuugacauccac

SEQ ID NO: 10794 - RNA, 19 nt, artificial
  Oligomer
cuucacagucgucuucgac

SEQ ID NO: 10795 - RNA, 19 nt, artificial
  Oligomer
acuccaaguauuacaaggg

SEQ ID NO: 10796 - RNA, 19 nt, artificial
  Oligomer
cugucucuccaucuguuug

SEQ ID NO: 10797 - RNA, 19 nt, artificial
  Oligomer
caucuucuccuucuaccug

SEQ ID NO: 10798 - RNA, 19 nt, artificial
  Oligomer
ggguucagaaaugcugccu

SEQ ID NO: 10799 - RNA, 19 nt, artificial
  Oligomer
guuuuguucugugguuuuc

SEQ ID NO: 10800 - RNA, 19 nt, artificial
  Oligomer
cacaaguucacguccaucc

SEQ ID NO: 10801 - RNA, 19 nt, artificial
  Oligomer
ucguuugacauccacuaug

SEQ ID NO: 10802 - RNA, 19 nt, artificial
  Oligomer
uugcuguuuuguucugugg

SEQ ID NO: 10803 - RNA, 19 nt, artificial
  Oligomer
uuuguucugugguuuuccc

SEQ ID NO: 10804 - RNA, 19 nt, artificial
  Oligomer
aaccugaugcagcagaagc

SEQ ID NO: 10805 - RNA, 19 nt, artificial
  Oligomer
aaacagaggagagucccag

SEQ ID NO: 10806 - RNA, 19 nt, artificial
  Oligomer
gaucuguuucgugcauugg

SEQ ID NO: 10807 - RNA, 19 nt, artificial
  Oligomer
gugcuucacagucgucuuc

SEQ ID NO: 10808 - RNA, 19 nt, artificial
  Oligomer
caaaggcuacaagcugucc

SEQ ID NO: 10809 - RNA, 19 nt, artificial
  Oligomer
aaguauuacaaggguucuc

SEQ ID NO: 10810 - RNA, 19 nt, artificial
  Oligomer
ucccuggguucagaaaugc

SEQ ID NO: 10811 - RNA, 19 nt, artificial
  Oligomer
auccagagcacagaucugu

SEQ ID NO: 10812 - RNA, 19 nt, artificial
  Oligomer
acgugaagaaugguaccuc

SEQ ID NO: 10813 - RNA, 19 nt, artificial
  Oligomer
uuacaaggguucucugucc

SEQ ID NO: 10814 - RNA, 19 nt, artificial
  Oligomer
guuucgugcauuggaagac

SEQ ID NO: 10815 - RNA, 19 nt, artificial
  Oligomer
augagcuggaaggagugag

SEQ ID NO: 10816 - RNA, 19 nt, artificial
  Oligomer
acaaaacccaccuuguugg

SEQ ID NO: 10817 - RNA, 19 nt, artificial
  Oligomer
cugauccagagcacagauc

SEQ ID NO: 10818 - RNA, 19 nt, artificial
  Oligomer
uggguucagaaaugcugcc

SEQ ID NO: 10819 - RNA, 19 nt, artificial
  Oligomer
ucuguggaggaccugauug

SEQ ID NO: 10820 - RNA, 19 nt, artificial
  Oligomer
uccauccacugcaaacugc

SEQ ID NO: 10821 - RNA, 19 nt, artificial
  Oligomer
aacaucuucuccuucuacc

SEQ ID NO: 10822 - RNA, 19 nt, artificial
  Oligomer
gguaccucguuugacaucc

SEQ ID NO: 10823 - RNA, 19 nt, artificial
  Oligomer
ugguaccucguuugacauc

SEQ ID NO: 10824 - RNA, 19 nt, artificial
  Oligomer
aaacccaccuuguuggagc

SEQ ID NO: 10825 - RNA, 19 nt, artificial
  Oligomer
aaaggcuacaagcuguccc

SEQ ID NO: 10826 - RNA, 19 nt, artificial
  Oligomer
auuacaaggguucucuguc

SEQ ID NO: 10827 - RNA, 19 nt, artificial
  Oligomer
acagaaacagaggagaguc

SEQ ID NO: 10828 - RNA, 19 nt, artificial
  Oligomer
uacgugaagaaugguaccu

SEQ ID NO: 10829 - RNA, 19 nt, artificial
  Oligomer
aucacacugaagcugggag

SEQ ID NO: 10830 - RNA, 19 nt, artificial
  Oligomer
aacugcuggacaucgcuug

SEQ ID NO: 10831 - RNA, 19 nt, artificial
  Oligomer
gucuucgacaaccugaugc

SEQ ID NO: 10832 - RNA, 19 nt, artificial
  Oligomer
uuucgugcauuggaagacc

SEQ ID NO: 10833 - RNA, 19 nt, artificial
  Oligomer
acccuaccuguucaguguc

SEQ ID NO: 10834 - RNA, 19 nt, artificial
  Oligomer
ugucucuccaucuguuugg

SEQ ID NO: 10835 - RNA, 19 nt, artificial
  Oligomer
uuuuguucugugguuuucc

SEQ ID NO: 10836 - RNA, 19 nt, artificial
  Oligomer
uucgacaaccugaugcagc

SEQ ID NO: 10837 - RNA, 19 nt, artificial
  Oligomer
agaaacagaggagaguccc

SEQ ID NO: 10838 - RNA, 19 nt, artificial
  Oligomer
cuucuccuucuaccugagc

SEQ ID NO: 10839 - RNA, 19 nt, artificial
  Oligomer
cucuccaucuguuuggugg

SEQ ID NO: 10840 - RNA, 19 nt, artificial
  Oligomer
uucgugcauuggaagaccc

SEQ ID NO: 10841 - RNA, 19 nt, artificial
  Oligomer
ugcaaacugcuggacaucg

SEQ ID NO: 10842 - RNA, 19 nt, artificial
  Oligomer
aaaacccaccuuguuggag

SEQ ID NO: 10843 - RNA, 19 nt, artificial
  Oligomer
aucuccgucaacaacgugc

SEQ ID NO: 10844 - RNA, 19 nt, artificial
  Oligomer
ucuccaucuguuugguggg

SEQ ID NO: 10845 - RNA, 19 nt, artificial
  Oligomer
aagaacuacauggacgccc

SEQ ID NO: 10846 - RNA, 19 nt, artificial
  Oligomer
ucuguccuaccugaauguc

SEQ ID NO: 10847 - RNA, 19 nt, artificial
  Oligomer
ucucaaaguacucccaggc

SEQ ID NO: 10848 - RNA, 19 nt, artificial
  Oligomer
ugcuucacagucgucuucg

SEQ ID NO: 10849 - RNA, 19 nt, artificial
  Oligomer
uucagaaaugcugccugcc

SEQ ID NO: 10850 - RNA, 19 nt, artificial
  Oligomer
auccacugcaaacugcugg

SEQ ID NO: 10851 - RNA, 19 nt, artificial
  Oligomer
ucucuccaucuguuuggug

SEQ ID NO: 10852 - RNA, 19 nt, artificial
  Oligomer
uucaugggcauggacaucc

SEQ ID NO: 10853 - RNA, 19 nt, artificial
  Oligomer
uccuaccugaaugucaccc

SEQ ID NO: 10854 - RNA, 19 nt, artificial
  Oligomer
uugugguggauccagcaag

SEQ ID NO: 10855 - RNA, 19 nt, artificial
  Oligomer
uaguucuugagcaccucgg

SEQ ID NO: 10856 - RNA, 19 nt, artificial
  Oligomer
uuguacuugugguggaucc

SEQ ID NO: 10857 - RNA, 19 nt, artificial
  Oligomer
uguauuuccaugucagcug

SEQ ID NO: 10858 - RNA, 19 nt, artificial
  Oligomer
uuguaauacuuggagucug

SEQ ID NO: 10859 - RNA, 19 nt, artificial
  Oligomer
uacuugugguggauccagc

SEQ ID NO: 10860 - RNA, 19 nt, artificial
  Oligomer
aucagguugucgaagacgg

SEQ ID NO: 10861 - RNA, 19 nt, artificial
  Oligomer
uugagcguguaguccucug

SEQ ID NO: 10862 - RNA, 19 nt, artificial
  Oligomer
uucugcugcaucagguugu

SEQ ID NO: 10863 - RNA, 19 nt, artificial
  Oligomer
uugcgggugacauucaggu

SEQ ID NO: 10864 - RNA, 19 nt, artificial
  Oligomer
uucugguccaccagcuucu

SEQ ID NO: 10865 - RNA, 19 nt, artificial
  Oligomer
uucuucacguaggugcugg

SEQ ID NO: 10866 - RNA, 19 nt, artificial
  Oligomer
aauacuuggagucugugcc

SEQ ID NO: 10867 - RNA, 19 nt, artificial
  Oligomer
uuugccucccagcuucagu

SEQ ID NO: 10868 - RNA, 19 nt, artificial
  Oligomer
ugggcguccauguaguucu

SEQ ID NO: 10869 - RNA, 19 nt, artificial
  Oligomer
uuguugucacggucaaaca

SEQ ID NO: 10870 - RNA, 19 nt, artificial
  Oligomer
uaauacuuggagucugugc

SEQ ID NO: 10871 - RNA, 19 nt, artificial
  Oligomer
uaguacugggcguccaugu

SEQ ID NO: 10872 - RNA, 19 nt, artificial
  Oligomer
uaguggaugucaaacgagg

SEQ ID NO: 10873 - RNA, 19 nt, artificial
  Oligomer
uuccaaugcacgaaacaga

SEQ ID NO: 10874 - RNA, 19 nt, artificial
  Oligomer
guuguugucacggucaaac

SEQ ID NO: 10875 - RNA, 19 nt, artificial
  Oligomer
ugcugcaucagguugucga

SEQ ID NO: 10876 - RNA, 19 nt, artificial
  Oligomer
ucagguaggacagagaacc

SEQ ID NO: 10877 - RNA, 19 nt, artificial
  Oligomer
ugucaaacgagguaccauu

SEQ ID NO: 10878 - RNA, 19 nt, artificial
  Oligomer
uucacguaggugcuggacu

SEQ ID NO: 10879 - RNA, 19 nt, artificial
  Oligomer
uagaaggagaagauguucu

SEQ ID NO: 10880 - RNA, 19 nt, artificial
  Oligomer
auguaguucuugagcaccu

SEQ ID NO: 10881 - RNA, 19 nt, artificial
  Oligomer
ucucacuccuuccagcuca

SEQ ID NO: 10882 - RNA, 19 nt, artificial
  Oligomer
ucgaagacgacugugaagc

SEQ ID NO: 10883 - RNA, 19 nt, artificial
  Oligomer
auguccaugcccaugaagc

SEQ ID NO: 10884 - RNA, 19 nt, artificial
  Oligomer
uguugucacggucaaacac

SEQ ID NO: 10885 - RNA, 19 nt, artificial
  Oligomer
uccauguaguucuugagca

SEQ ID NO: 10886 - RNA, 19 nt, artificial
  Oligomer
uguaguucuugagcaccuc

SEQ ID NO: 10887 - RNA, 19 nt, artificial
  Oligomer
agcuuguagccuuugccuc

SEQ ID NO: 10888 - RNA, 19 nt, artificial
  Oligomer
ugccucuccacuuugacac

SEQ ID NO: 10889 - RNA, 19 nt, artificial
  Oligomer
uucuugagcaccucgggaa

SEQ ID NO: 10890 - RNA, 19 nt, artificial
  Oligomer
acguuguugacggagaugc

SEQ ID NO: 10891 - RNA, 19 nt, artificial
  Oligomer
accuugagcguguaguccu

SEQ ID NO: 10892 - RNA, 19 nt, artificial
  Oligomer
aacaacuguauuuccaugu

SEQ ID NO: 10893 - RNA, 19 nt, artificial
  Oligomer
aacaagguggguuuugucc

SEQ ID NO: 10894 - RNA, 19 nt, artificial
  Oligomer
acagcuuguagccuuugcc

SEQ ID NO: 10895 - RNA, 19 nt, artificial
  Oligomer
auggacgugaacuugugca

SEQ ID NO: 10896 - RNA, 19 nt, artificial
  Oligomer
agaacaaaacagcaagucg

SEQ ID NO: 10897 - RNA, 19 nt, artificial
  Oligomer
aucugugcucuggaucagc

SEQ ID NO: 10898 - RNA, 19 nt, artificial
  Oligomer
aaucagguccuccacagag

SEQ ID NO: 10899 - RNA, 19 nt, artificial
  Oligomer
guaguucuugagcaccucg

SEQ ID NO: 10900 - RNA, 19 nt, artificial
  Oligomer
uacugggcguccauguagu

SEQ ID NO: 10901 - RNA, 19 nt, artificial
  Oligomer
ucugugcucuggaucagcu

SEQ ID NO: 10902 - RNA, 19 nt, artificial
  Oligomer
auguucugguccaccagcu

SEQ ID NO: 10903 - RNA, 19 nt, artificial
  Oligomer
uggaugucaaacgagguac

SEQ ID NO: 10904 - RNA, 19 nt, artificial
  Oligomer
uucagguaggacagagaac

SEQ ID NO: 10905 - RNA, 19 nt, artificial
  Oligomer
aaccacagaacaaaacagc

SEQ ID NO: 10906 - RNA, 19 nt, artificial
  Oligomer
uugucgcuguuguacuugu

SEQ ID NO: 10907 - RNA, 19 nt, artificial
  Oligomer
auguccagcaguuugcagu

SEQ ID NO: 10908 - RNA, 19 nt, artificial
  Oligomer
aacaaaacagcaagucggg

SEQ ID NO: 10909 - RNA, 19 nt, artificial
  Oligomer
ugcacgaaacagaucugug

SEQ ID NO: 10910 - RNA, 19 nt, artificial
  Oligomer
auguacucgcccugaauca

SEQ ID NO: 10911 - RNA, 19 nt, artificial
  Oligomer
ugggacucuccucuguuuc

SEQ ID NO: 10912 - RNA, 19 nt, artificial
  Oligomer
cuugucgcuguuguacuug

SEQ ID NO: 10913 - RNA, 19 nt, artificial
  Oligomer
ugacauucagguaggacag

SEQ ID NO: 10914 - RNA, 19 nt, artificial
  Oligomer
uuguagccuuugccuccca

SEQ ID NO: 10915 - RNA, 19 nt, artificial
  Oligomer
aagauguucugguccacca

SEQ ID NO: 10916 - RNA, 19 nt, artificial
  Oligomer
acaagguggguuuuguccc

SEQ ID NO: 10917 - RNA, 19 nt, artificial
  Oligomer
aaacgagguaccauucuuc

SEQ ID NO: 10918 - RNA, 19 nt, artificial
  Oligomer
uauuuccaugucagcuggg

SEQ ID NO: 10919 - RNA, 19 nt, artificial
  Oligomer
uccucuguuucugugcugg

SEQ ID NO: 10920 - RNA, 19 nt, artificial
  Oligomer
uccuuccagcucauccuca

SEQ ID NO: 10921 - RNA, 19 nt, artificial
  Oligomer
auuucugaacccagggagg

SEQ ID NO: 10922 - RNA, 19 nt, artificial
  Oligomer
guccauguaguucuugagc

SEQ ID NO: 10923 - RNA, 19 nt, artificial
  Oligomer
aaggagaagauguucuggu

SEQ ID NO: 10924 - RNA, 19 nt, artificial
  Oligomer
ugugcucuggaucagcucu

SEQ ID NO: 10925 - RNA, 19 nt, artificial
  Oligomer
uguacucgcccugaaucag

SEQ ID NO: 10926 - RNA, 19 nt, artificial
  Oligomer
uggacgugaacuugugcag

SEQ ID NO: 10927 - RNA, 19 nt, artificial
  Oligomer
ucugggacucuccucuguu

SEQ ID NO: 10928 - RNA, 19 nt, artificial
  Oligomer
ugcgaugaaggugaugccu

SEQ ID NO: 10929 - RNA, 19 nt, artificial
  Oligomer
agcauuucugaacccaggg

SEQ ID NO: 10930 - RNA, 19 nt, artificial
  Oligomer
agcuucugcugcaucaggu

SEQ ID NO: 10931 - RNA, 19 nt, artificial
  Oligomer
cgagguaccauucuucacg

SEQ ID NO: 10932 - RNA, 19 nt, artificial
  Oligomer
aagaccugccucuccacuu

SEQ ID NO: 10933 - RNA, 19 nt, artificial
  Oligomer
acacugaacagguagggug

SEQ ID NO: 10934 - RNA, 19 nt, artificial
  Oligomer
ugggaguacuuugagacgg

SEQ ID NO: 10935 - RNA, 19 nt, artificial
  Oligomer
uguaauacuuggagucugu

SEQ ID NO: 10936 - RNA, 19 nt, artificial
  Oligomer
caucagguugucgaagacg

SEQ ID NO: 10937 - RNA, 19 nt, artificial
  Oligomer
acaaaacagcaagucgggc

SEQ ID NO: 10938 - RNA, 19 nt, artificial
  Oligomer
gaacaaaacagcaagucgg

SEQ ID NO: 10939 - RNA, 19 nt, artificial
  Oligomer
caaaacagcaagucgggcu

SEQ ID NO: 10940 - RNA, 19 nt, artificial
  Oligomer
ugucgcuguuguacuugug

SEQ ID NO: 10941 - RNA, 19 nt, artificial
  Oligomer
cuguauuuccaugucagcu

SEQ ID NO: 10942 - RNA, 19 nt, artificial
  Oligomer
uguacuugugguggaucca

SEQ ID NO: 10943 - RNA, 19 nt, artificial
  Oligomer
aguuugcaguggauggagg

SEQ ID NO: 10944 - RNA, 19 nt, artificial
  Oligomer
aacuguauuuccaugucag

SEQ ID NO: 10945 - RNA, 19 nt, artificial
  Oligomer
ccauucuucacguaggugc

SEQ ID NO: 10946 - RNA, 19 nt, artificial
  Oligomer
cauguaguucuugagcacc

SEQ ID NO: 10947 - RNA, 19 nt, artificial
  Oligomer
uaguagcggccgaugaaga

SEQ ID NO: 10948 - RNA, 19 nt, artificial
  Oligomer
gugacauucagguaggaca

SEQ ID NO: 10949 - RNA, 19 nt, artificial
  Oligomer
cauuucugaacccagggag

SEQ ID NO: 10950 - RNA, 19 nt, artificial
  Oligomer
agcgauguccagcaguuug

SEQ ID NO: 10951 - RNA, 19 nt, artificial
  Oligomer
uccaacaagguggguuuug

SEQ ID NO: 10952 - RNA, 19 nt, artificial
  Oligomer
agcaguuugcaguggaugg

SEQ ID NO: 10953 - RNA, 19 nt, artificial
  Oligomer
ucauguacucgcccugaau

SEQ ID NO: 10954 - RNA, 19 nt, artificial
  Oligomer
uguuguugucacggucaaa

SEQ ID NO: 10955 - RNA, 19 nt, artificial
  Oligomer
aaagaccugccucuccacu

SEQ ID NO: 10956 - RNA, 19 nt, artificial
  Oligomer
guacuugugguggauccag

SEQ ID NO: 10957 - RNA, 19 nt, artificial
  Oligomer
auaguggaugucaaacgag

SEQ ID NO: 10958 - RNA, 19 nt, artificial
  Oligomer
aacagauggagagacagac

SEQ ID NO: 10959 - RNA, 19 nt, artificial
  Oligomer
uaggacagagaacccuugu

SEQ ID NO: 10960 - RNA, 19 nt, artificial
  Oligomer
ugcaucagguugucgaaga

SEQ ID NO: 10961 - RNA, 19 nt, artificial
  Oligomer
cuucugcugcaucagguug

SEQ ID NO: 10962 - RNA, 19 nt, artificial
  Oligomer
aaacagaucugugcucugg

SEQ ID NO: 10963 - RNA, 19 nt, artificial
  Oligomer
uguccagcaguuugcagug

SEQ ID NO: 10964 - RNA, 19 nt, artificial
  Oligomer
acuugugguggauccagca

SEQ ID NO: 10965 - RNA, 19 nt, artificial
  Oligomer
acccuuguaauacuuggag

SEQ ID NO: 10966 - RNA, 19 nt, artificial
  Oligomer
acuccuuccagcucauccu

SEQ ID NO: 10967 - RNA, 19 nt, artificial
  Oligomer
aagacgacugugaagcacu

SEQ ID NO: 10968 - RNA, 19 nt, artificial
  Oligomer
uccaaugcacgaaacagau

SEQ ID NO: 10969 - RNA, 19 nt, artificial
  Oligomer
ucgcuguuguacuuguggu

SEQ ID NO: 10970 - RNA, 19 nt, artificial
  Oligomer
gucgcuguuguacuugugg

SEQ ID NO: 10971 - RNA, 19 nt, artificial
  Oligomer
aaaacagcaagucgggcuu

SEQ ID NO: 10972 - RNA, 19 nt, artificial
  Oligomer
agauguucugguccaccag

SEQ ID NO: 10973 - RNA, 19 nt, artificial
  Oligomer
ucaaacgagguaccauucu

SEQ ID NO: 10974 - RNA, 19 nt, artificial
  Oligomer
cuugagcguguaguccucu

SEQ ID NO: 10975 - RNA, 19 nt, artificial
  Oligomer
cauguacucgcccugaauc

SEQ ID NO: 10976 - RNA, 19 nt, artificial
  Oligomer
aacgagguaccauucuuca

SEQ ID NO: 10977 - RNA, 19 nt, artificial
  Oligomer
augcacgaaacagaucugu

SEQ ID NO: 10978 - RNA, 19 nt, artificial
  Oligomer
ucugcugcaucagguuguc

SEQ ID NO: 10979 - RNA, 19 nt, artificial
  Oligomer
accagcuucugcugcauca

SEQ ID NO: 10980 - RNA, 19 nt, artificial
  Oligomer
acauucagguaggacagag

SEQ ID NO: 10981 - RNA, 19 nt, artificial
  Oligomer
gcuguuguacuuguggugg

SEQ ID NO: 10982 - RNA, 19 nt, artificial
  Oligomer
acuguauuuccaugucagc

SEQ ID NO: 10983 - RNA, 19 nt, artificial
  Oligomer
uguucugguccaccagcuu

SEQ ID NO: 10984 - RNA, 19 nt, artificial
  Oligomer
gaagauguucugguccacc

SEQ ID NO: 10985 - RNA, 19 nt, artificial
  Oligomer
cucuccucuguuucugugc

SEQ ID NO: 10986 - RNA, 19 nt, artificial
  Oligomer
guuguacuugugguggauc

SEQ ID NO: 10987 - RNA, 19 nt, artificial
  Oligomer
acaccuugagcguguaguc

SEQ ID NO: 10988 - RNA, 19 nt, artificial
  Oligomer
aacagaucugugcucugga

SEQ ID NO: 10989 - RNA, 19 nt, artificial
  Oligomer
cagaucugugcucuggauc

SEQ ID NO: 10990 - RNA, 19 nt, artificial
  Oligomer
auucuucacguaggugcug

SEQ ID NO: 10991 - RNA, 19 nt, artificial
  Oligomer
aaaaccacagaacaaaaca

SEQ ID NO: 10992 - RNA, 19 nt, artificial
  Oligomer
cagcuuguagccuuugccu

SEQ ID NO: 10993 - RNA, 19 nt, artificial
  Oligomer
augucaaacgagguaccau

SEQ ID NO: 10994 - RNA, 19 nt, artificial
  Oligomer
agaaggagaagauguucug

SEQ ID NO: 10995 - RNA, 19 nt, artificial
  Oligomer
acgaaacagaucugugcuc

SEQ ID NO: 10996 - RNA, 19 nt, artificial
  Oligomer
agguaggacagagaacccu

SEQ ID NO: 10997 - RNA, 19 nt, artificial
  Oligomer
agaacccuuguaauacuug

SEQ ID NO: 10998 - RNA, 19 nt, artificial
  Oligomer
aaaccacagaacaaaacag

SEQ ID NO: 10999 - RNA, 19 nt, artificial
  Oligomer
uguaguagcggccgaugaa

SEQ ID NO: 11000 - RNA, 19 nt, artificial
  Oligomer
auggagagacagacaggca

SEQ ID NO: 11001 - RNA, 19 nt, artificial
  Oligomer
uguuguacuugugguggau

SEQ ID NO: 11002 - RNA, 19 nt, artificial
  Oligomer
ucuccucuguuucugugcu

SEQ ID NO: 11003 - RNA, 19 nt, artificial
  Oligomer
ccuguuguugucacgguca

SEQ ID NO: 11004 - RNA, 19 nt, artificial
  Oligomer
cacagaacaaaacagcaag

SEQ ID NO: 11005 - RNA, 19 nt, artificial
  Oligomer
caaugcacgaaacagaucu

SEQ ID NO: 11006 - RNA, 19 nt, artificial
  Oligomer
ucccagcuucagugugauc

SEQ ID NO: 11007 - RNA, 19 nt, artificial
  Oligomer
ucacguaggugcuggacuu

SEQ ID NO: 11008 - RNA, 19 nt, artificial
  Oligomer
ccauaguggaugucaaacg

SEQ ID NO: 11009 - RNA, 19 nt, artificial
  Oligomer
ucacuccuuccagcucauc

SEQ ID NO: 11010 - RNA, 19 nt, artificial
  Oligomer
acaacuguauuuccauguc

SEQ ID NO: 11011 - RNA, 19 nt, artificial
  Oligomer
aagcccacccuguuguugu

SEQ ID NO: 11012 - RNA, 19 nt, artificial
  Oligomer
aucauguacucgcccugaa

SEQ ID NO: 11013 - RNA, 19 nt, artificial
  Oligomer
gucaaacgagguaccauuc

SEQ ID NO: 11014 - RNA, 19 nt, artificial
  Oligomer
agguagaaggagaagaugu

SEQ ID NO: 11015 - RNA, 19 nt, artificial
  Oligomer
guaggacagagaacccuug

SEQ ID NO: 11016 - RNA, 19 nt, artificial
  Oligomer
uccagcaguuugcagugga

SEQ ID NO: 11017 - RNA, 19 nt, artificial
  Oligomer
uaccauucuucacguaggu

SEQ ID NO: 11018 - RNA, 19 nt, artificial
  Oligomer
accacagaacaaaacagca

SEQ ID NO: 11019 - RNA, 19 nt, artificial
  Oligomer
cuuccaaugcacgaaacag

SEQ ID NO: 11020 - RNA, 19 nt, artificial
  Oligomer
accauucuucacguaggug

SEQ ID NO: 11021 - RNA, 19 nt, artificial
  Oligomer
ucagguagaaggagaagau

SEQ ID NO: 11022 - RNA, 19 nt, artificial
  Oligomer
aggagaagauguucugguc

SEQ ID NO: 11023 - RNA, 19 nt, artificial
  Oligomer
cagagaacccuuguaauac

SEQ ID NO: 11024 - RNA, 19 nt, artificial
  Oligomer
auucagguaggacagagaa

SEQ ID NO: 11025 - RNA, 19 nt, artificial
  Oligomer
ucuuccaaugcacgaaaca

SEQ ID NO: 11026 - RNA, 19 nt, artificial
  Oligomer
cagcauuucugaacccagg

SEQ ID NO: 11027 - RNA, 19 nt, artificial
  Oligomer
aacagaggucagcugcaga

SEQ ID NO: 11028 - RNA, 19 nt, artificial
  Oligomer
auccagcaagcgaugucca

SEQ ID NO: 11029 - RNA, 19 nt, artificial
  Oligomer
gguaccauucuucacguag

SEQ ID NO: 11030 - RNA, 19 nt, artificial
  Oligomer
acaggcaggcagcauuucu

SEQ ID NO: 11031 - RNA, 19 nt, artificial
  Oligomer
cuugugguggauccagcaa

SEQ ID NO: 11032 - RNA, 19 nt, artificial
  Oligomer
guauuuccaugucagcugg

SEQ ID NO: 11033 - RNA, 19 nt, artificial
  Oligomer
guaauacuuggagucugug

SEQ ID NO: 11034 - RNA, 19 nt, artificial
  Oligomer
guaccauucuucacguagg

SEQ ID NO: 11035 - RNA, 19 nt, artificial
  Oligomer
cagaacaaaacagcaaguc

SEQ ID NO: 11036 - RNA, 19 nt, artificial
  Oligomer
ccuuguaauacuuggaguc

SEQ ID NO: 11037 - RNA, 19 nt, artificial
  Oligomer
ggagaagauguucuggucc

SEQ ID NO: 11038 - RNA, 19 nt, artificial
  Oligomer
ugcucuggaucagcucuac

SEQ ID NO: 11039 - RNA, 19 nt, artificial
  Oligomer
cagauggagagacagacag

SEQ ID NO: 11040 - RNA, 19 nt, artificial
  Oligomer
aaugcacgaaacagaucug

SEQ ID NO: 11041 - RNA, 19 nt, artificial
  Oligomer
agaucugugcucuggauca

SEQ ID NO: 11042 - RNA, 19 nt, artificial
  Oligomer
caacaacuguauuuccaug

SEQ ID NO: 11043 - RNA, 19 nt, artificial
  Oligomer
acguaggugcuggacuugu

SEQ ID NO: 11044 - RNA, 19 nt, artificial
  Oligomer
gacuugucgcuguuguacu

SEQ ID NO: 11045 - RNA, 19 nt, artificial
  Oligomer
ugaacuugugcagcgggau

SEQ ID NO: 11046 - RNA, 19 nt, artificial
  Oligomer
ugcgggugacauucaggua

SEQ ID NO: 11047 - RNA, 19 nt, artificial
  Oligomer
uggauccagcaagcgaugu

SEQ ID NO: 11048 - RNA, 19 nt, artificial
  Oligomer
cgcuguuguacuuguggug

SEQ ID NO: 11049 - RNA, 19 nt, artificial
  Oligomer
cuggacuugucgcuguugu

SEQ ID NO: 11050 - RNA, 19 nt, artificial
  Oligomer
cugcaucagguugucgaag

SEQ ID NO: 11051 - RNA, 19 nt, artificial
  Oligomer
acgagguaccauucuucac

SEQ ID NO: 11052 - RNA, 19 nt, artificial
  Oligomer
cuuguaauacuuggagucu

SEQ ID NO: 11053 - RNA, 19 nt, artificial
  Oligomer
guagaaggagaagauguuc

SEQ ID NO: 11054 - RNA, 19 nt, artificial
  Oligomer
aggacaacagaggucagcu

SEQ ID NO: 11055 - RNA, 19 nt, artificial
  Oligomer
gcagcauuucugaacccag

SEQ ID NO: 11056 - RNA, 19 nt, artificial
  Oligomer
gacaccuugagcguguagu

SEQ ID NO: 11057 - RNA, 19 nt, artificial
  Oligomer
acucuccucuguuucugug

SEQ ID NO: 11058 - RNA, 19 nt, artificial
  Oligomer
caguuugcaguggauggag

SEQ ID NO: 11059 - RNA, 19 nt, artificial
  Oligomer
cucagguagaaggagaaga

SEQ ID NO: 11060 - RNA, 19 nt, artificial
  Oligomer
ucuugagcaccucgggaau

SEQ ID NO: 11061 - RNA, 19 nt, artificial
  Oligomer
agauggagagacagacagg

SEQ ID NO: 11062 - RNA, 19 nt, artificial
  Oligomer
cagcaguuugcaguggaug

SEQ ID NO: 11063 - RNA, 19 nt, artificial
  Oligomer
gugcucuggaucagcucua

SEQ ID NO: 11064 - RNA, 19 nt, artificial
  Oligomer
cuccucuguuucugugcug

SEQ ID NO: 11065 - RNA, 19 nt, artificial
  Oligomer
acccuguuguugucacggu

SEQ ID NO: 11066 - RNA, 19 nt, artificial
  Oligomer
gauggacgugaacuugugc

SEQ ID NO: 11067 - RNA, 19 nt, artificial
  Oligomer
ugucgaagacgacugugaa

SEQ ID NO: 11068 - RNA, 19 nt, artificial
  Oligomer
acuugucgcuguuguacuu

SEQ ID NO: 11069 - RNA, 19 nt, artificial
  Oligomer
cguccauguaguucuugag

SEQ ID NO: 11070 - RNA, 19 nt, artificial
  Oligomer
aguggaugucaaacgaggu

SEQ ID NO: 11071 - RNA, 19 nt, artificial
  Oligomer
uggacuugucgcuguugua

SEQ ID NO: 11072 - RNA, 19 nt, artificial
  Oligomer
aaacagcaagucgggcuug

SEQ ID NO: 11073 - RNA, 19 nt, artificial
  Oligomer
gacagcuuguagccuuugc

SEQ ID NO: 11074 - RNA, 19 nt, artificial
  Oligomer
aguacugggcguccaugua

SEQ ID NO: 11075 - RNA, 19 nt, artificial
  Oligomer
agcacguuguugacggaga

SEQ ID NO: 11076 - RNA, 19 nt, artificial
  Oligomer
cgaaacagaucugugcucu

SEQ ID NO: 11077 - RNA, 19 nt, artificial
  Oligomer
cugcucagguagaaggaga

SEQ ID NO: 11078 - RNA, 19 nt, artificial
  Oligomer
aacccuuguaauacuugga

SEQ ID NO: 11079 - RNA, 19 nt, artificial
  Oligomer
gguaggacagagaacccuu

SEQ ID NO: 11080 - RNA, 19 nt, artificial
  Oligomer
cugggaguacuuugagacg

SEQ ID NO: 11081 - RNA, 19 nt, artificial
  Oligomer
agaagauguucugguccac

SEQ ID NO: 11082 - RNA, 19 nt, artificial
  Oligomer
ugcuggacuugucgcuguu

SEQ ID NO: 11083 - RNA, 19 nt, artificial
  Oligomer
caacuguauuuccauguca

SEQ ID NO: 11084 - RNA, 19 nt, artificial
  Oligomer
acagaacaaaacagcaagu

SEQ ID NO: 11085 - RNA, 19 nt, artificial
  Oligomer
ucuucacguaggugcugga

SEQ ID NO: 11086 - RNA, 19 nt, artificial
  Oligomer
gugucgaagacgacuguga

SEQ ID NO: 11087 - RNA, 19 nt, artificial
  Oligomer
gaacccuuguaauacuugg

SEQ ID NO: 11088 - RNA, 19 nt, artificial
  Oligomer
accaaacagauggagagac

SEQ ID NO: 11089 - RNA, 19 nt, artificial
  Oligomer
cacgaaacagaucugugcu

SEQ ID NO: 11090 - RNA, 19 nt, artificial
  Oligomer
cuguuguacuuguggugga

SEQ ID NO: 11091 - RNA, 19 nt, artificial
  Oligomer
gcguccauguaguucuuga

SEQ ID NO: 11092 - RNA, 19 nt, artificial
  Oligomer
cacguuguugacggagaug

SEQ ID NO: 11093 - RNA, 19 nt, artificial
  Oligomer
acagauggagagacagaca

SEQ ID NO: 11094 - RNA, 19 nt, artificial
  Oligomer
ugcucagguagaaggagaa

SEQ ID NO: 11095 - RNA, 19 nt, artificial
  Oligomer
gaaggagaagauguucugg

SEQ ID NO: 11096 - RNA, 19 nt, artificial
  Oligomer
gcacgaaacagaucugugc

SEQ ID NO: 11097 - RNA, 19 nt, artificial
  Oligomer
agaccugccucuccacuuu

SEQ ID NO: 11098 - RNA, 19 nt, artificial
  Oligomer
acaacagaggucagcugca

SEQ ID NO: 11099 - RNA, 19 nt, artificial
  Oligomer
agacaggcaggcagcauuu

SEQ ID NO: 11100 - RNA, 19 nt, artificial
  Oligomer
ccaacaacuguauuuccau

SEQ ID NO: 11101 - RNA, 19 nt, artificial
  Oligomer
aggcaggcagcauuucuga

SEQ ID NO: 11102 - RNA, 19 nt, artificial
  Oligomer
aaacagauggagagacaga

SEQ ID NO: 11103 - RNA, 19 nt, artificial
  Oligomer
ggacuugucgcuguuguac

SEQ ID NO: 11104 - RNA, 19 nt, artificial
  Oligomer
caggcagcauuucugaacc

SEQ ID NO: 11105 - RNA, 19 nt, artificial
  Oligomer
caacaagguggguuuuguc

SEQ ID NO: 11106 - RNA, 19 nt, artificial
  Oligomer
cuguuguugucacggucaa

SEQ ID NO: 11107 - RNA, 19 nt, artificial
  Oligomer
agagaacccuuguaauacu

SEQ ID NO: 11108 - RNA, 19 nt, artificial
  Oligomer
acagagaacccuuguaaua

SEQ ID NO: 11109 - RNA, 19 nt, artificial
  Oligomer
cggauggacgugaacuugu

SEQ ID NO: 11110 - RNA, 19 nt, artificial
  Oligomer
ccauguaguucuugagcac

SEQ ID NO: 11111 - RNA, 19 nt, artificial
  Oligomer
agacgacugugaagcacug

SEQ ID NO: 11112 - RNA, 19 nt, artificial
  Oligomer
aagcgauguccagcaguuu

SEQ ID NO: 11113 - RNA, 19 nt, artificial
  Oligomer
ggugacauucagguaggac

SEQ ID NO: 11114 - RNA, 19 nt, artificial
  Oligomer
ccugggaguacuuugagac

SEQ ID NO: 11115 - RNA, 19 nt, artificial
  Oligomer
ggcguccauguaguucuug

SEQ ID NO: 11116 - RNA, 19 nt, artificial
  Oligomer
acugggcguccauguaguu

SEQ ID NO: 11117 - RNA, 19 nt, artificial
  Oligomer
gaaacagaucugugcucug

SEQ ID NO: 11118 - RNA, 19 nt, artificial
  Oligomer
cugccucuccacuuugaca

SEQ ID NO: 11119 - RNA, 19 nt, artificial
  Oligomer
gcaggcagcauuucugaac

SEQ ID NO: 11120 - RNA, 19 nt, artificial
  Oligomer
gaucauguacucgcccuga

SEQ ID NO: 11121 - RNA, 19 nt, artificial
  Oligomer
cauucagguaggacagaga

SEQ ID NO: 11122 - RNA, 19 nt, artificial
  Oligomer
gagaagauguucuggucca

SEQ ID NO: 11123 - RNA, 19 nt, artificial
  Oligomer
aggacagagaacccuugua

SEQ ID NO: 11124 - RNA, 19 nt, artificial
  Oligomer
ggacucuccucuguuucug

SEQ ID NO: 11125 - RNA, 19 nt, artificial
  Oligomer
accugccucuccacuuuga

SEQ ID NO: 11126 - RNA, 19 nt, artificial
  Oligomer
gauguccaugcccaugaag

SEQ ID NO: 11127 - RNA, 19 nt, artificial
  Oligomer
gauguccagcaguuugcag

SEQ ID NO: 11128 - RNA, 19 nt, artificial
  Oligomer
cauucuucacguaggugcu

SEQ ID NO: 11129 - RNA, 19 nt, artificial
  Oligomer
caaacgagguaccauucuu

SEQ ID NO: 11130 - RNA, 19 nt, artificial
  Oligomer
guggaugucaaacgaggua

SEQ ID NO: 11131 - RNA, 19 nt, artificial
  Oligomer
gucgaagacgacugugaag

SEQ ID NO: 11132 - RNA, 19 nt, artificial
  Oligomer
cccuuguaauacuuggagu

SEQ ID NO: 11133 - RNA, 19 nt, artificial
  Oligomer
caaacagauggagagacag

SEQ ID NO: 11134 - RNA, 19 nt, artificial
  Oligomer
cagguagaaggagaagaug

SEQ ID NO: 11135 - RNA, 19 nt, artificial
  Oligomer
aggcagcauuucugaaccc

SEQ ID NO: 11136 - RNA, 19 nt, artificial
  Oligomer
gaaaaccacagaacaaaac

SEQ ID NO: 11137 - RNA, 19 nt, artificial
  Oligomer
ggauggacgugaacuugug

SEQ ID NO: 11138 - RNA, 19 nt, artificial
  Oligomer
cauaguggaugucaaacga

SEQ ID NO: 11139 - RNA, 19 nt, artificial
  Oligomer
ccacagaacaaaacagcaa

SEQ ID NO: 11140 - RNA, 19 nt, artificial
  Oligomer
gggaaaaccacagaacaaa

SEQ ID NO: 11141 - RNA, 19 nt, artificial
  Oligomer
gcuucugcugcaucagguu

SEQ ID NO: 11142 - RNA, 19 nt, artificial
  Oligomer
cugggacucuccucuguuu

SEQ ID NO: 11143 - RNA, 19 nt, artificial
  Oligomer
ccaaugcacgaaacagauc

SEQ ID NO: 11144 - RNA, 19 nt, artificial
  Oligomer
gaagacgacugugaagcac

SEQ ID NO: 11145 - RNA, 19 nt, artificial
  Oligomer
ggacagcuuguagccuuug

SEQ ID NO: 11146 - RNA, 19 nt, artificial
  Oligomer
gagaacccuuguaauacuu

SEQ ID NO: 11147 - RNA, 19 nt, artificial
  Oligomer
gcauuucugaacccaggga

SEQ ID NO: 11148 - RNA, 19 nt, artificial
  Oligomer
acagaucugugcucuggau

SEQ ID NO: 11149 - RNA, 19 nt, artificial
  Oligomer
gagguaccauucuucacgu

SEQ ID NO: 11150 - RNA, 19 nt, artificial
  Oligomer
ggacagagaacccuuguaa

SEQ ID NO: 11151 - RNA, 19 nt, artificial
  Oligomer
gucuuccaaugcacgaaac

SEQ ID NO: 11152 - RNA, 19 nt, artificial
  Oligomer
cucacuccuuccagcucau

SEQ ID NO: 11153 - RNA, 19 nt, artificial
  Oligomer
ccaacaagguggguuuugu

SEQ ID NO: 11154 - RNA, 19 nt, artificial
  Oligomer
gaucugugcucuggaucag

SEQ ID NO: 11155 - RNA, 19 nt, artificial
  Oligomer
ggcagcauuucugaaccca

SEQ ID NO: 11156 - RNA, 19 nt, artificial
  Oligomer
caaucagguccuccacaga

SEQ ID NO: 11157 - RNA, 19 nt, artificial
  Oligomer
gcaguuugcaguggaugga

SEQ ID NO: 11158 - RNA, 19 nt, artificial
  Oligomer
gguagaaggagaagauguu

SEQ ID NO: 11159 - RNA, 19 nt, artificial
  Oligomer
ggaugucaaacgagguacc

SEQ ID NO: 11160 - RNA, 19 nt, artificial
  Oligomer
gaugucaaacgagguacca

SEQ ID NO: 11161 - RNA, 19 nt, artificial
  Oligomer
gcuccaacaagguggguuu

SEQ ID NO: 11162 - RNA, 19 nt, artificial
  Oligomer
gggacagcuuguagccuuu

SEQ ID NO: 11163 - RNA, 19 nt, artificial
  Oligomer
gacagagaacccuuguaau

SEQ ID NO: 11164 - RNA, 19 nt, artificial
  Oligomer
gacucuccucuguuucugu

SEQ ID NO: 11165 - RNA, 19 nt, artificial
  Oligomer
agguaccauucuucacgua

SEQ ID NO: 11166 - RNA, 19 nt, artificial
  Oligomer
cucccagcuucagugugau

SEQ ID NO: 11167 - RNA, 19 nt, artificial
  Oligomer
caagcgauguccagcaguu

SEQ ID NO: 11168 - RNA, 19 nt, artificial
  Oligomer
gcaucagguugucgaagac

SEQ ID NO: 11169 - RNA, 19 nt, artificial
  Oligomer
ggucuuccaaugcacgaaa

SEQ ID NO: 11170 - RNA, 19 nt, artificial
  Oligomer
gacacugaacagguagggu

SEQ ID NO: 11171 - RNA, 19 nt, artificial
  Oligomer
ccaaacagauggagagaca

SEQ ID NO: 11172 - RNA, 19 nt, artificial
  Oligomer
ggaaaaccacagaacaaaa

SEQ ID NO: 11173 - RNA, 19 nt, artificial
  Oligomer
gcugcaucagguugucgaa

SEQ ID NO: 11174 - RNA, 19 nt, artificial
  Oligomer
gggacucuccucuguuucu

SEQ ID NO: 11175 - RNA, 19 nt, artificial
  Oligomer
gcucagguagaaggagaag

SEQ ID NO: 11176 - RNA, 19 nt, artificial
  Oligomer
ccaccaaacagauggagag

SEQ ID NO: 11177 - RNA, 19 nt, artificial
  Oligomer
gggucuuccaaugcacgaa

SEQ ID NO: 11178 - RNA, 19 nt, artificial
  Oligomer
cgauguccagcaguuugca

SEQ ID NO: 11179 - RNA, 19 nt, artificial
  Oligomer
cuccaacaagguggguuuu

SEQ ID NO: 11180 - RNA, 19 nt, artificial
  Oligomer
gcacguuguugacggagau

SEQ ID NO: 11181 - RNA, 19 nt, artificial
  Oligomer
cccaccaaacagauggaga

SEQ ID NO: 11182 - RNA, 19 nt, artificial
  Oligomer
gggcguccauguaguucuu

SEQ ID NO: 11183 - RNA, 19 nt, artificial
  Oligomer
gacauucagguaggacaga

SEQ ID NO: 11184 - RNA, 19 nt, artificial
  Oligomer
gccugggaguacuuugaga

SEQ ID NO: 11185 - RNA, 19 nt, artificial
  Oligomer
cgaagacgacugugaagca

SEQ ID NO: 11186 - RNA, 19 nt, artificial
  Oligomer
ggcaggcagcauuucugaa

SEQ ID NO: 11187 - RNA, 19 nt, artificial
  Oligomer
ccagcaguuugcaguggau

SEQ ID NO: 11188 - RNA, 19 nt, artificial
  Oligomer
caccaaacagauggagaga

SEQ ID NO: 11189 - RNA, 19 nt, artificial
  Oligomer
ggauguccaugcccaugaa

SEQ ID NO: 11190 - RNA, 19 nt, artificial
  Oligomer
gggugacauucagguagga

SEQ ID NO: 11191 - RNA, 19 nt, artificial
  Oligomer
ccuuuaccaggaauuacua

SEQ ID NO: 11192 - RNA, 19 nt, artificial
  Oligomer
ggcccuuuaccaggaauua

SEQ ID NO: 11193 - RNA, 19 nt, artificial
  Oligomer
agaucggaggcaccaucaa

SEQ ID NO: 11194 - RNA, 19 nt, artificial
  Oligomer
cccuuuaccaggaauuacu

SEQ ID NO: 11195 - RNA, 19 nt, artificial
  Oligomer
gggcccuuuaccaggaauu

SEQ ID NO: 11196 - RNA, 19 nt, artificial
  Oligomer
aagcuguucgggcccuuua

SEQ ID NO: 11197 - RNA, 19 nt, artificial
  Oligomer
ugcacccaccugcaauaaa

SEQ ID NO: 11198 - RNA, 19 nt, artificial
  Oligomer
gcccuuuaccaggaauuac

SEQ ID NO: 11199 - RNA, 19 nt, artificial
  Oligomer
cuuuaccaggaauuacuau

SEQ ID NO: 11200 - RNA, 19 nt, artificial
  Oligomer
cacccagugguacuuuggu

SEQ ID NO: 11201 - RNA, 19 nt, artificial
  Oligomer
gugcacccaccugcaauaa

SEQ ID NO: 11202 - RNA, 19 nt, artificial
  Oligomer
caggaauuacuauguucgg

SEQ ID NO: 11203 - RNA, 19 nt, artificial
  Oligomer
agugguacuuuggugccua

SEQ ID NO: 11204 - RNA, 19 nt, artificial
  Oligomer
agaaguacaugaccgccgu

SEQ ID NO: 11205 - RNA, 19 nt, artificial
  Oligomer
uaccaggaauuacuauguu

SEQ ID NO: 11206 - RNA, 19 nt, artificial
  Oligomer
cuuuggugccuacuccauu

SEQ ID NO: 11207 - RNA, 19 nt, artificial
  Oligomer
gggacagaaguacaugacc

SEQ ID NO: 11208 - RNA, 19 nt, artificial
  Oligomer
uacuuuggugccuacucca

SEQ ID NO: 11209 - RNA, 19 nt, artificial
  Oligomer
gugguacuuuggugccuac

SEQ ID NO: 11210 - RNA, 19 nt, artificial
  Oligomer
ggacagaaguacaugaccg

SEQ ID NO: 11211 - RNA, 19 nt, artificial
  Oligomer
ccaggaauuacuauguucg

SEQ ID NO: 11212 - RNA, 19 nt, artificial
  Oligomer
gcuucacccagugguacuu

SEQ ID NO: 11213 - RNA, 19 nt, artificial
  Oligomer
acuuuggugccuacuccau

SEQ ID NO: 11214 - RNA, 19 nt, artificial
  Oligomer
uuaccaggaauuacuaugu

SEQ ID NO: 11215 - RNA, 19 nt, artificial
  Oligomer
cagugguacuuuggugccu

SEQ ID NO: 11216 - RNA, 19 nt, artificial
  Oligomer
accaggaauuacuauguuc

SEQ ID NO: 11217 - RNA, 19 nt, artificial
  Oligomer
gguacuuuggugccuacuc

SEQ ID NO: 11218 - RNA, 19 nt, artificial
  Oligomer
gacagaaguacaugaccgc

SEQ ID NO: 11219 - RNA, 19 nt, artificial
  Oligomer
uuuggugccuacuccauug

SEQ ID NO: 11220 - RNA, 19 nt, artificial
  Oligomer
acccagugguacuuuggug

SEQ ID NO: 11221 - RNA, 19 nt, artificial
  Oligomer
uggugccuacuccauugug

SEQ ID NO: 11222 - RNA, 19 nt, artificial
  Oligomer
aagaggaagaagggcucca

SEQ ID NO: 11223 - RNA, 19 nt, artificial
  Oligomer
gaauuacuauguucgggcc

SEQ ID NO: 11224 - RNA, 19 nt, artificial
  Oligomer
ugguacuuuggugccuacu

SEQ ID NO: 11225 - RNA, 19 nt, artificial
  Oligomer
cuucacccagugguacuuu

SEQ ID NO: 11226 - RNA, 19 nt, artificial
  Oligomer
ggaauuacuauguucgggc

SEQ ID NO: 11227 - RNA, 19 nt, artificial
  Oligomer
guacuuuggugccuacucc

SEQ ID NO: 11228 - RNA, 19 nt, artificial
  Oligomer
ucacccagugguacuuugg

SEQ ID NO: 11229 - RNA, 19 nt, artificial
  Oligomer
aggaauuacuauguucggg

SEQ ID NO: 11230 - RNA, 19 nt, artificial
  Oligomer
uucacccagugguacuuug

SEQ ID NO: 11231 - RNA, 19 nt, artificial
  Oligomer
uuggugccuacuccauugu

SEQ ID NO: 11232 - RNA, 19 nt, artificial
  Oligomer
uuuaccaggaauuacuaug

SEQ ID NO: 11233 - RNA, 19 nt, artificial
  Oligomer
auuacuauguucgggccgu

SEQ ID NO: 11234 - RNA, 19 nt, artificial
  Oligomer
uuacuauguucgggccguc

SEQ ID NO: 11235 - RNA, 19 nt, artificial
  Oligomer
acagaaguacaugaccgcc

SEQ ID NO: 11236 - RNA, 19 nt, artificial
  Oligomer
aauuacuauguucgggccg

SEQ ID NO: 11237 - RNA, 19 nt, artificial
  Oligomer
uggggacagaaguacauga

SEQ ID NO: 11238 - RNA, 19 nt, artificial
  Oligomer
uaguaauuccugguaaagg

SEQ ID NO: 11239 - RNA, 19 nt, artificial
  Oligomer
uaauuccugguaaagggcc

SEQ ID NO: 11240 - RNA, 19 nt, artificial
  Oligomer
uugauggugccuccgaucu

SEQ ID NO: 11241 - RNA, 19 nt, artificial
  Oligomer
aguaauuccugguaaaggg

SEQ ID NO: 11242 - RNA, 19 nt, artificial
  Oligomer
aauuccugguaaagggccc

SEQ ID NO: 11243 - RNA, 19 nt, artificial
  Oligomer
uaaagggcccgaacagcuu

SEQ ID NO: 11244 - RNA, 19 nt, artificial
  Oligomer
uuuauugcaggugggugca

SEQ ID NO: 11245 - RNA, 19 nt, artificial
  Oligomer
guaauuccugguaaagggc

SEQ ID NO: 11246 - RNA, 19 nt, artificial
  Oligomer
auaguaauuccugguaaag

SEQ ID NO: 11247 - RNA, 19 nt, artificial
  Oligomer
accaaaguaccacugggug

SEQ ID NO: 11248 - RNA, 19 nt, artificial
  Oligomer
uuauugcaggugggugcac

SEQ ID NO: 11249 - RNA, 19 nt, artificial
  Oligomer
ccgaacauaguaauuccug

SEQ ID NO: 11250 - RNA, 19 nt, artificial
  Oligomer
uaggcaccaaaguaccacu

SEQ ID NO: 11251 - RNA, 19 nt, artificial
  Oligomer
acggcggucauguacuucu

SEQ ID NO: 11252 - RNA, 19 nt, artificial
  Oligomer
aacauaguaauuccuggua

SEQ ID NO: 11253 - RNA, 19 nt, artificial
  Oligomer
aauggaguaggcaccaaag

SEQ ID NO: 11254 - RNA, 19 nt, artificial
  Oligomer
ggucauguacuucuguccc

SEQ ID NO: 11255 - RNA, 19 nt, artificial
  Oligomer
uggaguaggcaccaaagua

SEQ ID NO: 11256 - RNA, 19 nt, artificial
  Oligomer
guaggcaccaaaguaccac

SEQ ID NO: 11257 - RNA, 19 nt, artificial
  Oligomer
cggucauguacuucugucc

SEQ ID NO: 11258 - RNA, 19 nt, artificial
  Oligomer
cgaacauaguaauuccugg

SEQ ID NO: 11259 - RNA, 19 nt, artificial
  Oligomer
aaguaccacugggugaagc

SEQ ID NO: 11260 - RNA, 19 nt, artificial
  Oligomer
auggaguaggcaccaaagu

SEQ ID NO: 11261 - RNA, 19 nt, artificial
  Oligomer
acauaguaauuccugguaa

SEQ ID NO: 11262 - RNA, 19 nt, artificial
  Oligomer
aggcaccaaaguaccacug

SEQ ID NO: 11263 - RNA, 19 nt, artificial
  Oligomer
gaacauaguaauuccuggu

SEQ ID NO: 11264 - RNA, 19 nt, artificial
  Oligomer
gaguaggcaccaaaguacc

SEQ ID NO: 11265 - RNA, 19 nt, artificial
  Oligomer
gcggucauguacuucuguc

SEQ ID NO: 11266 - RNA, 19 nt, artificial
  Oligomer
caauggaguaggcaccaaa

SEQ ID NO: 11267 - RNA, 19 nt, artificial
  Oligomer
caccaaaguaccacugggu

SEQ ID NO: 11268 - RNA, 19 nt, artificial
  Oligomer
cacaauggaguaggcacca

SEQ ID NO: 11269 - RNA, 19 nt, artificial
  Oligomer
uggagcccuucuuccucuu

SEQ ID NO: 11270 - RNA, 19 nt, artificial
  Oligomer
ggcccgaacauaguaauuc

SEQ ID NO: 11271 - RNA, 19 nt, artificial
  Oligomer
aguaggcaccaaaguacca

SEQ ID NO: 11272 - RNA, 19 nt, artificial
  Oligomer
aaaguaccacugggugaag

SEQ ID NO: 11273 - RNA, 19 nt, artificial
  Oligomer
gcccgaacauaguaauucc

SEQ ID NO: 11274 - RNA, 19 nt, artificial
  Oligomer
ggaguaggcaccaaaguac

SEQ ID NO: 11275 - RNA, 19 nt, artificial
  Oligomer
ccaaaguaccacuggguga

SEQ ID NO: 11276 - RNA, 19 nt, artificial
  Oligomer
cccgaacauaguaauuccu

SEQ ID NO: 11277 - RNA, 19 nt, artificial
  Oligomer
caaaguaccacugggugaa

SEQ ID NO: 11278 - RNA, 19 nt, artificial
  Oligomer
acaauggaguaggcaccaa

SEQ ID NO: 11279 - RNA, 19 nt, artificial
  Oligomer
cauaguaauuccugguaaa

SEQ ID NO: 11280 - RNA, 19 nt, artificial
  Oligomer
acggcccgaacauaguaau

SEQ ID NO: 11281 - RNA, 19 nt, artificial
  Oligomer
gacggcccgaacauaguaa

SEQ ID NO: 11282 - RNA, 19 nt, artificial
  Oligomer
ggcggucauguacuucugu

SEQ ID NO: 11283 - RNA, 19 nt, artificial
  Oligomer
cggcccgaacauaguaauu

SEQ ID NO: 11284 - RNA, 19 nt, artificial
  Oligomer
ucauguacuucugucccca

SEQ ID NO: 11285 - RNA, 19 nt, artificial
  Oligomer
gaggaguguugaacuucaa

SEQ ID NO: 11286 - RNA, 19 nt, artificial
  Oligomer
cagugacccugaggaugaa

SEQ ID NO: 11287 - RNA, 19 nt, artificial
  Oligomer
cuagaacuguuuacaugaa

SEQ ID NO: 11288 - RNA, 19 nt, artificial
  Oligomer
ccaggugggcaaagaacua

SEQ ID NO: 11289 - RNA, 19 nt, artificial
  Oligomer
gauacucacuguucaugaa

SEQ ID NO: 11290 - RNA, 19 nt, artificial
  Oligomer
cugggucuuccaucuagaa

SEQ ID NO: 11291 - RNA, 19 nt, artificial
  Oligomer
gaauacacuugauguucaa

SEQ ID NO: 11292 - RNA, 19 nt, artificial
  Oligomer
gcuuccgagucaucaagaa

SEQ ID NO: 11293 - RNA, 19 nt, artificial
  Oligomer
uccgagucaucaagaagaa

SEQ ID NO: 11294 - RNA, 19 nt, artificial
  Oligomer
gcaggacgcacuugucuua

SEQ ID NO: 11295 - RNA, 19 nt, artificial
  Oligomer
guuuguuguuuguuuugua

SEQ ID NO: 11296 - RNA, 19 nt, artificial
  Oligomer
ggaucuuugacacuugaaa

SEQ ID NO: 11297 - RNA, 19 nt, artificial
  Oligomer
cagcuaucuuacagacgca

SEQ ID NO: 11298 - RNA, 19 nt, artificial
  Oligomer
aguuaacaguggugugaca

SEQ ID NO: 11299 - RNA, 19 nt, artificial
  Oligomer
ggacgcacuugucuuagca

SEQ ID NO: 11300 - RNA, 19 nt, artificial
  Oligomer
gguucgcacacccauucaa

SEQ ID NO: 11301 - RNA, 19 nt, artificial
  Oligomer
acuugauguucaaguauua

SEQ ID NO: 11302 - RNA, 19 nt, artificial
  Oligomer
gcauguaccuuauuauuuu

SEQ ID NO: 11303 - RNA, 19 nt, artificial
  Oligomer
uuuuguuacugacaguuaa

SEQ ID NO: 11304 - RNA, 19 nt, artificial
  Oligomer
cacuguucaugaauacacu

SEQ ID NO: 11305 - RNA, 19 nt, artificial
  Oligomer
caguggugugacauccaga

SEQ ID NO: 11306 - RNA, 19 nt, artificial
  Oligomer
cggaacagcugcucauuga

SEQ ID NO: 11307 - RNA, 19 nt, artificial
  Oligomer
gauuccugugguuggaaaa

SEQ ID NO: 11308 - RNA, 19 nt, artificial
  Oligomer
cucauugaggaguguugaa

SEQ ID NO: 11309 - RNA, 19 nt, artificial
  Oligomer
guucaaguauuaagaccua

SEQ ID NO: 11310 - RNA, 19 nt, artificial
  Oligomer
ugauguucaaguauuaaga

SEQ ID NO: 11311 - RNA, 19 nt, artificial
  Oligomer
agaacuguuuacaugaaga

SEQ ID NO: 11312 - RNA, 19 nt, artificial
  Oligomer
ccaggaagcucauugaguu

SEQ ID NO: 11313 - RNA, 19 nt, artificial
  Oligomer
gaagcuguacagcucggaa

SEQ ID NO: 11314 - RNA, 19 nt, artificial
  Oligomer
uacuguagcaugaaacaaa

SEQ ID NO: 11315 - RNA, 19 nt, artificial
  Oligomer
gaucuuugacacuugaaaa

SEQ ID NO: 11316 - RNA, 19 nt, artificial
  Oligomer
ugaggaguguugaacuuca

SEQ ID NO: 11317 - RNA, 19 nt, artificial
  Oligomer
acgcaugaauguaagagua

SEQ ID NO: 11318 - RNA, 19 nt, artificial
  Oligomer
caagacagagacgacugaa

SEQ ID NO: 11319 - RNA, 19 nt, artificial
  Oligomer
cuguuuacaugaagauaag

SEQ ID NO: 11320 - RNA, 19 nt, artificial
  Oligomer
cucugaguucaucagcaaa

SEQ ID NO: 11321 - RNA, 19 nt, artificial
  Oligomer
cggcacucugaguucauca

SEQ ID NO: 11322 - RNA, 19 nt, artificial
  Oligomer
cacucugaguucaucagca

SEQ ID NO: 11323 - RNA, 19 nt, artificial
  Oligomer
ccaagacagagacgacuga

SEQ ID NO: 11324 - RNA, 19 nt, artificial
  Oligomer
cagagacgacugaacuuuu

SEQ ID NO: 11325 - RNA, 19 nt, artificial
  Oligomer
aaacauguuuguuaaaaca

SEQ ID NO: 11326 - RNA, 19 nt, artificial
  Oligomer
gaauaguguuucccaggaa

SEQ ID NO: 11327 - RNA, 19 nt, artificial
  Oligomer
guagcauguaccuuauuau

SEQ ID NO: 11328 - RNA, 19 nt, artificial
  Oligomer
cagacgcaugaauguaaga

SEQ ID NO: 11329 - RNA, 19 nt, artificial
  Oligomer
gggaucuuugacacuugaa

SEQ ID NO: 11330 - RNA, 19 nt, artificial
  Oligomer
gacagagacgacugaacuu

SEQ ID NO: 11331 - RNA, 19 nt, artificial
  Oligomer
ccugugguuggaaaacuga

SEQ ID NO: 11332 - RNA, 19 nt, artificial
  Oligomer
caucuagaacuguuuacau

SEQ ID NO: 11333 - RNA, 19 nt, artificial
  Oligomer
gggacugauuccugugguu

SEQ ID NO: 11334 - RNA, 19 nt, artificial
  Oligomer
ucugggucuuccaucuaga

SEQ ID NO: 11335 - RNA, 19 nt, artificial
  Oligomer
cgcacuugucuuagcaguu

SEQ ID NO: 11336 - RNA, 19 nt, artificial
  Oligomer
guucaugaauacacuugau

SEQ ID NO: 11337 - RNA, 19 nt, artificial
  Oligomer
ucaguacuguagcaugaaa

SEQ ID NO: 11338 - RNA, 19 nt, artificial
  Oligomer
agaccuaugcaauauuuuu

SEQ ID NO: 11339 - RNA, 19 nt, artificial
  Oligomer
acuguuuacaugaagauaa

SEQ ID NO: 11340 - RNA, 19 nt, artificial
  Oligomer
gaacuguuuacaugaagau

SEQ ID NO: 11341 - RNA, 19 nt, artificial
  Oligomer
gagucaucaagaagaagcu

SEQ ID NO: 11342 - RNA, 19 nt, artificial
  Oligomer
cuugauguucaaguauuaa

SEQ ID NO: 11343 - RNA, 19 nt, artificial
  Oligomer
aguacuguagcaugaaaca

SEQ ID NO: 11344 - RNA, 19 nt, artificial
  Oligomer
gggucuuccaucuagaacu

SEQ ID NO: 11345 - RNA, 19 nt, artificial
  Oligomer
ccucaguacuguagcauga

SEQ ID NO: 11346 - RNA, 19 nt, artificial
  Oligomer
acucugaguucaucagcaa

SEQ ID NO: 11347 - RNA, 19 nt, artificial
  Oligomer
aguauuaagaccuaugcaa

SEQ ID NO: 11348 - RNA, 19 nt, artificial
  Oligomer
ucaucaagaagaagcugua

SEQ ID NO: 11349 - RNA, 19 nt, artificial
  Oligomer
cauguuuguuaaaacaguu

SEQ ID NO: 11350 - RNA, 19 nt, artificial
  Oligomer
cauguaccuuauuauuuuu

SEQ ID NO: 11351 - RNA, 19 nt, artificial
  Oligomer
cguguacugcagaguugag

SEQ ID NO: 11352 - RNA, 19 nt, artificial
  Oligomer
cuaucuuacagacgcauga

SEQ ID NO: 11353 - RNA, 19 nt, artificial
  Oligomer
caugaauguaagaguagga

SEQ ID NO: 11354 - RNA, 19 nt, artificial
  Oligomer
guguugaacuucaaccuga

SEQ ID NO: 11355 - RNA, 19 nt, artificial
  Oligomer
guaucuuacuggucugaag

SEQ ID NO: 11356 - RNA, 19 nt, artificial
  Oligomer
cccugaggaugaacacuug

SEQ ID NO: 11357 - RNA, 19 nt, artificial
  Oligomer
uauuaagaccuaugcaaua

SEQ ID NO: 11358 - RNA, 19 nt, artificial
  Oligomer
guuguaggcagcuaucuua

SEQ ID NO: 11359 - RNA, 19 nt, artificial
  Oligomer
gcucauugaggaguguuga

SEQ ID NO: 11360 - RNA, 19 nt, artificial
  Oligomer
aucggagcaucacuacuga

SEQ ID NO: 11361 - RNA, 19 nt, artificial
  Oligomer
ggagcaucacuacugaccu

SEQ ID NO: 11362 - RNA, 19 nt, artificial
  Oligomer
ugggaucuuugacacuuga

SEQ ID NO: 11363 - RNA, 19 nt, artificial
  Oligomer
ugauuccugugguuggaaa

SEQ ID NO: 11364 - RNA, 19 nt, artificial
  Oligomer
guacuguagcaugaaacaa

SEQ ID NO: 11365 - RNA, 19 nt, artificial
  Oligomer
caugaagauaagauacuca

SEQ ID NO: 11366 - RNA, 19 nt, artificial
  Oligomer
caucguguacugcagaguu

SEQ ID NO: 11367 - RNA, 19 nt, artificial
  Oligomer
ggcuuccgagucaucaaga

SEQ ID NO: 11368 - RNA, 19 nt, artificial
  Oligomer
acuguagcaugaaacaaag

SEQ ID NO: 11369 - RNA, 19 nt, artificial
  Oligomer
uacucacuguucaugaaua

SEQ ID NO: 11370 - RNA, 19 nt, artificial
  Oligomer
ucugaucggagcaucacua

SEQ ID NO: 11371 - RNA, 19 nt, artificial
  Oligomer
guauuaagaccuaugcaau

SEQ ID NO: 11372 - RNA, 19 nt, artificial
  Oligomer
gaucacuugggaucuuuga

SEQ ID NO: 11373 - RNA, 19 nt, artificial
  Oligomer
accuaugcaauauuuuuua

SEQ ID NO: 11374 - RNA, 19 nt, artificial
  Oligomer
ucuagaacuguuuacauga

SEQ ID NO: 11375 - RNA, 19 nt, artificial
  Oligomer
cucaguacuguagcaugaa

SEQ ID NO: 11376 - RNA, 19 nt, artificial
  Oligomer
aaguauuaagaccuaugca

SEQ ID NO: 11377 - RNA, 19 nt, artificial
  Oligomer
ccaucuagaacuguuuaca

SEQ ID NO: 11378 - RNA, 19 nt, artificial
  Oligomer
uguugaacuucaaccugag

SEQ ID NO: 11379 - RNA, 19 nt, artificial
  Oligomer
guaccuuauuauuuuuguu

SEQ ID NO: 11380 - RNA, 19 nt, artificial
  Oligomer
ucguguacugcagaguuga

SEQ ID NO: 11381 - RNA, 19 nt, artificial
  Oligomer
acauguuuguuaaaacagu

SEQ ID NO: 11382 - RNA, 19 nt, artificial
  Oligomer
ccuuauuauuuuuguuacu

SEQ ID NO: 11383 - RNA, 19 nt, artificial
  Oligomer
gcaucacuacugaccuguu

SEQ ID NO: 11384 - RNA, 19 nt, artificial
  Oligomer
cuuccaucuagaacuguuu

SEQ ID NO: 11385 - RNA, 19 nt, artificial
  Oligomer
cauugaggaguguugaacu

SEQ ID NO: 11386 - RNA, 19 nt, artificial
  Oligomer
uacagacgcaugaauguaa

SEQ ID NO: 11387 - RNA, 19 nt, artificial
  Oligomer
uguucaugaauacacuuga

SEQ ID NO: 11388 - RNA, 19 nt, artificial
  Oligomer
auaagauacucacuguuca

SEQ ID NO: 11389 - RNA, 19 nt, artificial
  Oligomer
cuuugacacuugaaaaauu

SEQ ID NO: 11390 - RNA, 19 nt, artificial
  Oligomer
agacagagacgacugaacu

SEQ ID NO: 11391 - RNA, 19 nt, artificial
  Oligomer
agauacucacuguucauga

SEQ ID NO: 11392 - RNA, 19 nt, artificial
  Oligomer
ggaauaguguuucccagga

SEQ ID NO: 11393 - RNA, 19 nt, artificial
  Oligomer
gaccuaugcaauauuuuuu

SEQ ID NO: 11394 - RNA, 19 nt, artificial
  Oligomer
gacgcaugaauguaagagu

SEQ ID NO: 11395 - RNA, 19 nt, artificial
  Oligomer
uaagauacucacuguucau

SEQ ID NO: 11396 - RNA, 19 nt, artificial
  Oligomer
caugaauacacuugauguu

SEQ ID NO: 11397 - RNA, 19 nt, artificial
  Oligomer
aacuguuuacaugaagaua

SEQ ID NO: 11398 - RNA, 19 nt, artificial
  Oligomer
agcuguacagcucggaaca

SEQ ID NO: 11399 - RNA, 19 nt, artificial
  Oligomer
ccugaggaugaacacuugu

SEQ ID NO: 11400 - RNA, 19 nt, artificial
  Oligomer
cugugguuggaaaacugag

SEQ ID NO: 11401 - RNA, 19 nt, artificial
  Oligomer
gcagcugcguuuaagccuu

SEQ ID NO: 11402 - RNA, 19 nt, artificial
  Oligomer
ccaucugggucuuccaucu

SEQ ID NO: 11403 - RNA, 19 nt, artificial
  Oligomer
uuuucugaucggagcauca

SEQ ID NO: 11404 - RNA, 19 nt, artificial
  Oligomer
acugauuccugugguugga

SEQ ID NO: 11405 - RNA, 19 nt, artificial
  Oligomer
agcaugaaacaaaggcuua

SEQ ID NO: 11406 - RNA, 19 nt, artificial
  Oligomer
uguagcauguaccuuauua

SEQ ID NO: 11407 - RNA, 19 nt, artificial
  Oligomer
aacaaggcuuccagcugga

SEQ ID NO: 11408 - RNA, 19 nt, artificial
  Oligomer
accuguuguaggcagcuau

SEQ ID NO: 11409 - RNA, 19 nt, artificial
  Oligomer
aggugggcaaagaacuacu

SEQ ID NO: 11410 - RNA, 19 nt, artificial
  Oligomer
gaguguugaacuucaaccu

SEQ ID NO: 11411 - RNA, 19 nt, artificial
  Oligomer
uacacuugauguucaagua

SEQ ID NO: 11412 - RNA, 19 nt, artificial
  Oligomer
uagcauguaccuuauuauu

SEQ ID NO: 11413 - RNA, 19 nt, artificial
  Oligomer
uggucugaagggaccaagu

SEQ ID NO: 11414 - RNA, 19 nt, artificial
  Oligomer
gaccuguuguaggcagcua

SEQ ID NO: 11415 - RNA, 19 nt, artificial
  Oligomer
aacaguggugugacaucca

SEQ ID NO: 11416 - RNA, 19 nt, artificial
  Oligomer
uaggcagcuaucuuacaga

SEQ ID NO: 11417 - RNA, 19 nt, artificial
  Oligomer
uccggcacucugaguucau

SEQ ID NO: 11418 - RNA, 19 nt, artificial
  Oligomer
caucugggucuuccaucua

SEQ ID NO: 11419 - RNA, 19 nt, artificial
  Oligomer
cugagggacugauuccugu

SEQ ID NO: 11420 - RNA, 19 nt, artificial
  Oligomer
uucccaggaagcucauuga

SEQ ID NO: 11421 - RNA, 19 nt, artificial
  Oligomer
ugacacuugaaaaauuaca

SEQ ID NO: 11422 - RNA, 19 nt, artificial
  Oligomer
ccgagucaucaagaagaag

SEQ ID NO: 11423 - RNA, 19 nt, artificial
  Oligomer
aggagcugagggacugauu

SEQ ID NO: 11424 - RNA, 19 nt, artificial
  Oligomer
agacacggcuuaccuggau

SEQ ID NO: 11425 - RNA, 19 nt, artificial
  Oligomer
aagacacggcuuaccugga

SEQ ID NO: 11426 - RNA, 19 nt, artificial
  Oligomer
guggugugacauccagaga

SEQ ID NO: 11427 - RNA, 19 nt, artificial
  Oligomer
uguuguaggcagcuaucuu

SEQ ID NO: 11428 - RNA, 19 nt, artificial
  Oligomer
uaucuuacagacgcaugaa

SEQ ID NO: 11429 - RNA, 19 nt, artificial
  Oligomer
uuuacaugaagauaagaua

SEQ ID NO: 11430 - RNA, 19 nt, artificial
  Oligomer
uuccgagucaucaagaaga

SEQ ID NO: 11431 - RNA, 19 nt, artificial
  Oligomer
uguaggcagcuaucuuaca

SEQ ID NO: 11432 - RNA, 19 nt, artificial
  Oligomer
ucacuacugaccuguugua

SEQ ID NO: 11433 - RNA, 19 nt, artificial
  Oligomer
acuucgagcugcucaguga

SEQ ID NO: 11434 - RNA, 19 nt, artificial
  Oligomer
ggucuuccaucuagaacug

SEQ ID NO: 11435 - RNA, 19 nt, artificial
  Oligomer
ggaagcucauugaguugug

SEQ ID NO: 11436 - RNA, 19 nt, artificial
  Oligomer
ugucagggaucacuuggga

SEQ ID NO: 11437 - RNA, 19 nt, artificial
  Oligomer
cucacuguucaugaauaca

SEQ ID NO: 11438 - RNA, 19 nt, artificial
  Oligomer
cuuacagacgcaugaaugu

SEQ ID NO: 11439 - RNA, 19 nt, artificial
  Oligomer
cugauuccugugguuggaa

SEQ ID NO: 11440 - RNA, 19 nt, artificial
  Oligomer
ugggugucagggaucacuu

SEQ ID NO: 11441 - RNA, 19 nt, artificial
  Oligomer
cacuugauguucaaguauu

SEQ ID NO: 11442 - RNA, 19 nt, artificial
  Oligomer
uuugacacuugaaaaauua

SEQ ID NO: 11443 - RNA, 19 nt, artificial
  Oligomer
uguuuuguaucuuguuuuu

SEQ ID NO: 11444 - RNA, 19 nt, artificial
  Oligomer
cuaauaaacauguuuguua

SEQ ID NO: 11445 - RNA, 19 nt, artificial
  Oligomer
gcaugaaacaaaggcuuag

SEQ ID NO: 11446 - RNA, 19 nt, artificial
  Oligomer
guuuguuuuguaucuuguu

SEQ ID NO: 11447 - RNA, 19 nt, artificial
  Oligomer
guguagcauguaccuuauu

SEQ ID NO: 11448 - RNA, 19 nt, artificial
  Oligomer
ugaagauaagauacucacu

SEQ ID NO: 11449 - RNA, 19 nt, artificial
  Oligomer
cacuugucuuagcaguucu

SEQ ID NO: 11450 - RNA, 19 nt, artificial
  Oligomer
aagaccuaugcaauauuuu

SEQ ID NO: 11451 - RNA, 19 nt, artificial
  Oligomer
uguuguuuguuuuguaucu

SEQ ID NO: 11452 - RNA, 19 nt, artificial
  Oligomer
ggaacagcugcucauugag

SEQ ID NO: 11453 - RNA, 19 nt, artificial
  Oligomer
ggugggcaaagaacuacug

SEQ ID NO: 11454 - RNA, 19 nt, artificial
  Oligomer
ugaauacacuugauguuca

SEQ ID NO: 11455 - RNA, 19 nt, artificial
  Oligomer
gagcaucacuacugaccug

SEQ ID NO: 11456 - RNA, 19 nt, artificial
  Oligomer
cuuuucuaauaaacauguu

SEQ ID NO: 11457 - RNA, 19 nt, artificial
  Oligomer
uaagaccuaugcaauauuu

SEQ ID NO: 11458 - RNA, 19 nt, artificial
  Oligomer
ucagugacccugaggauga

SEQ ID NO: 11459 - RNA, 19 nt, artificial
  Oligomer
guagcaugaaacaaaggcu

SEQ ID NO: 11460 - RNA, 19 nt, artificial
  Oligomer
agagacgacugaacuuuug

SEQ ID NO: 11461 - RNA, 19 nt, artificial
  Oligomer
uucugaucggagcaucacu

SEQ ID NO: 11462 - RNA, 19 nt, artificial
  Oligomer
guguuucccaggaagcuca

SEQ ID NO: 11463 - RNA, 19 nt, artificial
  Oligomer
aaggcuuccagcuggaugu

SEQ ID NO: 11464 - RNA, 19 nt, artificial
  Oligomer
acagacgcaugaauguaag

SEQ ID NO: 11465 - RNA, 19 nt, artificial
  Oligomer
gugacccugaggaugaaca

SEQ ID NO: 11466 - RNA, 19 nt, artificial
  Oligomer
ccuguuguaggcagcuauc

SEQ ID NO: 11467 - RNA, 19 nt, artificial
  Oligomer
uuccaucuagaacuguuua

SEQ ID NO: 11468 - RNA, 19 nt, artificial
  Oligomer
ucuuguuuuucugaucgga

SEQ ID NO: 11469 - RNA, 19 nt, artificial
  Oligomer
uuuguuguuuguuuuguau

SEQ ID NO: 11470 - RNA, 19 nt, artificial
  Oligomer
ugacccugaggaugaacac

SEQ ID NO: 11471 - RNA, 19 nt, artificial
  Oligomer
aucuuugacacuugaaaaa

SEQ ID NO: 11472 - RNA, 19 nt, artificial
  Oligomer
uguuuuucugaucggagca

SEQ ID NO: 11473 - RNA, 19 nt, artificial
  Oligomer
cccaggaagcucauugagu

SEQ ID NO: 11474 - RNA, 19 nt, artificial
  Oligomer
ggaucacuugggaucuuug

SEQ ID NO: 11475 - RNA, 19 nt, artificial
  Oligomer
gacaguuaacaguggugug

SEQ ID NO: 11476 - RNA, 19 nt, artificial
  Oligomer
uguuuacaugaagauaaga

SEQ ID NO: 11477 - RNA, 19 nt, artificial
  Oligomer
acuggucugaagggaccaa

SEQ ID NO: 11478 - RNA, 19 nt, artificial
  Oligomer
gggaucacuugggaucuuu

SEQ ID NO: 11479 - RNA, 19 nt, artificial
  Oligomer
acaguuaacagugguguga

SEQ ID NO: 11480 - RNA, 19 nt, artificial
  Oligomer
guucgcacacccauucaag

SEQ ID NO: 11481 - RNA, 19 nt, artificial
  Oligomer
ucuuccaucuagaacuguu

SEQ ID NO: 11482 - RNA, 19 nt, artificial
  Oligomer
cgcaugaauguaagaguag

SEQ ID NO: 11483 - RNA, 19 nt, artificial
  Oligomer
gugugacauccagagagca

SEQ ID NO: 11484 - RNA, 19 nt, artificial
  Oligomer
gacugauuccugugguugg

SEQ ID NO: 11485 - RNA, 19 nt, artificial
  Oligomer
augaauguaagaguaggaa

SEQ ID NO: 11486 - RNA, 19 nt, artificial
  Oligomer
acgcacuugucuuagcagu

SEQ ID NO: 11487 - RNA, 19 nt, artificial
  Oligomer
uguuucccaggaagcucau

SEQ ID NO: 11488 - RNA, 19 nt, artificial
  Oligomer
aggaagacacggcuuaccu

SEQ ID NO: 11489 - RNA, 19 nt, artificial
  Oligomer
gacgcacuugucuuagcag

SEQ ID NO: 11490 - RNA, 19 nt, artificial
  Oligomer
ucaugaauacacuugaugu

SEQ ID NO: 11491 - RNA, 19 nt, artificial
  Oligomer
ugaucggagcaucacuacu

SEQ ID NO: 11492 - RNA, 19 nt, artificial
  Oligomer
gauguucaaguauuaagac

SEQ ID NO: 11493 - RNA, 19 nt, artificial
  Oligomer
caguuaacaguggugugac

SEQ ID NO: 11494 - RNA, 19 nt, artificial
  Oligomer
ucaagaagaagcuguacag

SEQ ID NO: 11495 - RNA, 19 nt, artificial
  Oligomer
acucacuguucaugaauac

SEQ ID NO: 11496 - RNA, 19 nt, artificial
  Oligomer
ggcacucugaguucaucag

SEQ ID NO: 11497 - RNA, 19 nt, artificial
  Oligomer
gacccugaggaugaacacu

SEQ ID NO: 11498 - RNA, 19 nt, artificial
  Oligomer
uaaacauguuuguuaaaac

SEQ ID NO: 11499 - RNA, 19 nt, artificial
  Oligomer
ugguuggaaaacugaggca

SEQ ID NO: 11500 - RNA, 19 nt, artificial
  Oligomer
cuuccgagucaucaagaag

SEQ ID NO: 11501 - RNA, 19 nt, artificial
  Oligomer
uguaucuuacuggucugaa

SEQ ID NO: 11502 - RNA, 19 nt, artificial
  Oligomer
uccugugguuggaaaacug

SEQ ID NO: 11503 - RNA, 19 nt, artificial
  Oligomer
agggaucacuugggaucuu

SEQ ID NO: 11504 - RNA, 19 nt, artificial
  Oligomer
gcaugaauguaagaguagg

SEQ ID NO: 11505 - RNA, 19 nt, artificial
  Oligomer
guuacugacaguuaacagu

SEQ ID NO: 11506 - RNA, 19 nt, artificial
  Oligomer
aacagcugcucauugagga

SEQ ID NO: 11507 - RNA, 19 nt, artificial
  Oligomer
agauaagauacucacuguu

SEQ ID NO: 11508 - RNA, 19 nt, artificial
  Oligomer
cugaguucaucagcaaacg

SEQ ID NO: 11509 - RNA, 19 nt, artificial
  Oligomer
aguggugugacauccagag

SEQ ID NO: 11510 - RNA, 19 nt, artificial
  Oligomer
acaguggugugacauccag

SEQ ID NO: 11511 - RNA, 19 nt, artificial
  Oligomer
aggcagcuaucuuacagac

SEQ ID NO: 11512 - RNA, 19 nt, artificial
  Oligomer
uguaccuuauuauuuuugu

SEQ ID NO: 11513 - RNA, 19 nt, artificial
  Oligomer
gacacuugaaaaauuacac

SEQ ID NO: 11514 - RNA, 19 nt, artificial
  Oligomer
aagauaagauacucacugu

SEQ ID NO: 11515 - RNA, 19 nt, artificial
  Oligomer
aggaguguugaacuucaac

SEQ ID NO: 11516 - RNA, 19 nt, artificial
  Oligomer
uguacagcucggaacagcu

SEQ ID NO: 11517 - RNA, 19 nt, artificial
  Oligomer
gucugaagggaccaagugu

SEQ ID NO: 11518 - RNA, 19 nt, artificial
  Oligomer
caguacuguagcaugaaac

SEQ ID NO: 11519 - RNA, 19 nt, artificial
  Oligomer
caggaagcucauugaguug

SEQ ID NO: 11520 - RNA, 19 nt, artificial
  Oligomer
agggacugauuccuguggu

SEQ ID NO: 11521 - RNA, 19 nt, artificial
  Oligomer
gcaaagaacuacugcgccu

SEQ ID NO: 11522 - RNA, 19 nt, artificial
  Oligomer
cucggaacagcugcucauu

SEQ ID NO: 11523 - RNA, 19 nt, artificial
  Oligomer
ccaucguguacugcagagu

SEQ ID NO: 11524 - RNA, 19 nt, artificial
  Oligomer
aagacagagacgacugaac

SEQ ID NO: 11525 - RNA, 19 nt, artificial
  Oligomer
cagggaucacuugggaucu

SEQ ID NO: 11526 - RNA, 19 nt, artificial
  Oligomer
guaggcagcuaucuuacag

SEQ ID NO: 11527 - RNA, 19 nt, artificial
  Oligomer
uagcaugaaacaaaggcuu

SEQ ID NO: 11528 - RNA, 19 nt, artificial
  Oligomer
acuguucaugaauacacuu

SEQ ID NO: 11529 - RNA, 19 nt, artificial
  Oligomer
gucagggaucacuugggau

SEQ ID NO: 11530 - RNA, 19 nt, artificial
  Oligomer
uuaagaccuaugcaauauu

SEQ ID NO: 11531 - RNA, 19 nt, artificial
  Oligomer
ccuaugcaauauuuuuuac

SEQ ID NO: 11532 - RNA, 19 nt, artificial
  Oligomer
uuuuguaucuuguuuuucu

SEQ ID NO: 11533 - RNA, 19 nt, artificial
  Oligomer
gcugcucauugaggagugu

SEQ ID NO: 11534 - RNA, 19 nt, artificial
  Oligomer
uagaacuguuuacaugaag

SEQ ID NO: 11535 - RNA, 19 nt, artificial
  Oligomer
acugacaguuaacaguggu

SEQ ID NO: 11536 - RNA, 19 nt, artificial
  Oligomer
gagacgacugaacuuuugg

SEQ ID NO: 11537 - RNA, 19 nt, artificial
  Oligomer
agcuaucuuacagacgcau

SEQ ID NO: 11538 - RNA, 19 nt, artificial
  Oligomer
guuguuuguuuuguaucuu

SEQ ID NO: 11539 - RNA, 19 nt, artificial
  Oligomer
caucaagaagaagcuguac

SEQ ID NO: 11540 - RNA, 19 nt, artificial
  Oligomer
acacuugauguucaaguau

SEQ ID NO: 11541 - RNA, 19 nt, artificial
  Oligomer
uauuuuuguuacugacagu

SEQ ID NO: 11542 - RNA, 19 nt, artificial
  Oligomer
cccucaguacuguagcaug

SEQ ID NO: 11543 - RNA, 19 nt, artificial
  Oligomer
agcauguaccuuauuauuu

SEQ ID NO: 11544 - RNA, 19 nt, artificial
  Oligomer
aucuuacagacgcaugaau

SEQ ID NO: 11545 - RNA, 19 nt, artificial
  Oligomer
uguuuguuuuguaucuugu

SEQ ID NO: 11546 - RNA, 19 nt, artificial
  Oligomer
guuuacaugaagauaagau

SEQ ID NO: 11547 - RNA, 19 nt, artificial
  Oligomer
ucuuagcaguucucgcuga

SEQ ID NO: 11548 - RNA, 19 nt, artificial
  Oligomer
gcaauauuuuuuacuuuuc

SEQ ID NO: 11549 - RNA, 19 nt, artificial
  Oligomer
ugggcaaagaacuacugcg

SEQ ID NO: 11550 - RNA, 19 nt, artificial
  Oligomer
cugaucggagcaucacuac

SEQ ID NO: 11551 - RNA, 19 nt, artificial
  Oligomer
caucacuacugaccuguug

SEQ ID NO: 11552 - RNA, 19 nt, artificial
  Oligomer
uguaucuuguuuuucugau

SEQ ID NO: 11553 - RNA, 19 nt, artificial
  Oligomer
cuguuguaggcagcuaucu

SEQ ID NO: 11554 - RNA, 19 nt, artificial
  Oligomer
cuaugcaauauuuuuuacu

SEQ ID NO: 11555 - RNA, 19 nt, artificial
  Oligomer
uucuaauaaacauguuugu

SEQ ID NO: 11556 - RNA, 19 nt, artificial
  Oligomer
uuacagacgcaugaaugua

SEQ ID NO: 11557 - RNA, 19 nt, artificial
  Oligomer
caggacgcacuugucuuag

SEQ ID NO: 11558 - RNA, 19 nt, artificial
  Oligomer
guguaucuuacuggucuga

SEQ ID NO: 11559 - RNA, 19 nt, artificial
  Oligomer
ucacuugggaucuuugaca

SEQ ID NO: 11560 - RNA, 19 nt, artificial
  Oligomer
uuguaucuuguuuuucuga

SEQ ID NO: 11561 - RNA, 19 nt, artificial
  Oligomer
cuugaaaaauuacaccugg

SEQ ID NO: 11562 - RNA, 19 nt, artificial
  Oligomer
caaguauuaagaccuaugc

SEQ ID NO: 11563 - RNA, 19 nt, artificial
  Oligomer
agaagcuguacagcucgga

SEQ ID NO: 11564 - RNA, 19 nt, artificial
  Oligomer
uguuacugacaguuaacag

SEQ ID NO: 11565 - RNA, 19 nt, artificial
  Oligomer
cugaggaugaacacuugug

SEQ ID NO: 11566 - RNA, 19 nt, artificial
  Oligomer
auugaggaguguugaacuu

SEQ ID NO: 11567 - RNA, 19 nt, artificial
  Oligomer
cuccaagacagagacgacu

SEQ ID NO: 11568 - RNA, 19 nt, artificial
  Oligomer
ugugguuggaaaacugagg

SEQ ID NO: 11569 - RNA, 19 nt, artificial
  Oligomer
gcagcuaucuuacagacgc

SEQ ID NO: 11570 - RNA, 19 nt, artificial
  Oligomer
gaucggagcaucacuacug

SEQ ID NO: 11571 - RNA, 19 nt, artificial
  Oligomer
guuaacaguggugugacau

SEQ ID NO: 11572 - RNA, 19 nt, artificial
  Oligomer
cuuguuuuucugaucggag

SEQ ID NO: 11573 - RNA, 19 nt, artificial
  Oligomer
agaagaagcuguacagcuc

SEQ ID NO: 11574 - RNA, 19 nt, artificial
  Oligomer
uguacugcagaguugagcu

SEQ ID NO: 11575 - RNA, 19 nt, artificial
  Oligomer
cacuugaaaaauuacaccu

SEQ ID NO: 11576 - RNA, 19 nt, artificial
  Oligomer
gaagauaagauacucacug

SEQ ID NO: 11577 - RNA, 19 nt, artificial
  Oligomer
aucuagaacuguuuacaug

SEQ ID NO: 11578 - RNA, 19 nt, artificial
  Oligomer
gggaauaguguuucccagg

SEQ ID NO: 11579 - RNA, 19 nt, artificial
  Oligomer
guucaucagcaaacgcccu

SEQ ID NO: 11580 - RNA, 19 nt, artificial
  Oligomer
acaaggcuuccagcuggau

SEQ ID NO: 11581 - RNA, 19 nt, artificial
  Oligomer
gaauguaagaguaggaagg

SEQ ID NO: 11582 - RNA, 19 nt, artificial
  Oligomer
cagcugcguuuaagccuuc

SEQ ID NO: 11583 - RNA, 19 nt, artificial
  Oligomer
guguuuguuguuuguuuug

SEQ ID NO: 11584 - RNA, 19 nt, artificial
  Oligomer
uuuuuguuacugacaguua

SEQ ID NO: 11585 - RNA, 19 nt, artificial
  Oligomer
aggacgcacuugucuuagc

SEQ ID NO: 11586 - RNA, 19 nt, artificial
  Oligomer
acccugaggaugaacacuu

SEQ ID NO: 11587 - RNA, 19 nt, artificial
  Oligomer
agacgacugaacuuuuggg

SEQ ID NO: 11588 - RNA, 19 nt, artificial
  Oligomer
ucuuacuggucugaaggga

SEQ ID NO: 11589 - RNA, 19 nt, artificial
  Oligomer
uuguuacugacaguuaaca

SEQ ID NO: 11590 - RNA, 19 nt, artificial
  Oligomer
cuguagcaugaaacaaagg

SEQ ID NO: 11591 - RNA, 19 nt, artificial
  Oligomer
acagagacgacugaacuuu

SEQ ID NO: 11592 - RNA, 19 nt, artificial
  Oligomer
uguucaaguauuaagaccu

SEQ ID NO: 11593 - RNA, 19 nt, artificial
  Oligomer
caggugggcaaagaacuac

SEQ ID NO: 11594 - RNA, 19 nt, artificial
  Oligomer
agcugagggacugauuccu

SEQ ID NO: 11595 - RNA, 19 nt, artificial
  Oligomer
auacucacuguucaugaau

SEQ ID NO: 11596 - RNA, 19 nt, artificial
  Oligomer
auuaagaccuaugcaauau

SEQ ID NO: 11597 - RNA, 19 nt, artificial
  Oligomer
cuuagcaguucucgcugac

SEQ ID NO: 11598 - RNA, 19 nt, artificial
  Oligomer
cacuugggaucuuugacac

SEQ ID NO: 11599 - RNA, 19 nt, artificial
  Oligomer
aagaagaagcuguacagcu

SEQ ID NO: 11600 - RNA, 19 nt, artificial
  Oligomer
uauuauuuuuguuacugac

SEQ ID NO: 11601 - RNA, 19 nt, artificial
  Oligomer
accuuauuauuuuuguuac

SEQ ID NO: 11602 - RNA, 19 nt, artificial
  Oligomer
aauaguguuucccaggaag

SEQ ID NO: 11603 - RNA, 19 nt, artificial
  Oligomer
uacuggucugaagggacca

SEQ ID NO: 11604 - RNA, 19 nt, artificial
  Oligomer
acaugaagauaagauacuc

SEQ ID NO: 11605 - RNA, 19 nt, artificial
  Oligomer
aucaagaagaagcuguaca

SEQ ID NO: 11606 - RNA, 19 nt, artificial
  Oligomer
guaucuuguuuuucugauc

SEQ ID NO: 11607 - RNA, 19 nt, artificial
  Oligomer
ucggagcaucacuacugac

SEQ ID NO: 11608 - RNA, 19 nt, artificial
  Oligomer
uguuuguuguuuguuuugu

SEQ ID NO: 11609 - RNA, 19 nt, artificial
  Oligomer
guuuuucugaucggagcau

SEQ ID NO: 11610 - RNA, 19 nt, artificial
  Oligomer
uggugugacauccagagag

SEQ ID NO: 11611 - RNA, 19 nt, artificial
  Oligomer
caugaaacaaaggcuuagg

SEQ ID NO: 11612 - RNA, 19 nt, artificial
  Oligomer
cgagucaucaagaagaagc

SEQ ID NO: 11613 - RNA, 19 nt, artificial
  Oligomer
uaguguuucccaggaagcu

SEQ ID NO: 11614 - RNA, 19 nt, artificial
  Oligomer
aguucaucagcaaacgccc

SEQ ID NO: 11615 - RNA, 19 nt, artificial
  Oligomer
ucuguccucaccaugccua

SEQ ID NO: 11616 - RNA, 19 nt, artificial
  Oligomer
cucaccaugccuagccuuu

SEQ ID NO: 11617 - RNA, 19 nt, artificial
  Oligomer
cugacaguuaacaguggug

SEQ ID NO: 11618 - RNA, 19 nt, artificial
  Oligomer
aucugggucuuccaucuag

SEQ ID NO: 11619 - RNA, 19 nt, artificial
  Oligomer
uucaaguauuaagaccuau

SEQ ID NO: 11620 - RNA, 19 nt, artificial
  Oligomer
ugggucuuccaucuagaac

SEQ ID NO: 11621 - RNA, 19 nt, artificial
  Oligomer
ucccaggaagcucauugag

SEQ ID NO: 11622 - RNA, 19 nt, artificial
  Oligomer
gguuggaaaacugaggcag

SEQ ID NO: 11623 - RNA, 19 nt, artificial
  Oligomer
ugaauguaagaguaggaag

SEQ ID NO: 11624 - RNA, 19 nt, artificial
  Oligomer
ggcagcuaucuuacagacg

SEQ ID NO: 11625 - RNA, 19 nt, artificial
  Oligomer
uuuguuacugacaguuaac

SEQ ID NO: 11626 - RNA, 19 nt, artificial
  Oligomer
guugaacuucaaccugagg

SEQ ID NO: 11627 - RNA, 19 nt, artificial
  Oligomer
guuggaaaacugaggcagc

SEQ ID NO: 11628 - RNA, 19 nt, artificial
  Oligomer
ugucuuagcaguucucgcu

SEQ ID NO: 11629 - RNA, 19 nt, artificial
  Oligomer
cuuacuggucugaagggac

SEQ ID NO: 11630 - RNA, 19 nt, artificial
  Oligomer
ugaccuguuguaggcagcu

SEQ ID NO: 11631 - RNA, 19 nt, artificial
  Oligomer
gcuaucuuacagacgcaug

SEQ ID NO: 11632 - RNA, 19 nt, artificial
  Oligomer
uuuguaucuuguuuuucug

SEQ ID NO: 11633 - RNA, 19 nt, artificial
  Oligomer
uacugacaguuaacagugg

SEQ ID NO: 11634 - RNA, 19 nt, artificial
  Oligomer
uugacacuugaaaaauuac

SEQ ID NO: 11635 - RNA, 19 nt, artificial
  Oligomer
cacuacugaccuguuguag

SEQ ID NO: 11636 - RNA, 19 nt, artificial
  Oligomer
ugacauccagagagcagcu

SEQ ID NO: 11637 - RNA, 19 nt, artificial
  Oligomer
acuuuucuaauaaacaugu

SEQ ID NO: 11638 - RNA, 19 nt, artificial
  Oligomer
auuauuuuuguuacugaca

SEQ ID NO: 11639 - RNA, 19 nt, artificial
  Oligomer
gaagaagcuguacagcucg

SEQ ID NO: 11640 - RNA, 19 nt, artificial
  Oligomer
gugggcaaagaacuacugc

SEQ ID NO: 11641 - RNA, 19 nt, artificial
  Oligomer
gcacuugucuuagcaguuc

SEQ ID NO: 11642 - RNA, 19 nt, artificial
  Oligomer
aucguguacugcagaguug

SEQ ID NO: 11643 - RNA, 19 nt, artificial
  Oligomer
ugcucauugaggaguguug

SEQ ID NO: 11644 - RNA, 19 nt, artificial
  Oligomer
ggaguguugaacuucaacc

SEQ ID NO: 11645 - RNA, 19 nt, artificial
  Oligomer
cuugggaucuuugacacuu

SEQ ID NO: 11646 - RNA, 19 nt, artificial
  Oligomer
ugagggacugauuccugug

SEQ ID NO: 11647 - RNA, 19 nt, artificial
  Oligomer
ucaaguauuaagaccuaug

SEQ ID NO: 11648 - RNA, 19 nt, artificial
  Oligomer
uugauguucaaguauuaag

SEQ ID NO: 11649 - RNA, 19 nt, artificial
  Oligomer
ucacuguucaugaauacac

SEQ ID NO: 11650 - RNA, 19 nt, artificial
  Oligomer
guuucccaggaagcucauu

SEQ ID NO: 11651 - RNA, 19 nt, artificial
  Oligomer
ucuuugacacuugaaaaau

SEQ ID NO: 11652 - RNA, 19 nt, artificial
  Oligomer
cuacugaccuguuguaggc

SEQ ID NO: 11653 - RNA, 19 nt, artificial
  Oligomer
caagaagaagcuguacagc

SEQ ID NO: 11654 - RNA, 19 nt, artificial
  Oligomer
aguguugaacuucaaccug

SEQ ID NO: 11655 - RNA, 19 nt, artificial
  Oligomer
augaagauaagauacucac

SEQ ID NO: 11656 - RNA, 19 nt, artificial
  Oligomer
uugggaucuuugacacuug

SEQ ID NO: 11657 - RNA, 19 nt, artificial
  Oligomer
acuugggaucuuugacacu

SEQ ID NO: 11658 - RNA, 19 nt, artificial
  Oligomer
ugacaguuaacaguggugu

SEQ ID NO: 11659 - RNA, 19 nt, artificial
  Oligomer
ucuaauaaacauguuuguu

SEQ ID NO: 11660 - RNA, 19 nt, artificial
  Oligomer
aacauguuuguuaaaacag

SEQ ID NO: 11661 - RNA, 19 nt, artificial
  Oligomer
acagcugcucauugaggag

SEQ ID NO: 11662 - RNA, 19 nt, artificial
  Oligomer
acuugucuuagcaguucuc

SEQ ID NO: 11663 - RNA, 19 nt, artificial
  Oligomer
aucacuacugaccuguugu

SEQ ID NO: 11664 - RNA, 19 nt, artificial
  Oligomer
ucaccaugccuagccuuug

SEQ ID NO: 11665 - RNA, 19 nt, artificial
  Oligomer
acuugaaaaauuacaccug

SEQ ID NO: 11666 - RNA, 19 nt, artificial
  Oligomer
uuguuuuucugaucggagc

SEQ ID NO: 11667 - RNA, 19 nt, artificial
  Oligomer
gcacucugaguucaucagc

SEQ ID NO: 11668 - RNA, 19 nt, artificial
  Oligomer
gucuuccaucuagaacugu

SEQ ID NO: 11669 - RNA, 19 nt, artificial
  Oligomer
uucgcacacccauucaagc

SEQ ID NO: 11670 - RNA, 19 nt, artificial
  Oligomer
uuguuuguuuuguaucuug

SEQ ID NO: 11671 - RNA, 19 nt, artificial
  Oligomer
uuuguuuuguaucuuguuu

SEQ ID NO: 11672 - RNA, 19 nt, artificial
  Oligomer
uacugaccuguuguaggca

SEQ ID NO: 11673 - RNA, 19 nt, artificial
  Oligomer
uacaugaagauaagauacu

SEQ ID NO: 11674 - RNA, 19 nt, artificial
  Oligomer
uuauuuuuguuacugacag

SEQ ID NO: 11675 - RNA, 19 nt, artificial
  Oligomer
acugaccuguuguaggcag

SEQ ID NO: 11676 - RNA, 19 nt, artificial
  Oligomer
uuguaggcagcuaucuuac

SEQ ID NO: 11677 - RNA, 19 nt, artificial
  Oligomer
ucuuacagacgcaugaaug

SEQ ID NO: 11678 - RNA, 19 nt, artificial
  Oligomer
uuguuuuguaucuuguuuu

SEQ ID NO: 11679 - RNA, 19 nt, artificial
  Oligomer
ucugaguucaucagcaaac

SEQ ID NO: 11680 - RNA, 19 nt, artificial
  Oligomer
uuacaugaagauaagauac

SEQ ID NO: 11681 - RNA, 19 nt, artificial
  Oligomer
agacgcaugaauguaagag

SEQ ID NO: 11682 - RNA, 19 nt, artificial
  Oligomer
uuccugugguuggaaaacu

SEQ ID NO: 11683 - RNA, 19 nt, artificial
  Oligomer
agucaucaagaagaagcug

SEQ ID NO: 11684 - RNA, 19 nt, artificial
  Oligomer
cugcucauugaggaguguu

SEQ ID NO: 11685 - RNA, 19 nt, artificial
  Oligomer
gucaucaagaagaagcugu

SEQ ID NO: 11686 - RNA, 19 nt, artificial
  Oligomer
aagcuguacagcucggaac

SEQ ID NO: 11687 - RNA, 19 nt, artificial
  Oligomer
uuaacaguggugugacauc

SEQ ID NO: 11688 - RNA, 19 nt, artificial
  Oligomer
acuacugaccuguuguagg

SEQ ID NO: 11689 - RNA, 19 nt, artificial
  Oligomer
agcugcucauugaggagug

SEQ ID NO: 11690 - RNA, 19 nt, artificial
  Oligomer
ggacugauuccugugguug

SEQ ID NO: 11691 - RNA, 19 nt, artificial
  Oligomer
uuucugaucggagcaucac

SEQ ID NO: 11692 - RNA, 19 nt, artificial
  Oligomer
guacugcagaguugagcug

SEQ ID NO: 11693 - RNA, 19 nt, artificial
  Oligomer
ugaguucaucagcaaacgc

SEQ ID NO: 11694 - RNA, 19 nt, artificial
  Oligomer
gaguucaucagcaaacgcc

SEQ ID NO: 11695 - RNA, 19 nt, artificial
  Oligomer
ucggaacagcugcucauug

SEQ ID NO: 11696 - RNA, 19 nt, artificial
  Oligomer
agugacccugaggaugaac

SEQ ID NO: 11697 - RNA, 19 nt, artificial
  Oligomer
gugguuggaaaacugaggc

SEQ ID NO: 11698 - RNA, 19 nt, artificial
  Oligomer
gauaagauacucacuguuc

SEQ ID NO: 11699 - RNA, 19 nt, artificial
  Oligomer
gaacagcugcucauugagg

SEQ ID NO: 11700 - RNA, 19 nt, artificial
  Oligomer
ucugaagggaccaagugug

SEQ ID NO: 11701 - RNA, 19 nt, artificial
  Oligomer
uacuuuucuaauaaacaug

SEQ ID NO: 11702 - RNA, 19 nt, artificial
  Oligomer
acacuugaaaaauuacacc

SEQ ID NO: 11703 - RNA, 19 nt, artificial
  Oligomer
uaucuuacuggucugaagg

SEQ ID NO: 11704 - RNA, 19 nt, artificial
  Oligomer
uccaucuagaacuguuuac

SEQ ID NO: 11705 - RNA, 19 nt, artificial
  Oligomer
caaagaacuacugcgccug

SEQ ID NO: 11706 - RNA, 19 nt, artificial
  Oligomer
aucacuugggaucuuugac

SEQ ID NO: 11707 - RNA, 19 nt, artificial
  Oligomer
gucuuagcaguucucgcug

SEQ ID NO: 11708 - RNA, 19 nt, artificial
  Oligomer
aaagaacuacugcgccugg

SEQ ID NO: 11709 - RNA, 19 nt, artificial
  Oligomer
auacacuugauguucaagu

SEQ ID NO: 11710 - RNA, 19 nt, artificial
  Oligomer
aggaagcucauugaguugu

SEQ ID NO: 11711 - RNA, 19 nt, artificial
  Oligomer
guguacugcagaguugagc

SEQ ID NO: 11712 - RNA, 19 nt, artificial
  Oligomer
ugugacauccagagagcag

SEQ ID NO: 11713 - RNA, 19 nt, artificial
  Oligomer
uugucuuagcaguucucgc

SEQ ID NO: 11714 - RNA, 19 nt, artificial
  Oligomer
uuggaaaacugaggcagcc

SEQ ID NO: 11715 - RNA, 19 nt, artificial
  Oligomer
uaacaguggugugacaucc

SEQ ID NO: 11716 - RNA, 19 nt, artificial
  Oligomer
uccaagacagagacgacug

SEQ ID NO: 11717 - RNA, 19 nt, artificial
  Oligomer
aguguuucccaggaagcuc

SEQ ID NO: 11718 - RNA, 19 nt, artificial
  Oligomer
aagaagcuguacagcucgg

SEQ ID NO: 11719 - RNA, 19 nt, artificial
  Oligomer
augaaacaaaggcuuaggg

SEQ ID NO: 11720 - RNA, 19 nt, artificial
  Oligomer
cuuauuauuuuuguuacug

SEQ ID NO: 11721 - RNA, 19 nt, artificial
  Oligomer
aucuuguuuuucugaucgg

SEQ ID NO: 11722 - RNA, 19 nt, artificial
  Oligomer
agcaucacuacugaccugu

SEQ ID NO: 11723 - RNA, 19 nt, artificial
  Oligomer
auguucaaguauuaagacc

SEQ ID NO: 11724 - RNA, 19 nt, artificial
  Oligomer
ucauugaggaguguugaac

SEQ ID NO: 11725 - RNA, 19 nt, artificial
  Oligomer
agcugcguuuaagccuucc

SEQ ID NO: 11726 - RNA, 19 nt, artificial
  Oligomer
uuacugacaguuaacagug

SEQ ID NO: 11727 - RNA, 19 nt, artificial
  Oligomer
auuccugugguuggaaaac

SEQ ID NO: 11728 - RNA, 19 nt, artificial
  Oligomer
aauacacuugauguucaag

SEQ ID NO: 11729 - RNA, 19 nt, artificial
  Oligomer
cuguucaugaauacacuug

SEQ ID NO: 11730 - RNA, 19 nt, artificial
  Oligomer
uuguuguuuguuuuguauc

SEQ ID NO: 11731 - RNA, 19 nt, artificial
  Oligomer
uuucuaauaaacauguuug

SEQ ID NO: 11732 - RNA, 19 nt, artificial
  Oligomer
aucuuacuggucugaaggg

SEQ ID NO: 11733 - RNA, 19 nt, artificial
  Oligomer
uuacuggucugaagggacc

SEQ ID NO: 11734 - RNA, 19 nt, artificial
  Oligomer
aagauacucacuguucaug

SEQ ID NO: 11735 - RNA, 19 nt, artificial
  Oligomer
auuuuuguuacugacaguu

SEQ ID NO: 11736 - RNA, 19 nt, artificial
  Oligomer
cagcugcucauugaggagu

SEQ ID NO: 11737 - RNA, 19 nt, artificial
  Oligomer
guuuuguaucuuguuuuuc

SEQ ID NO: 11738 - RNA, 19 nt, artificial
  Oligomer
auaguguuucccaggaagc

SEQ ID NO: 11739 - RNA, 19 nt, artificial
  Oligomer
uguagcaugaaacaaaggc

SEQ ID NO: 11740 - RNA, 19 nt, artificial
  Oligomer
ucagggaucacuugggauc

SEQ ID NO: 11741 - RNA, 19 nt, artificial
  Oligomer
aauguaagaguaggaaggg

SEQ ID NO: 11742 - RNA, 19 nt, artificial
  Oligomer
uucaugaauacacuugaug

SEQ ID NO: 11743 - RNA, 19 nt, artificial
  Oligomer
uuuuucugaucggagcauc

SEQ ID NO: 11744 - RNA, 19 nt, artificial
  Oligomer
cuugucuuagcaguucucg

SEQ ID NO: 11745 - RNA, 19 nt, artificial
  Oligomer
auguaccuuauuauuuuug

SEQ ID NO: 11746 - RNA, 19 nt, artificial
  Oligomer
uaucuuguuuuucugaucg

SEQ ID NO: 11747 - RNA, 19 nt, artificial
  Oligomer
uuucccaggaagcucauug

SEQ ID NO: 11748 - RNA, 19 nt, artificial
  Oligomer
uacugcagaguugagcugg

SEQ ID NO: 11749 - RNA, 19 nt, artificial
  Oligomer
augaauacacuugauguuc

SEQ ID NO: 11750 - RNA, 19 nt, artificial
  Oligomer
uuagcaguucucgcugacc

SEQ ID NO: 11751 - RNA, 19 nt, artificial
  Oligomer
uugaggaguguugaacuuc

SEQ ID NO: 11752 - RNA, 19 nt, artificial
  Oligomer
uucaucagcaaacgcccug

SEQ ID NO: 11753 - RNA, 19 nt, artificial
  Oligomer
uugaacuucaaccugaggg

SEQ ID NO: 11754 - RNA, 19 nt, artificial
  Oligomer
gugccaaccugaugcagcu

SEQ ID NO: 11755 - RNA, 19 nt, artificial
  Oligomer
uugaaguucaacacuccuc

SEQ ID NO: 11756 - RNA, 19 nt, artificial
  Oligomer
uucauccucagggucacug

SEQ ID NO: 11757 - RNA, 19 nt, artificial
  Oligomer
uucauguaaacaguucuag

SEQ ID NO: 11758 - RNA, 19 nt, artificial
  Oligomer
uaguucuuugcccaccugg

SEQ ID NO: 11759 - RNA, 19 nt, artificial
  Oligomer
uucaugaacagugaguauc

SEQ ID NO: 11760 - RNA, 19 nt, artificial
  Oligomer
uucuagauggaagacccag

SEQ ID NO: 11761 - RNA, 19 nt, artificial
  Oligomer
uugaacaucaaguguauuc

SEQ ID NO: 11762 - RNA, 19 nt, artificial
  Oligomer
uucuugaugacucggaagc

SEQ ID NO: 11763 - RNA, 19 nt, artificial
  Oligomer
uucuucuugaugacucgga

SEQ ID NO: 11764 - RNA, 19 nt, artificial
  Oligomer
uaagacaagugcguccugc

SEQ ID NO: 11765 - RNA, 19 nt, artificial
  Oligomer
uacaaaacaaacaacaaac

SEQ ID NO: 11766 - RNA, 19 nt, artificial
  Oligomer
uuucaagugucaaagaucc

SEQ ID NO: 11767 - RNA, 19 nt, artificial
  Oligomer
ugcgucuguaagauagcug

SEQ ID NO: 11768 - RNA, 19 nt, artificial
  Oligomer
ugucacaccacuguuaacu

SEQ ID NO: 11769 - RNA, 19 nt, artificial
  Oligomer
ugcuaagacaagugcgucc

SEQ ID NO: 11770 - RNA, 19 nt, artificial
  Oligomer
uugaaugggugugcgaacc

SEQ ID NO: 11771 - RNA, 19 nt, artificial
  Oligomer
uaauacuugaacaucaagu

SEQ ID NO: 11772 - RNA, 19 nt, artificial
  Oligomer
aaaauaauaagguacaugc

SEQ ID NO: 11773 - RNA, 19 nt, artificial
  Oligomer
uuaacugucaguaacaaaa

SEQ ID NO: 11774 - RNA, 19 nt, artificial
  Oligomer
aguguauucaugaacagug

SEQ ID NO: 11775 - RNA, 19 nt, artificial
  Oligomer
ucuggaugucacaccacug

SEQ ID NO: 11776 - RNA, 19 nt, artificial
  Oligomer
ucaaugagcagcuguuccg

SEQ ID NO: 11777 - RNA, 19 nt, artificial
  Oligomer
uuuuccaaccacaggaauc

SEQ ID NO: 11778 - RNA, 19 nt, artificial
  Oligomer
uucaacacuccucaaugag

SEQ ID NO: 11779 - RNA, 19 nt, artificial
  Oligomer
uaggucuuaauacuugaac

SEQ ID NO: 11780 - RNA, 19 nt, artificial
  Oligomer
ucuuaauacuugaacauca

SEQ ID NO: 11781 - RNA, 19 nt, artificial
  Oligomer
ucuucauguaaacaguucu

SEQ ID NO: 11782 - RNA, 19 nt, artificial
  Oligomer
aacucaaugagcuuccugg

SEQ ID NO: 11783 - RNA, 19 nt, artificial
  Oligomer
uuccgagcuguacagcuuc

SEQ ID NO: 11784 - RNA, 19 nt, artificial
  Oligomer
uuuguuucaugcuacagua

SEQ ID NO: 11785 - RNA, 19 nt, artificial
  Oligomer
uuuucaagugucaaagauc

SEQ ID NO: 11786 - RNA, 19 nt, artificial
  Oligomer
ugaaguucaacacuccuca

SEQ ID NO: 11787 - RNA, 19 nt, artificial
  Oligomer
uacucuuacauucaugcgu

SEQ ID NO: 11788 - RNA, 19 nt, artificial
  Oligomer
uucagucgucucugucuug

SEQ ID NO: 11789 - RNA, 19 nt, artificial
  Oligomer
cuuaucuucauguaaacag

SEQ ID NO: 11790 - RNA, 19 nt, artificial
  Oligomer
uuugcugaugaacucagag

SEQ ID NO: 11791 - RNA, 19 nt, artificial
  Oligomer
ugaugaacucagagugccg

SEQ ID NO: 11792 - RNA, 19 nt, artificial
  Oligomer
ugcugaugaacucagagug

SEQ ID NO: 11793 - RNA, 19 nt, artificial
  Oligomer
ucagucgucucugucuugg

SEQ ID NO: 11794 - RNA, 19 nt, artificial
  Oligomer
aaaaguucagucgucucug

SEQ ID NO: 11795 - RNA, 19 nt, artificial
  Oligomer
uguuuuaacaaacauguuu

SEQ ID NO: 11796 - RNA, 19 nt, artificial
  Oligomer
uuccugggaaacacuauuc

SEQ ID NO: 11797 - RNA, 19 nt, artificial
  Oligomer
auaauaagguacaugcuac

SEQ ID NO: 11798 - RNA, 19 nt, artificial
  Oligomer
ucuuacauucaugcgucug

SEQ ID NO: 11799 - RNA, 19 nt, artificial
  Oligomer
uucaagugucaaagauccc

SEQ ID NO: 11800 - RNA, 19 nt, artificial
  Oligomer
aaguucagucgucucuguc

SEQ ID NO: 11801 - RNA, 19 nt, artificial
  Oligomer
ucaguuuuccaaccacagg

SEQ ID NO: 11802 - RNA, 19 nt, artificial
  Oligomer
auguaaacaguucuagaug

SEQ ID NO: 11803 - RNA, 19 nt, artificial
  Oligomer
aaccacaggaaucaguccc

SEQ ID NO: 11804 - RNA, 19 nt, artificial
  Oligomer
ucuagauggaagacccaga

SEQ ID NO: 11805 - RNA, 19 nt, artificial
  Oligomer
aacugcuaagacaagugcg

SEQ ID NO: 11806 - RNA, 19 nt, artificial
  Oligomer
aucaaguguauucaugaac

SEQ ID NO: 11807 - RNA, 19 nt, artificial
  Oligomer
uuucaugcuacaguacuga

SEQ ID NO: 11808 - RNA, 19 nt, artificial
  Oligomer
aaaaauauugcauaggucu

SEQ ID NO: 11809 - RNA, 19 nt, artificial
  Oligomer
uuaucuucauguaaacagu

SEQ ID NO: 11810 - RNA, 19 nt, artificial
  Oligomer
aucuucauguaaacaguuc

SEQ ID NO: 11811 - RNA, 19 nt, artificial
  Oligomer
agcuucuucuugaugacuc

SEQ ID NO: 11812 - RNA, 19 nt, artificial
  Oligomer
uuaauacuugaacaucaag

SEQ ID NO: 11813 - RNA, 19 nt, artificial
  Oligomer
uguuucaugcuacaguacu

SEQ ID NO: 11814 - RNA, 19 nt, artificial
  Oligomer
aguucuagauggaagaccc

SEQ ID NO: 11815 - RNA, 19 nt, artificial
  Oligomer
ucaugcuacaguacugagg

SEQ ID NO: 11816 - RNA, 19 nt, artificial
  Oligomer
uugcugaugaacucagagu

SEQ ID NO: 11817 - RNA, 19 nt, artificial
  Oligomer
uugcauaggucuuaauacu

SEQ ID NO: 11818 - RNA, 19 nt, artificial
  Oligomer
uacagcuucuucuugauga

SEQ ID NO: 11819 - RNA, 19 nt, artificial
  Oligomer
aacuguuuuaacaaacaug

SEQ ID NO: 11820 - RNA, 19 nt, artificial
  Oligomer
aaaaauaauaagguacaug

SEQ ID NO: 11821 - RNA, 19 nt, artificial
  Oligomer
cucaacucugcaguacacg

SEQ ID NO: 11822 - RNA, 19 nt, artificial
  Oligomer
ucaugcgucuguaagauag

SEQ ID NO: 11823 - RNA, 19 nt, artificial
  Oligomer
uccuacucuuacauucaug

SEQ ID NO: 11824 - RNA, 19 nt, artificial
  Oligomer
ucagguugaaguucaacac

SEQ ID NO: 11825 - RNA, 19 nt, artificial
  Oligomer
cuucagaccaguaagauac

SEQ ID NO: 11826 - RNA, 19 nt, artificial
  Oligomer
caaguguucauccucaggg

SEQ ID NO: 11827 - RNA, 19 nt, artificial
  Oligomer
uauugcauaggucuuaaua

SEQ ID NO: 11828 - RNA, 19 nt, artificial
  Oligomer
uaagauagcugccuacaac

SEQ ID NO: 11829 - RNA, 19 nt, artificial
  Oligomer
ucaacacuccucaaugagc

SEQ ID NO: 11830 - RNA, 19 nt, artificial
  Oligomer
ucaguagugaugcuccgau

SEQ ID NO: 11831 - RNA, 19 nt, artificial
  Oligomer
aggucaguagugaugcucc

SEQ ID NO: 11832 - RNA, 19 nt, artificial
  Oligomer
ucaagugucaaagauccca

SEQ ID NO: 11833 - RNA, 19 nt, artificial
  Oligomer
uuuccaaccacaggaauca

SEQ ID NO: 11834 - RNA, 19 nt, artificial
  Oligomer
uuguuucaugcuacaguac

SEQ ID NO: 11835 - RNA, 19 nt, artificial
  Oligomer
ugaguaucuuaucuucaug

SEQ ID NO: 11836 - RNA, 19 nt, artificial
  Oligomer
aacucugcaguacacgaug

SEQ ID NO: 11837 - RNA, 19 nt, artificial
  Oligomer
ucuugaugacucggaagcc

SEQ ID NO: 11838 - RNA, 19 nt, artificial
  Oligomer
cuuuguuucaugcuacagu

SEQ ID NO: 11839 - RNA, 19 nt, artificial
  Oligomer
uauucaugaacagugagua

SEQ ID NO: 11840 - RNA, 19 nt, artificial
  Oligomer
uagugaugcuccgaucaga

SEQ ID NO: 11841 - RNA, 19 nt, artificial
  Oligomer
auugcauaggucuuaauac

SEQ ID NO: 11842 - RNA, 19 nt, artificial
  Oligomer
ucaaagaucccaagugauc

SEQ ID NO: 11843 - RNA, 19 nt, artificial
  Oligomer
uaaaaaauauugcauaggu

SEQ ID NO: 11844 - RNA, 19 nt, artificial
  Oligomer
ucauguaaacaguucuaga

SEQ ID NO: 11845 - RNA, 19 nt, artificial
  Oligomer
uucaugcuacaguacugag

SEQ ID NO: 11846 - RNA, 19 nt, artificial
  Oligomer
ugcauaggucuuaauacuu

SEQ ID NO: 11847 - RNA, 19 nt, artificial
  Oligomer
uguaaacaguucuagaugg

SEQ ID NO: 11848 - RNA, 19 nt, artificial
  Oligomer
cucagguugaaguucaaca

SEQ ID NO: 11849 - RNA, 19 nt, artificial
  Oligomer
aacaaaaauaauaagguac

SEQ ID NO: 11850 - RNA, 19 nt, artificial
  Oligomer
ucaacucugcaguacacga

SEQ ID NO: 11851 - RNA, 19 nt, artificial
  Oligomer
acuguuuuaacaaacaugu

SEQ ID NO: 11852 - RNA, 19 nt, artificial
  Oligomer
aguaacaaaaauaauaagg

SEQ ID NO: 11853 - RNA, 19 nt, artificial
  Oligomer
aacaggucaguagugaugc

SEQ ID NO: 11854 - RNA, 19 nt, artificial
  Oligomer
aaacaguucuagauggaag

SEQ ID NO: 11855 - RNA, 19 nt, artificial
  Oligomer
aguucaacacuccucaaug

SEQ ID NO: 11856 - RNA, 19 nt, artificial
  Oligomer
uuacauucaugcgucugua

SEQ ID NO: 11857 - RNA, 19 nt, artificial
  Oligomer
ucaaguguauucaugaaca

SEQ ID NO: 11858 - RNA, 19 nt, artificial
  Oligomer
ugaacagugaguaucuuau

SEQ ID NO: 11859 - RNA, 19 nt, artificial
  Oligomer
aauuuuucaagugucaaag

SEQ ID NO: 11860 - RNA, 19 nt, artificial
  Oligomer
aguucagucgucucugucu

SEQ ID NO: 11861 - RNA, 19 nt, artificial
  Oligomer
ucaugaacagugaguaucu

SEQ ID NO: 11862 - RNA, 19 nt, artificial
  Oligomer
uccugggaaacacuauucc

SEQ ID NO: 11863 - RNA, 19 nt, artificial
  Oligomer
aaaaaauauugcauagguc

SEQ ID NO: 11864 - RNA, 19 nt, artificial
  Oligomer
acucuuacauucaugcguc

SEQ ID NO: 11865 - RNA, 19 nt, artificial
  Oligomer
augaacagugaguaucuua

SEQ ID NO: 11866 - RNA, 19 nt, artificial
  Oligomer
aacaucaaguguauucaug

SEQ ID NO: 11867 - RNA, 19 nt, artificial
  Oligomer
uaucuucauguaaacaguu

SEQ ID NO: 11868 - RNA, 19 nt, artificial
  Oligomer
uguuccgagcuguacagcu

SEQ ID NO: 11869 - RNA, 19 nt, artificial
  Oligomer
acaaguguucauccucagg

SEQ ID NO: 11870 - RNA, 19 nt, artificial
  Oligomer
cucaguuuuccaaccacag

SEQ ID NO: 11871 - RNA, 19 nt, artificial
  Oligomer
aaggcuuaaacgcagcugc

SEQ ID NO: 11872 - RNA, 19 nt, artificial
  Oligomer
agauggaagacccagaugg

SEQ ID NO: 11873 - RNA, 19 nt, artificial
  Oligomer
ugaugcuccgaucagaaaa

SEQ ID NO: 11874 - RNA, 19 nt, artificial
  Oligomer
uccaaccacaggaaucagu

SEQ ID NO: 11875 - RNA, 19 nt, artificial
  Oligomer
uaagccuuuguuucaugcu

SEQ ID NO: 11876 - RNA, 19 nt, artificial
  Oligomer
uaauaagguacaugcuaca

SEQ ID NO: 11877 - RNA, 19 nt, artificial
  Oligomer
uccagcuggaagccuuguu

SEQ ID NO: 11878 - RNA, 19 nt, artificial
  Oligomer
auagcugccuacaacaggu

SEQ ID NO: 11879 - RNA, 19 nt, artificial
  Oligomer
aguaguucuuugcccaccu

SEQ ID NO: 11880 - RNA, 19 nt, artificial
  Oligomer
agguugaaguucaacacuc

SEQ ID NO: 11881 - RNA, 19 nt, artificial
  Oligomer
uacuugaacaucaagugua

SEQ ID NO: 11882 - RNA, 19 nt, artificial
  Oligomer
aauaauaagguacaugcua

SEQ ID NO: 11883 - RNA, 19 nt, artificial
  Oligomer
acuuggucccuucagacca

SEQ ID NO: 11884 - RNA, 19 nt, artificial
  Oligomer
uagcugccuacaacagguc

SEQ ID NO: 11885 - RNA, 19 nt, artificial
  Oligomer
uggaugucacaccacuguu

SEQ ID NO: 11886 - RNA, 19 nt, artificial
  Oligomer
ucuguaagauagcugccua

SEQ ID NO: 11887 - RNA, 19 nt, artificial
  Oligomer
augaacucagagugccgga

SEQ ID NO: 11888 - RNA, 19 nt, artificial
  Oligomer
uagauggaagacccagaug

SEQ ID NO: 11889 - RNA, 19 nt, artificial
  Oligomer
acaggaaucagucccucag

SEQ ID NO: 11890 - RNA, 19 nt, artificial
  Oligomer
ucaaugagcuuccugggaa

SEQ ID NO: 11891 - RNA, 19 nt, artificial
  Oligomer
uguaauuuuucaaguguca

SEQ ID NO: 11892 - RNA, 19 nt, artificial
  Oligomer
cuucuucuugaugacucgg

SEQ ID NO: 11893 - RNA, 19 nt, artificial
  Oligomer
aaucagucccucagcuccu

SEQ ID NO: 11894 - RNA, 19 nt, artificial
  Oligomer
auccagguaagccgugucu

SEQ ID NO: 11895 - RNA, 19 nt, artificial
  Oligomer
uccagguaagccgugucuu

SEQ ID NO: 11896 - RNA, 19 nt, artificial
  Oligomer
ucucuggaugucacaccac

SEQ ID NO: 11897 - RNA, 19 nt, artificial
  Oligomer
aagauagcugccuacaaca

SEQ ID NO: 11898 - RNA, 19 nt, artificial
  Oligomer
uucaugcgucuguaagaua

SEQ ID NO: 11899 - RNA, 19 nt, artificial
  Oligomer
uaucuuaucuucauguaaa

SEQ ID NO: 11900 - RNA, 19 nt, artificial
  Oligomer
ucuucuugaugacucggaa

SEQ ID NO: 11901 - RNA, 19 nt, artificial
  Oligomer
uguaagauagcugccuaca

SEQ ID NO: 11902 - RNA, 19 nt, artificial
  Oligomer
uacaacaggucaguaguga

SEQ ID NO: 11903 - RNA, 19 nt, artificial
  Oligomer
ucacugagcagcucgaagu

SEQ ID NO: 11904 - RNA, 19 nt, artificial
  Oligomer
caguucuagauggaagacc

SEQ ID NO: 11905 - RNA, 19 nt, artificial
  Oligomer
cacaacucaaugagcuucc

SEQ ID NO: 11906 - RNA, 19 nt, artificial
  Oligomer
ucccaagugaucccugaca

SEQ ID NO: 11907 - RNA, 19 nt, artificial
  Oligomer
uguauucaugaacagugag

SEQ ID NO: 11908 - RNA, 19 nt, artificial
  Oligomer
acauucaugcgucuguaag

SEQ ID NO: 11909 - RNA, 19 nt, artificial
  Oligomer
uuccaaccacaggaaucag

SEQ ID NO: 11910 - RNA, 19 nt, artificial
  Oligomer
aagugaucccugacaccca

SEQ ID NO: 11911 - RNA, 19 nt, artificial
  Oligomer
aauacuugaacaucaagug

SEQ ID NO: 11912 - RNA, 19 nt, artificial
  Oligomer
uaauuuuucaagugucaaa

SEQ ID NO: 11913 - RNA, 19 nt, artificial
  Oligomer
aaaaacaagauacaaaaca

SEQ ID NO: 11914 - RNA, 19 nt, artificial
  Oligomer
uaacaaacauguuuauuag

SEQ ID NO: 11915 - RNA, 19 nt, artificial
  Oligomer
cuaagccuuuguuucaugc

SEQ ID NO: 11916 - RNA, 19 nt, artificial
  Oligomer
aacaagauacaaaacaaac

SEQ ID NO: 11917 - RNA, 19 nt, artificial
  Oligomer
aauaagguacaugcuacac

SEQ ID NO: 11918 - RNA, 19 nt, artificial
  Oligomer
agugaguaucuuaucuuca

SEQ ID NO: 11919 - RNA, 19 nt, artificial
  Oligomer
agaacugcuaagacaagug

SEQ ID NO: 11920 - RNA, 19 nt, artificial
  Oligomer
aaaauauugcauaggucuu

SEQ ID NO: 11921 - RNA, 19 nt, artificial
  Oligomer
agauacaaaacaaacaaca

SEQ ID NO: 11922 - RNA, 19 nt, artificial
  Oligomer
cucaaugagcagcuguucc

SEQ ID NO: 11923 - RNA, 19 nt, artificial
  Oligomer
caguaguucuuugcccacc

SEQ ID NO: 11924 - RNA, 19 nt, artificial
  Oligomer
ugaacaucaaguguauuca

SEQ ID NO: 11925 - RNA, 19 nt, artificial
  Oligomer
caggucaguagugaugcuc

SEQ ID NO: 11926 - RNA, 19 nt, artificial
  Oligomer
aacauguuuauuagaaaag

SEQ ID NO: 11927 - RNA, 19 nt, artificial
  Oligomer
aaauauugcauaggucuua

SEQ ID NO: 11928 - RNA, 19 nt, artificial
  Oligomer
ucauccucagggucacuga

SEQ ID NO: 11929 - RNA, 19 nt, artificial
  Oligomer
agccuuuguuucaugcuac

SEQ ID NO: 11930 - RNA, 19 nt, artificial
  Oligomer
caaaaguucagucgucucu

SEQ ID NO: 11931 - RNA, 19 nt, artificial
  Oligomer
agugaugcuccgaucagaa

SEQ ID NO: 11932 - RNA, 19 nt, artificial
  Oligomer
ugagcuuccugggaaacac

SEQ ID NO: 11933 - RNA, 19 nt, artificial
  Oligomer
acauccagcuggaagccuu

SEQ ID NO: 11934 - RNA, 19 nt, artificial
  Oligomer
cuuacauucaugcgucugu

SEQ ID NO: 11935 - RNA, 19 nt, artificial
  Oligomer
uguucauccucagggucac

SEQ ID NO: 11936 - RNA, 19 nt, artificial
  Oligomer
gauagcugccuacaacagg

SEQ ID NO: 11937 - RNA, 19 nt, artificial
  Oligomer
uaaacaguucuagauggaa

SEQ ID NO: 11938 - RNA, 19 nt, artificial
  Oligomer
uccgaucagaaaaacaaga

SEQ ID NO: 11939 - RNA, 19 nt, artificial
  Oligomer
auacaaaacaaacaacaaa

SEQ ID NO: 11940 - RNA, 19 nt, artificial
  Oligomer
guguucauccucaggguca

SEQ ID NO: 11941 - RNA, 19 nt, artificial
  Oligomer
uuuuucaagugucaaagau

SEQ ID NO: 11942 - RNA, 19 nt, artificial
  Oligomer
ugcuccgaucagaaaaaca

SEQ ID NO: 11943 - RNA, 19 nt, artificial
  Oligomer
acucaaugagcuuccuggg

SEQ ID NO: 11944 - RNA, 19 nt, artificial
  Oligomer
caaagaucccaagugaucc

SEQ ID NO: 11945 - RNA, 19 nt, artificial
  Oligomer
cacaccacuguuaacuguc

SEQ ID NO: 11946 - RNA, 19 nt, artificial
  Oligomer
ucuuaucuucauguaaaca

SEQ ID NO: 11947 - RNA, 19 nt, artificial
  Oligomer
uuggucccuucagaccagu

SEQ ID NO: 11948 - RNA, 19 nt, artificial
  Oligomer
aaagaucccaagugauccc

SEQ ID NO: 11949 - RNA, 19 nt, artificial
  Oligomer
ucacaccacuguuaacugu

SEQ ID NO: 11950 - RNA, 19 nt, artificial
  Oligomer
cuugaaugggugugcgaac

SEQ ID NO: 11951 - RNA, 19 nt, artificial
  Oligomer
aacaguucuagauggaaga

SEQ ID NO: 11952 - RNA, 19 nt, artificial
  Oligomer
cuacucuuacauucaugcg

SEQ ID NO: 11953 - RNA, 19 nt, artificial
  Oligomer
ugcucucuggaugucacac

SEQ ID NO: 11954 - RNA, 19 nt, artificial
  Oligomer
ccaaccacaggaaucaguc

SEQ ID NO: 11955 - RNA, 19 nt, artificial
  Oligomer
uuccuacucuuacauucau

SEQ ID NO: 11956 - RNA, 19 nt, artificial
  Oligomer
acugcuaagacaagugcgu

SEQ ID NO: 11957 - RNA, 19 nt, artificial
  Oligomer
augagcuuccugggaaaca

SEQ ID NO: 11958 - RNA, 19 nt, artificial
  Oligomer
agguaagccgugucuuccu

SEQ ID NO: 11959 - RNA, 19 nt, artificial
  Oligomer
cugcuaagacaagugcguc

SEQ ID NO: 11960 - RNA, 19 nt, artificial
  Oligomer
acaucaaguguauucauga

SEQ ID NO: 11961 - RNA, 19 nt, artificial
  Oligomer
aguagugaugcuccgauca

SEQ ID NO: 11962 - RNA, 19 nt, artificial
  Oligomer
gucuuaauacuugaacauc

SEQ ID NO: 11963 - RNA, 19 nt, artificial
  Oligomer
gucacaccacuguuaacug

SEQ ID NO: 11964 - RNA, 19 nt, artificial
  Oligomer
cuguacagcuucuucuuga

SEQ ID NO: 11965 - RNA, 19 nt, artificial
  Oligomer
guauucaugaacagugagu

SEQ ID NO: 11966 - RNA, 19 nt, artificial
  Oligomer
cugaugaacucagagugcc

SEQ ID NO: 11967 - RNA, 19 nt, artificial
  Oligomer
aguguucauccucaggguc

SEQ ID NO: 11968 - RNA, 19 nt, artificial
  Oligomer
guuuuaacaaacauguuua

SEQ ID NO: 11969 - RNA, 19 nt, artificial
  Oligomer
ugccucaguuuuccaacca

SEQ ID NO: 11970 - RNA, 19 nt, artificial
  Oligomer
cuucuugaugacucggaag

SEQ ID NO: 11971 - RNA, 19 nt, artificial
  Oligomer
uucagaccaguaagauaca

SEQ ID NO: 11972 - RNA, 19 nt, artificial
  Oligomer
caguuuuccaaccacagga

SEQ ID NO: 11973 - RNA, 19 nt, artificial
  Oligomer
aagaucccaagugaucccu

SEQ ID NO: 11974 - RNA, 19 nt, artificial
  Oligomer
ccuacucuuacauucaugc

SEQ ID NO: 11975 - RNA, 19 nt, artificial
  Oligomer
acuguuaacugucaguaac

SEQ ID NO: 11976 - RNA, 19 nt, artificial
  Oligomer
uccucaaugagcagcuguu

SEQ ID NO: 11977 - RNA, 19 nt, artificial
  Oligomer
aacagugaguaucuuaucu

SEQ ID NO: 11978 - RNA, 19 nt, artificial
  Oligomer
cguuugcugaugaacucag

SEQ ID NO: 11979 - RNA, 19 nt, artificial
  Oligomer
cucuggaugucacaccacu

SEQ ID NO: 11980 - RNA, 19 nt, artificial
  Oligomer
cuggaugucacaccacugu

SEQ ID NO: 11981 - RNA, 19 nt, artificial
  Oligomer
gucuguaagauagcugccu

SEQ ID NO: 11982 - RNA, 19 nt, artificial
  Oligomer
acaaaaauaauaagguaca

SEQ ID NO: 11983 - RNA, 19 nt, artificial
  Oligomer
guguaauuuuucaaguguc

SEQ ID NO: 11984 - RNA, 19 nt, artificial
  Oligomer
acagugaguaucuuaucuu

SEQ ID NO: 11985 - RNA, 19 nt, artificial
  Oligomer
guugaaguucaacacuccu

SEQ ID NO: 11986 - RNA, 19 nt, artificial
  Oligomer
agcuguuccgagcuguaca

SEQ ID NO: 11987 - RNA, 19 nt, artificial
  Oligomer
acacuuggucccuucagac

SEQ ID NO: 11988 - RNA, 19 nt, artificial
  Oligomer
guuucaugcuacaguacug

SEQ ID NO: 11989 - RNA, 19 nt, artificial
  Oligomer
caacucaaugagcuuccug

SEQ ID NO: 11990 - RNA, 19 nt, artificial
  Oligomer
accacaggaaucagucccu

SEQ ID NO: 11991 - RNA, 19 nt, artificial
  Oligomer
aggcgcaguaguucuuugc

SEQ ID NO: 11992 - RNA, 19 nt, artificial
  Oligomer
aaugagcagcuguuccgag

SEQ ID NO: 11993 - RNA, 19 nt, artificial
  Oligomer
acucugcaguacacgaugg

SEQ ID NO: 11994 - RNA, 19 nt, artificial
  Oligomer
guucagucgucucugucuu

SEQ ID NO: 11995 - RNA, 19 nt, artificial
  Oligomer
agaucccaagugaucccug

SEQ ID NO: 11996 - RNA, 19 nt, artificial
  Oligomer
cuguaagauagcugccuac

SEQ ID NO: 11997 - RNA, 19 nt, artificial
  Oligomer
aagccuuuguuucaugcua

SEQ ID NO: 11998 - RNA, 19 nt, artificial
  Oligomer
aaguguauucaugaacagu

SEQ ID NO: 11999 - RNA, 19 nt, artificial
  Oligomer
aucccaagugaucccugac

SEQ ID NO: 12000 - RNA, 19 nt, artificial
  Oligomer
aauauugcauaggucuuaa

SEQ ID NO: 12001 - RNA, 19 nt, artificial
  Oligomer
guaaaaaauauugcauagg

SEQ ID NO: 12002 - RNA, 19 nt, artificial
  Oligomer
agaaaaacaagauacaaaa

SEQ ID NO: 12003 - RNA, 19 nt, artificial
  Oligomer
acacuccucaaugagcagc

SEQ ID NO: 12004 - RNA, 19 nt, artificial
  Oligomer
cuucauguaaacaguucua

SEQ ID NO: 12005 - RNA, 19 nt, artificial
  Oligomer
accacuguuaacugucagu

SEQ ID NO: 12006 - RNA, 19 nt, artificial
  Oligomer
ccaaaaguucagucgucuc

SEQ ID NO: 12007 - RNA, 19 nt, artificial
  Oligomer
augcgucuguaagauagcu

SEQ ID NO: 12008 - RNA, 19 nt, artificial
  Oligomer
aagauacaaaacaaacaac

SEQ ID NO: 12009 - RNA, 19 nt, artificial
  Oligomer
guacagcuucuucuugaug

SEQ ID NO: 12010 - RNA, 19 nt, artificial
  Oligomer
auacuugaacaucaagugu

SEQ ID NO: 12011 - RNA, 19 nt, artificial
  Oligomer
acugucaguaacaaaaaua

SEQ ID NO: 12012 - RNA, 19 nt, artificial
  Oligomer
caugcuacaguacugaggg

SEQ ID NO: 12013 - RNA, 19 nt, artificial
  Oligomer
aaauaauaagguacaugcu

SEQ ID NO: 12014 - RNA, 19 nt, artificial
  Oligomer
auucaugcgucuguaagau

SEQ ID NO: 12015 - RNA, 19 nt, artificial
  Oligomer
acaagauacaaaacaaaca

SEQ ID NO: 12016 - RNA, 19 nt, artificial
  Oligomer
aucuuaucuucauguaaac

SEQ ID NO: 12017 - RNA, 19 nt, artificial
  Oligomer
ucagcgagaacugcuaaga

SEQ ID NO: 12018 - RNA, 19 nt, artificial
  Oligomer
gaaaaguaaaaaauauugc

SEQ ID NO: 12019 - RNA, 19 nt, artificial
  Oligomer
cgcaguaguucuuugccca

SEQ ID NO: 12020 - RNA, 19 nt, artificial
  Oligomer
guagugaugcuccgaucag

SEQ ID NO: 12021 - RNA, 19 nt, artificial
  Oligomer
caacaggucaguagugaug

SEQ ID NO: 12022 - RNA, 19 nt, artificial
  Oligomer
aucagaaaaacaagauaca

SEQ ID NO: 12023 - RNA, 19 nt, artificial
  Oligomer
agauagcugccuacaacag

SEQ ID NO: 12024 - RNA, 19 nt, artificial
  Oligomer
aguaaaaaauauugcauag

SEQ ID NO: 12025 - RNA, 19 nt, artificial
  Oligomer
acaaacauguuuauuagaa

SEQ ID NO: 12026 - RNA, 19 nt, artificial
  Oligomer
uacauucaugcgucuguaa

SEQ ID NO: 12027 - RNA, 19 nt, artificial
  Oligomer
cuaagacaagugcguccug

SEQ ID NO: 12028 - RNA, 19 nt, artificial
  Oligomer
ucagaccaguaagauacac

SEQ ID NO: 12029 - RNA, 19 nt, artificial
  Oligomer
ugucaaagaucccaaguga

SEQ ID NO: 12030 - RNA, 19 nt, artificial
  Oligomer
ucagaaaaacaagauacaa

SEQ ID NO: 12031 - RNA, 19 nt, artificial
  Oligomer
ccagguguaauuuuucaag

SEQ ID NO: 12032 - RNA, 19 nt, artificial
  Oligomer
gcauaggucuuaauacuug

SEQ ID NO: 12033 - RNA, 19 nt, artificial
  Oligomer
uccgagcuguacagcuucu

SEQ ID NO: 12034 - RNA, 19 nt, artificial
  Oligomer
cuguuaacugucaguaaca

SEQ ID NO: 12035 - RNA, 19 nt, artificial
  Oligomer
cacaaguguucauccucag

SEQ ID NO: 12036 - RNA, 19 nt, artificial
  Oligomer
aaguucaacacuccucaau

SEQ ID NO: 12037 - RNA, 19 nt, artificial
  Oligomer
agucgucucugucuuggag

SEQ ID NO: 12038 - RNA, 19 nt, artificial
  Oligomer
ccucaguuuuccaaccaca

SEQ ID NO: 12039 - RNA, 19 nt, artificial
  Oligomer
gcgucuguaagauagcugc

SEQ ID NO: 12040 - RNA, 19 nt, artificial
  Oligomer
caguagugaugcuccgauc

SEQ ID NO: 12041 - RNA, 19 nt, artificial
  Oligomer
augucacaccacuguuaac

SEQ ID NO: 12042 - RNA, 19 nt, artificial
  Oligomer
cuccgaucagaaaaacaag

SEQ ID NO: 12043 - RNA, 19 nt, artificial
  Oligomer
gagcuguacagcuucuucu

SEQ ID NO: 12044 - RNA, 19 nt, artificial
  Oligomer
agcucaacucugcaguaca

SEQ ID NO: 12045 - RNA, 19 nt, artificial
  Oligomer
agguguaauuuuucaagug

SEQ ID NO: 12046 - RNA, 19 nt, artificial
  Oligomer
cagugaguaucuuaucuuc

SEQ ID NO: 12047 - RNA, 19 nt, artificial
  Oligomer
cauguaaacaguucuagau

SEQ ID NO: 12048 - RNA, 19 nt, artificial
  Oligomer
ccugggaaacacuauuccc

SEQ ID NO: 12049 - RNA, 19 nt, artificial
  Oligomer
agggcguuugcugaugaac

SEQ ID NO: 12050 - RNA, 19 nt, artificial
  Oligomer
auccagcuggaagccuugu

SEQ ID NO: 12051 - RNA, 19 nt, artificial
  Oligomer
ccuuccuacucuuacauuc

SEQ ID NO: 12052 - RNA, 19 nt, artificial
  Oligomer
gaaggcuuaaacgcagcug

SEQ ID NO: 12053 - RNA, 19 nt, artificial
  Oligomer
caaaacaaacaacaaacac

SEQ ID NO: 12054 - RNA, 19 nt, artificial
  Oligomer
uaacugucaguaacaaaaa

SEQ ID NO: 12055 - RNA, 19 nt, artificial
  Oligomer
gcuaagacaagugcguccu

SEQ ID NO: 12056 - RNA, 19 nt, artificial
  Oligomer
aaguguucauccucagggu

SEQ ID NO: 12057 - RNA, 19 nt, artificial
  Oligomer
cccaaaaguucagucgucu

SEQ ID NO: 12058 - RNA, 19 nt, artificial
  Oligomer
ucccuucagaccaguaaga

SEQ ID NO: 12059 - RNA, 19 nt, artificial
  Oligomer
uguuaacugucaguaacaa

SEQ ID NO: 12060 - RNA, 19 nt, artificial
  Oligomer
ccuuuguuucaugcuacag

SEQ ID NO: 12061 - RNA, 19 nt, artificial
  Oligomer
aaaguucagucgucucugu

SEQ ID NO: 12062 - RNA, 19 nt, artificial
  Oligomer
aggucuuaauacuugaaca

SEQ ID NO: 12063 - RNA, 19 nt, artificial
  Oligomer
guaguucuuugcccaccug

SEQ ID NO: 12064 - RNA, 19 nt, artificial
  Oligomer
aggaaucagucccucagcu

SEQ ID NO: 12065 - RNA, 19 nt, artificial
  Oligomer
auucaugaacagugaguau

SEQ ID NO: 12066 - RNA, 19 nt, artificial
  Oligomer
auauugcauaggucuuaau

SEQ ID NO: 12067 - RNA, 19 nt, artificial
  Oligomer
gucagcgagaacugcuaag

SEQ ID NO: 12068 - RNA, 19 nt, artificial
  Oligomer
gugucaaagaucccaagug

SEQ ID NO: 12069 - RNA, 19 nt, artificial
  Oligomer
agcuguacagcuucuucuu

SEQ ID NO: 12070 - RNA, 19 nt, artificial
  Oligomer
gucaguaacaaaaauaaua

SEQ ID NO: 12071 - RNA, 19 nt, artificial
  Oligomer
guaacaaaaauaauaaggu

SEQ ID NO: 12072 - RNA, 19 nt, artificial
  Oligomer
cuuccugggaaacacuauu

SEQ ID NO: 12073 - RNA, 19 nt, artificial
  Oligomer
uggucccuucagaccagua

SEQ ID NO: 12074 - RNA, 19 nt, artificial
  Oligomer
gaguaucuuaucuucaugu

SEQ ID NO: 12075 - RNA, 19 nt, artificial
  Oligomer
uguacagcuucuucuugau

SEQ ID NO: 12076 - RNA, 19 nt, artificial
  Oligomer
gaucagaaaaacaagauac

SEQ ID NO: 12077 - RNA, 19 nt, artificial
  Oligomer
gucaguagugaugcuccga

SEQ ID NO: 12078 - RNA, 19 nt, artificial
  Oligomer
acaaaacaaacaacaaaca

SEQ ID NO: 12079 - RNA, 19 nt, artificial
  Oligomer
augcuccgaucagaaaaac

SEQ ID NO: 12080 - RNA, 19 nt, artificial
  Oligomer
cucucuggaugucacacca

SEQ ID NO: 12081 - RNA, 19 nt, artificial
  Oligomer
ccuaagccuuuguuucaug

SEQ ID NO: 12082 - RNA, 19 nt, artificial
  Oligomer
gcuucuucuugaugacucg

SEQ ID NO: 12083 - RNA, 19 nt, artificial
  Oligomer
agcuuccugggaaacacua

SEQ ID NO: 12084 - RNA, 19 nt, artificial
  Oligomer
gggcguuugcugaugaacu

SEQ ID NO: 12085 - RNA, 19 nt, artificial
  Oligomer
uaggcauggugaggacaga

SEQ ID NO: 12086 - RNA, 19 nt, artificial
  Oligomer
aaaggcuaggcauggugag

SEQ ID NO: 12087 - RNA, 19 nt, artificial
  Oligomer
caccacuguuaacugucag

SEQ ID NO: 12088 - RNA, 19 nt, artificial
  Oligomer
cuagauggaagacccagau

SEQ ID NO: 12089 - RNA, 19 nt, artificial
  Oligomer
auaggucuuaauacuugaa

SEQ ID NO: 12090 - RNA, 19 nt, artificial
  Oligomer
guucuagauggaagaccca

SEQ ID NO: 12091 - RNA, 19 nt, artificial
  Oligomer
cucaaugagcuuccuggga

SEQ ID NO: 12092 - RNA, 19 nt, artificial
  Oligomer
cugccucaguuuuccaacc

SEQ ID NO: 12093 - RNA, 19 nt, artificial
  Oligomer
cuuccuacucuuacauuca

SEQ ID NO: 12094 - RNA, 19 nt, artificial
  Oligomer
cgucuguaagauagcugcc

SEQ ID NO: 12095 - RNA, 19 nt, artificial
  Oligomer
guuaacugucaguaacaaa

SEQ ID NO: 12096 - RNA, 19 nt, artificial
  Oligomer
ccucagguugaaguucaac

SEQ ID NO: 12097 - RNA, 19 nt, artificial
  Oligomer
gcugccucaguuuuccaac

SEQ ID NO: 12098 - RNA, 19 nt, artificial
  Oligomer
agcgagaacugcuaagaca

SEQ ID NO: 12099 - RNA, 19 nt, artificial
  Oligomer
gucccuucagaccaguaag

SEQ ID NO: 12100 - RNA, 19 nt, artificial
  Oligomer
agcugccuacaacagguca

SEQ ID NO: 12101 - RNA, 19 nt, artificial
  Oligomer
caugcgucuguaagauagc

SEQ ID NO: 12102 - RNA, 19 nt, artificial
  Oligomer
cagaaaaacaagauacaaa

SEQ ID NO: 12103 - RNA, 19 nt, artificial
  Oligomer
ccacuguuaacugucagua

SEQ ID NO: 12104 - RNA, 19 nt, artificial
  Oligomer
guaauuuuucaagugucaa

SEQ ID NO: 12105 - RNA, 19 nt, artificial
  Oligomer
cuacaacaggucaguagug

SEQ ID NO: 12106 - RNA, 19 nt, artificial
  Oligomer
agcugcucucuggauguca

SEQ ID NO: 12107 - RNA, 19 nt, artificial
  Oligomer
acauguuuauuagaaaagu

SEQ ID NO: 12108 - RNA, 19 nt, artificial
  Oligomer
ugucaguaacaaaaauaau

SEQ ID NO: 12109 - RNA, 19 nt, artificial
  Oligomer
cgagcuguacagcuucuuc

SEQ ID NO: 12110 - RNA, 19 nt, artificial
  Oligomer
gcaguaguucuuugcccac

SEQ ID NO: 12111 - RNA, 19 nt, artificial
  Oligomer
gaacugcuaagacaagugc

SEQ ID NO: 12112 - RNA, 19 nt, artificial
  Oligomer
caacucugcaguacacgau

SEQ ID NO: 12113 - RNA, 19 nt, artificial
  Oligomer
caacacuccucaaugagca

SEQ ID NO: 12114 - RNA, 19 nt, artificial
  Oligomer
gguugaaguucaacacucc

SEQ ID NO: 12115 - RNA, 19 nt, artificial
  Oligomer
aagugucaaagaucccaag

SEQ ID NO: 12116 - RNA, 19 nt, artificial
  Oligomer
cacaggaaucagucccuca

SEQ ID NO: 12117 - RNA, 19 nt, artificial
  Oligomer
cauaggucuuaauacuuga

SEQ ID NO: 12118 - RNA, 19 nt, artificial
  Oligomer
cuuaauacuugaacaucaa

SEQ ID NO: 12119 - RNA, 19 nt, artificial
  Oligomer
guguauucaugaacaguga

SEQ ID NO: 12120 - RNA, 19 nt, artificial
  Oligomer
aaugagcuuccugggaaac

SEQ ID NO: 12121 - RNA, 19 nt, artificial
  Oligomer
auuuuucaagugucaaaga

SEQ ID NO: 12122 - RNA, 19 nt, artificial
  Oligomer
gccuacaacaggucaguag

SEQ ID NO: 12123 - RNA, 19 nt, artificial
  Oligomer
gcuguacagcuucuucuug

SEQ ID NO: 12124 - RNA, 19 nt, artificial
  Oligomer
cagguugaaguucaacacu

SEQ ID NO: 12125 - RNA, 19 nt, artificial
  Oligomer
gugaguaucuuaucuucau

SEQ ID NO: 12126 - RNA, 19 nt, artificial
  Oligomer
caagugucaaagaucccaa

SEQ ID NO: 12127 - RNA, 19 nt, artificial
  Oligomer
agugucaaagaucccaagu

SEQ ID NO: 12128 - RNA, 19 nt, artificial
  Oligomer
acaccacuguuaacuguca

SEQ ID NO: 12129 - RNA, 19 nt, artificial
  Oligomer
aacaaacauguuuauuaga

SEQ ID NO: 12130 - RNA, 19 nt, artificial
  Oligomer
cuguuuuaacaaacauguu

SEQ ID NO: 12131 - RNA, 19 nt, artificial
  Oligomer
cuccucaaugagcagcugu

SEQ ID NO: 12132 - RNA, 19 nt, artificial
  Oligomer
gagaacugcuaagacaagu

SEQ ID NO: 12133 - RNA, 19 nt, artificial
  Oligomer
acaacaggucaguagugau

SEQ ID NO: 12134 - RNA, 19 nt, artificial
  Oligomer
caaaggcuaggcaugguga

SEQ ID NO: 12135 - RNA, 19 nt, artificial
  Oligomer
cagguguaauuuuucaagu

SEQ ID NO: 12136 - RNA, 19 nt, artificial
  Oligomer
gcuccgaucagaaaaacaa

SEQ ID NO: 12137 - RNA, 19 nt, artificial
  Oligomer
gcugaugaacucagagugc

SEQ ID NO: 12138 - RNA, 19 nt, artificial
  Oligomer
acaguucuagauggaagac

SEQ ID NO: 12139 - RNA, 19 nt, artificial
  Oligomer
gcuugaaugggugugcgaa

SEQ ID NO: 12140 - RNA, 19 nt, artificial
  Oligomer
caagauacaaaacaaacaa

SEQ ID NO: 12141 - RNA, 19 nt, artificial
  Oligomer
aaacaagauacaaaacaaa

SEQ ID NO: 12142 - RNA, 19 nt, artificial
  Oligomer
ugccuacaacaggucagua

SEQ ID NO: 12143 - RNA, 19 nt, artificial
  Oligomer
aguaucuuaucuucaugua

SEQ ID NO: 12144 - RNA, 19 nt, artificial
  Oligomer
cugucaguaacaaaaauaa

SEQ ID NO: 12145 - RNA, 19 nt, artificial
  Oligomer
cugccuacaacaggucagu

SEQ ID NO: 12146 - RNA, 19 nt, artificial
  Oligomer
guaagauagcugccuacaa

SEQ ID NO: 12147 - RNA, 19 nt, artificial
  Oligomer
cauucaugcgucuguaaga

SEQ ID NO: 12148 - RNA, 19 nt, artificial
  Oligomer
aaaacaagauacaaaacaa

SEQ ID NO: 12149 - RNA, 19 nt, artificial
  Oligomer
guuugcugaugaacucaga

SEQ ID NO: 12150 - RNA, 19 nt, artificial
  Oligomer
guaucuuaucuucauguaa

SEQ ID NO: 12151 - RNA, 19 nt, artificial
  Oligomer
cucuuacauucaugcgucu

SEQ ID NO: 12152 - RNA, 19 nt, artificial
  Oligomer
aguuuuccaaccacaggaa

SEQ ID NO: 12153 - RNA, 19 nt, artificial
  Oligomer
cagcuucuucuugaugacu

SEQ ID NO: 12154 - RNA, 19 nt, artificial
  Oligomer
aacacuccucaaugagcag

SEQ ID NO: 12155 - RNA, 19 nt, artificial
  Oligomer
acagcuucuucuugaugac

SEQ ID NO: 12156 - RNA, 19 nt, artificial
  Oligomer
guuccgagcuguacagcuu

SEQ ID NO: 12157 - RNA, 19 nt, artificial
  Oligomer
gaugucacaccacuguuaa

SEQ ID NO: 12158 - RNA, 19 nt, artificial
  Oligomer
ccuacaacaggucaguagu

SEQ ID NO: 12159 - RNA, 19 nt, artificial
  Oligomer
cacuccucaaugagcagcu

SEQ ID NO: 12160 - RNA, 19 nt, artificial
  Oligomer
caaccacaggaaucagucc

SEQ ID NO: 12161 - RNA, 19 nt, artificial
  Oligomer
gugaugcuccgaucagaaa

SEQ ID NO: 12162 - RNA, 19 nt, artificial
  Oligomer
cagcucaacucugcaguac

SEQ ID NO: 12163 - RNA, 19 nt, artificial
  Oligomer
gcguuugcugaugaacuca

SEQ ID NO: 12164 - RNA, 19 nt, artificial
  Oligomer
ggcguuugcugaugaacuc

SEQ ID NO: 12165 - RNA, 19 nt, artificial
  Oligomer
caaugagcagcuguuccga

SEQ ID NO: 12166 - RNA, 19 nt, artificial
  Oligomer
guucauccucagggucacu

SEQ ID NO: 12167 - RNA, 19 nt, artificial
  Oligomer
gccucaguuuuccaaccac

SEQ ID NO: 12168 - RNA, 19 nt, artificial
  Oligomer
gaacagugaguaucuuauc

SEQ ID NO: 12169 - RNA, 19 nt, artificial
  Oligomer
ccucaaugagcagcuguuc

SEQ ID NO: 12170 - RNA, 19 nt, artificial
  Oligomer
cacacuuggucccuucaga

SEQ ID NO: 12171 - RNA, 19 nt, artificial
  Oligomer
cauguuuauuagaaaagua

SEQ ID NO: 12172 - RNA, 19 nt, artificial
  Oligomer
gguguaauuuuucaagugu

SEQ ID NO: 12173 - RNA, 19 nt, artificial
  Oligomer
ccuucagaccaguaagaua

SEQ ID NO: 12174 - RNA, 19 nt, artificial
  Oligomer
guaaacaguucuagaugga

SEQ ID NO: 12175 - RNA, 19 nt, artificial
  Oligomer
caggcgcaguaguucuuug

SEQ ID NO: 12176 - RNA, 19 nt, artificial
  Oligomer
gucaaagaucccaagugau

SEQ ID NO: 12177 - RNA, 19 nt, artificial
  Oligomer
cagcgagaacugcuaagac

SEQ ID NO: 12178 - RNA, 19 nt, artificial
  Oligomer
ccaggcgcaguaguucuuu

SEQ ID NO: 12179 - RNA, 19 nt, artificial
  Oligomer
acuugaacaucaaguguau

SEQ ID NO: 12180 - RNA, 19 nt, artificial
  Oligomer
acaacucaaugagcuuccu

SEQ ID NO: 12181 - RNA, 19 nt, artificial
  Oligomer
gcucaacucugcaguacac

SEQ ID NO: 12182 - RNA, 19 nt, artificial
  Oligomer
cugcucucuggaugucaca

SEQ ID NO: 12183 - RNA, 19 nt, artificial
  Oligomer
gcgagaacugcuaagacaa

SEQ ID NO: 12184 - RNA, 19 nt, artificial
  Oligomer
ggcugccucaguuuuccaa

SEQ ID NO: 12185 - RNA, 19 nt, artificial
  Oligomer
ggaugucacaccacuguua

SEQ ID NO: 12186 - RNA, 19 nt, artificial
  Oligomer
cagucgucucugucuugga

SEQ ID NO: 12187 - RNA, 19 nt, artificial
  Oligomer
gagcuuccugggaaacacu

SEQ ID NO: 12188 - RNA, 19 nt, artificial
  Oligomer
ccgagcuguacagcuucuu

SEQ ID NO: 12189 - RNA, 19 nt, artificial
  Oligomer
cccuaagccuuuguuucau

SEQ ID NO: 12190 - RNA, 19 nt, artificial
  Oligomer
caguaacaaaaauaauaag

SEQ ID NO: 12191 - RNA, 19 nt, artificial
  Oligomer
ccgaucagaaaaacaagau

SEQ ID NO: 12192 - RNA, 19 nt, artificial
  Oligomer
acaggucaguagugaugcu

SEQ ID NO: 12193 - RNA, 19 nt, artificial
  Oligomer
ggucuuaauacuugaacau

SEQ ID NO: 12194 - RNA, 19 nt, artificial
  Oligomer
guucaacacuccucaauga

SEQ ID NO: 12195 - RNA, 19 nt, artificial
  Oligomer
ggaaggcuuaaacgcagcu

SEQ ID NO: 12196 - RNA, 19 nt, artificial
  Oligomer
cacuguuaacugucaguaa

SEQ ID NO: 12197 - RNA, 19 nt, artificial
  Oligomer
guuuuccaaccacaggaau

SEQ ID NO: 12198 - RNA, 19 nt, artificial
  Oligomer
cuugaacaucaaguguauu

SEQ ID NO: 12199 - RNA, 19 nt, artificial
  Oligomer
caaguguauucaugaacag

SEQ ID NO: 12200 - RNA, 19 nt, artificial
  Oligomer
gauacaaaacaaacaacaa

SEQ ID NO: 12201 - RNA, 19 nt, artificial
  Oligomer
caaacauguuuauuagaaa

SEQ ID NO: 12202 - RNA, 19 nt, artificial
  Oligomer
cccuucagaccaguaagau

SEQ ID NO: 12203 - RNA, 19 nt, artificial
  Oligomer
ggucccuucagaccaguaa

SEQ ID NO: 12204 - RNA, 19 nt, artificial
  Oligomer
caugaacagugaguaucuu

SEQ ID NO: 12205 - RNA, 19 nt, artificial
  Oligomer
aacugucaguaacaaaaau

SEQ ID NO: 12206 - RNA, 19 nt, artificial
  Oligomer
acuccucaaugagcagcug

SEQ ID NO: 12207 - RNA, 19 nt, artificial
  Oligomer
gaaaaacaagauacaaaac

SEQ ID NO: 12208 - RNA, 19 nt, artificial
  Oligomer
gcuuccugggaaacacuau

SEQ ID NO: 12209 - RNA, 19 nt, artificial
  Oligomer
gccuuuguuucaugcuaca

SEQ ID NO: 12210 - RNA, 19 nt, artificial
  Oligomer
gaucccaagugaucccuga

SEQ ID NO: 12211 - RNA, 19 nt, artificial
  Oligomer
cccuuccuacucuuacauu

SEQ ID NO: 12212 - RNA, 19 nt, artificial
  Oligomer
caucaaguguauucaugaa

SEQ ID NO: 12213 - RNA, 19 nt, artificial
  Oligomer
gaugcuccgaucagaaaaa

SEQ ID NO: 12214 - RNA, 19 nt, artificial
  Oligomer
cgagaacugcuaagacaag

SEQ ID NO: 12215 - RNA, 19 nt, artificial
  Oligomer
caaaaauaauaagguacau

SEQ ID NO: 12216 - RNA, 19 nt, artificial
  Oligomer
cgaucagaaaaacaagaua

SEQ ID NO: 12217 - RNA, 19 nt, artificial
  Oligomer
caaugagcuuccugggaaa

SEQ ID NO: 12218 - RNA, 19 nt, artificial
  Oligomer
ccagcucaacucugcagua

SEQ ID NO: 12219 - RNA, 19 nt, artificial
  Oligomer
gaacaucaaguguauucau

SEQ ID NO: 12220 - RNA, 19 nt, artificial
  Oligomer
ggucagcgagaacugcuaa

SEQ ID NO: 12221 - RNA, 19 nt, artificial
  Oligomer
gaaguucaacacuccucaa

SEQ ID NO: 12222 - RNA, 19 nt, artificial
  Oligomer
cagggcguuugcugaugaa

SEQ ID NO: 12223 - RNA, 19 nt, artificial
  Oligomer
cccucagguugaaguucaa

SEQ ID NO: 12224 - RNA, 19 nt, artificial
  Oligomer
agcagcaucagguuggcac

SEQ ID NO: 12225 - RNA, 19 nt, artificial
  Oligomer
ggauuauguuguuccugaa

SEQ ID NO: 12226 - RNA, 19 nt, artificial
  Oligomer
ggcuuuucugggaauugaa

SEQ ID NO: 12227 - RNA, 19 nt, artificial
  Oligomer
cgugaacuuggaaauugaa

SEQ ID NO: 12228 - RNA, 19 nt, artificial
  Oligomer
caguguucuaacaaacuaa

SEQ ID NO: 12229 - RNA, 19 nt, artificial
  Oligomer
ccuguuaaaggaaauuaaa

SEQ ID NO: 12230 - RNA, 19 nt, artificial
  Oligomer
gccuguuaugcuuacaaaa

SEQ ID NO: 12231 - RNA, 19 nt, artificial
  Oligomer
cggcaauaauggaacugcu

SEQ ID NO: 12232 - RNA, 19 nt, artificial
  Oligomer
gucuauuuuugacaauaaa

SEQ ID NO: 12233 - RNA, 19 nt, artificial
  Oligomer
guaggugaguuuaauuaaa

SEQ ID NO: 12234 - RNA, 19 nt, artificial
  Oligomer
gaauuuagccuccacucaa

SEQ ID NO: 12235 - RNA, 19 nt, artificial
  Oligomer
gucacuagggaauaauaaa

SEQ ID NO: 12236 - RNA, 19 nt, artificial
  Oligomer
gauggaauagguaagcaaa

SEQ ID NO: 12237 - RNA, 19 nt, artificial
  Oligomer
gaguuuaauuaaagcuuaa

SEQ ID NO: 12238 - RNA, 19 nt, artificial
  Oligomer
ccuaaaaagggaaaauaua

SEQ ID NO: 12239 - RNA, 19 nt, artificial
  Oligomer
gguccuugucccugagaaa

SEQ ID NO: 12240 - RNA, 19 nt, artificial
  Oligomer
guugaauacugucuuuaaa

SEQ ID NO: 12241 - RNA, 19 nt, artificial
  Oligomer
ggauggaauagguaagcaa

SEQ ID NO: 12242 - RNA, 19 nt, artificial
  Oligomer
cugucacuagggaauaaua

SEQ ID NO: 12243 - RNA, 19 nt, artificial
  Oligomer
gaggauuuuuuaaaucaca

SEQ ID NO: 12244 - RNA, 19 nt, artificial
  Oligomer
ggagaacugucuguccaaa

SEQ ID NO: 12245 - RNA, 19 nt, artificial
  Oligomer
ugguuaaaaugcuggagaa

SEQ ID NO: 12246 - RNA, 19 nt, artificial
  Oligomer
gaguaaaugagaaauauua

SEQ ID NO: 12247 - RNA, 19 nt, artificial
  Oligomer
gcaaaauauugaacugaua

SEQ ID NO: 12248 - RNA, 19 nt, artificial
  Oligomer
gaaggcuguuaaauuaaua

SEQ ID NO: 12249 - RNA, 19 nt, artificial
  Oligomer
cuuggaaauugaaaaugua

SEQ ID NO: 12250 - RNA, 19 nt, artificial
  Oligomer
caggauuucgacuuguuaa

SEQ ID NO: 12251 - RNA, 19 nt, artificial
  Oligomer
gugacuuccucacucuaau

SEQ ID NO: 12252 - RNA, 19 nt, artificial
  Oligomer
uggagaacugucuguccaa

SEQ ID NO: 12253 - RNA, 19 nt, artificial
  Oligomer
aacugucuguccaaaucaa

SEQ ID NO: 12254 - RNA, 19 nt, artificial
  Oligomer
cuagaaaaaugcaaaauau

SEQ ID NO: 12255 - RNA, 19 nt, artificial
  Oligomer
ggugacuuccucacucuaa

SEQ ID NO: 12256 - RNA, 19 nt, artificial
  Oligomer
ucaugauuggguaguaaaa

SEQ ID NO: 12257 - RNA, 19 nt, artificial
  Oligomer
aagggaaaauauauaaaga

SEQ ID NO: 12258 - RNA, 19 nt, artificial
  Oligomer
ccaguguucuaacaaacua

SEQ ID NO: 12259 - RNA, 19 nt, artificial
  Oligomer
gauugaaggguccuaaaaa

SEQ ID NO: 12260 - RNA, 19 nt, artificial
  Oligomer
ccauugagugaaugaugaa

SEQ ID NO: 12261 - RNA, 19 nt, artificial
  Oligomer
ggagauaugguuuauagua

SEQ ID NO: 12262 - RNA, 19 nt, artificial
  Oligomer
ugguaauagacuauauaaa

SEQ ID NO: 12263 - RNA, 19 nt, artificial
  Oligomer
gggcuuuucugggaauuga

SEQ ID NO: 12264 - RNA, 19 nt, artificial
  Oligomer
ccaccugcccuaaauaaga

SEQ ID NO: 12265 - RNA, 19 nt, artificial
  Oligomer
ugcugugggucguggauaa

SEQ ID NO: 12266 - RNA, 19 nt, artificial
  Oligomer
acgugaacuuggaaauuga

SEQ ID NO: 12267 - RNA, 19 nt, artificial
  Oligomer
cuguccaaaucaaagcaaa

SEQ ID NO: 12268 - RNA, 19 nt, artificial
  Oligomer
gugcuuaaucucagaugaa

SEQ ID NO: 12269 - RNA, 19 nt, artificial
  Oligomer
uguugaauacugucuuuaa

SEQ ID NO: 12270 - RNA, 19 nt, artificial
  Oligomer
agguaagaguaaaugagaa

SEQ ID NO: 12271 - RNA, 19 nt, artificial
  Oligomer
ggaaggcuguuaaauuaau

SEQ ID NO: 12272 - RNA, 19 nt, artificial
  Oligomer
gcuuggaaagauacuacaa

SEQ ID NO: 12273 - RNA, 19 nt, artificial
  Oligomer
ugauauuuagccuaucaaa

SEQ ID NO: 12274 - RNA, 19 nt, artificial
  Oligomer
gaaauauuacggcaauaau

SEQ ID NO: 12275 - RNA, 19 nt, artificial
  Oligomer
ccagauuugccuauuuuga

SEQ ID NO: 12276 - RNA, 19 nt, artificial
  Oligomer
caguauuacaugugcuuaa

SEQ ID NO: 12277 - RNA, 19 nt, artificial
  Oligomer
aguguucuaacaaacuaaa

SEQ ID NO: 12278 - RNA, 19 nt, artificial
  Oligomer
caaggguaguagcuguaua

SEQ ID NO: 12279 - RNA, 19 nt, artificial
  Oligomer
ccacgguguuguuuuagau

SEQ ID NO: 12280 - RNA, 19 nt, artificial
  Oligomer
cgagguaauauuugaggaa

SEQ ID NO: 12281 - RNA, 19 nt, artificial
  Oligomer
caauaauggaacugcuuca

SEQ ID NO: 12282 - RNA, 19 nt, artificial
  Oligomer
gaaugaaacucaccgucca

SEQ ID NO: 12283 - RNA, 19 nt, artificial
  Oligomer
agguaggcuugguaauaga

SEQ ID NO: 12284 - RNA, 19 nt, artificial
  Oligomer
uccuguuacugauacuaua

SEQ ID NO: 12285 - RNA, 19 nt, artificial
  Oligomer
gugugauccuguuacugau

SEQ ID NO: 12286 - RNA, 19 nt, artificial
  Oligomer
cagagagccugcuaaguga

SEQ ID NO: 12287 - RNA, 19 nt, artificial
  Oligomer
caggagaacugcucaugga

SEQ ID NO: 12288 - RNA, 19 nt, artificial
  Oligomer
caccaguuccugacucaaa

SEQ ID NO: 12289 - RNA, 19 nt, artificial
  Oligomer
cccagagaauugcucaaga

SEQ ID NO: 12290 - RNA, 19 nt, artificial
  Oligomer
uacuauaagugaccuaaaa

SEQ ID NO: 12291 - RNA, 19 nt, artificial
  Oligomer
uuggagaagugauucaaaa

SEQ ID NO: 12292 - RNA, 19 nt, artificial
  Oligomer
caaaucaaagcaaacuaaa

SEQ ID NO: 12293 - RNA, 19 nt, artificial
  Oligomer
cugucuuuaaacuagaaaa

SEQ ID NO: 12294 - RNA, 19 nt, artificial
  Oligomer
cguggauaaggagcuuauu

SEQ ID NO: 12295 - RNA, 19 nt, artificial
  Oligomer
ugccuguuaugcuuacaaa

SEQ ID NO: 12296 - RNA, 19 nt, artificial
  Oligomer
auggaauagguaagcaaaa

SEQ ID NO: 12297 - RNA, 19 nt, artificial
  Oligomer
ugucacuagggaauaauaa

SEQ ID NO: 12298 - RNA, 19 nt, artificial
  Oligomer
cuaaaaugucacuguucaa

SEQ ID NO: 12299 - RNA, 19 nt, artificial
  Oligomer
gaaggguccuaaaaaggga

SEQ ID NO: 12300 - RNA, 19 nt, artificial
  Oligomer
aaggguuuuuagacaggaa

SEQ ID NO: 12301 - RNA, 19 nt, artificial
  Oligomer
caccugcccuaaauaagaa

SEQ ID NO: 12302 - RNA, 19 nt, artificial
  Oligomer
ccagagaauugcucaagau

SEQ ID NO: 12303 - RNA, 19 nt, artificial
  Oligomer
ggauuuuuuaaaucacaga

SEQ ID NO: 12304 - RNA, 19 nt, artificial
  Oligomer
ggagaagugauucaaaaua

SEQ ID NO: 12305 - RNA, 19 nt, artificial
  Oligomer
cuugggcaucgauguagaa

SEQ ID NO: 12306 - RNA, 19 nt, artificial
  Oligomer
accugucacuagggaauaa

SEQ ID NO: 12307 - RNA, 19 nt, artificial
  Oligomer
ccaaaucaaagcaaacuaa

SEQ ID NO: 12308 - RNA, 19 nt, artificial
  Oligomer
cuuggaaagauacuacaaa

SEQ ID NO: 12309 - RNA, 19 nt, artificial
  Oligomer
gauauuuagccuaucaaaa

SEQ ID NO: 12310 - RNA, 19 nt, artificial
  Oligomer
ugccuauuuugauuuucau

SEQ ID NO: 12311 - RNA, 19 nt, artificial
  Oligomer
ccguccagauaaccaugca

SEQ ID NO: 12312 - RNA, 19 nt, artificial
  Oligomer
guuccugacucaaauuuga

SEQ ID NO: 12313 - RNA, 19 nt, artificial
  Oligomer
gaauagguaagcaaaagua

SEQ ID NO: 12314 - RNA, 19 nt, artificial
  Oligomer
acaugugcuuaaucucaga

SEQ ID NO: 12315 - RNA, 19 nt, artificial
  Oligomer
guuuuagaugccuuuauaa

SEQ ID NO: 12316 - RNA, 19 nt, artificial
  Oligomer
ccaccaguuccugacucaa

SEQ ID NO: 12317 - RNA, 19 nt, artificial
  Oligomer
ggguaguagcuguauacua

SEQ ID NO: 12318 - RNA, 19 nt, artificial
  Oligomer
gggaaaauauauaaagauu

SEQ ID NO: 12319 - RNA, 19 nt, artificial
  Oligomer
aguaggugaguuuaauuaa

SEQ ID NO: 12320 - RNA, 19 nt, artificial
  Oligomer
guaaaaagcuggauaggau

SEQ ID NO: 12321 - RNA, 19 nt, artificial
  Oligomer
gagaaauauuacggcaaua

SEQ ID NO: 12322 - RNA, 19 nt, artificial
  Oligomer
gacccagagaauugcucaa

SEQ ID NO: 12323 - RNA, 19 nt, artificial
  Oligomer
uguuuuagaugccuuuaua

SEQ ID NO: 12324 - RNA, 19 nt, artificial
  Oligomer
aucacagaaucauacuaaa

SEQ ID NO: 12325 - RNA, 19 nt, artificial
  Oligomer
ccuguucuuaaguguugaa

SEQ ID NO: 12326 - RNA, 19 nt, artificial
  Oligomer
ggccuuauuuuuugucuua

SEQ ID NO: 12327 - RNA, 19 nt, artificial
  Oligomer
ccuguuacugauacuauaa

SEQ ID NO: 12328 - RNA, 19 nt, artificial
  Oligomer
uccacucaacaauguucaa

SEQ ID NO: 12329 - RNA, 19 nt, artificial
  Oligomer
cagauuugccuauuuugau

SEQ ID NO: 12330 - RNA, 19 nt, artificial
  Oligomer
gugauugaaggguccuaaa

SEQ ID NO: 12331 - RNA, 19 nt, artificial
  Oligomer
acugucuguccaaaucaaa

SEQ ID NO: 12332 - RNA, 19 nt, artificial
  Oligomer
ccacuuugaauuauugaaa

SEQ ID NO: 12333 - RNA, 19 nt, artificial
  Oligomer
ggcaguuugagcagcaaga

SEQ ID NO: 12334 - RNA, 19 nt, artificial
  Oligomer
uccuguuaaaggaaauuaa

SEQ ID NO: 12335 - RNA, 19 nt, artificial
  Oligomer
acagaaucauacuaaauga

SEQ ID NO: 12336 - RNA, 19 nt, artificial
  Oligomer
gcgucguaccuacuuuuga

SEQ ID NO: 12337 - RNA, 19 nt, artificial
  Oligomer
gaaugggauggaauaggua

SEQ ID NO: 12338 - RNA, 19 nt, artificial
  Oligomer
ucgacuuguuaagaaaaaa

SEQ ID NO: 12339 - RNA, 19 nt, artificial
  Oligomer
cugugaggauaggaaauua

SEQ ID NO: 12340 - RNA, 19 nt, artificial
  Oligomer
gcuugguaauagacuauau

SEQ ID NO: 12341 - RNA, 19 nt, artificial
  Oligomer
ccaacuaaguagaucauua

SEQ ID NO: 12342 - RNA, 19 nt, artificial
  Oligomer
gauucaaaauaguguagau

SEQ ID NO: 12343 - RNA, 19 nt, artificial
  Oligomer
cauccugguguuacugaaa

SEQ ID NO: 12344 - RNA, 19 nt, artificial
  Oligomer
cucucugauucacuuagua

SEQ ID NO: 12345 - RNA, 19 nt, artificial
  Oligomer
uccugguguuacugaaaaa

SEQ ID NO: 12346 - RNA, 19 nt, artificial
  Oligomer
cccuguucuuaaguguuga

SEQ ID NO: 12347 - RNA, 19 nt, artificial
  Oligomer
ugucuuuaaacuagaaaaa

SEQ ID NO: 12348 - RNA, 19 nt, artificial
  Oligomer
gauuuuuuaaaucacagaa

SEQ ID NO: 12349 - RNA, 19 nt, artificial
  Oligomer
cuugguaauagacuauaua

SEQ ID NO: 12350 - RNA, 19 nt, artificial
  Oligomer
accaguuccugacucaaau

SEQ ID NO: 12351 - RNA, 19 nt, artificial
  Oligomer
cuaaaaagggaaaauauau

SEQ ID NO: 12352 - RNA, 19 nt, artificial
  Oligomer
gguaagaguaaaugagaaa

SEQ ID NO: 12353 - RNA, 19 nt, artificial
  Oligomer
agauuuuuuccaccuugga

SEQ ID NO: 12354 - RNA, 19 nt, artificial
  Oligomer
gcaguuugagcagcaagaa

SEQ ID NO: 12355 - RNA, 19 nt, artificial
  Oligomer
cucacucuaauguuuuaaa

SEQ ID NO: 12356 - RNA, 19 nt, artificial
  Oligomer
cgucguaccuacuuuugag

SEQ ID NO: 12357 - RNA, 19 nt, artificial
  Oligomer
aaacuagaaaaaugcaaaa

SEQ ID NO: 12358 - RNA, 19 nt, artificial
  Oligomer
uggugacuuccucacucua

SEQ ID NO: 12359 - RNA, 19 nt, artificial
  Oligomer
caaacuaaacucuucaaau

SEQ ID NO: 12360 - RNA, 19 nt, artificial
  Oligomer
gacaggaagguaggauuaa

SEQ ID NO: 12361 - RNA, 19 nt, artificial
  Oligomer
gugugauucuagcgucgua

SEQ ID NO: 12362 - RNA, 19 nt, artificial
  Oligomer
gcuuauggaaggcuguuaa

SEQ ID NO: 12363 - RNA, 19 nt, artificial
  Oligomer
agcccauuugaguuuuaca

SEQ ID NO: 12364 - RNA, 19 nt, artificial
  Oligomer
cuuauggaaggcuguuaaa

SEQ ID NO: 12365 - RNA, 19 nt, artificial
  Oligomer
gaaacucaccguccagaua

SEQ ID NO: 12366 - RNA, 19 nt, artificial
  Oligomer
ggcaauaauggaacugcuu

SEQ ID NO: 12367 - RNA, 19 nt, artificial
  Oligomer
cacuaacaguuaucuuuga

SEQ ID NO: 12368 - RNA, 19 nt, artificial
  Oligomer
agggaaaauauauaaagau

SEQ ID NO: 12369 - RNA, 19 nt, artificial
  Oligomer
caacuaaguagaucauuau

SEQ ID NO: 12370 - RNA, 19 nt, artificial
  Oligomer
agauaugguuuauaguaca

SEQ ID NO: 12371 - RNA, 19 nt, artificial
  Oligomer
gaaaaaugcaaaauauuga

SEQ ID NO: 12372 - RNA, 19 nt, artificial
  Oligomer
ugugggucguggauaagga

SEQ ID NO: 12373 - RNA, 19 nt, artificial
  Oligomer
agaagugauucaaaauagu

SEQ ID NO: 12374 - RNA, 19 nt, artificial
  Oligomer
cacucuaauguuuuaaaga

SEQ ID NO: 12375 - RNA, 19 nt, artificial
  Oligomer
ccaccuuggauaccuguca

SEQ ID NO: 12376 - RNA, 19 nt, artificial
  Oligomer
ugucuauuuuugacaauaa

SEQ ID NO: 12377 - RNA, 19 nt, artificial
  Oligomer
ggguccuaaaaagggaaaa

SEQ ID NO: 12378 - RNA, 19 nt, artificial
  Oligomer
ggacuuuuucuuuaguaga

SEQ ID NO: 12379 - RNA, 19 nt, artificial
  Oligomer
caguaaccacgguguuguu

SEQ ID NO: 12380 - RNA, 19 nt, artificial
  Oligomer
caggaagguaggauuaagu

SEQ ID NO: 12381 - RNA, 19 nt, artificial
  Oligomer
uccucacucuaauguuuua

SEQ ID NO: 12382 - RNA, 19 nt, artificial
  Oligomer
gaaucauacuaaaugauau

SEQ ID NO: 12383 - RNA, 19 nt, artificial
  Oligomer
ccuguuaugcuuacaaaau

SEQ ID NO: 12384 - RNA, 19 nt, artificial
  Oligomer
aaccaugcaugcacccaga

SEQ ID NO: 12385 - RNA, 19 nt, artificial
  Oligomer
ucauccugguguuacugaa

SEQ ID NO: 12386 - RNA, 19 nt, artificial
  Oligomer
guuuuaaagaggcaacaaa

SEQ ID NO: 12387 - RNA, 19 nt, artificial
  Oligomer
uuuggagaagugauucaaa

SEQ ID NO: 12388 - RNA, 19 nt, artificial
  Oligomer
cguugaccaugguugcaac

SEQ ID NO: 12389 - RNA, 19 nt, artificial
  Oligomer
uguccuuuuuccacuaaca

SEQ ID NO: 12390 - RNA, 19 nt, artificial
  Oligomer
uuuuaaagaggcaacaaaa

SEQ ID NO: 12391 - RNA, 19 nt, artificial
  Oligomer
cagaggauuuuuuaaauca

SEQ ID NO: 12392 - RNA, 19 nt, artificial
  Oligomer
ugaacuuggaaauugaaaa

SEQ ID NO: 12393 - RNA, 19 nt, artificial
  Oligomer
ggauaccugucacuaggga

SEQ ID NO: 12394 - RNA, 19 nt, artificial
  Oligomer
aggaagguaggauuaagua

SEQ ID NO: 12395 - RNA, 19 nt, artificial
  Oligomer
uugguaauagacuauauaa

SEQ ID NO: 12396 - RNA, 19 nt, artificial
  Oligomer
agaauugaaugggauggaa

SEQ ID NO: 12397 - RNA, 19 nt, artificial
  Oligomer
gaaugaugaauaccuguga

SEQ ID NO: 12398 - RNA, 19 nt, artificial
  Oligomer
auggaaggcuguuaaauua

SEQ ID NO: 12399 - RNA, 19 nt, artificial
  Oligomer
aauugaaugggauggaaua

SEQ ID NO: 12400 - RNA, 19 nt, artificial
  Oligomer
uacugucuuuaaacuagaa

SEQ ID NO: 12401 - RNA, 19 nt, artificial
  Oligomer
gauaccugucacuagggaa

SEQ ID NO: 12402 - RNA, 19 nt, artificial
  Oligomer
gcuagucagcuaaagucau

SEQ ID NO: 12403 - RNA, 19 nt, artificial
  Oligomer
cagcuaaagucauuuguag

SEQ ID NO: 12404 - RNA, 19 nt, artificial
  Oligomer
gccuauuuugauuuucaua

SEQ ID NO: 12405 - RNA, 19 nt, artificial
  Oligomer
gagaacugcucauggacua

SEQ ID NO: 12406 - RNA, 19 nt, artificial
  Oligomer
guuuucagaggauuuuuua

SEQ ID NO: 12407 - RNA, 19 nt, artificial
  Oligomer
ccuuauuuuuugucuuauu

SEQ ID NO: 12408 - RNA, 19 nt, artificial
  Oligomer
gggauuauguuguuccuga

SEQ ID NO: 12409 - RNA, 19 nt, artificial
  Oligomer
uagguaagcaaaaguagaa

SEQ ID NO: 12410 - RNA, 19 nt, artificial
  Oligomer
auacuauaagugaccuaaa

SEQ ID NO: 12411 - RNA, 19 nt, artificial
  Oligomer
cuggagaacugucugucca

SEQ ID NO: 12412 - RNA, 19 nt, artificial
  Oligomer
uuugcaugucuauuguuaa

SEQ ID NO: 12413 - RNA, 19 nt, artificial
  Oligomer
cucacugauuggaacaaca

SEQ ID NO: 12414 - RNA, 19 nt, artificial
  Oligomer
auagguaagcaaaaguaga

SEQ ID NO: 12415 - RNA, 19 nt, artificial
  Oligomer
uggagaagugauucaaaau

SEQ ID NO: 12416 - RNA, 19 nt, artificial
  Oligomer
gagaaacugacccagagaa

SEQ ID NO: 12417 - RNA, 19 nt, artificial
  Oligomer
ugugcuuaaucucagauga

SEQ ID NO: 12418 - RNA, 19 nt, artificial
  Oligomer
uuuucagaggauuuuuuaa

SEQ ID NO: 12419 - RNA, 19 nt, artificial
  Oligomer
uggagauaugguuuauagu

SEQ ID NO: 12420 - RNA, 19 nt, artificial
  Oligomer
gugaacuuggaaauugaaa

SEQ ID NO: 12421 - RNA, 19 nt, artificial
  Oligomer
gaauaauaaaggccuuauu

SEQ ID NO: 12422 - RNA, 19 nt, artificial
  Oligomer
uaaccacgguguuguuuua

SEQ ID NO: 12423 - RNA, 19 nt, artificial
  Oligomer
ucagcuaaagucauuugua

SEQ ID NO: 12424 - RNA, 19 nt, artificial
  Oligomer
uggaaggcuguuaaauuaa

SEQ ID NO: 12425 - RNA, 19 nt, artificial
  Oligomer
agaguaaaugagaaauauu

SEQ ID NO: 12426 - RNA, 19 nt, artificial
  Oligomer
cuggaguugucaccacuga

SEQ ID NO: 12427 - RNA, 19 nt, artificial
  Oligomer
ggauuaaguaggugaguuu

SEQ ID NO: 12428 - RNA, 19 nt, artificial
  Oligomer
cuuuccuuuuuuauguuaa

SEQ ID NO: 12429 - RNA, 19 nt, artificial
  Oligomer
cagcuaacaggcugauuuu

SEQ ID NO: 12430 - RNA, 19 nt, artificial
  Oligomer
gauuaaguaggugaguuua

SEQ ID NO: 12431 - RNA, 19 nt, artificial
  Oligomer
gaagcccauuugaguuuua

SEQ ID NO: 12432 - RNA, 19 nt, artificial
  Oligomer
cucugauucacuuaguaau

SEQ ID NO: 12433 - RNA, 19 nt, artificial
  Oligomer
ccuagagaaugaaacucac

SEQ ID NO: 12434 - RNA, 19 nt, artificial
  Oligomer
caaccucaacgagguaaua

SEQ ID NO: 12435 - RNA, 19 nt, artificial
  Oligomer
gauuucgacuuguuaagaa

SEQ ID NO: 12436 - RNA, 19 nt, artificial
  Oligomer
gaaacagagccguugacca

SEQ ID NO: 12437 - RNA, 19 nt, artificial
  Oligomer
ccuaaaaugucacuguuca

SEQ ID NO: 12438 - RNA, 19 nt, artificial
  Oligomer
gccuaucaaaacuuccaaa

SEQ ID NO: 12439 - RNA, 19 nt, artificial
  Oligomer
agacaggaagguaggauua

SEQ ID NO: 12440 - RNA, 19 nt, artificial
  Oligomer
caagauaaaucaauguugu

SEQ ID NO: 12441 - RNA, 19 nt, artificial
  Oligomer
gagaacugucuguccaaau

SEQ ID NO: 12442 - RNA, 19 nt, artificial
  Oligomer
ucaggauuucgacuuguua

SEQ ID NO: 12443 - RNA, 19 nt, artificial
  Oligomer
ugauucacuuaguaaucua

SEQ ID NO: 12444 - RNA, 19 nt, artificial
  Oligomer
caaauuugaaggguuuuua

SEQ ID NO: 12445 - RNA, 19 nt, artificial
  Oligomer
gaaacgggucaauuuacga

SEQ ID NO: 12446 - RNA, 19 nt, artificial
  Oligomer
aacccuagguaagaguaaa

SEQ ID NO: 12447 - RNA, 19 nt, artificial
  Oligomer
cuauuagcuccacuucaca

SEQ ID NO: 12448 - RNA, 19 nt, artificial
  Oligomer
gguaauauuugaggaauca

SEQ ID NO: 12449 - RNA, 19 nt, artificial
  Oligomer
gcccauuugaguuuuacau

SEQ ID NO: 12450 - RNA, 19 nt, artificial
  Oligomer
ucaaaugcuuggaaagaua

SEQ ID NO: 12451 - RNA, 19 nt, artificial
  Oligomer
cauagaucccauuuuugua

SEQ ID NO: 12452 - RNA, 19 nt, artificial
  Oligomer
cacucaacaauguucaauu

SEQ ID NO: 12453 - RNA, 19 nt, artificial
  Oligomer
cguccagauaaccaugcau

SEQ ID NO: 12454 - RNA, 19 nt, artificial
  Oligomer
aagcaaaaguagaagccca

SEQ ID NO: 12455 - RNA, 19 nt, artificial
  Oligomer
ggauaaggagcuuauucag

SEQ ID NO: 12456 - RNA, 19 nt, artificial
  Oligomer
gcaugcacccagauuuuuu

SEQ ID NO: 12457 - RNA, 19 nt, artificial
  Oligomer
aagaguaaaugagaaauau

SEQ ID NO: 12458 - RNA, 19 nt, artificial
  Oligomer
ccuuggauaccugucacua

SEQ ID NO: 12459 - RNA, 19 nt, artificial
  Oligomer
uguucuuaaguguugaaua

SEQ ID NO: 12460 - RNA, 19 nt, artificial
  Oligomer
ugagaaauauuacggcaau

SEQ ID NO: 12461 - RNA, 19 nt, artificial
  Oligomer
gguccuaaaaagggaaaau

SEQ ID NO: 12462 - RNA, 19 nt, artificial
  Oligomer
agguccuugucccugagaa

SEQ ID NO: 12463 - RNA, 19 nt, artificial
  Oligomer
auuuuuguacagaauugaa

SEQ ID NO: 12464 - RNA, 19 nt, artificial
  Oligomer
aaggguccuaaaaagggaa

SEQ ID NO: 12465 - RNA, 19 nt, artificial
  Oligomer
gucuauuguuaagcuccaa

SEQ ID NO: 12466 - RNA, 19 nt, artificial
  Oligomer
ucaacgagguaauauuuga

SEQ ID NO: 12467 - RNA, 19 nt, artificial
  Oligomer
caugcaugcacccagauuu

SEQ ID NO: 12468 - RNA, 19 nt, artificial
  Oligomer
ugaguuuaauuaaagcuua

SEQ ID NO: 12469 - RNA, 19 nt, artificial
  Oligomer
gaacugucuguccaaauca

SEQ ID NO: 12470 - RNA, 19 nt, artificial
  Oligomer
uccuaaaaagggaaaauau

SEQ ID NO: 12471 - RNA, 19 nt, artificial
  Oligomer
ccuagguaagaguaaauga

SEQ ID NO: 12472 - RNA, 19 nt, artificial
  Oligomer
ggaaauugaaaauguaugu

SEQ ID NO: 12473 - RNA, 19 nt, artificial
  Oligomer
cucuucaaaugcuuggaaa

SEQ ID NO: 12474 - RNA, 19 nt, artificial
  Oligomer
aaagcuuaacccuagguaa

SEQ ID NO: 12475 - RNA, 19 nt, artificial
  Oligomer
ggaaauuaaaguuugucua

SEQ ID NO: 12476 - RNA, 19 nt, artificial
  Oligomer
ggaauagguaagcaaaagu

SEQ ID NO: 12477 - RNA, 19 nt, artificial
  Oligomer
guauguaaaaagcuggaua

SEQ ID NO: 12478 - RNA, 19 nt, artificial
  Oligomer
gauuggguaguaaaacuau

SEQ ID NO: 12479 - RNA, 19 nt, artificial
  Oligomer
gccuccacucaacaauguu

SEQ ID NO: 12480 - RNA, 19 nt, artificial
  Oligomer
ugauugaaggguccuaaaa

SEQ ID NO: 12481 - RNA, 19 nt, artificial
  Oligomer
cuuuggagaagugauucaa

SEQ ID NO: 12482 - RNA, 19 nt, artificial
  Oligomer
gaugaauaccugugaggau

SEQ ID NO: 12483 - RNA, 19 nt, artificial
  Oligomer
cuauggagauaugguuuau

SEQ ID NO: 12484 - RNA, 19 nt, artificial
  Oligomer
gaaggguuuuuagacagga

SEQ ID NO: 12485 - RNA, 19 nt, artificial
  Oligomer
gagaauugcucaagauguc

SEQ ID NO: 12486 - RNA, 19 nt, artificial
  Oligomer
aaaguagaagcccauuuga

SEQ ID NO: 12487 - RNA, 19 nt, artificial
  Oligomer
uugaaguaucucuccuuaa

SEQ ID NO: 12488 - RNA, 19 nt, artificial
  Oligomer
aucccauuuuuguacagaa

SEQ ID NO: 12489 - RNA, 19 nt, artificial
  Oligomer
guaauauuugaggaaucaa

SEQ ID NO: 12490 - RNA, 19 nt, artificial
  Oligomer
agaucuagucccucucuga

SEQ ID NO: 12491 - RNA, 19 nt, artificial
  Oligomer
aacaaacuaaacucuucaa

SEQ ID NO: 12492 - RNA, 19 nt, artificial
  Oligomer
guccuaaaaagggaaaaua

SEQ ID NO: 12493 - RNA, 19 nt, artificial
  Oligomer
guaguugauuacucuucca

SEQ ID NO: 12494 - RNA, 19 nt, artificial
  Oligomer
gugaggauaggaaauuagu

SEQ ID NO: 12495 - RNA, 19 nt, artificial
  Oligomer
ccucacucuaauguuuuaa

SEQ ID NO: 12496 - RNA, 19 nt, artificial
  Oligomer
ucaccguccagauaaccau

SEQ ID NO: 12497 - RNA, 19 nt, artificial
  Oligomer
gauucacuuaguaaucuau

SEQ ID NO: 12498 - RNA, 19 nt, artificial
  Oligomer
uguuucacauucauagcaa

SEQ ID NO: 12499 - RNA, 19 nt, artificial
  Oligomer
uaggcuugguaauagacua

SEQ ID NO: 12500 - RNA, 19 nt, artificial
  Oligomer
aaugggauggaauagguaa

SEQ ID NO: 12501 - RNA, 19 nt, artificial
  Oligomer
ucuugggcaucgauguaga

SEQ ID NO: 12502 - RNA, 19 nt, artificial
  Oligomer
aaagcaaacuaaacuuggu

SEQ ID NO: 12503 - RNA, 19 nt, artificial
  Oligomer
cagaaucauacuaaaugau

SEQ ID NO: 12504 - RNA, 19 nt, artificial
  Oligomer
gguaggauuaaguagguga

SEQ ID NO: 12505 - RNA, 19 nt, artificial
  Oligomer
aaaucaauguuguuuugca

SEQ ID NO: 12506 - RNA, 19 nt, artificial
  Oligomer
agccuaucaaaacuuccaa

SEQ ID NO: 12507 - RNA, 19 nt, artificial
  Oligomer
uaccugugaggauaggaaa

SEQ ID NO: 12508 - RNA, 19 nt, artificial
  Oligomer
auauuacggcaauaaugga

SEQ ID NO: 12509 - RNA, 19 nt, artificial
  Oligomer
uguauacuaccacuuugaa

SEQ ID NO: 12510 - RNA, 19 nt, artificial
  Oligomer
gguaauagacuauauaaac

SEQ ID NO: 12511 - RNA, 19 nt, artificial
  Oligomer
cauacuaaaugauauuuag

SEQ ID NO: 12512 - RNA, 19 nt, artificial
  Oligomer
gaacuuggaaauugaaaau

SEQ ID NO: 12513 - RNA, 19 nt, artificial
  Oligomer
cugggauuauguuguuccu

SEQ ID NO: 12514 - RNA, 19 nt, artificial
  Oligomer
ggccuuuggagaagugauu

SEQ ID NO: 12515 - RNA, 19 nt, artificial
  Oligomer
auuucgacuuguuaagaaa

SEQ ID NO: 12516 - RNA, 19 nt, artificial
  Oligomer
gucuuauuccaacuaagua

SEQ ID NO: 12517 - RNA, 19 nt, artificial
  Oligomer
agaaauauuacggcaauaa

SEQ ID NO: 12518 - RNA, 19 nt, artificial
  Oligomer
cuagcuucagggacuuuuu

SEQ ID NO: 12519 - RNA, 19 nt, artificial
  Oligomer
gggauggaauagguaagca

SEQ ID NO: 12520 - RNA, 19 nt, artificial
  Oligomer
uguuguuuugcaugucuau

SEQ ID NO: 12521 - RNA, 19 nt, artificial
  Oligomer
ccugcuaagugauuuugac

SEQ ID NO: 12522 - RNA, 19 nt, artificial
  Oligomer
cugguguuacugaaaaaca

SEQ ID NO: 12523 - RNA, 19 nt, artificial
  Oligomer
cuguauacuaccacuuuga

SEQ ID NO: 12524 - RNA, 19 nt, artificial
  Oligomer
acuagaaaaaugcaaaaua

SEQ ID NO: 12525 - RNA, 19 nt, artificial
  Oligomer
ccugagaaacugacccaga

SEQ ID NO: 12526 - RNA, 19 nt, artificial
  Oligomer
ccuuuuuuauguuaaugag

SEQ ID NO: 12527 - RNA, 19 nt, artificial
  Oligomer
agggacuuuuucuuuagua

SEQ ID NO: 12528 - RNA, 19 nt, artificial
  Oligomer
ugguguuacugaaaaacag

SEQ ID NO: 12529 - RNA, 19 nt, artificial
  Oligomer
uucgacuuguuaagaaaaa

SEQ ID NO: 12530 - RNA, 19 nt, artificial
  Oligomer
cauggacuagcuucaggga

SEQ ID NO: 12531 - RNA, 19 nt, artificial
  Oligomer
uuaucucuuuccuuuuuua

SEQ ID NO: 12532 - RNA, 19 nt, artificial
  Oligomer
guuugucuauuuuugacaa

SEQ ID NO: 12533 - RNA, 19 nt, artificial
  Oligomer
uggauaaggagcuuauuca

SEQ ID NO: 12534 - RNA, 19 nt, artificial
  Oligomer
cuagcgucguaccuacuuu

SEQ ID NO: 12535 - RNA, 19 nt, artificial
  Oligomer
ugcaaaauauugaacugau

SEQ ID NO: 12536 - RNA, 19 nt, artificial
  Oligomer
uuuaaaucacagaaucaua

SEQ ID NO: 12537 - RNA, 19 nt, artificial
  Oligomer
aaacgggucaauuuacgaa

SEQ ID NO: 12538 - RNA, 19 nt, artificial
  Oligomer
auugaaacgggucaauuua

SEQ ID NO: 12539 - RNA, 19 nt, artificial
  Oligomer
agcuauuagcuccacuuca

SEQ ID NO: 12540 - RNA, 19 nt, artificial
  Oligomer
cgcuucuccucugguuuca

SEQ ID NO: 12541 - RNA, 19 nt, artificial
  Oligomer
cuuggauaccugucacuag

SEQ ID NO: 12542 - RNA, 19 nt, artificial
  Oligomer
cagggacuuuuucuuuagu

SEQ ID NO: 12543 - RNA, 19 nt, artificial
  Oligomer
ccucaacgagguaauauuu

SEQ ID NO: 12544 - RNA, 19 nt, artificial
  Oligomer
aguagaucauuaucucuuu

SEQ ID NO: 12545 - RNA, 19 nt, artificial
  Oligomer
uauaguacagccuagagaa

SEQ ID NO: 12546 - RNA, 19 nt, artificial
  Oligomer
gaauacugucuuuaaacua

SEQ ID NO: 12547 - RNA, 19 nt, artificial
  Oligomer
agugauucaaaauagugua

SEQ ID NO: 12548 - RNA, 19 nt, artificial
  Oligomer
ggguaguaaaacuauucag

SEQ ID NO: 12549 - RNA, 19 nt, artificial
  Oligomer
uugccuauuuugauuuuca

SEQ ID NO: 12550 - RNA, 19 nt, artificial
  Oligomer
accacuuugaauuauugaa

SEQ ID NO: 12551 - RNA, 19 nt, artificial
  Oligomer
caggugugauccuguuacu

SEQ ID NO: 12552 - RNA, 19 nt, artificial
  Oligomer
guuccugaacccaaccuca

SEQ ID NO: 12553 - RNA, 19 nt, artificial
  Oligomer
ugcucauggacuagcuuca

SEQ ID NO: 12554 - RNA, 19 nt, artificial
  Oligomer
agggaauaauaaaggccuu

SEQ ID NO: 12555 - RNA, 19 nt, artificial
  Oligomer
uaugcacgugaacuuggaa

SEQ ID NO: 12556 - RNA, 19 nt, artificial
  Oligomer
gagaagugauucaaaauag

SEQ ID NO: 12557 - RNA, 19 nt, artificial
  Oligomer
aaucaauguuguuuugcau

SEQ ID NO: 12558 - RNA, 19 nt, artificial
  Oligomer
aaggaaacagagccguuga

SEQ ID NO: 12559 - RNA, 19 nt, artificial
  Oligomer
cauuuuuguacagaauuga

SEQ ID NO: 12560 - RNA, 19 nt, artificial
  Oligomer
aaggcuucuugggcaucga

SEQ ID NO: 12561 - RNA, 19 nt, artificial
  Oligomer
cagccuagagaaugaaacu

SEQ ID NO: 12562 - RNA, 19 nt, artificial
  Oligomer
aguacagccuagagaauga

SEQ ID NO: 12563 - RNA, 19 nt, artificial
  Oligomer
ugaggauaggaaauuaguu

SEQ ID NO: 12564 - RNA, 19 nt, artificial
  Oligomer
acuaaacuugguugcucaa

SEQ ID NO: 12565 - RNA, 19 nt, artificial
  Oligomer
aaacucaccguccagauaa

SEQ ID NO: 12566 - RNA, 19 nt, artificial
  Oligomer
gacucaaauuugaaggguu

SEQ ID NO: 12567 - RNA, 19 nt, artificial
  Oligomer
aagguaggauuaaguaggu

SEQ ID NO: 12568 - RNA, 19 nt, artificial
  Oligomer
gaauugaaugggauggaau

SEQ ID NO: 12569 - RNA, 19 nt, artificial
  Oligomer
aaauuaguucugagaucua

SEQ ID NO: 12570 - RNA, 19 nt, artificial
  Oligomer
ccugucacuagggaauaau

SEQ ID NO: 12571 - RNA, 19 nt, artificial
  Oligomer
cuccacucaacaauguuca

SEQ ID NO: 12572 - RNA, 19 nt, artificial
  Oligomer
cuacugggauuauguuguu

SEQ ID NO: 12573 - RNA, 19 nt, artificial
  Oligomer
aauuugaaggguuuuuaga

SEQ ID NO: 12574 - RNA, 19 nt, artificial
  Oligomer
ccguugaccaugguugcaa

SEQ ID NO: 12575 - RNA, 19 nt, artificial
  Oligomer
agcuagucagcuaaaguca

SEQ ID NO: 12576 - RNA, 19 nt, artificial
  Oligomer
ggcuuuuuuuucucuaagu

SEQ ID NO: 12577 - RNA, 19 nt, artificial
  Oligomer
gucccucucugauucacuu

SEQ ID NO: 12578 - RNA, 19 nt, artificial
  Oligomer
ggacuagcuucagggacuu

SEQ ID NO: 12579 - RNA, 19 nt, artificial
  Oligomer
cccagauuuuuuccaccuu

SEQ ID NO: 12580 - RNA, 19 nt, artificial
  Oligomer
aaggcuguuaaauuaauau

SEQ ID NO: 12581 - RNA, 19 nt, artificial
  Oligomer
accacgguguuguuuuaga

SEQ ID NO: 12582 - RNA, 19 nt, artificial
  Oligomer
caaagguccuugucccuga

SEQ ID NO: 12583 - RNA, 19 nt, artificial
  Oligomer
cacugauuggaacaacagu

SEQ ID NO: 12584 - RNA, 19 nt, artificial
  Oligomer
caauuuacgaagucugcau

SEQ ID NO: 12585 - RNA, 19 nt, artificial
  Oligomer
uguuguccuuuuuccacua

SEQ ID NO: 12586 - RNA, 19 nt, artificial
  Oligomer
caaaauauugaacugauau

SEQ ID NO: 12587 - RNA, 19 nt, artificial
  Oligomer
gcaugucuauuguuaagcu

SEQ ID NO: 12588 - RNA, 19 nt, artificial
  Oligomer
ggagaacucugauccucag

SEQ ID NO: 12589 - RNA, 19 nt, artificial
  Oligomer
uuaugcacgugaacuugga

SEQ ID NO: 12590 - RNA, 19 nt, artificial
  Oligomer
cuguuaugcuuacaaaaug

SEQ ID NO: 12591 - RNA, 19 nt, artificial
  Oligomer
cuguuaaauuaauauuccu

SEQ ID NO: 12592 - RNA, 19 nt, artificial
  Oligomer
ccagauaaccaugcaugca

SEQ ID NO: 12593 - RNA, 19 nt, artificial
  Oligomer
cgaaggaaacagagccguu

SEQ ID NO: 12594 - RNA, 19 nt, artificial
  Oligomer
cagaugaaccauuucacca

SEQ ID NO: 12595 - RNA, 19 nt, artificial
  Oligomer
uucagaggauuuuuuaaau

SEQ ID NO: 12596 - RNA, 19 nt, artificial
  Oligomer
gguuuauaguacagccuag

SEQ ID NO: 12597 - RNA, 19 nt, artificial
  Oligomer
ccaguuccugacucaaauu

SEQ ID NO: 12598 - RNA, 19 nt, artificial
  Oligomer
ccaugcaugcacccagauu

SEQ ID NO: 12599 - RNA, 19 nt, artificial
  Oligomer
cugucuguccaaaucaaag

SEQ ID NO: 12600 - RNA, 19 nt, artificial
  Oligomer
uaauauuccuguuaaagga

SEQ ID NO: 12601 - RNA, 19 nt, artificial
  Oligomer
aggccuuauuuuuugucuu

SEQ ID NO: 12602 - RNA, 19 nt, artificial
  Oligomer
aaaguuugucuauuuuuga

SEQ ID NO: 12603 - RNA, 19 nt, artificial
  Oligomer
uccucugguuucaggagaa

SEQ ID NO: 12604 - RNA, 19 nt, artificial
  Oligomer
ugucuauuguuaagcucca

SEQ ID NO: 12605 - RNA, 19 nt, artificial
  Oligomer
gauacuauaagugaccuaa

SEQ ID NO: 12606 - RNA, 19 nt, artificial
  Oligomer
gccugcuaagugauuuuga

SEQ ID NO: 12607 - RNA, 19 nt, artificial
  Oligomer
auuaaguaggugaguuuaa

SEQ ID NO: 12608 - RNA, 19 nt, artificial
  Oligomer
agaaacugacccagagaau

SEQ ID NO: 12609 - RNA, 19 nt, artificial
  Oligomer
gggaauaauaaaggccuua

SEQ ID NO: 12610 - RNA, 19 nt, artificial
  Oligomer
acaggaagguaggauuaag

SEQ ID NO: 12611 - RNA, 19 nt, artificial
  Oligomer
aacuguuguccuuuuucca

SEQ ID NO: 12612 - RNA, 19 nt, artificial
  Oligomer
uagguaagaguaaaugaga

SEQ ID NO: 12613 - RNA, 19 nt, artificial
  Oligomer
gaucuagucccucucugau

SEQ ID NO: 12614 - RNA, 19 nt, artificial
  Oligomer
aaaugucacuguucaaauu

SEQ ID NO: 12615 - RNA, 19 nt, artificial
  Oligomer
ccauuugaguuuuacauuu

SEQ ID NO: 12616 - RNA, 19 nt, artificial
  Oligomer
gguuucaggagaacucuga

SEQ ID NO: 12617 - RNA, 19 nt, artificial
  Oligomer
gccuuauuuuuugucuuau

SEQ ID NO: 12618 - RNA, 19 nt, artificial
  Oligomer
gucuuuaaacuagaaaaau

SEQ ID NO: 12619 - RNA, 19 nt, artificial
  Oligomer
gggacuuuuucuuuaguag

SEQ ID NO: 12620 - RNA, 19 nt, artificial
  Oligomer
uguacagaauugaauggga

SEQ ID NO: 12621 - RNA, 19 nt, artificial
  Oligomer
uaaacuagaaaaaugcaaa

SEQ ID NO: 12622 - RNA, 19 nt, artificial
  Oligomer
gcaucgauguagaacuguu

SEQ ID NO: 12623 - RNA, 19 nt, artificial
  Oligomer
auaccugugaggauaggaa

SEQ ID NO: 12624 - RNA, 19 nt, artificial
  Oligomer
aacuaaacuugguugcuca

SEQ ID NO: 12625 - RNA, 19 nt, artificial
  Oligomer
ugagaaacugacccagaga

SEQ ID NO: 12626 - RNA, 19 nt, artificial
  Oligomer
aguagaagcccauuugagu

SEQ ID NO: 12627 - RNA, 19 nt, artificial
  Oligomer
aggcuucuugggcaucgau

SEQ ID NO: 12628 - RNA, 19 nt, artificial
  Oligomer
caacgagguaauauuugag

SEQ ID NO: 12629 - RNA, 19 nt, artificial
  Oligomer
auugaaguaucucuccuua

SEQ ID NO: 12630 - RNA, 19 nt, artificial
  Oligomer
uuaaguaggugaguuuaau

SEQ ID NO: 12631 - RNA, 19 nt, artificial
  Oligomer
gauucuagcgucguaccua

SEQ ID NO: 12632 - RNA, 19 nt, artificial
  Oligomer
agaugaaccauuucaccau

SEQ ID NO: 12633 - RNA, 19 nt, artificial
  Oligomer
gaccuaaaaugucacuguu

SEQ ID NO: 12634 - RNA, 19 nt, artificial
  Oligomer
ccucucugauucacuuagu

SEQ ID NO: 12635 - RNA, 19 nt, artificial
  Oligomer
augauauuuagccuaucaa

SEQ ID NO: 12636 - RNA, 19 nt, artificial
  Oligomer
gagugaaugaugaauaccu

SEQ ID NO: 12637 - RNA, 19 nt, artificial
  Oligomer
gcguagggacagauguauu

SEQ ID NO: 12638 - RNA, 19 nt, artificial
  Oligomer
cuuccucacucuaauguuu

SEQ ID NO: 12639 - RNA, 19 nt, artificial
  Oligomer
ggcguagggacagauguau

SEQ ID NO: 12640 - RNA, 19 nt, artificial
  Oligomer
uccauugagugaaugauga

SEQ ID NO: 12641 - RNA, 19 nt, artificial
  Oligomer
cugcauagaucccauuuuu

SEQ ID NO: 12642 - RNA, 19 nt, artificial
  Oligomer
cauagcaacugcagcuaac

SEQ ID NO: 12643 - RNA, 19 nt, artificial
  Oligomer
acaaacuaaacucuucaaa

SEQ ID NO: 12644 - RNA, 19 nt, artificial
  Oligomer
cuuuuuuauguuaaugaga

SEQ ID NO: 12645 - RNA, 19 nt, artificial
  Oligomer
ccagaauuugguuaaaaug

SEQ ID NO: 12646 - RNA, 19 nt, artificial
  Oligomer
ggugugauccuguuacuga

SEQ ID NO: 12647 - RNA, 19 nt, artificial
  Oligomer
agcaaaaguagaagcccau

SEQ ID NO: 12648 - RNA, 19 nt, artificial
  Oligomer
cacaauuugguuucaggua

SEQ ID NO: 12649 - RNA, 19 nt, artificial
  Oligomer
agaggauuuuuuaaaucac

SEQ ID NO: 12650 - RNA, 19 nt, artificial
  Oligomer
aaaccagauuugccuauuu

SEQ ID NO: 12651 - RNA, 19 nt, artificial
  Oligomer
ucguggauaaggagcuuau

SEQ ID NO: 12652 - RNA, 19 nt, artificial
  Oligomer
cuuuacucacugauuggaa

SEQ ID NO: 12653 - RNA, 19 nt, artificial
  Oligomer
ccucagcucaggauuucga

SEQ ID NO: 12654 - RNA, 19 nt, artificial
  Oligomer
ugaaacucaccguccagau

SEQ ID NO: 12655 - RNA, 19 nt, artificial
  Oligomer
cgacuuguuaagaaaaaac

SEQ ID NO: 12656 - RNA, 19 nt, artificial
  Oligomer
agaauuuagccuccacuca

SEQ ID NO: 12657 - RNA, 19 nt, artificial
  Oligomer
uuucaugauuggguaguaa

SEQ ID NO: 12658 - RNA, 19 nt, artificial
  Oligomer
ccacaauuugguuucaggu

SEQ ID NO: 12659 - RNA, 19 nt, artificial
  Oligomer
uucaugauuggguaguaaa

SEQ ID NO: 12660 - RNA, 19 nt, artificial
  Oligomer
uagacuauauaaaccagau

SEQ ID NO: 12661 - RNA, 19 nt, artificial
  Oligomer
agauuugccuauuuugauu

SEQ ID NO: 12662 - RNA, 19 nt, artificial
  Oligomer
guacagaauugaaugggau

SEQ ID NO: 12663 - RNA, 19 nt, artificial
  Oligomer
ggaagguaggauuaaguag

SEQ ID NO: 12664 - RNA, 19 nt, artificial
  Oligomer
uuucagaggauuuuuuaaa

SEQ ID NO: 12665 - RNA, 19 nt, artificial
  Oligomer
gcuauggagauaugguuua

SEQ ID NO: 12666 - RNA, 19 nt, artificial
  Oligomer
guuucaggagaacucugau

SEQ ID NO: 12667 - RNA, 19 nt, artificial
  Oligomer
cagugauugaaggguccua

SEQ ID NO: 12668 - RNA, 19 nt, artificial
  Oligomer
aggguccuaaaaagggaaa

SEQ ID NO: 12669 - RNA, 19 nt, artificial
  Oligomer
ggaacaacagugauugaag

SEQ ID NO: 12670 - RNA, 19 nt, artificial
  Oligomer
cucaccguccagauaacca

SEQ ID NO: 12671 - RNA, 19 nt, artificial
  Oligomer
uagcgucguaccuacuuuu

SEQ ID NO: 12672 - RNA, 19 nt, artificial
  Oligomer
ccagcauuucagaauugcu

SEQ ID NO: 12673 - RNA, 19 nt, artificial
  Oligomer
cucagaugaaccauuucac

SEQ ID NO: 12674 - RNA, 19 nt, artificial
  Oligomer
uuccugacucaaauuugaa

SEQ ID NO: 12675 - RNA, 19 nt, artificial
  Oligomer
aaaggaaauuaaaguuugu

SEQ ID NO: 12676 - RNA, 19 nt, artificial
  Oligomer
aaucucagaugaaccauuu

SEQ ID NO: 12677 - RNA, 19 nt, artificial
  Oligomer
ggcuauggagauaugguuu

SEQ ID NO: 12678 - RNA, 19 nt, artificial
  Oligomer
gauuuuuuccaccuuggau

SEQ ID NO: 12679 - RNA, 19 nt, artificial
  Oligomer
uauggagauaugguuuaua

SEQ ID NO: 12680 - RNA, 19 nt, artificial
  Oligomer
ucaaaauaguguagauuuu

SEQ ID NO: 12681 - RNA, 19 nt, artificial
  Oligomer
gcuucagggacuuuuucuu

SEQ ID NO: 12682 - RNA, 19 nt, artificial
  Oligomer
augcaugcacccagauuuu

SEQ ID NO: 12683 - RNA, 19 nt, artificial
  Oligomer
ugacuacugggauuauguu

SEQ ID NO: 12684 - RNA, 19 nt, artificial
  Oligomer
auacugucuuuaaacuaga

SEQ ID NO: 12685 - RNA, 19 nt, artificial
  Oligomer
gggucaauuuacgaagucu

SEQ ID NO: 12686 - RNA, 19 nt, artificial
  Oligomer
ccuaucaaaacuuccaaaa

SEQ ID NO: 12687 - RNA, 19 nt, artificial
  Oligomer
cuucuugggcaucgaugua

SEQ ID NO: 12688 - RNA, 19 nt, artificial
  Oligomer
uauucauccugguguuacu

SEQ ID NO: 12689 - RNA, 19 nt, artificial
  Oligomer
ugcuuggaaagauacuaca

SEQ ID NO: 12690 - RNA, 19 nt, artificial
  Oligomer
ggauuucgacuuguuaaga

SEQ ID NO: 12691 - RNA, 19 nt, artificial
  Oligomer
ucucugauucacuuaguaa

SEQ ID NO: 12692 - RNA, 19 nt, artificial
  Oligomer
accugcccuaaauaagaaa

SEQ ID NO: 12693 - RNA, 19 nt, artificial
  Oligomer
cacauucauagcaacugca

SEQ ID NO: 12694 - RNA, 19 nt, artificial
  Oligomer
guagauuuucugcauagau

SEQ ID NO: 12695 - RNA, 19 nt, artificial
  Oligomer
uaguaaaacuauucagcua

SEQ ID NO: 12696 - RNA, 19 nt, artificial
  Oligomer
gcacgugaacuuggaaauu

SEQ ID NO: 12697 - RNA, 19 nt, artificial
  Oligomer
cuguuaaaggaaauuaaag

SEQ ID NO: 12698 - RNA, 19 nt, artificial
  Oligomer
caccuuggauaccugucac

SEQ ID NO: 12699 - RNA, 19 nt, artificial
  Oligomer
ggcuugguaauagacuaua

SEQ ID NO: 12700 - RNA, 19 nt, artificial
  Oligomer
uuuuuauguuaaugagaga

SEQ ID NO: 12701 - RNA, 19 nt, artificial
  Oligomer
gauaggaaauuaguucuga

SEQ ID NO: 12702 - RNA, 19 nt, artificial
  Oligomer
aggauuuuuuaaaucacag

SEQ ID NO: 12703 - RNA, 19 nt, artificial
  Oligomer
gauuuugacuacugggauu

SEQ ID NO: 12704 - RNA, 19 nt, artificial
  Oligomer
aacucaccguccagauaac

SEQ ID NO: 12705 - RNA, 19 nt, artificial
  Oligomer
uguuuuaaagaggcaacaa

SEQ ID NO: 12706 - RNA, 19 nt, artificial
  Oligomer
auuugaguuuuacauuuga

SEQ ID NO: 12707 - RNA, 19 nt, artificial
  Oligomer
uuucgacuuguuaagaaaa

SEQ ID NO: 12708 - RNA, 19 nt, artificial
  Oligomer
caagauguccugcggcuuu

SEQ ID NO: 12709 - RNA, 19 nt, artificial
  Oligomer
ucauagcaacugcagcuaa

SEQ ID NO: 12710 - RNA, 19 nt, artificial
  Oligomer
uauugaaacgggucaauuu

SEQ ID NO: 12711 - RNA, 19 nt, artificial
  Oligomer
uaagaguaaaugagaaaua

SEQ ID NO: 12712 - RNA, 19 nt, artificial
  Oligomer
agaaucauacuaaaugaua

SEQ ID NO: 12713 - RNA, 19 nt, artificial
  Oligomer
uguuaaugagagaauuuag

SEQ ID NO: 12714 - RNA, 19 nt, artificial
  Oligomer
ugauuggguaguaaaacua

SEQ ID NO: 12715 - RNA, 19 nt, artificial
  Oligomer
gaaacugacccagagaauu

SEQ ID NO: 12716 - RNA, 19 nt, artificial
  Oligomer
uguaaaaagcuggauagga

SEQ ID NO: 12717 - RNA, 19 nt, artificial
  Oligomer
accucaacgagguaauauu

SEQ ID NO: 12718 - RNA, 19 nt, artificial
  Oligomer
agagaauugcucaagaugu

SEQ ID NO: 12719 - RNA, 19 nt, artificial
  Oligomer
guuucagguaggcuuggua

SEQ ID NO: 12720 - RNA, 19 nt, artificial
  Oligomer
ccuuuggagaagugauuca

SEQ ID NO: 12721 - RNA, 19 nt, artificial
  Oligomer
acgagguaauauuugagga

SEQ ID NO: 12722 - RNA, 19 nt, artificial
  Oligomer
caacaauguucaauucagc

SEQ ID NO: 12723 - RNA, 19 nt, artificial
  Oligomer
gcuuuucugggaauugaag

SEQ ID NO: 12724 - RNA, 19 nt, artificial
  Oligomer
agccuccacucaacaaugu

SEQ ID NO: 12725 - RNA, 19 nt, artificial
  Oligomer
uucaggaacaacauaaucc

SEQ ID NO: 12726 - RNA, 19 nt, artificial
  Oligomer
uucaauucccagaaaagcc

SEQ ID NO: 12727 - RNA, 19 nt, artificial
  Oligomer
uucaauuuccaaguucacg

SEQ ID NO: 12728 - RNA, 19 nt, artificial
  Oligomer
uuaguuuguuagaacacug

SEQ ID NO: 12729 - RNA, 19 nt, artificial
  Oligomer
uuuaauuuccuuuaacagg

SEQ ID NO: 12730 - RNA, 19 nt, artificial
  Oligomer
uuuuguaagcauaacaggc

SEQ ID NO: 12731 - RNA, 19 nt, artificial
  Oligomer
agcaguuccauuauugccg

SEQ ID NO: 12732 - RNA, 19 nt, artificial
  Oligomer
uuuauugucaaaaauagac

SEQ ID NO: 12733 - RNA, 19 nt, artificial
  Oligomer
uuuaauuaaacucaccuac

SEQ ID NO: 12734 - RNA, 19 nt, artificial
  Oligomer
uugaguggaggcuaaauuc

SEQ ID NO: 12735 - RNA, 19 nt, artificial
  Oligomer
uuuauuauucccuagugac

SEQ ID NO: 12736 - RNA, 19 nt, artificial
  Oligomer
uuugcuuaccuauuccauc

SEQ ID NO: 12737 - RNA, 19 nt, artificial
  Oligomer
uuaagcuuuaauuaaacuc

SEQ ID NO: 12738 - RNA, 19 nt, artificial
  Oligomer
uauauuuucccuuuuuagg

SEQ ID NO: 12739 - RNA, 19 nt, artificial
  Oligomer
uuucucagggacaaggacc

SEQ ID NO: 12740 - RNA, 19 nt, artificial
  Oligomer
uuuaaagacaguauucaac

SEQ ID NO: 12741 - RNA, 19 nt, artificial
  Oligomer
uugcuuaccuauuccaucc

SEQ ID NO: 12742 - RNA, 19 nt, artificial
  Oligomer
uauuauucccuagugacag

SEQ ID NO: 12743 - RNA, 19 nt, artificial
  Oligomer
ugugauuuaaaaaauccuc

SEQ ID NO: 12744 - RNA, 19 nt, artificial
  Oligomer
uuuggacagacaguucucc

SEQ ID NO: 12745 - RNA, 19 nt, artificial
  Oligomer
uucuccagcauuuuaacca

SEQ ID NO: 12746 - RNA, 19 nt, artificial
  Oligomer
uaauauuucucauuuacuc

SEQ ID NO: 12747 - RNA, 19 nt, artificial
  Oligomer
uaucaguucaauauuuugc

SEQ ID NO: 12748 - RNA, 19 nt, artificial
  Oligomer
uauuaauuuaacagccuuc

SEQ ID NO: 12749 - RNA, 19 nt, artificial
  Oligomer
uacauuuucaauuuccaag

SEQ ID NO: 12750 - RNA, 19 nt, artificial
  Oligomer
uuaacaagucgaaauccug

SEQ ID NO: 12751 - RNA, 19 nt, artificial
  Oligomer
auuagagugaggaagucac

SEQ ID NO: 12752 - RNA, 19 nt, artificial
  Oligomer
uuggacagacaguucucca

SEQ ID NO: 12753 - RNA, 19 nt, artificial
  Oligomer
uugauuuggacagacaguu

SEQ ID NO: 12754 - RNA, 19 nt, artificial
  Oligomer
auauuuugcauuuuucuag

SEQ ID NO: 12755 - RNA, 19 nt, artificial
  Oligomer
uuagagugaggaagucacc

SEQ ID NO: 12756 - RNA, 19 nt, artificial
  Oligomer
uuuuacuacccaaucauga

SEQ ID NO: 12757 - RNA, 19 nt, artificial
  Oligomer
ucuuuauauauuuucccuu

SEQ ID NO: 12758 - RNA, 19 nt, artificial
  Oligomer
uaguuuguuagaacacugg

SEQ ID NO: 12759 - RNA, 19 nt, artificial
  Oligomer
uuuuuaggacccuucaauc

SEQ ID NO: 12760 - RNA, 19 nt, artificial
  Oligomer
uucaucauucacucaaugg

SEQ ID NO: 12761 - RNA, 19 nt, artificial
  Oligomer
uacuauaaaccauaucucc

SEQ ID NO: 12762 - RNA, 19 nt, artificial
  Oligomer
uuuauauagucuauuacca

SEQ ID NO: 12763 - RNA, 19 nt, artificial
  Oligomer
ucaauucccagaaaagccc

SEQ ID NO: 12764 - RNA, 19 nt, artificial
  Oligomer
ucuuauuuagggcaggugg

SEQ ID NO: 12765 - RNA, 19 nt, artificial
  Oligomer
uuauccacgacccacagca

SEQ ID NO: 12766 - RNA, 19 nt, artificial
  Oligomer
ucaauuuccaaguucacgu

SEQ ID NO: 12767 - RNA, 19 nt, artificial
  Oligomer
uuugcuuugauuuggacag

SEQ ID NO: 12768 - RNA, 19 nt, artificial
  Oligomer
uucaucugagauuaagcac

SEQ ID NO: 12769 - RNA, 19 nt, artificial
  Oligomer
uuaaagacaguauucaaca

SEQ ID NO: 12770 - RNA, 19 nt, artificial
  Oligomer
uucucauuuacucuuaccu

SEQ ID NO: 12771 - RNA, 19 nt, artificial
  Oligomer
auuaauuuaacagccuucc

SEQ ID NO: 12772 - RNA, 19 nt, artificial
  Oligomer
uuguaguaucuuuccaagc

SEQ ID NO: 12773 - RNA, 19 nt, artificial
  Oligomer
uuugauaggcuaaauauca

SEQ ID NO: 12774 - RNA, 19 nt, artificial
  Oligomer
auuauugccguaauauuuc

SEQ ID NO: 12775 - RNA, 19 nt, artificial
  Oligomer
ucaaaauaggcaaaucugg

SEQ ID NO: 12776 - RNA, 19 nt, artificial
  Oligomer
uuaagcacauguaauacug

SEQ ID NO: 12777 - RNA, 19 nt, artificial
  Oligomer
uuuaguuuguuagaacacu

SEQ ID NO: 12778 - RNA, 19 nt, artificial
  Oligomer
uauacagcuacuacccuug

SEQ ID NO: 12779 - RNA, 19 nt, artificial
  Oligomer
aucuaaaacaacaccgugg

SEQ ID NO: 12780 - RNA, 19 nt, artificial
  Oligomer
uuccucaaauauuaccucg

SEQ ID NO: 12781 - RNA, 19 nt, artificial
  Oligomer
ugaagcaguuccauuauug

SEQ ID NO: 12782 - RNA, 19 nt, artificial
  Oligomer
uggacggugaguuucauuc

SEQ ID NO: 12783 - RNA, 19 nt, artificial
  Oligomer
ucuauuaccaagccuaccu

SEQ ID NO: 12784 - RNA, 19 nt, artificial
  Oligomer
uauaguaucaguaacagga

SEQ ID NO: 12785 - RNA, 19 nt, artificial
  Oligomer
aucaguaacaggaucacac

SEQ ID NO: 12786 - RNA, 19 nt, artificial
  Oligomer
ucacuuagcaggcucucug

SEQ ID NO: 12787 - RNA, 19 nt, artificial
  Oligomer
uccaugagcaguucuccug

SEQ ID NO: 12788 - RNA, 19 nt, artificial
  Oligomer
uuugagucaggaacuggug

SEQ ID NO: 12789 - RNA, 19 nt, artificial
  Oligomer
ucuugagcaauucucuggg

SEQ ID NO: 12790 - RNA, 19 nt, artificial
  Oligomer
uuuuaggucacuuauagua

SEQ ID NO: 12791 - RNA, 19 nt, artificial
  Oligomer
uuuugaaucacuucuccaa

SEQ ID NO: 12792 - RNA, 19 nt, artificial
  Oligomer
uuuaguuugcuuugauuug

SEQ ID NO: 12793 - RNA, 19 nt, artificial
  Oligomer
uuuucuaguuuaaagacag

SEQ ID NO: 12794 - RNA, 19 nt, artificial
  Oligomer
aauaagcuccuuauccacg

SEQ ID NO: 12795 - RNA, 19 nt, artificial
  Oligomer
uuuguaagcauaacaggca

SEQ ID NO: 12796 - RNA, 19 nt, artificial
  Oligomer
uuuugcuuaccuauuccau

SEQ ID NO: 12797 - RNA, 19 nt, artificial
  Oligomer
uuauuauucccuagugaca

SEQ ID NO: 12798 - RNA, 19 nt, artificial
  Oligomer
uugaacagugacauuuuag

SEQ ID NO: 12799 - RNA, 19 nt, artificial
  Oligomer
ucccuuuuuaggacccuuc

SEQ ID NO: 12800 - RNA, 19 nt, artificial
  Oligomer
uuccugucuaaaaacccuu

SEQ ID NO: 12801 - RNA, 19 nt, artificial
  Oligomer
uucuuauuuagggcaggug

SEQ ID NO: 12802 - RNA, 19 nt, artificial
  Oligomer
aucuugagcaauucucugg

SEQ ID NO: 12803 - RNA, 19 nt, artificial
  Oligomer
ucugugauuuaaaaaaucc

SEQ ID NO: 12804 - RNA, 19 nt, artificial
  Oligomer
uauuuugaaucacuucucc

SEQ ID NO: 12805 - RNA, 19 nt, artificial
  Oligomer
uucuacaucgaugcccaag

SEQ ID NO: 12806 - RNA, 19 nt, artificial
  Oligomer
uuauucccuagugacaggu

SEQ ID NO: 12807 - RNA, 19 nt, artificial
  Oligomer
uuaguuugcuuugauuugg

SEQ ID NO: 12808 - RNA, 19 nt, artificial
  Oligomer
uuuguaguaucuuuccaag

SEQ ID NO: 12809 - RNA, 19 nt, artificial
  Oligomer
uuuugauaggcuaaauauc

SEQ ID NO: 12810 - RNA, 19 nt, artificial
  Oligomer
augaaaaucaaaauaggca

SEQ ID NO: 12811 - RNA, 19 nt, artificial
  Oligomer
ugcaugguuaucuggacgg

SEQ ID NO: 12812 - RNA, 19 nt, artificial
  Oligomer
ucaaauuugagucaggaac

SEQ ID NO: 12813 - RNA, 19 nt, artificial
  Oligomer
uacuuuugcuuaccuauuc

SEQ ID NO: 12814 - RNA, 19 nt, artificial
  Oligomer
ucugagauuaagcacaugu

SEQ ID NO: 12815 - RNA, 19 nt, artificial
  Oligomer
uuauaaaggcaucuaaaac

SEQ ID NO: 12816 - RNA, 19 nt, artificial
  Oligomer
uugagucaggaacuggugg

SEQ ID NO: 12817 - RNA, 19 nt, artificial
  Oligomer
uaguauacagcuacuaccc

SEQ ID NO: 12818 - RNA, 19 nt, artificial
  Oligomer
aaucuuuauauauuuuccc

SEQ ID NO: 12819 - RNA, 19 nt, artificial
  Oligomer
uuaauuaaacucaccuacu

SEQ ID NO: 12820 - RNA, 19 nt, artificial
  Oligomer
auccuauccagcuuuuuac

SEQ ID NO: 12821 - RNA, 19 nt, artificial
  Oligomer
uauugccguaauauuucuc

SEQ ID NO: 12822 - RNA, 19 nt, artificial
  Oligomer
uugagcaauucucuggguc

SEQ ID NO: 12823 - RNA, 19 nt, artificial
  Oligomer
uauaaaggcaucuaaaaca

SEQ ID NO: 12824 - RNA, 19 nt, artificial
  Oligomer
uuuaguaugauucugugau

SEQ ID NO: 12825 - RNA, 19 nt, artificial
  Oligomer
uucaacacuuaagaacagg

SEQ ID NO: 12826 - RNA, 19 nt, artificial
  Oligomer
uaagacaaaaaauaaggcc

SEQ ID NO: 12827 - RNA, 19 nt, artificial
  Oligomer
uuauaguaucaguaacagg

SEQ ID NO: 12828 - RNA, 19 nt, artificial
  Oligomer
uugaacauuguugagugga

SEQ ID NO: 12829 - RNA, 19 nt, artificial
  Oligomer
aucaaaauaggcaaaucug

SEQ ID NO: 12830 - RNA, 19 nt, artificial
  Oligomer
uuuaggacccuucaaucac

SEQ ID NO: 12831 - RNA, 19 nt, artificial
  Oligomer
uuugauuuggacagacagu

SEQ ID NO: 12832 - RNA, 19 nt, artificial
  Oligomer
uuucaauaauucaaagugg

SEQ ID NO: 12833 - RNA, 19 nt, artificial
  Oligomer
ucuugcugcucaaacugcc

SEQ ID NO: 12834 - RNA, 19 nt, artificial
  Oligomer
uuaauuuccuuuaacagga

SEQ ID NO: 12835 - RNA, 19 nt, artificial
  Oligomer
ucauuuaguaugauucugu

SEQ ID NO: 12836 - RNA, 19 nt, artificial
  Oligomer
ucaaaaguagguacgacgc

SEQ ID NO: 12837 - RNA, 19 nt, artificial
  Oligomer
uaccuauuccaucccauuc

SEQ ID NO: 12838 - RNA, 19 nt, artificial
  Oligomer
uuuuuucuuaacaagucga

SEQ ID NO: 12839 - RNA, 19 nt, artificial
  Oligomer
uaauuuccuauccucacag

SEQ ID NO: 12840 - RNA, 19 nt, artificial
  Oligomer
auauagucuauuaccaagc

SEQ ID NO: 12841 - RNA, 19 nt, artificial
  Oligomer
uaaugaucuacuuaguugg

SEQ ID NO: 12842 - RNA, 19 nt, artificial
  Oligomer
aucuacacuauuuugaauc

SEQ ID NO: 12843 - RNA, 19 nt, artificial
  Oligomer
uuucaguaacaccaggaug

SEQ ID NO: 12844 - RNA, 19 nt, artificial
  Oligomer
uacuaagugaaucagagag

SEQ ID NO: 12845 - RNA, 19 nt, artificial
  Oligomer
uuuuucaguaacaccagga

SEQ ID NO: 12846 - RNA, 19 nt, artificial
  Oligomer
ucaacacuuaagaacaggg

SEQ ID NO: 12847 - RNA, 19 nt, artificial
  Oligomer
uuuuucuaguuuaaagaca

SEQ ID NO: 12848 - RNA, 19 nt, artificial
  Oligomer
uucugugauuuaaaaaauc

SEQ ID NO: 12849 - RNA, 19 nt, artificial
  Oligomer
uauauagucuauuaccaag

SEQ ID NO: 12850 - RNA, 19 nt, artificial
  Oligomer
auuugagucaggaacuggu

SEQ ID NO: 12851 - RNA, 19 nt, artificial
  Oligomer
auauauuuucccuuuuuag

SEQ ID NO: 12852 - RNA, 19 nt, artificial
  Oligomer
uuucucauuuacucuuacc

SEQ ID NO: 12853 - RNA, 19 nt, artificial
  Oligomer
uccaagguggaaaaaaucu

SEQ ID NO: 12854 - RNA, 19 nt, artificial
  Oligomer
uucuugcugcucaaacugc

SEQ ID NO: 12855 - RNA, 19 nt, artificial
  Oligomer
uuuaaaacauuagagugag

SEQ ID NO: 12856 - RNA, 19 nt, artificial
  Oligomer
cucaaaaguagguacgacg

SEQ ID NO: 12857 - RNA, 19 nt, artificial
  Oligomer
uuuugcauuuuucuaguuu

SEQ ID NO: 12858 - RNA, 19 nt, artificial
  Oligomer
uagagugaggaagucacca

SEQ ID NO: 12859 - RNA, 19 nt, artificial
  Oligomer
auuugaagaguuuaguuug

SEQ ID NO: 12860 - RNA, 19 nt, artificial
  Oligomer
uuaauccuaccuuccuguc

SEQ ID NO: 12861 - RNA, 19 nt, artificial
  Oligomer
uacgacgcuagaaucacac

SEQ ID NO: 12862 - RNA, 19 nt, artificial
  Oligomer
uuaacagccuuccauaagc

SEQ ID NO: 12863 - RNA, 19 nt, artificial
  Oligomer
uguaaaacucaaaugggcu

SEQ ID NO: 12864 - RNA, 19 nt, artificial
  Oligomer
uuuaacagccuuccauaag

SEQ ID NO: 12865 - RNA, 19 nt, artificial
  Oligomer
uaucuggacggugaguuuc

SEQ ID NO: 12866 - RNA, 19 nt, artificial
  Oligomer
aagcaguuccauuauugcc

SEQ ID NO: 12867 - RNA, 19 nt, artificial
  Oligomer
ucaaagauaacuguuagug

SEQ ID NO: 12868 - RNA, 19 nt, artificial
  Oligomer
aucuuuauauauuuucccu

SEQ ID NO: 12869 - RNA, 19 nt, artificial
  Oligomer
auaaugaucuacuuaguug

SEQ ID NO: 12870 - RNA, 19 nt, artificial
  Oligomer
uguacuauaaaccauaucu

SEQ ID NO: 12871 - RNA, 19 nt, artificial
  Oligomer
ucaauauuuugcauuuuuc

SEQ ID NO: 12872 - RNA, 19 nt, artificial
  Oligomer
uccuuauccacgacccaca

SEQ ID NO: 12873 - RNA, 19 nt, artificial
  Oligomer
acuauuuugaaucacuucu

SEQ ID NO: 12874 - RNA, 19 nt, artificial
  Oligomer
ucuuuaaaacauuagagug

SEQ ID NO: 12875 - RNA, 19 nt, artificial
  Oligomer
ugacagguauccaaggugg

SEQ ID NO: 12876 - RNA, 19 nt, artificial
  Oligomer
uuauugucaaaaauagaca

SEQ ID NO: 12877 - RNA, 19 nt, artificial
  Oligomer
uuuucccuuuuuaggaccc

SEQ ID NO: 12878 - RNA, 19 nt, artificial
  Oligomer
ucuacuaaagaaaaagucc

SEQ ID NO: 12879 - RNA, 19 nt, artificial
  Oligomer
aacaacaccgugguuacug

SEQ ID NO: 12880 - RNA, 19 nt, artificial
  Oligomer
acuuaauccuaccuuccug

SEQ ID NO: 12881 - RNA, 19 nt, artificial
  Oligomer
uaaaacauuagagugagga

SEQ ID NO: 12882 - RNA, 19 nt, artificial
  Oligomer
auaucauuuaguaugauuc

SEQ ID NO: 12883 - RNA, 19 nt, artificial
  Oligomer
auuuuguaagcauaacagg

SEQ ID NO: 12884 - RNA, 19 nt, artificial
  Oligomer
ucugggugcaugcaugguu

SEQ ID NO: 12885 - RNA, 19 nt, artificial
  Oligomer
uucaguaacaccaggauga

SEQ ID NO: 12886 - RNA, 19 nt, artificial
  Oligomer
uuuguugccucuuuaaaac

SEQ ID NO: 12887 - RNA, 19 nt, artificial
  Oligomer
uuugaaucacuucuccaaa

SEQ ID NO: 12888 - RNA, 19 nt, artificial
  Oligomer
guugcaaccauggucaacg

SEQ ID NO: 12889 - RNA, 19 nt, artificial
  Oligomer
uguuaguggaaaaaggaca

SEQ ID NO: 12890 - RNA, 19 nt, artificial
  Oligomer
uuuuguugccucuuuaaaa

SEQ ID NO: 12891 - RNA, 19 nt, artificial
  Oligomer
ugauuuaaaaaauccucug

SEQ ID NO: 12892 - RNA, 19 nt, artificial
  Oligomer
uuuucaauuuccaaguuca

SEQ ID NO: 12893 - RNA, 19 nt, artificial
  Oligomer
ucccuagugacagguaucc

SEQ ID NO: 12894 - RNA, 19 nt, artificial
  Oligomer
uacuuaauccuaccuuccu

SEQ ID NO: 12895 - RNA, 19 nt, artificial
  Oligomer
uuauauagucuauuaccaa

SEQ ID NO: 12896 - RNA, 19 nt, artificial
  Oligomer
uuccaucccauucaauucu

SEQ ID NO: 12897 - RNA, 19 nt, artificial
  Oligomer
ucacagguauucaucauuc

SEQ ID NO: 12898 - RNA, 19 nt, artificial
  Oligomer
uaauuuaacagccuuccau

SEQ ID NO: 12899 - RNA, 19 nt, artificial
  Oligomer
uauuccaucccauucaauu

SEQ ID NO: 12900 - RNA, 19 nt, artificial
  Oligomer
uucuaguuuaaagacagua

SEQ ID NO: 12901 - RNA, 19 nt, artificial
  Oligomer
uucccuagugacagguauc

SEQ ID NO: 12902 - RNA, 19 nt, artificial
  Oligomer
augacuuuagcugacuagc

SEQ ID NO: 12903 - RNA, 19 nt, artificial
  Oligomer
cuacaaaugacuuuagcug

SEQ ID NO: 12904 - RNA, 19 nt, artificial
  Oligomer
uaugaaaaucaaaauaggc

SEQ ID NO: 12905 - RNA, 19 nt, artificial
  Oligomer
uaguccaugagcaguucuc

SEQ ID NO: 12906 - RNA, 19 nt, artificial
  Oligomer
uaaaaaauccucugaaaac

SEQ ID NO: 12907 - RNA, 19 nt, artificial
  Oligomer
aauaagacaaaaaauaagg

SEQ ID NO: 12908 - RNA, 19 nt, artificial
  Oligomer
ucaggaacaacauaauccc

SEQ ID NO: 12909 - RNA, 19 nt, artificial
  Oligomer
uucuacuuuugcuuaccua

SEQ ID NO: 12910 - RNA, 19 nt, artificial
  Oligomer
uuuaggucacuuauaguau

SEQ ID NO: 12911 - RNA, 19 nt, artificial
  Oligomer
uggacagacaguucuccag

SEQ ID NO: 12912 - RNA, 19 nt, artificial
  Oligomer
uuaacaauagacaugcaaa

SEQ ID NO: 12913 - RNA, 19 nt, artificial
  Oligomer
uguuguuccaaucagugag

SEQ ID NO: 12914 - RNA, 19 nt, artificial
  Oligomer
ucuacuuuugcuuaccuau

SEQ ID NO: 12915 - RNA, 19 nt, artificial
  Oligomer
auuuugaaucacuucucca

SEQ ID NO: 12916 - RNA, 19 nt, artificial
  Oligomer
uucucugggucaguuucuc

SEQ ID NO: 12917 - RNA, 19 nt, artificial
  Oligomer
ucaucugagauuaagcaca

SEQ ID NO: 12918 - RNA, 19 nt, artificial
  Oligomer
uuaaaaaauccucugaaaa

SEQ ID NO: 12919 - RNA, 19 nt, artificial
  Oligomer
acuauaaaccauaucucca

SEQ ID NO: 12920 - RNA, 19 nt, artificial
  Oligomer
uuucaauuuccaaguucac

SEQ ID NO: 12921 - RNA, 19 nt, artificial
  Oligomer
aauaaggccuuuauuauuc

SEQ ID NO: 12922 - RNA, 19 nt, artificial
  Oligomer
uaaaacaacaccgugguua

SEQ ID NO: 12923 - RNA, 19 nt, artificial
  Oligomer
uacaaaugacuuuagcuga

SEQ ID NO: 12924 - RNA, 19 nt, artificial
  Oligomer
uuaauuuaacagccuucca

SEQ ID NO: 12925 - RNA, 19 nt, artificial
  Oligomer
aauauuucucauuuacucu

SEQ ID NO: 12926 - RNA, 19 nt, artificial
  Oligomer
ucaguggugacaacuccag

SEQ ID NO: 12927 - RNA, 19 nt, artificial
  Oligomer
aaacucaccuacuuaaucc

SEQ ID NO: 12928 - RNA, 19 nt, artificial
  Oligomer
uuaacauaaaaaaggaaag

SEQ ID NO: 12929 - RNA, 19 nt, artificial
  Oligomer
aaaaucagccuguuagcug

SEQ ID NO: 12930 - RNA, 19 nt, artificial
  Oligomer
uaaacucaccuacuuaauc

SEQ ID NO: 12931 - RNA, 19 nt, artificial
  Oligomer
uaaaacucaaaugggcuuc

SEQ ID NO: 12932 - RNA, 19 nt, artificial
  Oligomer
auuacuaagugaaucagag

SEQ ID NO: 12933 - RNA, 19 nt, artificial
  Oligomer
gugaguuucauucucuagg

SEQ ID NO: 12934 - RNA, 19 nt, artificial
  Oligomer
uauuaccucguugagguug

SEQ ID NO: 12935 - RNA, 19 nt, artificial
  Oligomer
uucuuaacaagucgaaauc

SEQ ID NO: 12936 - RNA, 19 nt, artificial
  Oligomer
uggucaacggcucuguuuc

SEQ ID NO: 12937 - RNA, 19 nt, artificial
  Oligomer
ugaacagugacauuuuagg

SEQ ID NO: 12938 - RNA, 19 nt, artificial
  Oligomer
uuuggaaguuuugauaggc

SEQ ID NO: 12939 - RNA, 19 nt, artificial
  Oligomer
uaauccuaccuuccugucu

SEQ ID NO: 12940 - RNA, 19 nt, artificial
  Oligomer
acaacauugauuuaucuug

SEQ ID NO: 12941 - RNA, 19 nt, artificial
  Oligomer
auuuggacagacaguucuc

SEQ ID NO: 12942 - RNA, 19 nt, artificial
  Oligomer
uaacaagucgaaauccuga

SEQ ID NO: 12943 - RNA, 19 nt, artificial
  Oligomer
uagauuacuaagugaauca

SEQ ID NO: 12944 - RNA, 19 nt, artificial
  Oligomer
uaaaaacccuucaaauuug

SEQ ID NO: 12945 - RNA, 19 nt, artificial
  Oligomer
ucguaaauugacccguuuc

SEQ ID NO: 12946 - RNA, 19 nt, artificial
  Oligomer
uuuacucuuaccuaggguu

SEQ ID NO: 12947 - RNA, 19 nt, artificial
  Oligomer
ugugaaguggagcuaauag

SEQ ID NO: 12948 - RNA, 19 nt, artificial
  Oligomer
ugauuccucaaauauuacc

SEQ ID NO: 12949 - RNA, 19 nt, artificial
  Oligomer
auguaaaacucaaaugggc

SEQ ID NO: 12950 - RNA, 19 nt, artificial
  Oligomer
uaucuuuccaagcauuuga

SEQ ID NO: 12951 - RNA, 19 nt, artificial
  Oligomer
uacaaaaaugggaucuaug

SEQ ID NO: 12952 - RNA, 19 nt, artificial
  Oligomer
aauugaacauuguugagug

SEQ ID NO: 12953 - RNA, 19 nt, artificial
  Oligomer
augcaugguuaucuggacg

SEQ ID NO: 12954 - RNA, 19 nt, artificial
  Oligomer
ugggcuucuacuuuugcuu

SEQ ID NO: 12955 - RNA, 19 nt, artificial
  Oligomer
cugaauaagcuccuuaucc

SEQ ID NO: 12956 - RNA, 19 nt, artificial
  Oligomer
aaaaaaucugggugcaugc

SEQ ID NO: 12957 - RNA, 19 nt, artificial
  Oligomer
auauuucucauuuacucuu

SEQ ID NO: 12958 - RNA, 19 nt, artificial
  Oligomer
uagugacagguauccaagg

SEQ ID NO: 12959 - RNA, 19 nt, artificial
  Oligomer
uauucaacacuuaagaaca

SEQ ID NO: 12960 - RNA, 19 nt, artificial
  Oligomer
auugccguaauauuucuca

SEQ ID NO: 12961 - RNA, 19 nt, artificial
  Oligomer
auuuucccuuuuuaggacc

SEQ ID NO: 12962 - RNA, 19 nt, artificial
  Oligomer
uucucagggacaaggaccu

SEQ ID NO: 12963 - RNA, 19 nt, artificial
  Oligomer
uucaauucuguacaaaaau

SEQ ID NO: 12964 - RNA, 19 nt, artificial
  Oligomer
uucccuuuuuaggacccuu

SEQ ID NO: 12965 - RNA, 19 nt, artificial
  Oligomer
uuggagcuuaacaauagac

SEQ ID NO: 12966 - RNA, 19 nt, artificial
  Oligomer
ucaaauauuaccucguuga

SEQ ID NO: 12967 - RNA, 19 nt, artificial
  Oligomer
aaaucugggugcaugcaug

SEQ ID NO: 12968 - RNA, 19 nt, artificial
  Oligomer
uaagcuuuaauuaaacuca

SEQ ID NO: 12969 - RNA, 19 nt, artificial
  Oligomer
ugauuuggacagacaguuc

SEQ ID NO: 12970 - RNA, 19 nt, artificial
  Oligomer
auauuuucccuuuuuagga

SEQ ID NO: 12971 - RNA, 19 nt, artificial
  Oligomer
ucauuuacucuuaccuagg

SEQ ID NO: 12972 - RNA, 19 nt, artificial
  Oligomer
acauacauuuucaauuucc

SEQ ID NO: 12973 - RNA, 19 nt, artificial
  Oligomer
uuuccaagcauuugaagag

SEQ ID NO: 12974 - RNA, 19 nt, artificial
  Oligomer
uuaccuaggguuaagcuuu

SEQ ID NO: 12975 - RNA, 19 nt, artificial
  Oligomer
uagacaaacuuuaauuucc

SEQ ID NO: 12976 - RNA, 19 nt, artificial
  Oligomer
acuuuugcuuaccuauucc

SEQ ID NO: 12977 - RNA, 19 nt, artificial
  Oligomer
uauccagcuuuuuacauac

SEQ ID NO: 12978 - RNA, 19 nt, artificial
  Oligomer
auaguuuuacuacccaauc

SEQ ID NO: 12979 - RNA, 19 nt, artificial
  Oligomer
aacauuguugaguggaggc

SEQ ID NO: 12980 - RNA, 19 nt, artificial
  Oligomer
uuuuaggacccuucaauca

SEQ ID NO: 12981 - RNA, 19 nt, artificial
  Oligomer
uugaaucacuucuccaaag

SEQ ID NO: 12982 - RNA, 19 nt, artificial
  Oligomer
auccucacagguauucauc

SEQ ID NO: 12983 - RNA, 19 nt, artificial
  Oligomer
auaaaccauaucuccauag

SEQ ID NO: 12984 - RNA, 19 nt, artificial
  Oligomer
uccugucuaaaaacccuuc

SEQ ID NO: 12985 - RNA, 19 nt, artificial
  Oligomer
gacaucuugagcaauucuc

SEQ ID NO: 12986 - RNA, 19 nt, artificial
  Oligomer
ucaaaugggcuucuacuuu

SEQ ID NO: 12987 - RNA, 19 nt, artificial
  Oligomer
uuaaggagagauacuucaa

SEQ ID NO: 12988 - RNA, 19 nt, artificial
  Oligomer
uucuguacaaaaaugggau

SEQ ID NO: 12989 - RNA, 19 nt, artificial
  Oligomer
uugauuccucaaauauuac

SEQ ID NO: 12990 - RNA, 19 nt, artificial
  Oligomer
ucagagagggacuagaucu

SEQ ID NO: 12991 - RNA, 19 nt, artificial
  Oligomer
uugaagaguuuaguuuguu

SEQ ID NO: 12992 - RNA, 19 nt, artificial
  Oligomer
uauuuucccuuuuuaggac

SEQ ID NO: 12993 - RNA, 19 nt, artificial
  Oligomer
uggaagaguaaucaacuac

SEQ ID NO: 12994 - RNA, 19 nt, artificial
  Oligomer
acuaauuuccuauccucac

SEQ ID NO: 12995 - RNA, 19 nt, artificial
  Oligomer
uuaaaacauuagagugagg

SEQ ID NO: 12996 - RNA, 19 nt, artificial
  Oligomer
augguuaucuggacgguga

SEQ ID NO: 12997 - RNA, 19 nt, artificial
  Oligomer
auagauuacuaagugaauc

SEQ ID NO: 12998 - RNA, 19 nt, artificial
  Oligomer
uugcuaugaaugugaaaca

SEQ ID NO: 12999 - RNA, 19 nt, artificial
  Oligomer
uagucuauuaccaagccua

SEQ ID NO: 13000 - RNA, 19 nt, artificial
  Oligomer
uuaccuauuccaucccauu

SEQ ID NO: 13001 - RNA, 19 nt, artificial
  Oligomer
ucuacaucgaugcccaaga

SEQ ID NO: 13002 - RNA, 19 nt, artificial
  Oligomer
accaaguuuaguuugcuuu

SEQ ID NO: 13003 - RNA, 19 nt, artificial
  Oligomer
aucauuuaguaugauucug

SEQ ID NO: 13004 - RNA, 19 nt, artificial
  Oligomer
ucaccuacuuaauccuacc

SEQ ID NO: 13005 - RNA, 19 nt, artificial
  Oligomer
ugcaaaacaacauugauuu

SEQ ID NO: 13006 - RNA, 19 nt, artificial
  Oligomer
uuggaaguuuugauaggcu

SEQ ID NO: 13007 - RNA, 19 nt, artificial
  Oligomer
uuuccuauccucacaggua

SEQ ID NO: 13008 - RNA, 19 nt, artificial
  Oligomer
uccauuauugccguaauau

SEQ ID NO: 13009 - RNA, 19 nt, artificial
  Oligomer
uucaaagugguaguauaca

SEQ ID NO: 13010 - RNA, 19 nt, artificial
  Oligomer
guuuauauagucuauuacc

SEQ ID NO: 13011 - RNA, 19 nt, artificial
  Oligomer
cuaaauaucauuuaguaug

SEQ ID NO: 13012 - RNA, 19 nt, artificial
  Oligomer
auuuucaauuuccaaguuc

SEQ ID NO: 13013 - RNA, 19 nt, artificial
  Oligomer
aggaacaacauaaucccag

SEQ ID NO: 13014 - RNA, 19 nt, artificial
  Oligomer
aaucacuucuccaaaggcc

SEQ ID NO: 13015 - RNA, 19 nt, artificial
  Oligomer
uuucuuaacaagucgaaau

SEQ ID NO: 13016 - RNA, 19 nt, artificial
  Oligomer
uacuuaguuggaauaagac

SEQ ID NO: 13017 - RNA, 19 nt, artificial
  Oligomer
uuauugccguaauauuucu

SEQ ID NO: 13018 - RNA, 19 nt, artificial
  Oligomer
aaaaagucccugaagcuag

SEQ ID NO: 13019 - RNA, 19 nt, artificial
  Oligomer
ugcuuaccuauuccauccc

SEQ ID NO: 13020 - RNA, 19 nt, artificial
  Oligomer
auagacaugcaaaacaaca

SEQ ID NO: 13021 - RNA, 19 nt, artificial
  Oligomer
gucaaaaucacuuagcagg

SEQ ID NO: 13022 - RNA, 19 nt, artificial
  Oligomer
uguuuuucaguaacaccag

SEQ ID NO: 13023 - RNA, 19 nt, artificial
  Oligomer
ucaaagugguaguauacag

SEQ ID NO: 13024 - RNA, 19 nt, artificial
  Oligomer
uauuuugcauuuuucuagu

SEQ ID NO: 13025 - RNA, 19 nt, artificial
  Oligomer
ucugggucaguuucucagg

SEQ ID NO: 13026 - RNA, 19 nt, artificial
  Oligomer
cucauuaacauaaaaaagg

SEQ ID NO: 13027 - RNA, 19 nt, artificial
  Oligomer
uacuaaagaaaaagucccu

SEQ ID NO: 13028 - RNA, 19 nt, artificial
  Oligomer
cuguuuuucaguaacacca

SEQ ID NO: 13029 - RNA, 19 nt, artificial
  Oligomer
uuuuucuuaacaagucgaa

SEQ ID NO: 13030 - RNA, 19 nt, artificial
  Oligomer
ucccugaagcuaguccaug

SEQ ID NO: 13031 - RNA, 19 nt, artificial
  Oligomer
uaaaaaaggaaagagauaa

SEQ ID NO: 13032 - RNA, 19 nt, artificial
  Oligomer
uugucaaaaauagacaaac

SEQ ID NO: 13033 - RNA, 19 nt, artificial
  Oligomer
ugaauaagcuccuuaucca

SEQ ID NO: 13034 - RNA, 19 nt, artificial
  Oligomer
aaaguagguacgacgcuag

SEQ ID NO: 13035 - RNA, 19 nt, artificial
  Oligomer
aucaguucaauauuuugca

SEQ ID NO: 13036 - RNA, 19 nt, artificial
  Oligomer
uaugauucugugauuuaaa

SEQ ID NO: 13037 - RNA, 19 nt, artificial
  Oligomer
uucguaaauugacccguuu

SEQ ID NO: 13038 - RNA, 19 nt, artificial
  Oligomer
uaaauugacccguuucaau

SEQ ID NO: 13039 - RNA, 19 nt, artificial
  Oligomer
ugaaguggagcuaauagcu

SEQ ID NO: 13040 - RNA, 19 nt, artificial
  Oligomer
ugaaaccagaggagaagcg

SEQ ID NO: 13041 - RNA, 19 nt, artificial
  Oligomer
cuagugacagguauccaag

SEQ ID NO: 13042 - RNA, 19 nt, artificial
  Oligomer
acuaaagaaaaagucccug

SEQ ID NO: 13043 - RNA, 19 nt, artificial
  Oligomer
aaauauuaccucguugagg

SEQ ID NO: 13044 - RNA, 19 nt, artificial
  Oligomer
aaagagauaaugaucuacu

SEQ ID NO: 13045 - RNA, 19 nt, artificial
  Oligomer
uucucuaggcuguacuaua

SEQ ID NO: 13046 - RNA, 19 nt, artificial
  Oligomer
uaguuuaaagacaguauuc

SEQ ID NO: 13047 - RNA, 19 nt, artificial
  Oligomer
uacacuauuuugaaucacu

SEQ ID NO: 13048 - RNA, 19 nt, artificial
  Oligomer
cugaauaguuuuacuaccc

SEQ ID NO: 13049 - RNA, 19 nt, artificial
  Oligomer
ugaaaaucaaaauaggcaa

SEQ ID NO: 13050 - RNA, 19 nt, artificial
  Oligomer
uucaauaauucaaaguggu

SEQ ID NO: 13051 - RNA, 19 nt, artificial
  Oligomer
aguaacaggaucacaccug

SEQ ID NO: 13052 - RNA, 19 nt, artificial
  Oligomer
ugagguuggguucaggaac

SEQ ID NO: 13053 - RNA, 19 nt, artificial
  Oligomer
ugaagcuaguccaugagca

SEQ ID NO: 13054 - RNA, 19 nt, artificial
  Oligomer
aaggccuuuauuauucccu

SEQ ID NO: 13055 - RNA, 19 nt, artificial
  Oligomer
uuccaaguucacgugcaua

SEQ ID NO: 13056 - RNA, 19 nt, artificial
  Oligomer
cuauuuugaaucacuucuc

SEQ ID NO: 13057 - RNA, 19 nt, artificial
  Oligomer
augcaaaacaacauugauu

SEQ ID NO: 13058 - RNA, 19 nt, artificial
  Oligomer
ucaacggcucuguuuccuu

SEQ ID NO: 13059 - RNA, 19 nt, artificial
  Oligomer
ucaauucuguacaaaaaug

SEQ ID NO: 13060 - RNA, 19 nt, artificial
  Oligomer
ucgaugcccaagaagccuu

SEQ ID NO: 13061 - RNA, 19 nt, artificial
  Oligomer
aguuucauucucuaggcug

SEQ ID NO: 13062 - RNA, 19 nt, artificial
  Oligomer
ucauucucuaggcuguacu

SEQ ID NO: 13063 - RNA, 19 nt, artificial
  Oligomer
aacuaauuuccuauccuca

SEQ ID NO: 13064 - RNA, 19 nt, artificial
  Oligomer
uugagcaaccaaguuuagu

SEQ ID NO: 13065 - RNA, 19 nt, artificial
  Oligomer
uuaucuggacggugaguuu

SEQ ID NO: 13066 - RNA, 19 nt, artificial
  Oligomer
aacccuucaaauuugaguc

SEQ ID NO: 13067 - RNA, 19 nt, artificial
  Oligomer
accuacuuaauccuaccuu

SEQ ID NO: 13068 - RNA, 19 nt, artificial
  Oligomer
auuccaucccauucaauuc

SEQ ID NO: 13069 - RNA, 19 nt, artificial
  Oligomer
uagaucucagaacuaauuu

SEQ ID NO: 13070 - RNA, 19 nt, artificial
  Oligomer
auuauucccuagugacagg

SEQ ID NO: 13071 - RNA, 19 nt, artificial
  Oligomer
ugaacauuguugaguggag

SEQ ID NO: 13072 - RNA, 19 nt, artificial
  Oligomer
aacaacauaaucccaguag

SEQ ID NO: 13073 - RNA, 19 nt, artificial
  Oligomer
ucuaaaaacccuucaaauu

SEQ ID NO: 13074 - RNA, 19 nt, artificial
  Oligomer
uugcaaccauggucaacgg

SEQ ID NO: 13075 - RNA, 19 nt, artificial
  Oligomer
ugacuuuagcugacuagcu

SEQ ID NO: 13076 - RNA, 19 nt, artificial
  Oligomer
acuuagagaaaaaaaagcc

SEQ ID NO: 13077 - RNA, 19 nt, artificial
  Oligomer
aagugaaucagagagggac

SEQ ID NO: 13078 - RNA, 19 nt, artificial
  Oligomer
aagucccugaagcuagucc

SEQ ID NO: 13079 - RNA, 19 nt, artificial
  Oligomer
aagguggaaaaaaucuggg

SEQ ID NO: 13080 - RNA, 19 nt, artificial
  Oligomer
auauuaauuuaacagccuu

SEQ ID NO: 13081 - RNA, 19 nt, artificial
  Oligomer
ucuaaaacaacaccguggu

SEQ ID NO: 13082 - RNA, 19 nt, artificial
  Oligomer
ucagggacaaggaccuuug

SEQ ID NO: 13083 - RNA, 19 nt, artificial
  Oligomer
acuguuguuccaaucagug

SEQ ID NO: 13084 - RNA, 19 nt, artificial
  Oligomer
augcagacuucguaaauug

SEQ ID NO: 13085 - RNA, 19 nt, artificial
  Oligomer
uaguggaaaaaggacaaca

SEQ ID NO: 13086 - RNA, 19 nt, artificial
  Oligomer
auaucaguucaauauuuug

SEQ ID NO: 13087 - RNA, 19 nt, artificial
  Oligomer
agcuuaacaauagacaugc

SEQ ID NO: 13088 - RNA, 19 nt, artificial
  Oligomer
cugaggaucagaguucucc

SEQ ID NO: 13089 - RNA, 19 nt, artificial
  Oligomer
uccaaguucacgugcauaa

SEQ ID NO: 13090 - RNA, 19 nt, artificial
  Oligomer
cauuuuguaagcauaacag

SEQ ID NO: 13091 - RNA, 19 nt, artificial
  Oligomer
aggaauauuaauuuaacag

SEQ ID NO: 13092 - RNA, 19 nt, artificial
  Oligomer
ugcaugcaugguuaucugg

SEQ ID NO: 13093 - RNA, 19 nt, artificial
  Oligomer
aacggcucuguuuccuucg

SEQ ID NO: 13094 - RNA, 19 nt, artificial
  Oligomer
uggugaaaugguucaucug

SEQ ID NO: 13095 - RNA, 19 nt, artificial
  Oligomer
auuuaaaaaauccucugaa

SEQ ID NO: 13096 - RNA, 19 nt, artificial
  Oligomer
cuaggcuguacuauaaacc

SEQ ID NO: 13097 - RNA, 19 nt, artificial
  Oligomer
aauuugagucaggaacugg

SEQ ID NO: 13098 - RNA, 19 nt, artificial
  Oligomer
aaucugggugcaugcaugg

SEQ ID NO: 13099 - RNA, 19 nt, artificial
  Oligomer
cuuugauuuggacagacag

SEQ ID NO: 13100 - RNA, 19 nt, artificial
  Oligomer
uccuuuaacaggaauauua

SEQ ID NO: 13101 - RNA, 19 nt, artificial
  Oligomer
aagacaaaaaauaaggccu

SEQ ID NO: 13102 - RNA, 19 nt, artificial
  Oligomer
ucaaaaauagacaaacuuu

SEQ ID NO: 13103 - RNA, 19 nt, artificial
  Oligomer
uucuccugaaaccagagga

SEQ ID NO: 13104 - RNA, 19 nt, artificial
  Oligomer
uggagcuuaacaauagaca

SEQ ID NO: 13105 - RNA, 19 nt, artificial
  Oligomer
uuaggucacuuauaguauc

SEQ ID NO: 13106 - RNA, 19 nt, artificial
  Oligomer
ucaaaaucacuuagcaggc

SEQ ID NO: 13107 - RNA, 19 nt, artificial
  Oligomer
uuaaacucaccuacuuaau

SEQ ID NO: 13108 - RNA, 19 nt, artificial
  Oligomer
auucucugggucaguuucu

SEQ ID NO: 13109 - RNA, 19 nt, artificial
  Oligomer
uaaggccuuuauuauuccc

SEQ ID NO: 13110 - RNA, 19 nt, artificial
  Oligomer
cuuaauccuaccuuccugu

SEQ ID NO: 13111 - RNA, 19 nt, artificial
  Oligomer
uggaaaaaggacaacaguu

SEQ ID NO: 13112 - RNA, 19 nt, artificial
  Oligomer
ucucauuuacucuuaccua

SEQ ID NO: 13113 - RNA, 19 nt, artificial
  Oligomer
aucagagagggacuagauc

SEQ ID NO: 13114 - RNA, 19 nt, artificial
  Oligomer
aauuugaacagugacauuu

SEQ ID NO: 13115 - RNA, 19 nt, artificial
  Oligomer
aaauguaaaacucaaaugg

SEQ ID NO: 13116 - RNA, 19 nt, artificial
  Oligomer
ucagaguucuccugaaacc

SEQ ID NO: 13117 - RNA, 19 nt, artificial
  Oligomer
auaagacaaaaaauaaggc

SEQ ID NO: 13118 - RNA, 19 nt, artificial
  Oligomer
auuuuucuaguuuaaagac

SEQ ID NO: 13119 - RNA, 19 nt, artificial
  Oligomer
cuacuaaagaaaaaguccc

SEQ ID NO: 13120 - RNA, 19 nt, artificial
  Oligomer
ucccauucaauucuguaca

SEQ ID NO: 13121 - RNA, 19 nt, artificial
  Oligomer
uuugcauuuuucuaguuua

SEQ ID NO: 13122 - RNA, 19 nt, artificial
  Oligomer
aacaguucuacaucgaugc

SEQ ID NO: 13123 - RNA, 19 nt, artificial
  Oligomer
uuccuauccucacagguau

SEQ ID NO: 13124 - RNA, 19 nt, artificial
  Oligomer
ugagcaaccaaguuuaguu

SEQ ID NO: 13125 - RNA, 19 nt, artificial
  Oligomer
ucucugggucaguuucuca

SEQ ID NO: 13126 - RNA, 19 nt, artificial
  Oligomer
acucaaaugggcuucuacu

SEQ ID NO: 13127 - RNA, 19 nt, artificial
  Oligomer
aucgaugcccaagaagccu

SEQ ID NO: 13128 - RNA, 19 nt, artificial
  Oligomer
cucaaauauuaccucguug

SEQ ID NO: 13129 - RNA, 19 nt, artificial
  Oligomer
uaaggagagauacuucaau

SEQ ID NO: 13130 - RNA, 19 nt, artificial
  Oligomer
auuaaacucaccuacuuaa

SEQ ID NO: 13131 - RNA, 19 nt, artificial
  Oligomer
uagguacgacgcuagaauc

SEQ ID NO: 13132 - RNA, 19 nt, artificial
  Oligomer
auggugaaaugguucaucu

SEQ ID NO: 13133 - RNA, 19 nt, artificial
  Oligomer
aacagugacauuuuagguc

SEQ ID NO: 13134 - RNA, 19 nt, artificial
  Oligomer
acuaagugaaucagagagg

SEQ ID NO: 13135 - RNA, 19 nt, artificial
  Oligomer
uugauaggcuaaauaucau

SEQ ID NO: 13136 - RNA, 19 nt, artificial
  Oligomer
agguauucaucauucacuc

SEQ ID NO: 13137 - RNA, 19 nt, artificial
  Oligomer
aauacaucugucccuacgc

SEQ ID NO: 13138 - RNA, 19 nt, artificial
  Oligomer
aaacauuagagugaggaag

SEQ ID NO: 13139 - RNA, 19 nt, artificial
  Oligomer
auacaucugucccuacgcc

SEQ ID NO: 13140 - RNA, 19 nt, artificial
  Oligomer
ucaucauucacucaaugga

SEQ ID NO: 13141 - RNA, 19 nt, artificial
  Oligomer
aaaaaugggaucuaugcag

SEQ ID NO: 13142 - RNA, 19 nt, artificial
  Oligomer
guuagcugcaguugcuaug

SEQ ID NO: 13143 - RNA, 19 nt, artificial
  Oligomer
uuugaagaguuuaguuugu

SEQ ID NO: 13144 - RNA, 19 nt, artificial
  Oligomer
ucucauuaacauaaaaaag

SEQ ID NO: 13145 - RNA, 19 nt, artificial
  Oligomer
cauuuuaaccaaauucugg

SEQ ID NO: 13146 - RNA, 19 nt, artificial
  Oligomer
ucaguaacaggaucacacc

SEQ ID NO: 13147 - RNA, 19 nt, artificial
  Oligomer
augggcuucuacuuuugcu

SEQ ID NO: 13148 - RNA, 19 nt, artificial
  Oligomer
uaccugaaaccaaauugug

SEQ ID NO: 13149 - RNA, 19 nt, artificial
  Oligomer
gugauuuaaaaaauccucu

SEQ ID NO: 13150 - RNA, 19 nt, artificial
  Oligomer
aaauaggcaaaucugguuu

SEQ ID NO: 13151 - RNA, 19 nt, artificial
  Oligomer
auaagcuccuuauccacga

SEQ ID NO: 13152 - RNA, 19 nt, artificial
  Oligomer
uuccaaucagugaguaaag

SEQ ID NO: 13153 - RNA, 19 nt, artificial
  Oligomer
ucgaaauccugagcugagg

SEQ ID NO: 13154 - RNA, 19 nt, artificial
  Oligomer
aucuggacggugaguuuca

SEQ ID NO: 13155 - RNA, 19 nt, artificial
  Oligomer
guuuuuucuuaacaagucg

SEQ ID NO: 13156 - RNA, 19 nt, artificial
  Oligomer
ugaguggaggcuaaauucu

SEQ ID NO: 13157 - RNA, 19 nt, artificial
  Oligomer
uuacuacccaaucaugaaa

SEQ ID NO: 13158 - RNA, 19 nt, artificial
  Oligomer
accugaaaccaaauugugg

SEQ ID NO: 13159 - RNA, 19 nt, artificial
  Oligomer
uuuacuacccaaucaugaa

SEQ ID NO: 13160 - RNA, 19 nt, artificial
  Oligomer
aucugguuuauauagucua

SEQ ID NO: 13161 - RNA, 19 nt, artificial
  Oligomer
aaucaaaauaggcaaaucu

SEQ ID NO: 13162 - RNA, 19 nt, artificial
  Oligomer
aucccauucaauucuguac

SEQ ID NO: 13163 - RNA, 19 nt, artificial
  Oligomer
cuacuuaauccuaccuucc

SEQ ID NO: 13164 - RNA, 19 nt, artificial
  Oligomer
uuuaaaaaauccucugaaa

SEQ ID NO: 13165 - RNA, 19 nt, artificial
  Oligomer
uaaaccauaucuccauagc

SEQ ID NO: 13166 - RNA, 19 nt, artificial
  Oligomer
aucagaguucuccugaaac

SEQ ID NO: 13167 - RNA, 19 nt, artificial
  Oligomer
uaggacccuucaaucacug

SEQ ID NO: 13168 - RNA, 19 nt, artificial
  Oligomer
uuucccuuuuuaggacccu

SEQ ID NO: 13169 - RNA, 19 nt, artificial
  Oligomer
cuucaaucacuguuguucc

SEQ ID NO: 13170 - RNA, 19 nt, artificial
  Oligomer
ugguuaucuggacggugag

SEQ ID NO: 13171 - RNA, 19 nt, artificial
  Oligomer
aaaaguagguacgacgcua

SEQ ID NO: 13172 - RNA, 19 nt, artificial
  Oligomer
agcaauucugaaaugcugg

SEQ ID NO: 13173 - RNA, 19 nt, artificial
  Oligomer
gugaaaugguucaucugag

SEQ ID NO: 13174 - RNA, 19 nt, artificial
  Oligomer
uucaaauuugagucaggaa

SEQ ID NO: 13175 - RNA, 19 nt, artificial
  Oligomer
acaaacuuuaauuuccuuu

SEQ ID NO: 13176 - RNA, 19 nt, artificial
  Oligomer
aaaugguucaucugagauu

SEQ ID NO: 13177 - RNA, 19 nt, artificial
  Oligomer
aaaccauaucuccauagcc

SEQ ID NO: 13178 - RNA, 19 nt, artificial
  Oligomer
auccaagguggaaaaaauc

SEQ ID NO: 13179 - RNA, 19 nt, artificial
  Oligomer
uauaaaccauaucuccaua

SEQ ID NO: 13180 - RNA, 19 nt, artificial
  Oligomer
aaaaucuacacuauuuuga

SEQ ID NO: 13181 - RNA, 19 nt, artificial
  Oligomer
aagaaaaagucccugaagc

SEQ ID NO: 13182 - RNA, 19 nt, artificial
  Oligomer
aaaaucugggugcaugcau

SEQ ID NO: 13183 - RNA, 19 nt, artificial
  Oligomer
aacauaaucccaguaguca

SEQ ID NO: 13184 - RNA, 19 nt, artificial
  Oligomer
ucuaguuuaaagacaguau

SEQ ID NO: 13185 - RNA, 19 nt, artificial
  Oligomer
agacuucguaaauugaccc

SEQ ID NO: 13186 - RNA, 19 nt, artificial
  Oligomer
uuuuggaaguuuugauagg

SEQ ID NO: 13187 - RNA, 19 nt, artificial
  Oligomer
uacaucgaugcccaagaag

SEQ ID NO: 13188 - RNA, 19 nt, artificial
  Oligomer
aguaacaccaggaugaaua

SEQ ID NO: 13189 - RNA, 19 nt, artificial
  Oligomer
uguaguaucuuuccaagca

SEQ ID NO: 13190 - RNA, 19 nt, artificial
  Oligomer
ucuuaacaagucgaaaucc

SEQ ID NO: 13191 - RNA, 19 nt, artificial
  Oligomer
uuacuaagugaaucagaga

SEQ ID NO: 13192 - RNA, 19 nt, artificial
  Oligomer
uuucuuauuuagggcaggu

SEQ ID NO: 13193 - RNA, 19 nt, artificial
  Oligomer
ugcaguugcuaugaaugug

SEQ ID NO: 13194 - RNA, 19 nt, artificial
  Oligomer
aucuaugcagaaaaucuac

SEQ ID NO: 13195 - RNA, 19 nt, artificial
  Oligomer
uagcugaauaguuuuacua

SEQ ID NO: 13196 - RNA, 19 nt, artificial
  Oligomer
aauuuccaaguucacgugc

SEQ ID NO: 13197 - RNA, 19 nt, artificial
  Oligomer
cuuuaauuuccuuuaacag

SEQ ID NO: 13198 - RNA, 19 nt, artificial
  Oligomer
gugacagguauccaaggug

SEQ ID NO: 13199 - RNA, 19 nt, artificial
  Oligomer
uauagucuauuaccaagcc

SEQ ID NO: 13200 - RNA, 19 nt, artificial
  Oligomer
ucucucauuaacauaaaaa

SEQ ID NO: 13201 - RNA, 19 nt, artificial
  Oligomer
ucagaacuaauuuccuauc

SEQ ID NO: 13202 - RNA, 19 nt, artificial
  Oligomer
cugugauuuaaaaaauccu

SEQ ID NO: 13203 - RNA, 19 nt, artificial
  Oligomer
aaucccaguagucaaaauc

SEQ ID NO: 13204 - RNA, 19 nt, artificial
  Oligomer
guuaucuggacggugaguu

SEQ ID NO: 13205 - RNA, 19 nt, artificial
  Oligomer
uuguugccucuuuaaaaca

SEQ ID NO: 13206 - RNA, 19 nt, artificial
  Oligomer
ucaaauguaaaacucaaau

SEQ ID NO: 13207 - RNA, 19 nt, artificial
  Oligomer
uuuucuuaacaagucgaaa

SEQ ID NO: 13208 - RNA, 19 nt, artificial
  Oligomer
aaagccgcaggacaucuug

SEQ ID NO: 13209 - RNA, 19 nt, artificial
  Oligomer
uuagcugcaguugcuauga

SEQ ID NO: 13210 - RNA, 19 nt, artificial
  Oligomer
aaauugacccguuucaaua

SEQ ID NO: 13211 - RNA, 19 nt, artificial
  Oligomer
uauuucucauuuacucuua

SEQ ID NO: 13212 - RNA, 19 nt, artificial
  Oligomer
uaucauuuaguaugauucu

SEQ ID NO: 13213 - RNA, 19 nt, artificial
  Oligomer
cuaaauucucucauuaaca

SEQ ID NO: 13214 - RNA, 19 nt, artificial
  Oligomer
uaguuuuacuacccaauca

SEQ ID NO: 13215 - RNA, 19 nt, artificial
  Oligomer
aauucucugggucaguuuc

SEQ ID NO: 13216 - RNA, 19 nt, artificial
  Oligomer
uccuauccagcuuuuuaca

SEQ ID NO: 13217 - RNA, 19 nt, artificial
  Oligomer
aauauuaccucguugaggu

SEQ ID NO: 13218 - RNA, 19 nt, artificial
  Oligomer
acaucuugagcaauucucu

SEQ ID NO: 13219 - RNA, 19 nt, artificial
  Oligomer
uaccaagccuaccugaaac

SEQ ID NO: 13220 - RNA, 19 nt, artificial
  Oligomer
ugaaucacuucuccaaagg

SEQ ID NO: 13221 - RNA, 19 nt, artificial
  Oligomer
uccucaaauauuaccucgu

SEQ ID NO: 13222 - RNA, 19 nt, artificial
  Oligomer
gcugaauugaacauuguug

SEQ ID NO: 13223 - RNA, 19 nt, artificial
  Oligomer
cuucaauucccagaaaagc

SEQ ID NO: 13224 - RNA, 19 nt, artificial
  Oligomer
acauuguugaguggaggcu

SEQ ID NO: 13225 - RNA, 19 nt, artificial
  Oligomer
ggucuagagugaaaaacaa

SEQ ID NO: 13226 - RNA, 19 nt, artificial
  Oligomer
cugugaagauaguuauaaa

SEQ ID NO: 13227 - RNA, 19 nt, artificial
  Oligomer
gcuagauuaucguccaaaa

SEQ ID NO: 13228 - RNA, 19 nt, artificial
  Oligomer
ccuggaaccaccuaaagaa

SEQ ID NO: 13229 - RNA, 19 nt, artificial
  Oligomer
caaacuucaucaagaguaa

SEQ ID NO: 13230 - RNA, 19 nt, artificial
  Oligomer
gcuuagaaguggaaauaaa

SEQ ID NO: 13231 - RNA, 19 nt, artificial
  Oligomer
ccagcaacaccaagugcaa

SEQ ID NO: 13232 - RNA, 19 nt, artificial
  Oligomer
ccaaaauagaugagaucaa

SEQ ID NO: 13233 - RNA, 19 nt, artificial
  Oligomer
gacacuaagucaaguuaaa

SEQ ID NO: 13234 - RNA, 19 nt, artificial
  Oligomer
gauuaaagaucucaaaaaa

SEQ ID NO: 13235 - RNA, 19 nt, artificial
  Oligomer
caagaaugacaauguccaa

SEQ ID NO: 13236 - RNA, 19 nt, artificial
  Oligomer
caugaaucuccaaccuuaa

SEQ ID NO: 13237 - RNA, 19 nt, artificial
  Oligomer
gguaaaaguacguaauuaa

SEQ ID NO: 13238 - RNA, 19 nt, artificial
  Oligomer
gaggaaggauccagaucua

SEQ ID NO: 13239 - RNA, 19 nt, artificial
  Oligomer
gcacagaaaggaaaaccaa

SEQ ID NO: 13240 - RNA, 19 nt, artificial
  Oligomer
caaggauguuuaaaaucua

SEQ ID NO: 13241 - RNA, 19 nt, artificial
  Oligomer
gaaauaucaccaaaaaaua

SEQ ID NO: 13242 - RNA, 19 nt, artificial
  Oligomer
cagaaagcacagaaaggaa

SEQ ID NO: 13243 - RNA, 19 nt, artificial
  Oligomer
ccugguuuggagauacuaa

SEQ ID NO: 13244 - RNA, 19 nt, artificial
  Oligomer
cuacuauccuacguuuaaa

SEQ ID NO: 13245 - RNA, 19 nt, artificial
  Oligomer
guaaaaguacguaauuaaa

SEQ ID NO: 13246 - RNA, 19 nt, artificial
  Oligomer
caccaaaugugaacaugga

SEQ ID NO: 13247 - RNA, 19 nt, artificial
  Oligomer
caauaaugucccauguaaa

SEQ ID NO: 13248 - RNA, 19 nt, artificial
  Oligomer
cugugacccuugcaccaaa

SEQ ID NO: 13249 - RNA, 19 nt, artificial
  Oligomer
cauggaaauaucaccaaaa

SEQ ID NO: 13250 - RNA, 19 nt, artificial
  Oligomer
agcagaacagaaaguucaa

SEQ ID NO: 13251 - RNA, 19 nt, artificial
  Oligomer
ccuccaaggauguuuaaaa

SEQ ID NO: 13252 - RNA, 19 nt, artificial
  Oligomer
ccuuggugcucaucuuaau

SEQ ID NO: 13253 - RNA, 19 nt, artificial
  Oligomer
gcaggagaguauuacuaga

SEQ ID NO: 13254 - RNA, 19 nt, artificial
  Oligomer
acuuaauaguccaccaaaa

SEQ ID NO: 13255 - RNA, 19 nt, artificial
  Oligomer
cugagaagaucauauuuau

SEQ ID NO: 13256 - RNA, 19 nt, artificial
  Oligomer
uggaaauaucaccaaaaaa

SEQ ID NO: 13257 - RNA, 19 nt, artificial
  Oligomer
caaagaugauaaaauagau

SEQ ID NO: 13258 - RNA, 19 nt, artificial
  Oligomer
ucaacuucauggaaagaaa

SEQ ID NO: 13259 - RNA, 19 nt, artificial
  Oligomer
ggaaaacaaacuucaucaa

SEQ ID NO: 13260 - RNA, 19 nt, artificial
  Oligomer
ccauguuugcaaucaaaga

SEQ ID NO: 13261 - RNA, 19 nt, artificial
  Oligomer
caugcuaaguacccaaaua

SEQ ID NO: 13262 - RNA, 19 nt, artificial
  Oligomer
aaagaauggugucaaugaa

SEQ ID NO: 13263 - RNA, 19 nt, artificial
  Oligomer
agugacucagaaaauucaa

SEQ ID NO: 13264 - RNA, 19 nt, artificial
  Oligomer
caaaaguguuaaugcccaa

SEQ ID NO: 13265 - RNA, 19 nt, artificial
  Oligomer
gagaaaggaaguacagaaa

SEQ ID NO: 13266 - RNA, 19 nt, artificial
  Oligomer
caccaagugcaaagaggaa

SEQ ID NO: 13267 - RNA, 19 nt, artificial
  Oligomer
auggaaauaucaccaaaaa

SEQ ID NO: 13268 - RNA, 19 nt, artificial
  Oligomer
cauuacuagugacucagaa

SEQ ID NO: 13269 - RNA, 19 nt, artificial
  Oligomer
caguguauguuaguacaaa

SEQ ID NO: 13270 - RNA, 19 nt, artificial
  Oligomer
caugcagaaagcacagaaa

SEQ ID NO: 13271 - RNA, 19 nt, artificial
  Oligomer
ccaaguuucuaagauuuaa

SEQ ID NO: 13272 - RNA, 19 nt, artificial
  Oligomer
cuucagaaaugaaauccaa

SEQ ID NO: 13273 - RNA, 19 nt, artificial
  Oligomer
acguuuaaauaucuuugaa

SEQ ID NO: 13274 - RNA, 19 nt, artificial
  Oligomer
gaaagcacagaaaggaaaa

SEQ ID NO: 13275 - RNA, 19 nt, artificial
  Oligomer
auuugagugcagaauuuaa

SEQ ID NO: 13276 - RNA, 19 nt, artificial
  Oligomer
gcagaggaugaaagauuaa

SEQ ID NO: 13277 - RNA, 19 nt, artificial
  Oligomer
ccaggugaaaggaaagcua

SEQ ID NO: 13278 - RNA, 19 nt, artificial
  Oligomer
caaagaggaaggauccaga

SEQ ID NO: 13279 - RNA, 19 nt, artificial
  Oligomer
guuuauuggugucauauua

SEQ ID NO: 13280 - RNA, 19 nt, artificial
  Oligomer
gaaaauucaaacuucagaa

SEQ ID NO: 13281 - RNA, 19 nt, artificial
  Oligomer
gaggaagacuguuacuaca

SEQ ID NO: 13282 - RNA, 19 nt, artificial
  Oligomer
acccauguuugcaaucaaa

SEQ ID NO: 13283 - RNA, 19 nt, artificial
  Oligomer
cguuuaaauaucuuugaaa

SEQ ID NO: 13284 - RNA, 19 nt, artificial
  Oligomer
gagugcagaauuuaaauaa

SEQ ID NO: 13285 - RNA, 19 nt, artificial
  Oligomer
ggacauuacuagugacuca

SEQ ID NO: 13286 - RNA, 19 nt, artificial
  Oligomer
gcaagacugcccuuagaaa

SEQ ID NO: 13287 - RNA, 19 nt, artificial
  Oligomer
agagaaaggaaguacagaa

SEQ ID NO: 13288 - RNA, 19 nt, artificial
  Oligomer
aaaccaagguucucaugaa

SEQ ID NO: 13289 - RNA, 19 nt, artificial
  Oligomer
caccaaaaaauacuuaaua

SEQ ID NO: 13290 - RNA, 19 nt, artificial
  Oligomer
cauugauuaaagaucucaa

SEQ ID NO: 13291 - RNA, 19 nt, artificial
  Oligomer
aggcaagacugcccuuaga

SEQ ID NO: 13292 - RNA, 19 nt, artificial
  Oligomer
cccacucuaugaaucaaua

SEQ ID NO: 13293 - RNA, 19 nt, artificial
  Oligomer
acaguuuauuggugucaua

SEQ ID NO: 13294 - RNA, 19 nt, artificial
  Oligomer
agugcagauguaaaccaaa

SEQ ID NO: 13295 - RNA, 19 nt, artificial
  Oligomer
gaggauugcucaacaacca

SEQ ID NO: 13296 - RNA, 19 nt, artificial
  Oligomer
ggcuuagaaguggaaauaa

SEQ ID NO: 13297 - RNA, 19 nt, artificial
  Oligomer
aaccaaacuuuuuuuguaa

SEQ ID NO: 13298 - RNA, 19 nt, artificial
  Oligomer
ggaaauaucaccaaaaaau

SEQ ID NO: 13299 - RNA, 19 nt, artificial
  Oligomer
cacucaccagcaacaccaa

SEQ ID NO: 13300 - RNA, 19 nt, artificial
  Oligomer
agaagaucauauuuaugua

SEQ ID NO: 13301 - RNA, 19 nt, artificial
  Oligomer
guagcuuugugacauguca

SEQ ID NO: 13302 - RNA, 19 nt, artificial
  Oligomer
gguucucaugaaucuccaa

SEQ ID NO: 13303 - RNA, 19 nt, artificial
  Oligomer
ccacuuugccucuaaauua

SEQ ID NO: 13304 - RNA, 19 nt, artificial
  Oligomer
cuguaaauguaaacuguga

SEQ ID NO: 13305 - RNA, 19 nt, artificial
  Oligomer
agcccauuuuucuuccaaa

SEQ ID NO: 13306 - RNA, 19 nt, artificial
  Oligomer
cagcaacaccaagugcaaa

SEQ ID NO: 13307 - RNA, 19 nt, artificial
  Oligomer
ggcagcuuauacauagcaa

SEQ ID NO: 13308 - RNA, 19 nt, artificial
  Oligomer
aaaccaaacuuuuuuugua

SEQ ID NO: 13309 - RNA, 19 nt, artificial
  Oligomer
aggaauugcucuugucaua

SEQ ID NO: 13310 - RNA, 19 nt, artificial
  Oligomer
gauguugacuugaguaaau

SEQ ID NO: 13311 - RNA, 19 nt, artificial
  Oligomer
aacccauguuugcaaucaa

SEQ ID NO: 13312 - RNA, 19 nt, artificial
  Oligomer
cgaaaauguucaauaaugu

SEQ ID NO: 13313 - RNA, 19 nt, artificial
  Oligomer
cccaagugacugacaucaa

SEQ ID NO: 13314 - RNA, 19 nt, artificial
  Oligomer
cuuggucuagagugaaaaa

SEQ ID NO: 13315 - RNA, 19 nt, artificial
  Oligomer
ggugucauauuauacaaua

SEQ ID NO: 13316 - RNA, 19 nt, artificial
  Oligomer
uuguuugggugaagagaaa

SEQ ID NO: 13317 - RNA, 19 nt, artificial
  Oligomer
gugacucagaaaauucaaa

SEQ ID NO: 13318 - RNA, 19 nt, artificial
  Oligomer
cagagaaaauucagacuau

SEQ ID NO: 13319 - RNA, 19 nt, artificial
  Oligomer
acauggaaauaucaccaaa

SEQ ID NO: 13320 - RNA, 19 nt, artificial
  Oligomer
cuagggacugcacagucaa

SEQ ID NO: 13321 - RNA, 19 nt, artificial
  Oligomer
gauacuaacugcucucaga

SEQ ID NO: 13322 - RNA, 19 nt, artificial
  Oligomer
cuaacugcucucagagaaa

SEQ ID NO: 13323 - RNA, 19 nt, artificial
  Oligomer
cuccaaggauguuuaaaau

SEQ ID NO: 13324 - RNA, 19 nt, artificial
  Oligomer
cuuugugacaugucaugaa

SEQ ID NO: 13325 - RNA, 19 nt, artificial
  Oligomer
cuuugaaaguuuguauuaa

SEQ ID NO: 13326 - RNA, 19 nt, artificial
  Oligomer
aagugcagauguaaaccaa

SEQ ID NO: 13327 - RNA, 19 nt, artificial
  Oligomer
gaagauaguuauaaacuga

SEQ ID NO: 13328 - RNA, 19 nt, artificial
  Oligomer
gggugaagagaaaggaagu

SEQ ID NO: 13329 - RNA, 19 nt, artificial
  Oligomer
aaauagaugagaucaagaa

SEQ ID NO: 13330 - RNA, 19 nt, artificial
  Oligomer
ucagaaaauucaaacuuca

SEQ ID NO: 13331 - RNA, 19 nt, artificial
  Oligomer
cccgaaaauguucaauaau

SEQ ID NO: 13332 - RNA, 19 nt, artificial
  Oligomer
cuagagugaaaaacaacaa

SEQ ID NO: 13333 - RNA, 19 nt, artificial
  Oligomer
ugacugacaucaacuccaa

SEQ ID NO: 13334 - RNA, 19 nt, artificial
  Oligomer
gguacauuuuaucauuuau

SEQ ID NO: 13335 - RNA, 19 nt, artificial
  Oligomer
guacagaaaacaugcagaa

SEQ ID NO: 13336 - RNA, 19 nt, artificial
  Oligomer
ggguacauuuuaucauuua

SEQ ID NO: 13337 - RNA, 19 nt, artificial
  Oligomer
cccuugcaccaaaugugaa

SEQ ID NO: 13338 - RNA, 19 nt, artificial
  Oligomer
caguucugaguauaugcaa

SEQ ID NO: 13339 - RNA, 19 nt, artificial
  Oligomer
ggaaaaccaagguucucau

SEQ ID NO: 13340 - RNA, 19 nt, artificial
  Oligomer
gugaacauggaaucaucaa

SEQ ID NO: 13341 - RNA, 19 nt, artificial
  Oligomer
gaaauaaacugcacccgga

SEQ ID NO: 13342 - RNA, 19 nt, artificial
  Oligomer
gggaaaacaaacuucauca

SEQ ID NO: 13343 - RNA, 19 nt, artificial
  Oligomer
ugcaauuaguguuugaaaa

SEQ ID NO: 13344 - RNA, 19 nt, artificial
  Oligomer
agaccuuugcacaguuuau

SEQ ID NO: 13345 - RNA, 19 nt, artificial
  Oligomer
gcuaaguacccaaauagga

SEQ ID NO: 13346 - RNA, 19 nt, artificial
  Oligomer
acuacuauccuacguuuaa

SEQ ID NO: 13347 - RNA, 19 nt, artificial
  Oligomer
accuuuugcugaaauauca

SEQ ID NO: 13348 - RNA, 19 nt, artificial
  Oligomer
ugcaaucaaagaugauaaa

SEQ ID NO: 13349 - RNA, 19 nt, artificial
  Oligomer
aguguauguuaguacaaau

SEQ ID NO: 13350 - RNA, 19 nt, artificial
  Oligomer
aaugcacacucaccagcaa

SEQ ID NO: 13351 - RNA, 19 nt, artificial
  Oligomer
cccaaacauggaaauauca

SEQ ID NO: 13352 - RNA, 19 nt, artificial
  Oligomer
cuaaauuaccucugauaau

SEQ ID NO: 13353 - RNA, 19 nt, artificial
  Oligomer
gugucauauuauacaauau

SEQ ID NO: 13354 - RNA, 19 nt, artificial
  Oligomer
uuugagugcagaauuuaaa

SEQ ID NO: 13355 - RNA, 19 nt, artificial
  Oligomer
ccaaguugcugaaucaaug

SEQ ID NO: 13356 - RNA, 19 nt, artificial
  Oligomer
aaaacaaacuucaucaaga

SEQ ID NO: 13357 - RNA, 19 nt, artificial
  Oligomer
cagcagaacagaaaguuca

SEQ ID NO: 13358 - RNA, 19 nt, artificial
  Oligomer
ggcaagacugcccuuagaa

SEQ ID NO: 13359 - RNA, 19 nt, artificial
  Oligomer
cuaugaaucaauagaagaa

SEQ ID NO: 13360 - RNA, 19 nt, artificial
  Oligomer
aaucuaguugggaaaacaa

SEQ ID NO: 13361 - RNA, 19 nt, artificial
  Oligomer
ugauguugacuugaguaaa

SEQ ID NO: 13362 - RNA, 19 nt, artificial
  Oligomer
gagugaaaaacaacaaauu

SEQ ID NO: 13363 - RNA, 19 nt, artificial
  Oligomer
ugcagaggaugaaagauua

SEQ ID NO: 13364 - RNA, 19 nt, artificial
  Oligomer
ugugaauucacauagaaaa

SEQ ID NO: 13365 - RNA, 19 nt, artificial
  Oligomer
guuugaaaagauucuuaau

SEQ ID NO: 13366 - RNA, 19 nt, artificial
  Oligomer
cuacaguugagacucagaa

SEQ ID NO: 13367 - RNA, 19 nt, artificial
  Oligomer
aaauaaggcucuaccucaa

SEQ ID NO: 13368 - RNA, 19 nt, artificial
  Oligomer
gccucuaaauuaccucuga

SEQ ID NO: 13369 - RNA, 19 nt, artificial
  Oligomer
agaaaggaaguacagaaaa

SEQ ID NO: 13370 - RNA, 19 nt, artificial
  Oligomer
auaccuggaaccaccuaaa

SEQ ID NO: 13371 - RNA, 19 nt, artificial
  Oligomer
aggcuuuguucgaaagaau

SEQ ID NO: 13372 - RNA, 19 nt, artificial
  Oligomer
ccauguaaaaccugcuaca

SEQ ID NO: 13373 - RNA, 19 nt, artificial
  Oligomer
ugccuccaaggauguuuaa

SEQ ID NO: 13374 - RNA, 19 nt, artificial
  Oligomer
uagagugaaaaacaacaaa

SEQ ID NO: 13375 - RNA, 19 nt, artificial
  Oligomer
ucacauagaaaacauuaaa

SEQ ID NO: 13376 - RNA, 19 nt, artificial
  Oligomer
uccuccaggugaaaggaaa

SEQ ID NO: 13377 - RNA, 19 nt, artificial
  Oligomer
ugauuaaagaucucaaaaa

SEQ ID NO: 13378 - RNA, 19 nt, artificial
  Oligomer
agcuuggucuagagugaaa

SEQ ID NO: 13379 - RNA, 19 nt, artificial
  Oligomer
ucggaggauugcucaacaa

SEQ ID NO: 13380 - RNA, 19 nt, artificial
  Oligomer
gaugaaagauuaagauuau

SEQ ID NO: 13381 - RNA, 19 nt, artificial
  Oligomer
ggaaggccugcaucaugau

SEQ ID NO: 13382 - RNA, 19 nt, artificial
  Oligomer
gcuaugaccuuuugcugaa

SEQ ID NO: 13383 - RNA, 19 nt, artificial
  Oligomer
gaaagaaagaagcguauga

SEQ ID NO: 13384 - RNA, 19 nt, artificial
  Oligomer
gccuuggugcucaucuuaa

SEQ ID NO: 13385 - RNA, 19 nt, artificial
  Oligomer
accaaaugugaacauggaa

SEQ ID NO: 13386 - RNA, 19 nt, artificial
  Oligomer
gaagaucauauuuauguaa

SEQ ID NO: 13387 - RNA, 19 nt, artificial
  Oligomer
cauuuuucuuccaaaugca

SEQ ID NO: 13388 - RNA, 19 nt, artificial
  Oligomer
aauaaugucccauguaaaa

SEQ ID NO: 13389 - RNA, 19 nt, artificial
  Oligomer
gcaugcuaaguacccaaau

SEQ ID NO: 13390 - RNA, 19 nt, artificial
  Oligomer
ucaugaaucuccaaccuua

SEQ ID NO: 13391 - RNA, 19 nt, artificial
  Oligomer
ugaaauaucaguuacugaa

SEQ ID NO: 13392 - RNA, 19 nt, artificial
  Oligomer
gcccauuuuucuuccaaau

SEQ ID NO: 13393 - RNA, 19 nt, artificial
  Oligomer
agaggaugaaagauuaaga

SEQ ID NO: 13394 - RNA, 19 nt, artificial
  Oligomer
agacuaucauccucaagga

SEQ ID NO: 13395 - RNA, 19 nt, artificial
  Oligomer
ggauuggaauugaggaaga

SEQ ID NO: 13396 - RNA, 19 nt, artificial
  Oligomer
caaacuucagaaaugaaau

SEQ ID NO: 13397 - RNA, 19 nt, artificial
  Oligomer
gaaagaauggugucaauga

SEQ ID NO: 13398 - RNA, 19 nt, artificial
  Oligomer
ccucuaaauuaccucugau

SEQ ID NO: 13399 - RNA, 19 nt, artificial
  Oligomer
uguuugaaaagauucuuaa

SEQ ID NO: 13400 - RNA, 19 nt, artificial
  Oligomer
uagugacucagaaaauuca

SEQ ID NO: 13401 - RNA, 19 nt, artificial
  Oligomer
aacuuuuuuuguaacucua

SEQ ID NO: 13402 - RNA, 19 nt, artificial
  Oligomer
ccucaaagaccuuugcaca

SEQ ID NO: 13403 - RNA, 19 nt, artificial
  Oligomer
uggucuagagugaaaaaca

SEQ ID NO: 13404 - RNA, 19 nt, artificial
  Oligomer
cauuuauuagcgcugaaga

SEQ ID NO: 13405 - RNA, 19 nt, artificial
  Oligomer
cucugauaauucuagagau

SEQ ID NO: 13406 - RNA, 19 nt, artificial
  Oligomer
ccagaauaccaagugcaga

SEQ ID NO: 13407 - RNA, 19 nt, artificial
  Oligomer
cugccuccaaggauguuua

SEQ ID NO: 13408 - RNA, 19 nt, artificial
  Oligomer
gccugguuuggagauacua

SEQ ID NO: 13409 - RNA, 19 nt, artificial
  Oligomer
caaucaaagaugauaaaau

SEQ ID NO: 13410 - RNA, 19 nt, artificial
  Oligomer
caaaauagaugagaucaag

SEQ ID NO: 13411 - RNA, 19 nt, artificial
  Oligomer
aguuuguauuaaaugugaa

SEQ ID NO: 13412 - RNA, 19 nt, artificial
  Oligomer
caaucuuuguacucuugca

SEQ ID NO: 13413 - RNA, 19 nt, artificial
  Oligomer
gcuggagucaugacacuaa

SEQ ID NO: 13414 - RNA, 19 nt, artificial
  Oligomer
cugaguauaugcaauuagu

SEQ ID NO: 13415 - RNA, 19 nt, artificial
  Oligomer
ccauauuucuaaacuuugu

SEQ ID NO: 13416 - RNA, 19 nt, artificial
  Oligomer
gcuuggucuagagugaaaa

SEQ ID NO: 13417 - RNA, 19 nt, artificial
  Oligomer
uagaugagaucaagaauga

SEQ ID NO: 13418 - RNA, 19 nt, artificial
  Oligomer
agggauuggaauugaggaa

SEQ ID NO: 13419 - RNA, 19 nt, artificial
  Oligomer
aacugugaagauaguuaua

SEQ ID NO: 13420 - RNA, 19 nt, artificial
  Oligomer
ggcaauaaauuuaucugau

SEQ ID NO: 13421 - RNA, 19 nt, artificial
  Oligomer
ggcucaaaacuaccuacuu

SEQ ID NO: 13422 - RNA, 19 nt, artificial
  Oligomer
gaauuuaaauaaggcucua

SEQ ID NO: 13423 - RNA, 19 nt, artificial
  Oligomer
aauugugaauucacauaga

SEQ ID NO: 13424 - RNA, 19 nt, artificial
  Oligomer
guugcuagauuaucgucca

SEQ ID NO: 13425 - RNA, 19 nt, artificial
  Oligomer
augagaucaagaaugacaa

SEQ ID NO: 13426 - RNA, 19 nt, artificial
  Oligomer
aagaaagaagcguaugaca

SEQ ID NO: 13427 - RNA, 19 nt, artificial
  Oligomer
ugaagagaaaggaaguaca

SEQ ID NO: 13428 - RNA, 19 nt, artificial
  Oligomer
gaguguaugcagaggauga

SEQ ID NO: 13429 - RNA, 19 nt, artificial
  Oligomer
uugggugaagagaaaggaa

SEQ ID NO: 13430 - RNA, 19 nt, artificial
  Oligomer
caucaucuggauuuaggaa

SEQ ID NO: 13431 - RNA, 19 nt, artificial
  Oligomer
gagugagggaagcgguuua

SEQ ID NO: 13432 - RNA, 19 nt, artificial
  Oligomer
cuaugaccuuuugcugaaa

SEQ ID NO: 13433 - RNA, 19 nt, artificial
  Oligomer
aggaguguaugcagaggau

SEQ ID NO: 13434 - RNA, 19 nt, artificial
  Oligomer
agaaagcacagaaaggaaa

SEQ ID NO: 13435 - RNA, 19 nt, artificial
  Oligomer
guacguaauuaaauaaugu

SEQ ID NO: 13436 - RNA, 19 nt, artificial
  Oligomer
uguaaauguaaacugugaa

SEQ ID NO: 13437 - RNA, 19 nt, artificial
  Oligomer
gaaggauccagaucuaacu

SEQ ID NO: 13438 - RNA, 19 nt, artificial
  Oligomer
guugggaaaacaaacuuca

SEQ ID NO: 13439 - RNA, 19 nt, artificial
  Oligomer
aucuaguugggaaaacaaa

SEQ ID NO: 13440 - RNA, 19 nt, artificial
  Oligomer
guauuugagugcagaauuu

SEQ ID NO: 13441 - RNA, 19 nt, artificial
  Oligomer
gaaguggaaauaaacugca

SEQ ID NO: 13442 - RNA, 19 nt, artificial
  Oligomer
ggcaucaacuucauggaaa

SEQ ID NO: 13443 - RNA, 19 nt, artificial
  Oligomer
caacauauuuguagauuuu

SEQ ID NO: 13444 - RNA, 19 nt, artificial
  Oligomer
cugaaauaucaguuacuga

SEQ ID NO: 13445 - RNA, 19 nt, artificial
  Oligomer
uaccaagugcagauguaaa

SEQ ID NO: 13446 - RNA, 19 nt, artificial
  Oligomer
cacuaauuguuugggugaa

SEQ ID NO: 13447 - RNA, 19 nt, artificial
  Oligomer
ccaccuaaagaacuuccau

SEQ ID NO: 13448 - RNA, 19 nt, artificial
  Oligomer
agguaaaaguacguaauua

SEQ ID NO: 13449 - RNA, 19 nt, artificial
  Oligomer
guuauaaacugaagcagau

SEQ ID NO: 13450 - RNA, 19 nt, artificial
  Oligomer
guacaaaugucuauccaca

SEQ ID NO: 13451 - RNA, 19 nt, artificial
  Oligomer
ccaaaaguguuaaugccca

SEQ ID NO: 13452 - RNA, 19 nt, artificial
  Oligomer
gcagaaagcacagaaagga

SEQ ID NO: 13453 - RNA, 19 nt, artificial
  Oligomer
gcagcuuauacauagcaau

SEQ ID NO: 13454 - RNA, 19 nt, artificial
  Oligomer
gaggaugaaagauuaagau

SEQ ID NO: 13455 - RNA, 19 nt, artificial
  Oligomer
aaaauagaugagaucaaga

SEQ ID NO: 13456 - RNA, 19 nt, artificial
  Oligomer
ugugaacauggaaucauca

SEQ ID NO: 13457 - RNA, 19 nt, artificial
  Oligomer
gagaaaauucagacuauca

SEQ ID NO: 13458 - RNA, 19 nt, artificial
  Oligomer
augcaauuaguguuugaaa

SEQ ID NO: 13459 - RNA, 19 nt, artificial
  Oligomer
aaggcuuuguucgaaagaa

SEQ ID NO: 13460 - RNA, 19 nt, artificial
  Oligomer
uguaaaaccugcuacaaau

SEQ ID NO: 13461 - RNA, 19 nt, artificial
  Oligomer
gccuccaaggauguuuaaa

SEQ ID NO: 13462 - RNA, 19 nt, artificial
  Oligomer
uugugaauucacauagaaa

SEQ ID NO: 13463 - RNA, 19 nt, artificial
  Oligomer
ucuguaguaugaauguaau

SEQ ID NO: 13464 - RNA, 19 nt, artificial
  Oligomer
ucaucaucuggauuuagga

SEQ ID NO: 13465 - RNA, 19 nt, artificial
  Oligomer
acaccaagugcaaagagga

SEQ ID NO: 13466 - RNA, 19 nt, artificial
  Oligomer
uugcuagauuaucguccaa

SEQ ID NO: 13467 - RNA, 19 nt, artificial
  Oligomer
aaggaaguacagaaaacau

SEQ ID NO: 13468 - RNA, 19 nt, artificial
  Oligomer
agcacagaaaggaaaacca

SEQ ID NO: 13469 - RNA, 19 nt, artificial
  Oligomer
uuauuggugucauauuaua

SEQ ID NO: 13470 - RNA, 19 nt, artificial
  Oligomer
uuggugucauauuauacaa

SEQ ID NO: 13471 - RNA, 19 nt, artificial
  Oligomer
ggcaugcuaaguacccaaa

SEQ ID NO: 13472 - RNA, 19 nt, artificial
  Oligomer
gaaucaauagaagaagcua

SEQ ID NO: 13473 - RNA, 19 nt, artificial
  Oligomer
guaaauauaucaccacuau

SEQ ID NO: 13474 - RNA, 19 nt, artificial
  Oligomer
ccuuaaauccugaaacagu

SEQ ID NO: 13475 - RNA, 19 nt, artificial
  Oligomer
ucgaaagaauggugucaau

SEQ ID NO: 13476 - RNA, 19 nt, artificial
  Oligomer
uauguauuugagugcagaa

SEQ ID NO: 13477 - RNA, 19 nt, artificial
  Oligomer
caacaaccaugcugggcau

SEQ ID NO: 13478 - RNA, 19 nt, artificial
  Oligomer
caugaacccauguuugcaa

SEQ ID NO: 13479 - RNA, 19 nt, artificial
  Oligomer
aaccuuaaauccugaaaca

SEQ ID NO: 13480 - RNA, 19 nt, artificial
  Oligomer
cuaucauccucaaggacau

SEQ ID NO: 13481 - RNA, 19 nt, artificial
  Oligomer
gagucaugacacuaaguca

SEQ ID NO: 13482 - RNA, 19 nt, artificial
  Oligomer
ggugaagagaaaggaagua

SEQ ID NO: 13483 - RNA, 19 nt, artificial
  Oligomer
uugagugcagaauuuaaau

SEQ ID NO: 13484 - RNA, 19 nt, artificial
  Oligomer
cagaauaccaagugcagau

SEQ ID NO: 13485 - RNA, 19 nt, artificial
  Oligomer
acauggaaucaucaaggaa

SEQ ID NO: 13486 - RNA, 19 nt, artificial
  Oligomer
aauagaugagaucaagaau

SEQ ID NO: 13487 - RNA, 19 nt, artificial
  Oligomer
guguaugcagaggaugaaa

SEQ ID NO: 13488 - RNA, 19 nt, artificial
  Oligomer
accuggaaccaccuaaaga

SEQ ID NO: 13489 - RNA, 19 nt, artificial
  Oligomer
aauacugcuugguuuuuua

SEQ ID NO: 13490 - RNA, 19 nt, artificial
  Oligomer
auugauuaaagaucucaaa

SEQ ID NO: 13491 - RNA, 19 nt, artificial
  Oligomer
cauggaaucaucaaggaau

SEQ ID NO: 13492 - RNA, 19 nt, artificial
  Oligomer
ccaaaaaauacuuaauagu

SEQ ID NO: 13493 - RNA, 19 nt, artificial
  Oligomer
ggauguuuaaaaucuaguu

SEQ ID NO: 13494 - RNA, 19 nt, artificial
  Oligomer
gagcaggagaguauuacua

SEQ ID NO: 13495 - RNA, 19 nt, artificial
  Oligomer
guagauuuuuaauaucuca

SEQ ID NO: 13496 - RNA, 19 nt, artificial
  Oligomer
ucuccuuacuacuauccua

SEQ ID NO: 13497 - RNA, 19 nt, artificial
  Oligomer
acucuaugaaucaauagaa

SEQ ID NO: 13498 - RNA, 19 nt, artificial
  Oligomer
ugagacucagaacuuggaa

SEQ ID NO: 13499 - RNA, 19 nt, artificial
  Oligomer
ugagggaagcgguuuacga

SEQ ID NO: 13500 - RNA, 19 nt, artificial
  Oligomer
guaugcagaggaugaaaga

SEQ ID NO: 13501 - RNA, 19 nt, artificial
  Oligomer
cucuaaauuaccucugaua

SEQ ID NO: 13502 - RNA, 19 nt, artificial
  Oligomer
ggaugaaagauuaagauua

SEQ ID NO: 13503 - RNA, 19 nt, artificial
  Oligomer
ccaagugacugacaucaac

SEQ ID NO: 13504 - RNA, 19 nt, artificial
  Oligomer
ucuaaauuaccucugauaa

SEQ ID NO: 13505 - RNA, 19 nt, artificial
  Oligomer
gcaucaacuucauggaaag

SEQ ID NO: 13506 - RNA, 19 nt, artificial
  Oligomer
ggaaccaccuaaagaacuu

SEQ ID NO: 13507 - RNA, 19 nt, artificial
  Oligomer
aaguucaacugcuucguaa

SEQ ID NO: 13508 - RNA, 19 nt, artificial
  Oligomer
ugacacuaagucaaguuaa

SEQ ID NO: 13509 - RNA, 19 nt, artificial
  Oligomer
aguguaugcagaggaugaa

SEQ ID NO: 13510 - RNA, 19 nt, artificial
  Oligomer
agauguaaaccaaacuuuu

SEQ ID NO: 13511 - RNA, 19 nt, artificial
  Oligomer
ugagaucaagaaugacaau

SEQ ID NO: 13512 - RNA, 19 nt, artificial
  Oligomer
aaagcuuggucuagaguga

SEQ ID NO: 13513 - RNA, 19 nt, artificial
  Oligomer
ccucaaggacauuacuagu

SEQ ID NO: 13514 - RNA, 19 nt, artificial
  Oligomer
cauguaaaaccugcuacaa

SEQ ID NO: 13515 - RNA, 19 nt, artificial
  Oligomer
cuugcagagaaaauucaga

SEQ ID NO: 13516 - RNA, 19 nt, artificial
  Oligomer
gauuuuaccauauuucuaa

SEQ ID NO: 13517 - RNA, 19 nt, artificial
  Oligomer
ggaagcgguuuacgaguga

SEQ ID NO: 13518 - RNA, 19 nt, artificial
  Oligomer
uauacauagcaaugguaaa

SEQ ID NO: 13519 - RNA, 19 nt, artificial
  Oligomer
gauaccuggaaccaccuaa

SEQ ID NO: 13520 - RNA, 19 nt, artificial
  Oligomer
ggcucuaccucaaagaccu

SEQ ID NO: 13521 - RNA, 19 nt, artificial
  Oligomer
gaaguacagaaaacaugca

SEQ ID NO: 13522 - RNA, 19 nt, artificial
  Oligomer
gcaucaaaagcauuuugag

SEQ ID NO: 13523 - RNA, 19 nt, artificial
  Oligomer
caacuccaagggauuggaa

SEQ ID NO: 13524 - RNA, 19 nt, artificial
  Oligomer
aaauguaaacugugaagau

SEQ ID NO: 13525 - RNA, 19 nt, artificial
  Oligomer
aaacuucaucaagaguaaa

SEQ ID NO: 13526 - RNA, 19 nt, artificial
  Oligomer
cugguuuggagauacuaac

SEQ ID NO: 13527 - RNA, 19 nt, artificial
  Oligomer
agagaaaguagcuuuguga

SEQ ID NO: 13528 - RNA, 19 nt, artificial
  Oligomer
uucagacuaucauccucaa

SEQ ID NO: 13529 - RNA, 19 nt, artificial
  Oligomer
uugggaaaacaaacuucau

SEQ ID NO: 13530 - RNA, 19 nt, artificial
  Oligomer
aggaaggauccagaucuaa

SEQ ID NO: 13531 - RNA, 19 nt, artificial
  Oligomer
ucaccaaaaaauacuuaau

SEQ ID NO: 13532 - RNA, 19 nt, artificial
  Oligomer
ccuccaggugaaaggaaag

SEQ ID NO: 13533 - RNA, 19 nt, artificial
  Oligomer
aaaaauacuuaauagucca

SEQ ID NO: 13534 - RNA, 19 nt, artificial
  Oligomer
agugcagaauuuaaauaag

SEQ ID NO: 13535 - RNA, 19 nt, artificial
  Oligomer
agaaaauucaaacuucaga

SEQ ID NO: 13536 - RNA, 19 nt, artificial
  Oligomer
ucaauaaugucccauguaa

SEQ ID NO: 13537 - RNA, 19 nt, artificial
  Oligomer
aagggauuggaauugagga

SEQ ID NO: 13538 - RNA, 19 nt, artificial
  Oligomer
augaaucuccaaccuuaaa

SEQ ID NO: 13539 - RNA, 19 nt, artificial
  Oligomer
uauagguaaaaguacguaa

SEQ ID NO: 13540 - RNA, 19 nt, artificial
  Oligomer
cuggguacauuuuaucauu

SEQ ID NO: 13541 - RNA, 19 nt, artificial
  Oligomer
auaugauucuguaguauga

SEQ ID NO: 13542 - RNA, 19 nt, artificial
  Oligomer
acccuugcaccaaauguga

SEQ ID NO: 13543 - RNA, 19 nt, artificial
  Oligomer
ggaauuauaaaauauaggu

SEQ ID NO: 13544 - RNA, 19 nt, artificial
  Oligomer
gaauucacauagaaaacau

SEQ ID NO: 13545 - RNA, 19 nt, artificial
  Oligomer
aaagaggaaggauccagau

SEQ ID NO: 13546 - RNA, 19 nt, artificial
  Oligomer
caaagaccuuugcacaguu

SEQ ID NO: 13547 - RNA, 19 nt, artificial
  Oligomer
auuacuagugacucagaaa

SEQ ID NO: 13548 - RNA, 19 nt, artificial
  Oligomer
gaauguaaucaguguaugu

SEQ ID NO: 13549 - RNA, 19 nt, artificial
  Oligomer
agauuuuaccauauuucua

SEQ ID NO: 13550 - RNA, 19 nt, artificial
  Oligomer
gugaaaaacaacaaauuca

SEQ ID NO: 13551 - RNA, 19 nt, artificial
  Oligomer
uucagaaaugaaauccaaa

SEQ ID NO: 13552 - RNA, 19 nt, artificial
  Oligomer
ccuaaagaacuuccauuua

SEQ ID NO: 13553 - RNA, 19 nt, artificial
  Oligomer
ccuacuucuuucucaggca

SEQ ID NO: 13554 - RNA, 19 nt, artificial
  Oligomer
caauuaguguuugaaaaga

SEQ ID NO: 13555 - RNA, 19 nt, artificial
  Oligomer
aaauaggaguguaugcaga

SEQ ID NO: 13556 - RNA, 19 nt, artificial
  Oligomer
gaaaguuuguauuaaaugu

SEQ ID NO: 13557 - RNA, 19 nt, artificial
  Oligomer
acuucauggaaagaaagaa

SEQ ID NO: 13558 - RNA, 19 nt, artificial
  Oligomer
acaauauuucaauugugaa

SEQ ID NO: 13559 - RNA, 19 nt, artificial
  Oligomer
uggaaggccugcaucauga

SEQ ID NO: 13560 - RNA, 19 nt, artificial
  Oligomer
uccaaaugcagaagaugua

SEQ ID NO: 13561 - RNA, 19 nt, artificial
  Oligomer
cccagaauaccaagugcag

SEQ ID NO: 13562 - RNA, 19 nt, artificial
  Oligomer
auugugaauucacauagaa

SEQ ID NO: 13563 - RNA, 19 nt, artificial
  Oligomer
cuccaaccuuaaauccuga

SEQ ID NO: 13564 - RNA, 19 nt, artificial
  Oligomer
aagauaguuauaaacugaa

SEQ ID NO: 13565 - RNA, 19 nt, artificial
  Oligomer
cagaaaauucaaacuucag

SEQ ID NO: 13566 - RNA, 19 nt, artificial
  Oligomer
acgucuguugcuagauuau

SEQ ID NO: 13567 - RNA, 19 nt, artificial
  Oligomer
agaucauauuuauguaaag

SEQ ID NO: 13568 - RNA, 19 nt, artificial
  Oligomer
aguuauaaacugaagcaga

SEQ ID NO: 13569 - RNA, 19 nt, artificial
  Oligomer
auuguuugggugaagagaa

SEQ ID NO: 13570 - RNA, 19 nt, artificial
  Oligomer
gaacacugugacccuugca

SEQ ID NO: 13571 - RNA, 19 nt, artificial
  Oligomer
cugauguugacuugaguaa

SEQ ID NO: 13572 - RNA, 19 nt, artificial
  Oligomer
gcaaucaaagaugauaaaa

SEQ ID NO: 13573 - RNA, 19 nt, artificial
  Oligomer
aaacaaacuucaucaagag

SEQ ID NO: 13574 - RNA, 19 nt, artificial
  Oligomer
ggcuguaaauacugcuugg

SEQ ID NO: 13575 - RNA, 19 nt, artificial
  Oligomer
caagacugcccuuagaaau

SEQ ID NO: 13576 - RNA, 19 nt, artificial
  Oligomer
aacauaugauucuguagua

SEQ ID NO: 13577 - RNA, 19 nt, artificial
  Oligomer
ccaaccuuaaauccugaaa

SEQ ID NO: 13578 - RNA, 19 nt, artificial
  Oligomer
guguuugaaaagauucuua

SEQ ID NO: 13579 - RNA, 19 nt, artificial
  Oligomer
aaaggaaguacagaaaaca

SEQ ID NO: 13580 - RNA, 19 nt, artificial
  Oligomer
uugcaaucaaagaugauaa

SEQ ID NO: 13581 - RNA, 19 nt, artificial
  Oligomer
aaaucuaguugggaaaaca

SEQ ID NO: 13582 - RNA, 19 nt, artificial
  Oligomer
ucaugauucugccuccaag

SEQ ID NO: 13583 - RNA, 19 nt, artificial
  Oligomer
gaagcucuuucacuucgga

SEQ ID NO: 13584 - RNA, 19 nt, artificial
  Oligomer
ccaagggauuggaauugag

SEQ ID NO: 13585 - RNA, 19 nt, artificial
  Oligomer
ggcuuugucuucuucuuuu

SEQ ID NO: 13586 - RNA, 19 nt, artificial
  Oligomer
auagguaaaaguacguaau

SEQ ID NO: 13587 - RNA, 19 nt, artificial
  Oligomer
guaaaaucaucaucuggau

SEQ ID NO: 13588 - RNA, 19 nt, artificial
  Oligomer
uggaaagaaagaagcguau

SEQ ID NO: 13589 - RNA, 19 nt, artificial
  Oligomer
auguaaaaccugcuacaaa

SEQ ID NO: 13590 - RNA, 19 nt, artificial
  Oligomer
gauguaaaccaaacuuuuu

SEQ ID NO: 13591 - RNA, 19 nt, artificial
  Oligomer
augaccuuuugcugaaaua

SEQ ID NO: 13592 - RNA, 19 nt, artificial
  Oligomer
ccaacauauuuguagauuu

SEQ ID NO: 13593 - RNA, 19 nt, artificial
  Oligomer
ugcagaagauguagauugu

SEQ ID NO: 13594 - RNA, 19 nt, artificial
  Oligomer
caucaagaguaaaugcagu

SEQ ID NO: 13595 - RNA, 19 nt, artificial
  Oligomer
cacauagaaaacauuaaau

SEQ ID NO: 13596 - RNA, 19 nt, artificial
  Oligomer
gcaacaccaagugcaaaga

SEQ ID NO: 13597 - RNA, 19 nt, artificial
  Oligomer
agguucucaugaaucucca

SEQ ID NO: 13598 - RNA, 19 nt, artificial
  Oligomer
caagaagggaaggaguaca

SEQ ID NO: 13599 - RNA, 19 nt, artificial
  Oligomer
cacagaaaggaaaaccaag

SEQ ID NO: 13600 - RNA, 19 nt, artificial
  Oligomer
uuguacucuugcagagaaa

SEQ ID NO: 13601 - RNA, 19 nt, artificial
  Oligomer
caaggacauuacuagugac

SEQ ID NO: 13602 - RNA, 19 nt, artificial
  Oligomer
aguucaacugcuucguaau

SEQ ID NO: 13603 - RNA, 19 nt, artificial
  Oligomer
aguucugaguauaugcaau

SEQ ID NO: 13604 - RNA, 19 nt, artificial
  Oligomer
cuauccuacguuuaaauau

SEQ ID NO: 13605 - RNA, 19 nt, artificial
  Oligomer
aguuuauuggugucauauu

SEQ ID NO: 13606 - RNA, 19 nt, artificial
  Oligomer
acaugcagaaagcacagaa

SEQ ID NO: 13607 - RNA, 19 nt, artificial
  Oligomer
gaaaugaaauccaaagcuu

SEQ ID NO: 13608 - RNA, 19 nt, artificial
  Oligomer
gaaaggaaguacagaaaac

SEQ ID NO: 13609 - RNA, 19 nt, artificial
  Oligomer
uacuuaauaguccaccaaa

SEQ ID NO: 13610 - RNA, 19 nt, artificial
  Oligomer
augucuauccacaggcuaa

SEQ ID NO: 13611 - RNA, 19 nt, artificial
  Oligomer
gaaugcacacucaccagca

SEQ ID NO: 13612 - RNA, 19 nt, artificial
  Oligomer
uucuguaguaugaauguaa

SEQ ID NO: 13613 - RNA, 19 nt, artificial
  Oligomer
cuuagaaguggaaauaaac

SEQ ID NO: 13614 - RNA, 19 nt, artificial
  Oligomer
uacuagugacucagaaaau

SEQ ID NO: 13615 - RNA, 19 nt, artificial
  Oligomer
gaagagaaaggaaguacag

SEQ ID NO: 13616 - RNA, 19 nt, artificial
  Oligomer
aguguuaaugcccaaguga

SEQ ID NO: 13617 - RNA, 19 nt, artificial
  Oligomer
agagugaaaaacaacaaau

SEQ ID NO: 13618 - RNA, 19 nt, artificial
  Oligomer
caguuuauuggugucauau

SEQ ID NO: 13619 - RNA, 19 nt, artificial
  Oligomer
auguuaguacaaaugucua

SEQ ID NO: 13620 - RNA, 19 nt, artificial
  Oligomer
ggcaucaaaagcauuuuga

SEQ ID NO: 13621 - RNA, 19 nt, artificial
  Oligomer
cacucuaugaaucaauaga

SEQ ID NO: 13622 - RNA, 19 nt, artificial
  Oligomer
acuaacugcucucagagaa

SEQ ID NO: 13623 - RNA, 19 nt, artificial
  Oligomer
cccaaguuucuaagauuua

SEQ ID NO: 13624 - RNA, 19 nt, artificial
  Oligomer
aaguuuguauuaaauguga

SEQ ID NO: 13625 - RNA, 19 nt, artificial
  Oligomer
aaaugcagaagauguagau

SEQ ID NO: 13626 - RNA, 19 nt, artificial
  Oligomer
gauuuuuaauaucucauga

SEQ ID NO: 13627 - RNA, 19 nt, artificial
  Oligomer
ccgaaaauguucaauaaug

SEQ ID NO: 13628 - RNA, 19 nt, artificial
  Oligomer
caacaaauucaguucugag

SEQ ID NO: 13629 - RNA, 19 nt, artificial
  Oligomer
aauaccaagugcagaugua

SEQ ID NO: 13630 - RNA, 19 nt, artificial
  Oligomer
aagcuuggucuagagugaa

SEQ ID NO: 13631 - RNA, 19 nt, artificial
  Oligomer
gaguaaauauaucaccacu

SEQ ID NO: 13632 - RNA, 19 nt, artificial
  Oligomer
guguuuggaauuauaaaau

SEQ ID NO: 13633 - RNA, 19 nt, artificial
  Oligomer
aaccaagguucucaugaau

SEQ ID NO: 13634 - RNA, 19 nt, artificial
  Oligomer
aaaucaucaucuggauuua

SEQ ID NO: 13635 - RNA, 19 nt, artificial
  Oligomer
ggaagacuguuacuacagu

SEQ ID NO: 13636 - RNA, 19 nt, artificial
  Oligomer
ccaagguucucaugaaucu

SEQ ID NO: 13637 - RNA, 19 nt, artificial
  Oligomer
uuacuagugacucagaaaa

SEQ ID NO: 13638 - RNA, 19 nt, artificial
  Oligomer
uagggacugcacagucaau

SEQ ID NO: 13639 - RNA, 19 nt, artificial
  Oligomer
cucaugauucugccuccaa

SEQ ID NO: 13640 - RNA, 19 nt, artificial
  Oligomer
cuaaagaacuuccauuuau

SEQ ID NO: 13641 - RNA, 19 nt, artificial
  Oligomer
ucaaacuucagaaaugaaa

SEQ ID NO: 13642 - RNA, 19 nt, artificial
  Oligomer
auaccaagugcagauguaa

SEQ ID NO: 13643 - RNA, 19 nt, artificial
  Oligomer
caggugaaaggaaagcuag

SEQ ID NO: 13644 - RNA, 19 nt, artificial
  Oligomer
ccaaaugugaacauggaau

SEQ ID NO: 13645 - RNA, 19 nt, artificial
  Oligomer
auguaaucaguguauguua

SEQ ID NO: 13646 - RNA, 19 nt, artificial
  Oligomer
uguugacuugaguaaauau

SEQ ID NO: 13647 - RNA, 19 nt, artificial
  Oligomer
guaacucuacuguauguga

SEQ ID NO: 13648 - RNA, 19 nt, artificial
  Oligomer
guuugcaaucaaagaugau

SEQ ID NO: 13649 - RNA, 19 nt, artificial
  Oligomer
gcuuauacauagcaauggu

SEQ ID NO: 13650 - RNA, 19 nt, artificial
  Oligomer
ugagcaggagaguauuacu

SEQ ID NO: 13651 - RNA, 19 nt, artificial
  Oligomer
cuucuuucucaggcaucaa

SEQ ID NO: 13652 - RNA, 19 nt, artificial
  Oligomer
ucuuucucaggcaucaaaa

SEQ ID NO: 13653 - RNA, 19 nt, artificial
  Oligomer
uucacauagaaaacauuaa

SEQ ID NO: 13654 - RNA, 19 nt, artificial
  Oligomer
aaguuucuaagauuuaaga

SEQ ID NO: 13655 - RNA, 19 nt, artificial
  Oligomer
gacuguuacuacaguugag

SEQ ID NO: 13656 - RNA, 19 nt, artificial
  Oligomer
acuagugacucagaaaauu

SEQ ID NO: 13657 - RNA, 19 nt, artificial
  Oligomer
caaaugcagaagauguaga

SEQ ID NO: 13658 - RNA, 19 nt, artificial
  Oligomer
caaauucaguucugaguau

SEQ ID NO: 13659 - RNA, 19 nt, artificial
  Oligomer
gaaaaacaacaaauucagu

SEQ ID NO: 13660 - RNA, 19 nt, artificial
  Oligomer
agaaaauucagacuaucau

SEQ ID NO: 13661 - RNA, 19 nt, artificial
  Oligomer
gauuaucguccaaaagugu

SEQ ID NO: 13662 - RNA, 19 nt, artificial
  Oligomer
uagguaaaaguacguaauu

SEQ ID NO: 13663 - RNA, 19 nt, artificial
  Oligomer
aauguaaacugugaagaua

SEQ ID NO: 13664 - RNA, 19 nt, artificial
  Oligomer
aucaccaaaaaauacuuaa

SEQ ID NO: 13665 - RNA, 19 nt, artificial
  Oligomer
ucgugagcucgucucugau

SEQ ID NO: 13666 - RNA, 19 nt, artificial
  Oligomer
caauauuucaauugugaau

SEQ ID NO: 13667 - RNA, 19 nt, artificial
  Oligomer
aguuaaaggcuuuguucga

SEQ ID NO: 13668 - RNA, 19 nt, artificial
  Oligomer
gaaaguagcuuugugacau

SEQ ID NO: 13669 - RNA, 19 nt, artificial
  Oligomer
guuugacuauuauauaugu

SEQ ID NO: 13670 - RNA, 19 nt, artificial
  Oligomer
gaaagcuagggacugcaca

SEQ ID NO: 13671 - RNA, 19 nt, artificial
  Oligomer
cacaguuuauuggugucau

SEQ ID NO: 13672 - RNA, 19 nt, artificial
  Oligomer
cauguuugcaaucaaagau

SEQ ID NO: 13673 - RNA, 19 nt, artificial
  Oligomer
ugagugcagaauuuaaaua

SEQ ID NO: 13674 - RNA, 19 nt, artificial
  Oligomer
aaaacaugcagaaagcaca

SEQ ID NO: 13675 - RNA, 19 nt, artificial
  Oligomer
uaccucugauaauucuaga

SEQ ID NO: 13676 - RNA, 19 nt, artificial
  Oligomer
aauuaguguuugaaaagau

SEQ ID NO: 13677 - RNA, 19 nt, artificial
  Oligomer
guuuguauuaaaugugaau

SEQ ID NO: 13678 - RNA, 19 nt, artificial
  Oligomer
agacaaagcccauuuuucu

SEQ ID NO: 13679 - RNA, 19 nt, artificial
  Oligomer
uacguuuaaauaucuuuga

SEQ ID NO: 13680 - RNA, 19 nt, artificial
  Oligomer
aacauggaaucaucaagga

SEQ ID NO: 13681 - RNA, 19 nt, artificial
  Oligomer
uguuugcaaucaaagauga

SEQ ID NO: 13682 - RNA, 19 nt, artificial
  Oligomer
ccuccuaccucugguucuu

SEQ ID NO: 13683 - RNA, 19 nt, artificial
  Oligomer
cuuuuuuuguaacucuacu

SEQ ID NO: 13684 - RNA, 19 nt, artificial
  Oligomer
uacagaaaacaugcagaaa

SEQ ID NO: 13685 - RNA, 19 nt, artificial
  Oligomer
guuaaaggcuuuguucgaa

SEQ ID NO: 13686 - RNA, 19 nt, artificial
  Oligomer
acagaaaguucaacugcuu

SEQ ID NO: 13687 - RNA, 19 nt, artificial
  Oligomer
gaugagaucaagaaugaca

SEQ ID NO: 13688 - RNA, 19 nt, artificial
  Oligomer
guccuccaggugaaaggaa

SEQ ID NO: 13689 - RNA, 19 nt, artificial
  Oligomer
aguacagaaaacaugcaga

SEQ ID NO: 13690 - RNA, 19 nt, artificial
  Oligomer
uaucguccaaaaguguuaa

SEQ ID NO: 13691 - RNA, 19 nt, artificial
  Oligomer
ggauuuaggaauugcucuu

SEQ ID NO: 13692 - RNA, 19 nt, artificial
  Oligomer
uaacucuacuguaugugaa

SEQ ID NO: 13693 - RNA, 19 nt, artificial
  Oligomer
cacagacaaagcccauuuu

SEQ ID NO: 13694 - RNA, 19 nt, artificial
  Oligomer
agucaugacacuaagucaa

SEQ ID NO: 13695 - RNA, 19 nt, artificial
  Oligomer
guugacuugaguaaauaua

SEQ ID NO: 13696 - RNA, 19 nt, artificial
  Oligomer
uucaaacuucagaaaugaa

SEQ ID NO: 13697 - RNA, 19 nt, artificial
  Oligomer
cauuuauggaggauuuuuu

SEQ ID NO: 13698 - RNA, 19 nt, artificial
  Oligomer
aagagaaaggaaguacaga

SEQ ID NO: 13699 - RNA, 19 nt, artificial
  Oligomer
cuagauuaucguccaaaag

SEQ ID NO: 13700 - RNA, 19 nt, artificial
  Oligomer
ucaguguauguuaguacaa

SEQ ID NO: 13701 - RNA, 19 nt, artificial
  Oligomer
aaaauucaaacuucagaaa

SEQ ID NO: 13702 - RNA, 19 nt, artificial
  Oligomer
caacuucauggaaagaaag

SEQ ID NO: 13703 - RNA, 19 nt, artificial
  Oligomer
acuucggaggauugcucaa

SEQ ID NO: 13704 - RNA, 19 nt, artificial
  Oligomer
acaacaaauucaguucuga

SEQ ID NO: 13705 - RNA, 19 nt, artificial
  Oligomer
cagaaaacaugcagaaagc

SEQ ID NO: 13706 - RNA, 19 nt, artificial
  Oligomer
cauccucaaggacauuacu

SEQ ID NO: 13707 - RNA, 19 nt, artificial
  Oligomer
uguuaguacaaaugucuau

SEQ ID NO: 13708 - RNA, 19 nt, artificial
  Oligomer
cuguaugugaacacuguga

SEQ ID NO: 13709 - RNA, 19 nt, artificial
  Oligomer
ccacuaauuguuuggguga

SEQ ID NO: 13710 - RNA, 19 nt, artificial
  Oligomer
aucauuuauuagcgcugaa

SEQ ID NO: 13711 - RNA, 19 nt, artificial
  Oligomer
aaacugugaagauaguuau

SEQ ID NO: 13712 - RNA, 19 nt, artificial
  Oligomer
gagauuuuaccauauuucu

SEQ ID NO: 13713 - RNA, 19 nt, artificial
  Oligomer
uuucaauugugaauucaca

SEQ ID NO: 13714 - RNA, 19 nt, artificial
  Oligomer
ugugacccuugcaccaaau

SEQ ID NO: 13715 - RNA, 19 nt, artificial
  Oligomer
acuacaguugagacucaga

SEQ ID NO: 13716 - RNA, 19 nt, artificial
  Oligomer
gaaucaucaaggaaugcac

SEQ ID NO: 13717 - RNA, 19 nt, artificial
  Oligomer
ugaucucgcgcaagaguga

SEQ ID NO: 13718 - RNA, 19 nt, artificial
  Oligomer
caggcaucaaaagcauuuu

SEQ ID NO: 13719 - RNA, 19 nt, artificial
  Oligomer
acugaagcagauaccugga

SEQ ID NO: 13720 - RNA, 19 nt, artificial
  Oligomer
cagaaaggaaaaccaaggu

SEQ ID NO: 13721 - RNA, 19 nt, artificial
  Oligomer
gcaaugguaaaaucaucau

SEQ ID NO: 13722 - RNA, 19 nt, artificial
  Oligomer
gugaaaggaaagcuaggga

SEQ ID NO: 13723 - RNA, 19 nt, artificial
  Oligomer
cugaagcagauaccuggaa

SEQ ID NO: 13724 - RNA, 19 nt, artificial
  Oligomer
aguaaauauaucaccacua

SEQ ID NO: 13725 - RNA, 19 nt, artificial
  Oligomer
uuguuuuucacucuagacc

SEQ ID NO: 13726 - RNA, 19 nt, artificial
  Oligomer
uuuauaacuaucuucacag

SEQ ID NO: 13727 - RNA, 19 nt, artificial
  Oligomer
uuuuggacgauaaucuagc

SEQ ID NO: 13728 - RNA, 19 nt, artificial
  Oligomer
uucuuuaggugguuccagg

SEQ ID NO: 13729 - RNA, 19 nt, artificial
  Oligomer
uuacucuugaugaaguuug

SEQ ID NO: 13730 - RNA, 19 nt, artificial
  Oligomer
uuuauuuccacuucuaagc

SEQ ID NO: 13731 - RNA, 19 nt, artificial
  Oligomer
uugcacuugguguugcugg

SEQ ID NO: 13732 - RNA, 19 nt, artificial
  Oligomer
uugaucucaucuauuuugg

SEQ ID NO: 13733 - RNA, 19 nt, artificial
  Oligomer
uuuaacuugacuuaguguc

SEQ ID NO: 13734 - RNA, 19 nt, artificial
  Oligomer
uuuuuugagaucuuuaauc

SEQ ID NO: 13735 - RNA, 19 nt, artificial
  Oligomer
uuggacauugucauucuug

SEQ ID NO: 13736 - RNA, 19 nt, artificial
  Oligomer
uuaagguuggagauucaug

SEQ ID NO: 13737 - RNA, 19 nt, artificial
  Oligomer
uuaauuacguacuuuuacc

SEQ ID NO: 13738 - RNA, 19 nt, artificial
  Oligomer
uagaucuggauccuuccuc

SEQ ID NO: 13739 - RNA, 19 nt, artificial
  Oligomer
uugguuuuccuuucugugc

SEQ ID NO: 13740 - RNA, 19 nt, artificial
  Oligomer
uagauuuuaaacauccuug

SEQ ID NO: 13741 - RNA, 19 nt, artificial
  Oligomer
uauuuuuuggugauauuuc

SEQ ID NO: 13742 - RNA, 19 nt, artificial
  Oligomer
uuccuuucugugcuuucug

SEQ ID NO: 13743 - RNA, 19 nt, artificial
  Oligomer
uuaguaucuccaaaccagg

SEQ ID NO: 13744 - RNA, 19 nt, artificial
  Oligomer
uuuaaacguaggauaguag

SEQ ID NO: 13745 - RNA, 19 nt, artificial
  Oligomer
uuuaauuacguacuuuuac

SEQ ID NO: 13746 - RNA, 19 nt, artificial
  Oligomer
uccauguucacauuuggug

SEQ ID NO: 13747 - RNA, 19 nt, artificial
  Oligomer
uuuacaugggacauuauug

SEQ ID NO: 13748 - RNA, 19 nt, artificial
  Oligomer
uuuggugcaagggucacag

SEQ ID NO: 13749 - RNA, 19 nt, artificial
  Oligomer
uuuuggugauauuuccaug

SEQ ID NO: 13750 - RNA, 19 nt, artificial
  Oligomer
uugaacuuucuguucugcu

SEQ ID NO: 13751 - RNA, 19 nt, artificial
  Oligomer
uuuuaaacauccuuggagg

SEQ ID NO: 13752 - RNA, 19 nt, artificial
  Oligomer
auuaagaugagcaccaagg

SEQ ID NO: 13753 - RNA, 19 nt, artificial
  Oligomer
ucuaguaauacucuccugc

SEQ ID NO: 13754 - RNA, 19 nt, artificial
  Oligomer
uuuugguggacuauuaagu

SEQ ID NO: 13755 - RNA, 19 nt, artificial
  Oligomer
auaaauaugaucuucucag

SEQ ID NO: 13756 - RNA, 19 nt, artificial
  Oligomer
uuuuuuggugauauuucca

SEQ ID NO: 13757 - RNA, 19 nt, artificial
  Oligomer
aucuauuuuaucaucuuug

SEQ ID NO: 13758 - RNA, 19 nt, artificial
  Oligomer
uuucuuuccaugaaguuga

SEQ ID NO: 13759 - RNA, 19 nt, artificial
  Oligomer
uugaugaaguuuguuuucc

SEQ ID NO: 13760 - RNA, 19 nt, artificial
  Oligomer
ucuuugauugcaaacaugg

SEQ ID NO: 13761 - RNA, 19 nt, artificial
  Oligomer
uauuuggguacuuagcaug

SEQ ID NO: 13762 - RNA, 19 nt, artificial
  Oligomer
uucauugacaccauucuuu

SEQ ID NO: 13763 - RNA, 19 nt, artificial
  Oligomer
uugaauuuucugagucacu

SEQ ID NO: 13764 - RNA, 19 nt, artificial
  Oligomer
uugggcauuaacacuuuug

SEQ ID NO: 13765 - RNA, 19 nt, artificial
  Oligomer
uuucuguacuuccuuucuc

SEQ ID NO: 13766 - RNA, 19 nt, artificial
  Oligomer
uuccucuuugcacuuggug

SEQ ID NO: 13767 - RNA, 19 nt, artificial
  Oligomer
uuuuuggugauauuuccau

SEQ ID NO: 13768 - RNA, 19 nt, artificial
  Oligomer
uucugagucacuaguaaug

SEQ ID NO: 13769 - RNA, 19 nt, artificial
  Oligomer
uuuguacuaacauacacug

SEQ ID NO: 13770 - RNA, 19 nt, artificial
  Oligomer
uuucugugcuuucugcaug

SEQ ID NO: 13771 - RNA, 19 nt, artificial
  Oligomer
uuaaaucuuagaaacuugg

SEQ ID NO: 13772 - RNA, 19 nt, artificial
  Oligomer
uuggauuucauuucugaag

SEQ ID NO: 13773 - RNA, 19 nt, artificial
  Oligomer
uucaaagauauuuaaacgu

SEQ ID NO: 13774 - RNA, 19 nt, artificial
  Oligomer
uuuuccuuucugugcuuuc

SEQ ID NO: 13775 - RNA, 19 nt, artificial
  Oligomer
uuaaauucugcacucaaau

SEQ ID NO: 13776 - RNA, 19 nt, artificial
  Oligomer
uuaaucuuucauccucugc

SEQ ID NO: 13777 - RNA, 19 nt, artificial
  Oligomer
uagcuuuccuuucaccugg

SEQ ID NO: 13778 - RNA, 19 nt, artificial
  Oligomer
ucuggauccuuccucuuug

SEQ ID NO: 13779 - RNA, 19 nt, artificial
  Oligomer
uaauaugacaccaauaaac

SEQ ID NO: 13780 - RNA, 19 nt, artificial
  Oligomer
uucugaaguuugaauuuuc

SEQ ID NO: 13781 - RNA, 19 nt, artificial
  Oligomer
uguaguaacagucuuccuc

SEQ ID NO: 13782 - RNA, 19 nt, artificial
  Oligomer
uuugauugcaaacaugggu

SEQ ID NO: 13783 - RNA, 19 nt, artificial
  Oligomer
uuucaaagauauuuaaacg

SEQ ID NO: 13784 - RNA, 19 nt, artificial
  Oligomer
uuauuuaaauucugcacuc

SEQ ID NO: 13785 - RNA, 19 nt, artificial
  Oligomer
ugagucacuaguaaugucc

SEQ ID NO: 13786 - RNA, 19 nt, artificial
  Oligomer
uuucuaagggcagucuugc

SEQ ID NO: 13787 - RNA, 19 nt, artificial
  Oligomer
uucuguacuuccuuucucu

SEQ ID NO: 13788 - RNA, 19 nt, artificial
  Oligomer
uucaugagaaccuugguuu

SEQ ID NO: 13789 - RNA, 19 nt, artificial
  Oligomer
uauuaaguauuuuuuggug

SEQ ID NO: 13790 - RNA, 19 nt, artificial
  Oligomer
uugagaucuuuaaucaaug

SEQ ID NO: 13791 - RNA, 19 nt, artificial
  Oligomer
ucuaagggcagucuugccu

SEQ ID NO: 13792 - RNA, 19 nt, artificial
  Oligomer
uauugauucauagaguggg

SEQ ID NO: 13793 - RNA, 19 nt, artificial
  Oligomer
uaugacaccaauaaacugu

SEQ ID NO: 13794 - RNA, 19 nt, artificial
  Oligomer
uuugguuuacaucugcacu

SEQ ID NO: 13795 - RNA, 19 nt, artificial
  Oligomer
ugguuguugagcaauccuc

SEQ ID NO: 13796 - RNA, 19 nt, artificial
  Oligomer
uuauuuccacuucuaagcc

SEQ ID NO: 13797 - RNA, 19 nt, artificial
  Oligomer
uuacaaaaaaaguuugguu

SEQ ID NO: 13798 - RNA, 19 nt, artificial
  Oligomer
auuuuuuggugauauuucc

SEQ ID NO: 13799 - RNA, 19 nt, artificial
  Oligomer
uugguguugcuggugagug

SEQ ID NO: 13800 - RNA, 19 nt, artificial
  Oligomer
uacauaaauaugaucuucu

SEQ ID NO: 13801 - RNA, 19 nt, artificial
  Oligomer
ugacaugucacaaagcuac

SEQ ID NO: 13802 - RNA, 19 nt, artificial
  Oligomer
uuggagauucaugagaacc

SEQ ID NO: 13803 - RNA, 19 nt, artificial
  Oligomer
uaauuuagaggcaaagugg

SEQ ID NO: 13804 - RNA, 19 nt, artificial
  Oligomer
ucacaguuuacauuuacag

SEQ ID NO: 13805 - RNA, 19 nt, artificial
  Oligomer
uuuggaagaaaaaugggcu

SEQ ID NO: 13806 - RNA, 19 nt, artificial
  Oligomer
uuugcacuugguguugcug

SEQ ID NO: 13807 - RNA, 19 nt, artificial
  Oligomer
uugcuauguauaagcugcc

SEQ ID NO: 13808 - RNA, 19 nt, artificial
  Oligomer
uacaaaaaaaguuugguuu

SEQ ID NO: 13809 - RNA, 19 nt, artificial
  Oligomer
uaugacaagagcaauuccu

SEQ ID NO: 13810 - RNA, 19 nt, artificial
  Oligomer
auuuacucaagucaacauc

SEQ ID NO: 13811 - RNA, 19 nt, artificial
  Oligomer
uugauugcaaacauggguu

SEQ ID NO: 13812 - RNA, 19 nt, artificial
  Oligomer
acauuauugaacauuuucg

SEQ ID NO: 13813 - RNA, 19 nt, artificial
  Oligomer
uugaugucagucacuuggg

SEQ ID NO: 13814 - RNA, 19 nt, artificial
  Oligomer
uuuuucacucuagaccaag

SEQ ID NO: 13815 - RNA, 19 nt, artificial
  Oligomer
uauuguauaauaugacacc

SEQ ID NO: 13816 - RNA, 19 nt, artificial
  Oligomer
uuucucuucacccaaacaa

SEQ ID NO: 13817 - RNA, 19 nt, artificial
  Oligomer
uuugaauuuucugagucac

SEQ ID NO: 13818 - RNA, 19 nt, artificial
  Oligomer
auagucugaauuuucucug

SEQ ID NO: 13819 - RNA, 19 nt, artificial
  Oligomer
uuuggugauauuuccaugu

SEQ ID NO: 13820 - RNA, 19 nt, artificial
  Oligomer
uugacugugcagucccuag

SEQ ID NO: 13821 - RNA, 19 nt, artificial
  Oligomer
ucugagagcaguuaguauc

SEQ ID NO: 13822 - RNA, 19 nt, artificial
  Oligomer
uuucucugagagcaguuag

SEQ ID NO: 13823 - RNA, 19 nt, artificial
  Oligomer
auuuuaaacauccuuggag

SEQ ID NO: 13824 - RNA, 19 nt, artificial
  Oligomer
uucaugacaugucacaaag

SEQ ID NO: 13825 - RNA, 19 nt, artificial
  Oligomer
uuaauacaaacuuucaaag

SEQ ID NO: 13826 - RNA, 19 nt, artificial
  Oligomer
uugguuuacaucugcacuu

SEQ ID NO: 13827 - RNA, 19 nt, artificial
  Oligomer
ucaguuuauaacuaucuuc

SEQ ID NO: 13828 - RNA, 19 nt, artificial
  Oligomer
acuuccuuucucuucaccc

SEQ ID NO: 13829 - RNA, 19 nt, artificial
  Oligomer
uucuugaucucaucuauuu

SEQ ID NO: 13830 - RNA, 19 nt, artificial
  Oligomer
ugaaguuugaauuuucuga

SEQ ID NO: 13831 - RNA, 19 nt, artificial
  Oligomer
auuauugaacauuuucggg

SEQ ID NO: 13832 - RNA, 19 nt, artificial
  Oligomer
uuguuguuuuucacucuag

SEQ ID NO: 13833 - RNA, 19 nt, artificial
  Oligomer
uuggaguugaugucaguca

SEQ ID NO: 13834 - RNA, 19 nt, artificial
  Oligomer
auaaaugauaaaauguacc

SEQ ID NO: 13835 - RNA, 19 nt, artificial
  Oligomer
uucugcauguuuucuguac

SEQ ID NO: 13836 - RNA, 19 nt, artificial
  Oligomer
uaaaugauaaaauguaccc

SEQ ID NO: 13837 - RNA, 19 nt, artificial
  Oligomer
uucacauuuggugcaaggg

SEQ ID NO: 13838 - RNA, 19 nt, artificial
  Oligomer
uugcauauacucagaacug

SEQ ID NO: 13839 - RNA, 19 nt, artificial
  Oligomer
augagaaccuugguuuucc

SEQ ID NO: 13840 - RNA, 19 nt, artificial
  Oligomer
uugaugauuccauguucac

SEQ ID NO: 13841 - RNA, 19 nt, artificial
  Oligomer
uccgggugcaguuuauuuc

SEQ ID NO: 13842 - RNA, 19 nt, artificial
  Oligomer
ugaugaaguuuguuuuccc

SEQ ID NO: 13843 - RNA, 19 nt, artificial
  Oligomer
uuuucaaacacuaauugca

SEQ ID NO: 13844 - RNA, 19 nt, artificial
  Oligomer
auaaacugugcaaaggucu

SEQ ID NO: 13845 - RNA, 19 nt, artificial
  Oligomer
uccuauuuggguacuuagc

SEQ ID NO: 13846 - RNA, 19 nt, artificial
  Oligomer
uuaaacguaggauaguagu

SEQ ID NO: 13847 - RNA, 19 nt, artificial
  Oligomer
ugauauuucagcaaaaggu

SEQ ID NO: 13848 - RNA, 19 nt, artificial
  Oligomer
uuuaucaucuuugauugca

SEQ ID NO: 13849 - RNA, 19 nt, artificial
  Oligomer
auuuguacuaacauacacu

SEQ ID NO: 13850 - RNA, 19 nt, artificial
  Oligomer
uugcuggugagugugcauu

SEQ ID NO: 13851 - RNA, 19 nt, artificial
  Oligomer
ugauauuuccauguuuggg

SEQ ID NO: 13852 - RNA, 19 nt, artificial
  Oligomer
auuaucagagguaauuuag

SEQ ID NO: 13853 - RNA, 19 nt, artificial
  Oligomer
auauuguauaauaugacac

SEQ ID NO: 13854 - RNA, 19 nt, artificial
  Oligomer
uuuaaauucugcacucaaa

SEQ ID NO: 13855 - RNA, 19 nt, artificial
  Oligomer
cauugauucagcaacuugg

SEQ ID NO: 13856 - RNA, 19 nt, artificial
  Oligomer
ucuugaugaaguuuguuuu

SEQ ID NO: 13857 - RNA, 19 nt, artificial
  Oligomer
ugaacuuucuguucugcug

SEQ ID NO: 13858 - RNA, 19 nt, artificial
  Oligomer
uucuaagggcagucuugcc

SEQ ID NO: 13859 - RNA, 19 nt, artificial
  Oligomer
uucuucuauugauucauag

SEQ ID NO: 13860 - RNA, 19 nt, artificial
  Oligomer
uuguuuucccaacuagauu

SEQ ID NO: 13861 - RNA, 19 nt, artificial
  Oligomer
uuuacucaagucaacauca

SEQ ID NO: 13862 - RNA, 19 nt, artificial
  Oligomer
aauuuguuguuuuucacuc

SEQ ID NO: 13863 - RNA, 19 nt, artificial
  Oligomer
uaaucuuucauccucugca

SEQ ID NO: 13864 - RNA, 19 nt, artificial
  Oligomer
uuuucuaugugaauucaca

SEQ ID NO: 13865 - RNA, 19 nt, artificial
  Oligomer
auuaagaaucuuuucaaac

SEQ ID NO: 13866 - RNA, 19 nt, artificial
  Oligomer
uucugagucucaacuguag

SEQ ID NO: 13867 - RNA, 19 nt, artificial
  Oligomer
uugagguagagccuuauuu

SEQ ID NO: 13868 - RNA, 19 nt, artificial
  Oligomer
ucagagguaauuuagaggc

SEQ ID NO: 13869 - RNA, 19 nt, artificial
  Oligomer
uuuucuguacuuccuuucu

SEQ ID NO: 13870 - RNA, 19 nt, artificial
  Oligomer
uuuaggugguuccagguau

SEQ ID NO: 13871 - RNA, 19 nt, artificial
  Oligomer
auucuuucgaacaaagccu

SEQ ID NO: 13872 - RNA, 19 nt, artificial
  Oligomer
uguagcagguuuuacaugg

SEQ ID NO: 13873 - RNA, 19 nt, artificial
  Oligomer
uuaaacauccuuggaggca

SEQ ID NO: 13874 - RNA, 19 nt, artificial
  Oligomer
uuuguuguuuuucacucua

SEQ ID NO: 13875 - RNA, 19 nt, artificial
  Oligomer
uuuaauguuuucuauguga

SEQ ID NO: 13876 - RNA, 19 nt, artificial
  Oligomer
uuuccuuucaccuggagga

SEQ ID NO: 13877 - RNA, 19 nt, artificial
  Oligomer
uuuuugagaucuuuaauca

SEQ ID NO: 13878 - RNA, 19 nt, artificial
  Oligomer
uuucacucuagaccaagcu

SEQ ID NO: 13879 - RNA, 19 nt, artificial
  Oligomer
uuguugagcaauccuccga

SEQ ID NO: 13880 - RNA, 19 nt, artificial
  Oligomer
auaaucuuaaucuuucauc

SEQ ID NO: 13881 - RNA, 19 nt, artificial
  Oligomer
aucaugaugcaggccuucc

SEQ ID NO: 13882 - RNA, 19 nt, artificial
  Oligomer
uucagcaaaaggucauagc

SEQ ID NO: 13883 - RNA, 19 nt, artificial
  Oligomer
ucauacgcuucuuucuuuc

SEQ ID NO: 13884 - RNA, 19 nt, artificial
  Oligomer
uuaagaugagcaccaaggc

SEQ ID NO: 13885 - RNA, 19 nt, artificial
  Oligomer
uuccauguucacauuuggu

SEQ ID NO: 13886 - RNA, 19 nt, artificial
  Oligomer
uuacauaaauaugaucuuc

SEQ ID NO: 13887 - RNA, 19 nt, artificial
  Oligomer
ugcauuuggaagaaaaaug

SEQ ID NO: 13888 - RNA, 19 nt, artificial
  Oligomer
uuuuacaugggacauuauu

SEQ ID NO: 13889 - RNA, 19 nt, artificial
  Oligomer
auuuggguacuuagcaugc

SEQ ID NO: 13890 - RNA, 19 nt, artificial
  Oligomer
uaagguuggagauucauga

SEQ ID NO: 13891 - RNA, 19 nt, artificial
  Oligomer
uucaguaacugauauuuca

SEQ ID NO: 13892 - RNA, 19 nt, artificial
  Oligomer
auuuggaagaaaaaugggc

SEQ ID NO: 13893 - RNA, 19 nt, artificial
  Oligomer
ucuuaaucuuucauccucu

SEQ ID NO: 13894 - RNA, 19 nt, artificial
  Oligomer
uccuugaggaugauagucu

SEQ ID NO: 13895 - RNA, 19 nt, artificial
  Oligomer
ucuuccucaauuccaaucc

SEQ ID NO: 13896 - RNA, 19 nt, artificial
  Oligomer
auuucauuucugaaguuug

SEQ ID NO: 13897 - RNA, 19 nt, artificial
  Oligomer
ucauugacaccauucuuuc

SEQ ID NO: 13898 - RNA, 19 nt, artificial
  Oligomer
aucagagguaauuuagagg

SEQ ID NO: 13899 - RNA, 19 nt, artificial
  Oligomer
uuaagaaucuuuucaaaca

SEQ ID NO: 13900 - RNA, 19 nt, artificial
  Oligomer
ugaauuuucugagucacua

SEQ ID NO: 13901 - RNA, 19 nt, artificial
  Oligomer
uagaguuacaaaaaaaguu

SEQ ID NO: 13902 - RNA, 19 nt, artificial
  Oligomer
ugugcaaaggucuuugagg

SEQ ID NO: 13903 - RNA, 19 nt, artificial
  Oligomer
uguuuuucacucuagacca

SEQ ID NO: 13904 - RNA, 19 nt, artificial
  Oligomer
ucuucagcgcuaauaaaug

SEQ ID NO: 13905 - RNA, 19 nt, artificial
  Oligomer
aucucuagaauuaucagag

SEQ ID NO: 13906 - RNA, 19 nt, artificial
  Oligomer
ucugcacuugguauucugg

SEQ ID NO: 13907 - RNA, 19 nt, artificial
  Oligomer
uaaacauccuuggaggcag

SEQ ID NO: 13908 - RNA, 19 nt, artificial
  Oligomer
uaguaucuccaaaccaggc

SEQ ID NO: 13909 - RNA, 19 nt, artificial
  Oligomer
auuuuaucaucuuugauug

SEQ ID NO: 13910 - RNA, 19 nt, artificial
  Oligomer
cuugaucucaucuauuuug

SEQ ID NO: 13911 - RNA, 19 nt, artificial
  Oligomer
uucacauuuaauacaaacu

SEQ ID NO: 13912 - RNA, 19 nt, artificial
  Oligomer
ugcaagaguacaaagauug

SEQ ID NO: 13913 - RNA, 19 nt, artificial
  Oligomer
uuagugucaugacuccagc

SEQ ID NO: 13914 - RNA, 19 nt, artificial
  Oligomer
acuaauugcauauacucag

SEQ ID NO: 13915 - RNA, 19 nt, artificial
  Oligomer
acaaaguuuagaaauaugg

SEQ ID NO: 13916 - RNA, 19 nt, artificial
  Oligomer
uuuucacucuagaccaagc

SEQ ID NO: 13917 - RNA, 19 nt, artificial
  Oligomer
ucauucuugaucucaucua

SEQ ID NO: 13918 - RNA, 19 nt, artificial
  Oligomer
uuccucaauuccaaucccu

SEQ ID NO: 13919 - RNA, 19 nt, artificial
  Oligomer
uauaacuaucuucacaguu

SEQ ID NO: 13920 - RNA, 19 nt, artificial
  Oligomer
aucagauaaauuuauugcc

SEQ ID NO: 13921 - RNA, 19 nt, artificial
  Oligomer
aaguagguaguuuugagcc

SEQ ID NO: 13922 - RNA, 19 nt, artificial
  Oligomer
uagagccuuauuuaaauuc

SEQ ID NO: 13923 - RNA, 19 nt, artificial
  Oligomer
ucuaugugaauucacaauu

SEQ ID NO: 13924 - RNA, 19 nt, artificial
  Oligomer
uggacgauaaucuagcaac

SEQ ID NO: 13925 - RNA, 19 nt, artificial
  Oligomer
uugucauucuugaucucau

SEQ ID NO: 13926 - RNA, 19 nt, artificial
  Oligomer
ugucauacgcuucuuucuu

SEQ ID NO: 13927 - RNA, 19 nt, artificial
  Oligomer
uguacuuccuuucucuuca

SEQ ID NO: 13928 - RNA, 19 nt, artificial
  Oligomer
ucauccucugcauacacuc

SEQ ID NO: 13929 - RNA, 19 nt, artificial
  Oligomer
uuccuuucucuucacccaa

SEQ ID NO: 13930 - RNA, 19 nt, artificial
  Oligomer
uuccuaaauccagaugaug

SEQ ID NO: 13931 - RNA, 19 nt, artificial
  Oligomer
uaaaccgcuucccucacuc

SEQ ID NO: 13932 - RNA, 19 nt, artificial
  Oligomer
uuucagcaaaaggucauag

SEQ ID NO: 13933 - RNA, 19 nt, artificial
  Oligomer
auccucugcauacacuccu

SEQ ID NO: 13934 - RNA, 19 nt, artificial
  Oligomer
uuuccuuucugugcuuucu

SEQ ID NO: 13935 - RNA, 19 nt, artificial
  Oligomer
acauuauuuaauuacguac

SEQ ID NO: 13936 - RNA, 19 nt, artificial
  Oligomer
uucacaguuuacauuuaca

SEQ ID NO: 13937 - RNA, 19 nt, artificial
  Oligomer
aguuagaucuggauccuuc

SEQ ID NO: 13938 - RNA, 19 nt, artificial
  Oligomer
ugaaguuuguuuucccaac

SEQ ID NO: 13939 - RNA, 19 nt, artificial
  Oligomer
uuuguuuucccaacuagau

SEQ ID NO: 13940 - RNA, 19 nt, artificial
  Oligomer
aaauucugcacucaaauac

SEQ ID NO: 13941 - RNA, 19 nt, artificial
  Oligomer
ugcaguuuauuuccacuuc

SEQ ID NO: 13942 - RNA, 19 nt, artificial
  Oligomer
uuuccaugaaguugaugcc

SEQ ID NO: 13943 - RNA, 19 nt, artificial
  Oligomer
aaaaucuacaaauauguug

SEQ ID NO: 13944 - RNA, 19 nt, artificial
  Oligomer
ucaguaacugauauuucag

SEQ ID NO: 13945 - RNA, 19 nt, artificial
  Oligomer
uuuacaucugcacuuggua

SEQ ID NO: 13946 - RNA, 19 nt, artificial
  Oligomer
uucacccaaacaauuagug

SEQ ID NO: 13947 - RNA, 19 nt, artificial
  Oligomer
auggaaguucuuuaggugg

SEQ ID NO: 13948 - RNA, 19 nt, artificial
  Oligomer
uaauuacguacuuuuaccu

SEQ ID NO: 13949 - RNA, 19 nt, artificial
  Oligomer
aucugcuucaguuuauaac

SEQ ID NO: 13950 - RNA, 19 nt, artificial
  Oligomer
uguggauagacauuuguac

SEQ ID NO: 13951 - RNA, 19 nt, artificial
  Oligomer
ugggcauuaacacuuuugg

SEQ ID NO: 13952 - RNA, 19 nt, artificial
  Oligomer
uccuuucugugcuuucugc

SEQ ID NO: 13953 - RNA, 19 nt, artificial
  Oligomer
auugcuauguauaagcugc

SEQ ID NO: 13954 - RNA, 19 nt, artificial
  Oligomer
aucuuaaucuuucauccuc

SEQ ID NO: 13955 - RNA, 19 nt, artificial
  Oligomer
ucuugaucucaucuauuuu

SEQ ID NO: 13956 - RNA, 19 nt, artificial
  Oligomer
ugaugauuccauguucaca

SEQ ID NO: 13957 - RNA, 19 nt, artificial
  Oligomer
ugauagucugaauuuucuc

SEQ ID NO: 13958 - RNA, 19 nt, artificial
  Oligomer
uuucaaacacuaauugcau

SEQ ID NO: 13959 - RNA, 19 nt, artificial
  Oligomer
uucuuucgaacaaagccuu

SEQ ID NO: 13960 - RNA, 19 nt, artificial
  Oligomer
auuuguagcagguuuuaca

SEQ ID NO: 13961 - RNA, 19 nt, artificial
  Oligomer
uuuaaacauccuuggaggc

SEQ ID NO: 13962 - RNA, 19 nt, artificial
  Oligomer
uuucuaugugaauucacaa

SEQ ID NO: 13963 - RNA, 19 nt, artificial
  Oligomer
auuacauucauacuacaga

SEQ ID NO: 13964 - RNA, 19 nt, artificial
  Oligomer
uccuaaauccagaugauga

SEQ ID NO: 13965 - RNA, 19 nt, artificial
  Oligomer
uccucuuugcacuuggugu

SEQ ID NO: 13966 - RNA, 19 nt, artificial
  Oligomer
uuggacgauaaucuagcaa

SEQ ID NO: 13967 - RNA, 19 nt, artificial
  Oligomer
auguuuucuguacuuccuu

SEQ ID NO: 13968 - RNA, 19 nt, artificial
  Oligomer
ugguuuuccuuucugugcu

SEQ ID NO: 13969 - RNA, 19 nt, artificial
  Oligomer
uauaauaugacaccaauaa

SEQ ID NO: 13970 - RNA, 19 nt, artificial
  Oligomer
uuguauaauaugacaccaa

SEQ ID NO: 13971 - RNA, 19 nt, artificial
  Oligomer
uuuggguacuuagcaugcc

SEQ ID NO: 13972 - RNA, 19 nt, artificial
  Oligomer
uagcuucuucuauugauuc

SEQ ID NO: 13973 - RNA, 19 nt, artificial
  Oligomer
auaguggugauauauuuac

SEQ ID NO: 13974 - RNA, 19 nt, artificial
  Oligomer
acuguuucaggauuuaagg

SEQ ID NO: 13975 - RNA, 19 nt, artificial
  Oligomer
auugacaccauucuuucga

SEQ ID NO: 13976 - RNA, 19 nt, artificial
  Oligomer
uucugcacucaaauacaua

SEQ ID NO: 13977 - RNA, 19 nt, artificial
  Oligomer
augcccagcaugguuguug

SEQ ID NO: 13978 - RNA, 19 nt, artificial
  Oligomer
uugcaaacauggguucaug

SEQ ID NO: 13979 - RNA, 19 nt, artificial
  Oligomer
uguuucaggauuuaagguu

SEQ ID NO: 13980 - RNA, 19 nt, artificial
  Oligomer
auguccuugaggaugauag

SEQ ID NO: 13981 - RNA, 19 nt, artificial
  Oligomer
ugacuuagugucaugacuc

SEQ ID NO: 13982 - RNA, 19 nt, artificial
  Oligomer
uacuuccuuucucuucacc

SEQ ID NO: 13983 - RNA, 19 nt, artificial
  Oligomer
auuuaaauucugcacucaa

SEQ ID NO: 13984 - RNA, 19 nt, artificial
  Oligomer
aucugcacuugguauucug

SEQ ID NO: 13985 - RNA, 19 nt, artificial
  Oligomer
uuccuugaugauuccaugu

SEQ ID NO: 13986 - RNA, 19 nt, artificial
  Oligomer
auucuugaucucaucuauu

SEQ ID NO: 13987 - RNA, 19 nt, artificial
  Oligomer
uuucauccucugcauacac

SEQ ID NO: 13988 - RNA, 19 nt, artificial
  Oligomer
ucuuuaggugguuccaggu

SEQ ID NO: 13989 - RNA, 19 nt, artificial
  Oligomer
uaaaaaaccaagcaguauu

SEQ ID NO: 13990 - RNA, 19 nt, artificial
  Oligomer
uuugagaucuuuaaucaau

SEQ ID NO: 13991 - RNA, 19 nt, artificial
  Oligomer
auuccuugaugauuccaug

SEQ ID NO: 13992 - RNA, 19 nt, artificial
  Oligomer
acuauuaaguauuuuuugg

SEQ ID NO: 13993 - RNA, 19 nt, artificial
  Oligomer
aacuagauuuuaaacaucc

SEQ ID NO: 13994 - RNA, 19 nt, artificial
  Oligomer
uaguaauacucuccugcuc

SEQ ID NO: 13995 - RNA, 19 nt, artificial
  Oligomer
ugagauauuaaaaaucuac

SEQ ID NO: 13996 - RNA, 19 nt, artificial
  Oligomer
uaggauaguaguaaggaga

SEQ ID NO: 13997 - RNA, 19 nt, artificial
  Oligomer
uucuauugauucauagagu

SEQ ID NO: 13998 - RNA, 19 nt, artificial
  Oligomer
uuccaaguucugagucuca

SEQ ID NO: 13999 - RNA, 19 nt, artificial
  Oligomer
ucguaaaccgcuucccuca

SEQ ID NO: 14000 - RNA, 19 nt, artificial
  Oligomer
ucuuucauccucugcauac

SEQ ID NO: 14001 - RNA, 19 nt, artificial
  Oligomer
uaucagagguaauuuagag

SEQ ID NO: 14002 - RNA, 19 nt, artificial
  Oligomer
uaaucuuaaucuuucaucc

SEQ ID NO: 14003 - RNA, 19 nt, artificial
  Oligomer
guugaugucagucacuugg

SEQ ID NO: 14004 - RNA, 19 nt, artificial
  Oligomer
uuaucagagguaauuuaga

SEQ ID NO: 14005 - RNA, 19 nt, artificial
  Oligomer
cuuuccaugaaguugaugc

SEQ ID NO: 14006 - RNA, 19 nt, artificial
  Oligomer
aaguucuuuaggugguucc

SEQ ID NO: 14007 - RNA, 19 nt, artificial
  Oligomer
uuacgaagcaguugaacuu

SEQ ID NO: 14008 - RNA, 19 nt, artificial
  Oligomer
uuaacuugacuuaguguca

SEQ ID NO: 14009 - RNA, 19 nt, artificial
  Oligomer
uucauccucugcauacacu

SEQ ID NO: 14010 - RNA, 19 nt, artificial
  Oligomer
aaaaguuugguuuacaucu

SEQ ID NO: 14011 - RNA, 19 nt, artificial
  Oligomer
auugucauucuugaucuca

SEQ ID NO: 14012 - RNA, 19 nt, artificial
  Oligomer
ucacucuagaccaagcuuu

SEQ ID NO: 14013 - RNA, 19 nt, artificial
  Oligomer
acuaguaauguccuugagg

SEQ ID NO: 14014 - RNA, 19 nt, artificial
  Oligomer
uuguagcagguuuuacaug

SEQ ID NO: 14015 - RNA, 19 nt, artificial
  Oligomer
ucugaauuuucucugcaag

SEQ ID NO: 14016 - RNA, 19 nt, artificial
  Oligomer
uuagaaauaugguaaaauc

SEQ ID NO: 14017 - RNA, 19 nt, artificial
  Oligomer
ucacucguaaaccgcuucc

SEQ ID NO: 14018 - RNA, 19 nt, artificial
  Oligomer
uuuaccauugcuauguaua

SEQ ID NO: 14019 - RNA, 19 nt, artificial
  Oligomer
uuaggugguuccagguauc

SEQ ID NO: 14020 - RNA, 19 nt, artificial
  Oligomer
aggucuuugagguagagcc

SEQ ID NO: 14021 - RNA, 19 nt, artificial
  Oligomer
ugcauguuuucuguacuuc

SEQ ID NO: 14022 - RNA, 19 nt, artificial
  Oligomer
cucaaaaugcuuuugaugc

SEQ ID NO: 14023 - RNA, 19 nt, artificial
  Oligomer
uuccaaucccuuggaguug

SEQ ID NO: 14024 - RNA, 19 nt, artificial
  Oligomer
aucuucacaguuuacauuu

SEQ ID NO: 14025 - RNA, 19 nt, artificial
  Oligomer
uuuacucuugaugaaguuu

SEQ ID NO: 14026 - RNA, 19 nt, artificial
  Oligomer
guuaguaucuccaaaccag

SEQ ID NO: 14027 - RNA, 19 nt, artificial
  Oligomer
ucacaaagcuacuuucucu

SEQ ID NO: 14028 - RNA, 19 nt, artificial
  Oligomer
uugaggaugauagucugaa

SEQ ID NO: 14029 - RNA, 19 nt, artificial
  Oligomer
augaaguuuguuuucccaa

SEQ ID NO: 14030 - RNA, 19 nt, artificial
  Oligomer
uuagaucuggauccuuccu

SEQ ID NO: 14031 - RNA, 19 nt, artificial
  Oligomer
auuaaguauuuuuugguga

SEQ ID NO: 14032 - RNA, 19 nt, artificial
  Oligomer
cuuuccuuucaccuggagg

SEQ ID NO: 14033 - RNA, 19 nt, artificial
  Oligomer
uggacuauuaaguauuuuu

SEQ ID NO: 14034 - RNA, 19 nt, artificial
  Oligomer
cuuauuuaaauucugcacu

SEQ ID NO: 14035 - RNA, 19 nt, artificial
  Oligomer
ucugaaguuugaauuuucu

SEQ ID NO: 14036 - RNA, 19 nt, artificial
  Oligomer
uuacaugggacauuauuga

SEQ ID NO: 14037 - RNA, 19 nt, artificial
  Oligomer
uccucaauuccaaucccuu

SEQ ID NO: 14038 - RNA, 19 nt, artificial
  Oligomer
uuuaagguuggagauucau

SEQ ID NO: 14039 - RNA, 19 nt, artificial
  Oligomer
uuacguacuuuuaccuaua

SEQ ID NO: 14040 - RNA, 19 nt, artificial
  Oligomer
aaugauaaaauguacccag

SEQ ID NO: 14041 - RNA, 19 nt, artificial
  Oligomer
ucauacuacagaaucauau

SEQ ID NO: 14042 - RNA, 19 nt, artificial
  Oligomer
ucacauuuggugcaagggu

SEQ ID NO: 14043 - RNA, 19 nt, artificial
  Oligomer
accuauauuuuauaauucc

SEQ ID NO: 14044 - RNA, 19 nt, artificial
  Oligomer
auguuuucuaugugaauuc

SEQ ID NO: 14045 - RNA, 19 nt, artificial
  Oligomer
aucuggauccuuccucuuu

SEQ ID NO: 14046 - RNA, 19 nt, artificial
  Oligomer
aacugugcaaaggucuuug

SEQ ID NO: 14047 - RNA, 19 nt, artificial
  Oligomer
uuucugagucacuaguaau

SEQ ID NO: 14048 - RNA, 19 nt, artificial
  Oligomer
acauacacugauuacauuc

SEQ ID NO: 14049 - RNA, 19 nt, artificial
  Oligomer
uagaaauaugguaaaaucu

SEQ ID NO: 14050 - RNA, 19 nt, artificial
  Oligomer
ugaauuuguuguuuuucac

SEQ ID NO: 14051 - RNA, 19 nt, artificial
  Oligomer
uuuggauuucauuucugaa

SEQ ID NO: 14052 - RNA, 19 nt, artificial
  Oligomer
uaaauggaaguucuuuagg

SEQ ID NO: 14053 - RNA, 19 nt, artificial
  Oligomer
ugccugagaaagaaguagg

SEQ ID NO: 14054 - RNA, 19 nt, artificial
  Oligomer
ucuuuucaaacacuaauug

SEQ ID NO: 14055 - RNA, 19 nt, artificial
  Oligomer
ucugcauacacuccuauuu

SEQ ID NO: 14056 - RNA, 19 nt, artificial
  Oligomer
acauuuaauacaaacuuuc

SEQ ID NO: 14057 - RNA, 19 nt, artificial
  Oligomer
uucuuucuuuccaugaagu

SEQ ID NO: 14058 - RNA, 19 nt, artificial
  Oligomer
uucacaauugaaauauugu

SEQ ID NO: 14059 - RNA, 19 nt, artificial
  Oligomer
ucaugaugcaggccuucca

SEQ ID NO: 14060 - RNA, 19 nt, artificial
  Oligomer
uacaucuucugcauuugga

SEQ ID NO: 14061 - RNA, 19 nt, artificial
  Oligomer
cugcacuugguauucuggg

SEQ ID NO: 14062 - RNA, 19 nt, artificial
  Oligomer
uucuaugugaauucacaau

SEQ ID NO: 14063 - RNA, 19 nt, artificial
  Oligomer
ucaggauuuaagguuggag

SEQ ID NO: 14064 - RNA, 19 nt, artificial
  Oligomer
uucaguuuauaacuaucuu

SEQ ID NO: 14065 - RNA, 19 nt, artificial
  Oligomer
cugaaguuugaauuuucug

SEQ ID NO: 14066 - RNA, 19 nt, artificial
  Oligomer
auaaucuagcaacagacgu

SEQ ID NO: 14067 - RNA, 19 nt, artificial
  Oligomer
cuuuacauaaauaugaucu

SEQ ID NO: 14068 - RNA, 19 nt, artificial
  Oligomer
ucugcuucaguuuauaacu

SEQ ID NO: 14069 - RNA, 19 nt, artificial
  Oligomer
uucucuucacccaaacaau

SEQ ID NO: 14070 - RNA, 19 nt, artificial
  Oligomer
ugcaagggucacaguguuc

SEQ ID NO: 14071 - RNA, 19 nt, artificial
  Oligomer
uuacucaagucaacaucag

SEQ ID NO: 14072 - RNA, 19 nt, artificial
  Oligomer
uuuuaucaucuuugauugc

SEQ ID NO: 14073 - RNA, 19 nt, artificial
  Oligomer
cucuugaugaaguuuguuu

SEQ ID NO: 14074 - RNA, 19 nt, artificial
  Oligomer
ccaagcaguauuuacagcc

SEQ ID NO: 14075 - RNA, 19 nt, artificial
  Oligomer
auuucuaagggcagucuug

SEQ ID NO: 14076 - RNA, 19 nt, artificial
  Oligomer
uacuacagaaucauauguu

SEQ ID NO: 14077 - RNA, 19 nt, artificial
  Oligomer
uuucaggauuuaagguugg

SEQ ID NO: 14078 - RNA, 19 nt, artificial
  Oligomer
uaagaaucuuuucaaacac

SEQ ID NO: 14079 - RNA, 19 nt, artificial
  Oligomer
uguuuucuguacuuccuuu

SEQ ID NO: 14080 - RNA, 19 nt, artificial
  Oligomer
uuaucaucuuugauugcaa

SEQ ID NO: 14081 - RNA, 19 nt, artificial
  Oligomer
uguuuucccaacuagauuu

SEQ ID NO: 14082 - RNA, 19 nt, artificial
  Oligomer
cuuggaggcagaaucauga

SEQ ID NO: 14083 - RNA, 19 nt, artificial
  Oligomer
uccgaagugaaagagcuuc

SEQ ID NO: 14084 - RNA, 19 nt, artificial
  Oligomer
cucaauuccaaucccuugg

SEQ ID NO: 14085 - RNA, 19 nt, artificial
  Oligomer
aaaagaagaagacaaagcc

SEQ ID NO: 14086 - RNA, 19 nt, artificial
  Oligomer
auuacguacuuuuaccuau

SEQ ID NO: 14087 - RNA, 19 nt, artificial
  Oligomer
auccagaugaugauuuuac

SEQ ID NO: 14088 - RNA, 19 nt, artificial
  Oligomer
auacgcuucuuucuuucca

SEQ ID NO: 14089 - RNA, 19 nt, artificial
  Oligomer
uuuguagcagguuuuacau

SEQ ID NO: 14090 - RNA, 19 nt, artificial
  Oligomer
aaaaaguuugguuuacauc

SEQ ID NO: 14091 - RNA, 19 nt, artificial
  Oligomer
uauuucagcaaaaggucau

SEQ ID NO: 14092 - RNA, 19 nt, artificial
  Oligomer
aaaucuacaaauauguugg

SEQ ID NO: 14093 - RNA, 19 nt, artificial
  Oligomer
acaaucuacaucuucugca

SEQ ID NO: 14094 - RNA, 19 nt, artificial
  Oligomer
acugcauuuacucuugaug

SEQ ID NO: 14095 - RNA, 19 nt, artificial
  Oligomer
auuuaauguuuucuaugug

SEQ ID NO: 14096 - RNA, 19 nt, artificial
  Oligomer
ucuuugcacuugguguugc

SEQ ID NO: 14097 - RNA, 19 nt, artificial
  Oligomer
uggagauucaugagaaccu

SEQ ID NO: 14098 - RNA, 19 nt, artificial
  Oligomer
uguacuccuucccuucuug

SEQ ID NO: 14099 - RNA, 19 nt, artificial
  Oligomer
cuugguuuuccuuucugug

SEQ ID NO: 14100 - RNA, 19 nt, artificial
  Oligomer
uuucucugcaagaguacaa

SEQ ID NO: 14101 - RNA, 19 nt, artificial
  Oligomer
gucacuaguaauguccuug

SEQ ID NO: 14102 - RNA, 19 nt, artificial
  Oligomer
auuacgaagcaguugaacu

SEQ ID NO: 14103 - RNA, 19 nt, artificial
  Oligomer
auugcauauacucagaacu

SEQ ID NO: 14104 - RNA, 19 nt, artificial
  Oligomer
auauuuaaacguaggauag

SEQ ID NO: 14105 - RNA, 19 nt, artificial
  Oligomer
aauaugacaccaauaaacu

SEQ ID NO: 14106 - RNA, 19 nt, artificial
  Oligomer
uucugugcuuucugcaugu

SEQ ID NO: 14107 - RNA, 19 nt, artificial
  Oligomer
aagcuuuggauuucauuuc

SEQ ID NO: 14108 - RNA, 19 nt, artificial
  Oligomer
guuuucuguacuuccuuuc

SEQ ID NO: 14109 - RNA, 19 nt, artificial
  Oligomer
uuugguggacuauuaagua

SEQ ID NO: 14110 - RNA, 19 nt, artificial
  Oligomer
uuagccuguggauagacau

SEQ ID NO: 14111 - RNA, 19 nt, artificial
  Oligomer
ugcuggugagugugcauuc

SEQ ID NO: 14112 - RNA, 19 nt, artificial
  Oligomer
uuacauucauacuacagaa

SEQ ID NO: 14113 - RNA, 19 nt, artificial
  Oligomer
guuuauuuccacuucuaag

SEQ ID NO: 14114 - RNA, 19 nt, artificial
  Oligomer
auuuucugagucacuagua

SEQ ID NO: 14115 - RNA, 19 nt, artificial
  Oligomer
cuguacuuccuuucucuuc

SEQ ID NO: 14116 - RNA, 19 nt, artificial
  Oligomer
ucacuugggcauuaacacu

SEQ ID NO: 14117 - RNA, 19 nt, artificial
  Oligomer
auuuguuguuuuucacucu

SEQ ID NO: 14118 - RNA, 19 nt, artificial
  Oligomer
auaugacaccaauaaacug

SEQ ID NO: 14119 - RNA, 19 nt, artificial
  Oligomer
uagacauuuguacuaacau

SEQ ID NO: 14120 - RNA, 19 nt, artificial
  Oligomer
ucaaaaugcuuuugaugcc

SEQ ID NO: 14121 - RNA, 19 nt, artificial
  Oligomer
ucuauugauucauagagug

SEQ ID NO: 14122 - RNA, 19 nt, artificial
  Oligomer
uucucugagagcaguuagu

SEQ ID NO: 14123 - RNA, 19 nt, artificial
  Oligomer
uaaaucuuagaaacuuggg

SEQ ID NO: 14124 - RNA, 19 nt, artificial
  Oligomer
ucacauuuaauacaaacuu

SEQ ID NO: 14125 - RNA, 19 nt, artificial
  Oligomer
aucuacaucuucugcauuu

SEQ ID NO: 14126 - RNA, 19 nt, artificial
  Oligomer
ucaugagauauuaaaaauc

SEQ ID NO: 14127 - RNA, 19 nt, artificial
  Oligomer
cauuauugaacauuuucgg

SEQ ID NO: 14128 - RNA, 19 nt, artificial
  Oligomer
cucagaacugaauuuguug

SEQ ID NO: 14129 - RNA, 19 nt, artificial
  Oligomer
uacaucugcacuugguauu

SEQ ID NO: 14130 - RNA, 19 nt, artificial
  Oligomer
uucacucuagaccaagcuu

SEQ ID NO: 14131 - RNA, 19 nt, artificial
  Oligomer
aguggugauauauuuacuc

SEQ ID NO: 14132 - RNA, 19 nt, artificial
  Oligomer
auuuuauaauuccaaacac

SEQ ID NO: 14133 - RNA, 19 nt, artificial
  Oligomer
auucaugagaaccuugguu

SEQ ID NO: 14134 - RNA, 19 nt, artificial
  Oligomer
uaaauccagaugaugauuu

SEQ ID NO: 14135 - RNA, 19 nt, artificial
  Oligomer
acuguaguaacagucuucc

SEQ ID NO: 14136 - RNA, 19 nt, artificial
  Oligomer
agauucaugagaaccuugg

SEQ ID NO: 14137 - RNA, 19 nt, artificial
  Oligomer
uuuucugagucacuaguaa

SEQ ID NO: 14138 - RNA, 19 nt, artificial
  Oligomer
auugacugugcagucccua

SEQ ID NO: 14139 - RNA, 19 nt, artificial
  Oligomer
uuggaggcagaaucaugag

SEQ ID NO: 14140 - RNA, 19 nt, artificial
  Oligomer
auaaauggaaguucuuuag

SEQ ID NO: 14141 - RNA, 19 nt, artificial
  Oligomer
uuucauuucugaaguuuga

SEQ ID NO: 14142 - RNA, 19 nt, artificial
  Oligomer
uuacaucugcacuugguau

SEQ ID NO: 14143 - RNA, 19 nt, artificial
  Oligomer
cuagcuuuccuuucaccug

SEQ ID NO: 14144 - RNA, 19 nt, artificial
  Oligomer
auuccauguucacauuugg

SEQ ID NO: 14145 - RNA, 19 nt, artificial
  Oligomer
uaacauacacugauuacau

SEQ ID NO: 14146 - RNA, 19 nt, artificial
  Oligomer
auauuuacucaagucaaca

SEQ ID NO: 14147 - RNA, 19 nt, artificial
  Oligomer
ucacauacaguagaguuac

SEQ ID NO: 14148 - RNA, 19 nt, artificial
  Oligomer
aucaucuuugauugcaaac

SEQ ID NO: 14149 - RNA, 19 nt, artificial
  Oligomer
accauugcuauguauaagc

SEQ ID NO: 14150 - RNA, 19 nt, artificial
  Oligomer
aguaauacucuccugcuca

SEQ ID NO: 14151 - RNA, 19 nt, artificial
  Oligomer
uugaugccugagaaagaag

SEQ ID NO: 14152 - RNA, 19 nt, artificial
  Oligomer
uuuugaugccugagaaaga

SEQ ID NO: 14153 - RNA, 19 nt, artificial
  Oligomer
uuaauguuuucuaugugaa

SEQ ID NO: 14154 - RNA, 19 nt, artificial
  Oligomer
ucuuaaaucuuagaaacuu

SEQ ID NO: 14155 - RNA, 19 nt, artificial
  Oligomer
cucaacuguaguaacaguc

SEQ ID NO: 14156 - RNA, 19 nt, artificial
  Oligomer
aauuuucugagucacuagu

SEQ ID NO: 14157 - RNA, 19 nt, artificial
  Oligomer
ucuacaucuucugcauuug

SEQ ID NO: 14158 - RNA, 19 nt, artificial
  Oligomer
auacucagaacugaauuug

SEQ ID NO: 14159 - RNA, 19 nt, artificial
  Oligomer
acugaauuuguuguuuuuc

SEQ ID NO: 14160 - RNA, 19 nt, artificial
  Oligomer
augauagucugaauuuucu

SEQ ID NO: 14161 - RNA, 19 nt, artificial
  Oligomer
acacuuuuggacgauaauc

SEQ ID NO: 14162 - RNA, 19 nt, artificial
  Oligomer
aauuacguacuuuuaccua

SEQ ID NO: 14163 - RNA, 19 nt, artificial
  Oligomer
uaucuucacaguuuacauu

SEQ ID NO: 14164 - RNA, 19 nt, artificial
  Oligomer
uuaaguauuuuuuggugau

SEQ ID NO: 14165 - RNA, 19 nt, artificial
  Oligomer
aucagagacgagcucacga

SEQ ID NO: 14166 - RNA, 19 nt, artificial
  Oligomer
auucacaauugaaauauug

SEQ ID NO: 14167 - RNA, 19 nt, artificial
  Oligomer
ucgaacaaagccuuuaacu

SEQ ID NO: 14168 - RNA, 19 nt, artificial
  Oligomer
augucacaaagcuacuuuc

SEQ ID NO: 14169 - RNA, 19 nt, artificial
  Oligomer
acauauauaauagucaaac

SEQ ID NO: 14170 - RNA, 19 nt, artificial
  Oligomer
ugugcagucccuagcuuuc

SEQ ID NO: 14171 - RNA, 19 nt, artificial
  Oligomer
augacaccaauaaacugug

SEQ ID NO: 14172 - RNA, 19 nt, artificial
  Oligomer
aucuuugauugcaaacaug

SEQ ID NO: 14173 - RNA, 19 nt, artificial
  Oligomer
uauuuaaauucugcacuca

SEQ ID NO: 14174 - RNA, 19 nt, artificial
  Oligomer
ugugcuuucugcauguuuu

SEQ ID NO: 14175 - RNA, 19 nt, artificial
  Oligomer
ucuagaauuaucagaggua

SEQ ID NO: 14176 - RNA, 19 nt, artificial
  Oligomer
aucuuuucaaacacuaauu

SEQ ID NO: 14177 - RNA, 19 nt, artificial
  Oligomer
auucacauuuaauacaaac

SEQ ID NO: 14178 - RNA, 19 nt, artificial
  Oligomer
agaaaaaugggcuuugucu

SEQ ID NO: 14179 - RNA, 19 nt, artificial
  Oligomer
ucaaagauauuuaaacgua

SEQ ID NO: 14180 - RNA, 19 nt, artificial
  Oligomer
uccuugaugauuccauguu

SEQ ID NO: 14181 - RNA, 19 nt, artificial
  Oligomer
ucaucuuugauugcaaaca

SEQ ID NO: 14182 - RNA, 19 nt, artificial
  Oligomer
aagaaccagagguaggagg

SEQ ID NO: 14183 - RNA, 19 nt, artificial
  Oligomer
aguagaguuacaaaaaaag

SEQ ID NO: 14184 - RNA, 19 nt, artificial
  Oligomer
uuucugcauguuuucugua

SEQ ID NO: 14185 - RNA, 19 nt, artificial
  Oligomer
uucgaacaaagccuuuaac

SEQ ID NO: 14186 - RNA, 19 nt, artificial
  Oligomer
aagcaguugaacuuucugu

SEQ ID NO: 14187 - RNA, 19 nt, artificial
  Oligomer
ugucauucuugaucucauc

SEQ ID NO: 14188 - RNA, 19 nt, artificial
  Oligomer
uuccuuucaccuggaggac

SEQ ID NO: 14189 - RNA, 19 nt, artificial
  Oligomer
ucugcauguuuucuguacu

SEQ ID NO: 14190 - RNA, 19 nt, artificial
  Oligomer
uuaacacuuuuggacgaua

SEQ ID NO: 14191 - RNA, 19 nt, artificial
  Oligomer
aagagcaauuccuaaaucc

SEQ ID NO: 14192 - RNA, 19 nt, artificial
  Oligomer
uucacauacaguagaguua

SEQ ID NO: 14193 - RNA, 19 nt, artificial
  Oligomer
aaaaugggcuuugucugug

SEQ ID NO: 14194 - RNA, 19 nt, artificial
  Oligomer
uugacuuagugucaugacu

SEQ ID NO: 14195 - RNA, 19 nt, artificial
  Oligomer
uauauuuacucaagucaac

SEQ ID NO: 14196 - RNA, 19 nt, artificial
  Oligomer
uucauuucugaaguuugaa

SEQ ID NO: 14197 - RNA, 19 nt, artificial
  Oligomer
aaaaaauccuccauaaaug

SEQ ID NO: 14198 - RNA, 19 nt, artificial
  Oligomer
ucuguacuuccuuucucuu

SEQ ID NO: 14199 - RNA, 19 nt, artificial
  Oligomer
cuuuuggacgauaaucuag

SEQ ID NO: 14200 - RNA, 19 nt, artificial
  Oligomer
uuguacuaacauacacuga

SEQ ID NO: 14201 - RNA, 19 nt, artificial
  Oligomer
uuucugaaguuugaauuuu

SEQ ID NO: 14202 - RNA, 19 nt, artificial
  Oligomer
cuuucuuuccaugaaguug

SEQ ID NO: 14203 - RNA, 19 nt, artificial
  Oligomer
uugagcaauccuccgaagu

SEQ ID NO: 14204 - RNA, 19 nt, artificial
  Oligomer
ucagaacugaauuuguugu

SEQ ID NO: 14205 - RNA, 19 nt, artificial
  Oligomer
gcuuucugcauguuuucug

SEQ ID NO: 14206 - RNA, 19 nt, artificial
  Oligomer
aguaauguccuugaggaug

SEQ ID NO: 14207 - RNA, 19 nt, artificial
  Oligomer
auagacauuuguacuaaca

SEQ ID NO: 14208 - RNA, 19 nt, artificial
  Oligomer
ucacaguguucacauacag

SEQ ID NO: 14209 - RNA, 19 nt, artificial
  Oligomer
ucacccaaacaauuagugg

SEQ ID NO: 14210 - RNA, 19 nt, artificial
  Oligomer
uucagcgcuaauaaaugau

SEQ ID NO: 14211 - RNA, 19 nt, artificial
  Oligomer
auaacuaucuucacaguuu

SEQ ID NO: 14212 - RNA, 19 nt, artificial
  Oligomer
agaaauaugguaaaaucuc

SEQ ID NO: 14213 - RNA, 19 nt, artificial
  Oligomer
ugugaauucacaauugaaa

SEQ ID NO: 14214 - RNA, 19 nt, artificial
  Oligomer
auuuggugcaagggucaca

SEQ ID NO: 14215 - RNA, 19 nt, artificial
  Oligomer
ucugagucucaacuguagu

SEQ ID NO: 14216 - RNA, 19 nt, artificial
  Oligomer
gugcauuccuugaugauuc

SEQ ID NO: 14217 - RNA, 19 nt, artificial
  Oligomer
ucacucuugcgcgagauca

SEQ ID NO: 14218 - RNA, 19 nt, artificial
  Oligomer
aaaaugcuuuugaugccug

SEQ ID NO: 14219 - RNA, 19 nt, artificial
  Oligomer
uccagguaucugcuucagu

SEQ ID NO: 14220 - RNA, 19 nt, artificial
  Oligomer
accuugguuuuccuuucug

SEQ ID NO: 14221 - RNA, 19 nt, artificial
  Oligomer
augaugauuuuaccauugc

SEQ ID NO: 14222 - RNA, 19 nt, artificial
  Oligomer
ucccuagcuuuccuuucac

SEQ ID NO: 14223 - RNA, 19 nt, artificial
  Oligomer
uuccagguaucugcuucag

SEQ ID NO: 14224 - RNA, 19 nt, artificial
  Oligomer
uaguggugauauauuuacu

SEQ ID NO: 14225 - RNA, 19 nt, artificial
  Oligomer
cggugaaacuaacagauaa

SEQ ID NO: 14226 - RNA, 19 nt, artificial
  Oligomer
gagggagaagcaugaaaaa

SEQ ID NO: 14227 - RNA, 19 nt, artificial
  Oligomer
cucuaauagugcuuaaaaa

SEQ ID NO: 14228 - RNA, 19 nt, artificial
  Oligomer
ggauuuaagggauggaaaa

SEQ ID NO: 14229 - RNA, 19 nt, artificial
  Oligomer
ggaggaauaugacggaaga

SEQ ID NO: 14230 - RNA, 19 nt, artificial
  Oligomer
gcauuuuugugaaaugaaa

SEQ ID NO: 14231 - RNA, 19 nt, artificial
  Oligomer
ggagaagcaugaaaaagca

SEQ ID NO: 14232 - RNA, 19 nt, artificial
  Oligomer
gcagcaucuucacuucuaa

SEQ ID NO: 14233 - RNA, 19 nt, artificial
  Oligomer
ggacugagaagaaguaaaa

SEQ ID NO: 14234 - RNA, 19 nt, artificial
  Oligomer
ggaauaugacggaagaaca

SEQ ID NO: 14235 - RNA, 19 nt, artificial
  Oligomer
cguuuuucggcuuauauaa

SEQ ID NO: 14236 - RNA, 19 nt, artificial
  Oligomer
cagugagggucuucuuaca

SEQ ID NO: 14237 - RNA, 19 nt, artificial
  Oligomer
ccauuaugauucuuuguua

SEQ ID NO: 14238 - RNA, 19 nt, artificial
  Oligomer
caacucuaauagugcuuaa

SEQ ID NO: 14239 - RNA, 19 nt, artificial
  Oligomer
cuagaggcuugcauaauaa

SEQ ID NO: 14240 - RNA, 19 nt, artificial
  Oligomer
cgagaauguuguauucagu

SEQ ID NO: 14241 - RNA, 19 nt, artificial
  Oligomer
gaggaauaugacggaagaa

SEQ ID NO: 14242 - RNA, 19 nt, artificial
  Oligomer
ggauguuucagcucuucca

SEQ ID NO: 14243 - RNA, 19 nt, artificial
  Oligomer
cggcuuauauaagcucuaa

SEQ ID NO: 14244 - RNA, 19 nt, artificial
  Oligomer
ggacucauuucauuccuaa

SEQ ID NO: 14245 - RNA, 19 nt, artificial
  Oligomer
cauuuuugugaaaugaaaa

SEQ ID NO: 14246 - RNA, 19 nt, artificial
  Oligomer
agagggagaagcaugaaaa

SEQ ID NO: 14247 - RNA, 19 nt, artificial
  Oligomer
cuggagugaaguauaagaa

SEQ ID NO: 14248 - RNA, 19 nt, artificial
  Oligomer
gguugcauuuggucaagau

SEQ ID NO: 14249 - RNA, 19 nt, artificial
  Oligomer
gaguauuuaggcagauuga

SEQ ID NO: 14250 - RNA, 19 nt, artificial
  Oligomer
gaaacuaacagauaagcaa

SEQ ID NO: 14251 - RNA, 19 nt, artificial
  Oligomer
gaauaugacggaagaacau

SEQ ID NO: 14252 - RNA, 19 nt, artificial
  Oligomer
cagcaucuucacuucuaaa

SEQ ID NO: 14253 - RNA, 19 nt, artificial
  Oligomer
ccucuugagcagucagcaa

SEQ ID NO: 14254 - RNA, 19 nt, artificial
  Oligomer
aggauuuaagggauggaaa

SEQ ID NO: 14255 - RNA, 19 nt, artificial
  Oligomer
agaugugcauuuuugugaa

SEQ ID NO: 14256 - RNA, 19 nt, artificial
  Oligomer
ggacugucuuucagauaca

SEQ ID NO: 14257 - RNA, 19 nt, artificial
  Oligomer
ccagacaaauggaggaaua

SEQ ID NO: 14258 - RNA, 19 nt, artificial
  Oligomer
gaggauuuaagggauggaa

SEQ ID NO: 14259 - RNA, 19 nt, artificial
  Oligomer
acaggcaaguccaacucaa

SEQ ID NO: 14260 - RNA, 19 nt, artificial
  Oligomer
gagaccacaggguucaaaa

SEQ ID NO: 14261 - RNA, 19 nt, artificial
  Oligomer
agcucuuccaccuacagaa

SEQ ID NO: 14262 - RNA, 19 nt, artificial
  Oligomer
gggacucauuucauuccua

SEQ ID NO: 14263 - RNA, 19 nt, artificial
  Oligomer
gugaaaugaaaacauguaa

SEQ ID NO: 14264 - RNA, 19 nt, artificial
  Oligomer
ggccuugugaucaaugaaa

SEQ ID NO: 14265 - RNA, 19 nt, artificial
  Oligomer
gccucuacaggacugagaa

SEQ ID NO: 14266 - RNA, 19 nt, artificial
  Oligomer
gguucugguugccuuggua

SEQ ID NO: 14267 - RNA, 19 nt, artificial
  Oligomer
cauuugaggucaaguaaga

SEQ ID NO: 14268 - RNA, 19 nt, artificial
  Oligomer
guauuuaggcagauugaaa

SEQ ID NO: 14269 - RNA, 19 nt, artificial
  Oligomer
gaagagggagaagcaugaa

SEQ ID NO: 14270 - RNA, 19 nt, artificial
  Oligomer
agacuagaggcuugcauaa

SEQ ID NO: 14271 - RNA, 19 nt, artificial
  Oligomer
ggauggaaaaggaagacua

SEQ ID NO: 14272 - RNA, 19 nt, artificial
  Oligomer
cccugaagaagagagggaa

SEQ ID NO: 14273 - RNA, 19 nt, artificial
  Oligomer
aagagagaauguagauauu

SEQ ID NO: 14274 - RNA, 19 nt, artificial
  Oligomer
ccagguguucuacacucau

SEQ ID NO: 14275 - RNA, 19 nt, artificial
  Oligomer
acucuaauagugcuuaaaa

SEQ ID NO: 14276 - RNA, 19 nt, artificial
  Oligomer
aggacugagaagaaguaaa

SEQ ID NO: 14277 - RNA, 19 nt, artificial
  Oligomer
gauguuuuccuauaauaua

SEQ ID NO: 14278 - RNA, 19 nt, artificial
  Oligomer
uaaugauguuuuccuauaa

SEQ ID NO: 14279 - RNA, 19 nt, artificial
  Oligomer
ugaaguacauauuaggaaa

SEQ ID NO: 14280 - RNA, 19 nt, artificial
  Oligomer
caugguugugaccugagga

SEQ ID NO: 14281 - RNA, 19 nt, artificial
  Oligomer
uugugaccugaggauuuaa

SEQ ID NO: 14282 - RNA, 19 nt, artificial
  Oligomer
gacaaauggaggaauauga

SEQ ID NO: 14283 - RNA, 19 nt, artificial
  Oligomer
gacugucuuucagauacau

SEQ ID NO: 14284 - RNA, 19 nt, artificial
  Oligomer
agcuaaagaggcugaaaga

SEQ ID NO: 14285 - RNA, 19 nt, artificial
  Oligomer
cagugcugaucauuuauau

SEQ ID NO: 14286 - RNA, 19 nt, artificial
  Oligomer
gcagcuaccagguguucua

SEQ ID NO: 14287 - RNA, 19 nt, artificial
  Oligomer
ucuacaugaggaacucuaa

SEQ ID NO: 14288 - RNA, 19 nt, artificial
  Oligomer
gggauucuuuccauuauga

SEQ ID NO: 14289 - RNA, 19 nt, artificial
  Oligomer
agacguuuuucggcuuaua

SEQ ID NO: 14290 - RNA, 19 nt, artificial
  Oligomer
ccgagaauguuguauucag

SEQ ID NO: 14291 - RNA, 19 nt, artificial
  Oligomer
cuauggaaacucuauaaga

SEQ ID NO: 14292 - RNA, 19 nt, artificial
  Oligomer
acguuuuucggcuuauaua

SEQ ID NO: 14293 - RNA, 19 nt, artificial
  Oligomer
cccaggaucuggugaugau

SEQ ID NO: 14294 - RNA, 19 nt, artificial
  Oligomer
aauagugcuuaaaaaucau

SEQ ID NO: 14295 - RNA, 19 nt, artificial
  Oligomer
aaugcuuccugacaaucaa

SEQ ID NO: 14296 - RNA, 19 nt, artificial
  Oligomer
aagggauggaaaaggaaga

SEQ ID NO: 14297 - RNA, 19 nt, artificial
  Oligomer
caugcagcagcccuucaau

SEQ ID NO: 14298 - RNA, 19 nt, artificial
  Oligomer
gagagaauguagauauugu

SEQ ID NO: 14299 - RNA, 19 nt, artificial
  Oligomer
acuagaggcuugcauaaua

SEQ ID NO: 14300 - RNA, 19 nt, artificial
  Oligomer
uccugacaaucaacucuaa

SEQ ID NO: 14301 - RNA, 19 nt, artificial
  Oligomer
ugaaaaggacaccuuuuaa

SEQ ID NO: 14302 - RNA, 19 nt, artificial
  Oligomer
gagguguuucccuuagcua

SEQ ID NO: 14303 - RNA, 19 nt, artificial
  Oligomer
caucggugaaacuaacaga

SEQ ID NO: 14304 - RNA, 19 nt, artificial
  Oligomer
auuuggucaagauuuugaa

SEQ ID NO: 14305 - RNA, 19 nt, artificial
  Oligomer
caacucaccuaauguuuau

SEQ ID NO: 14306 - RNA, 19 nt, artificial
  Oligomer
cagacaaauggaggaauau

SEQ ID NO: 14307 - RNA, 19 nt, artificial
  Oligomer
ugaagagggagaagcauga

SEQ ID NO: 14308 - RNA, 19 nt, artificial
  Oligomer
cagcaucaucuuuggagaa

SEQ ID NO: 14309 - RNA, 19 nt, artificial
  Oligomer
agcuauggaaacucuauaa

SEQ ID NO: 14310 - RNA, 19 nt, artificial
  Oligomer
agguguuucccuuagcuau

SEQ ID NO: 14311 - RNA, 19 nt, artificial
  Oligomer
ggguugcauuuggucaaga

SEQ ID NO: 14312 - RNA, 19 nt, artificial
  Oligomer
ugcauuugaggucaaguaa

SEQ ID NO: 14313 - RNA, 19 nt, artificial
  Oligomer
cacucaucuuagugccuga

SEQ ID NO: 14314 - RNA, 19 nt, artificial
  Oligomer
cacaguucuucccugucca

SEQ ID NO: 14315 - RNA, 19 nt, artificial
  Oligomer
caggacugagaagaaguaa

SEQ ID NO: 14316 - RNA, 19 nt, artificial
  Oligomer
ugggaagacaccuauggaa

SEQ ID NO: 14317 - RNA, 19 nt, artificial
  Oligomer
gaaaugaaaacauguaaua

SEQ ID NO: 14318 - RNA, 19 nt, artificial
  Oligomer
caucuuuggagaagcaaau

SEQ ID NO: 14319 - RNA, 19 nt, artificial
  Oligomer
cuuucuggagugaaguaua

SEQ ID NO: 14320 - RNA, 19 nt, artificial
  Oligomer
uagauauugugaaguacau

SEQ ID NO: 14321 - RNA, 19 nt, artificial
  Oligomer
gcuccucaacucaccuaau

SEQ ID NO: 14322 - RNA, 19 nt, artificial
  Oligomer
ugcauuuuugugaaaugaa

SEQ ID NO: 14323 - RNA, 19 nt, artificial
  Oligomer
ucuggagugaaguauaaga

SEQ ID NO: 14324 - RNA, 19 nt, artificial
  Oligomer
gaugugcauuuuugugaaa

SEQ ID NO: 14325 - RNA, 19 nt, artificial
  Oligomer
ggcagcaucuucacuucua

SEQ ID NO: 14326 - RNA, 19 nt, artificial
  Oligomer
ugauguuuuccuauaauau

SEQ ID NO: 14327 - RNA, 19 nt, artificial
  Oligomer
auggguugcauuuggucaa

SEQ ID NO: 14328 - RNA, 19 nt, artificial
  Oligomer
aagagggagaagcaugaaa

SEQ ID NO: 14329 - RNA, 19 nt, artificial
  Oligomer
aguauuuaggcagauugaa

SEQ ID NO: 14330 - RNA, 19 nt, artificial
  Oligomer
caggcaaguccaacucaag

SEQ ID NO: 14331 - RNA, 19 nt, artificial
  Oligomer
aaaaguauauguuaggaua

SEQ ID NO: 14332 - RNA, 19 nt, artificial
  Oligomer
gacguuuuucggcuuauau

SEQ ID NO: 14333 - RNA, 19 nt, artificial
  Oligomer
gcuugcauaauaagcuaaa

SEQ ID NO: 14334 - RNA, 19 nt, artificial
  Oligomer
agauauugugaaguacaua

SEQ ID NO: 14335 - RNA, 19 nt, artificial
  Oligomer
cauugauugucagcuacua

SEQ ID NO: 14336 - RNA, 19 nt, artificial
  Oligomer
guagauauugugaaguaca

SEQ ID NO: 14337 - RNA, 19 nt, artificial
  Oligomer
gcuuauauaagcucuaaga

SEQ ID NO: 14338 - RNA, 19 nt, artificial
  Oligomer
uuaagggauggaaaaggaa

SEQ ID NO: 14339 - RNA, 19 nt, artificial
  Oligomer
ggauucuuuccauuaugau

SEQ ID NO: 14340 - RNA, 19 nt, artificial
  Oligomer
agugcuuaaaaaucauuga

SEQ ID NO: 14341 - RNA, 19 nt, artificial
  Oligomer
ugacuaaagagagaaugua

SEQ ID NO: 14342 - RNA, 19 nt, artificial
  Oligomer
gauugucagcuacuaauga

SEQ ID NO: 14343 - RNA, 19 nt, artificial
  Oligomer
ccugcuuucuggagugaag

SEQ ID NO: 14344 - RNA, 19 nt, artificial
  Oligomer
ucuugagcagucagcaaca

SEQ ID NO: 14345 - RNA, 19 nt, artificial
  Oligomer
ucaucuuuggagaagcaaa

SEQ ID NO: 14346 - RNA, 19 nt, artificial
  Oligomer
caugccucuggaaugggaa

SEQ ID NO: 14347 - RNA, 19 nt, artificial
  Oligomer
cauuuaacaggcaagucca

SEQ ID NO: 14348 - RNA, 19 nt, artificial
  Oligomer
ggaaaauauggguugcauu

SEQ ID NO: 14349 - RNA, 19 nt, artificial
  Oligomer
uuucuggagugaaguauaa

SEQ ID NO: 14350 - RNA, 19 nt, artificial
  Oligomer
augugaagagggagaagca

SEQ ID NO: 14351 - RNA, 19 nt, artificial
  Oligomer
ggugaaacuaacagauaag

SEQ ID NO: 14352 - RNA, 19 nt, artificial
  Oligomer
gcccuucaauuacccauau

SEQ ID NO: 14353 - RNA, 19 nt, artificial
  Oligomer
aacagauaagcaagagaga

SEQ ID NO: 14354 - RNA, 19 nt, artificial
  Oligomer
acaguucuucccuguccaa

SEQ ID NO: 14355 - RNA, 19 nt, artificial
  Oligomer
aggcuugcauaauaagcua

SEQ ID NO: 14356 - RNA, 19 nt, artificial
  Oligomer
gggucuucuuacaugcauu

SEQ ID NO: 14357 - RNA, 19 nt, artificial
  Oligomer
gaaguacauauuaggaaaa

SEQ ID NO: 14358 - RNA, 19 nt, artificial
  Oligomer
uauugugaaguacauauua

SEQ ID NO: 14359 - RNA, 19 nt, artificial
  Oligomer
gcagaacuccgagagucua

SEQ ID NO: 14360 - RNA, 19 nt, artificial
  Oligomer
acaggacugagaagaagua

SEQ ID NO: 14361 - RNA, 19 nt, artificial
  Oligomer
ucuacaggacugagaagaa

SEQ ID NO: 14362 - RNA, 19 nt, artificial
  Oligomer
gauggaaaaggaagacuag

SEQ ID NO: 14363 - RNA, 19 nt, artificial
  Oligomer
uaauagugcuuaaaaauca

SEQ ID NO: 14364 - RNA, 19 nt, artificial
  Oligomer
ggaagacaccuauggaauu

SEQ ID NO: 14365 - RNA, 19 nt, artificial
  Oligomer
cuuuguauauuccaaagua

SEQ ID NO: 14366 - RNA, 19 nt, artificial
  Oligomer
uacuaaugauguuuuccua

SEQ ID NO: 14367 - RNA, 19 nt, artificial
  Oligomer
uauuuaggcagauugaaaa

SEQ ID NO: 14368 - RNA, 19 nt, artificial
  Oligomer
gagaagaaguaaaaccguu

SEQ ID NO: 14369 - RNA, 19 nt, artificial
  Oligomer
cugagcucucucuggucaa

SEQ ID NO: 14370 - RNA, 19 nt, artificial
  Oligomer
gauugaaaaggacaccuuu

SEQ ID NO: 14371 - RNA, 19 nt, artificial
  Oligomer
guugugaccugaggauuua

SEQ ID NO: 14372 - RNA, 19 nt, artificial
  Oligomer
gguugugaccugaggauuu

SEQ ID NO: 14373 - RNA, 19 nt, artificial
  Oligomer
gggcaguguucaaucuuac

SEQ ID NO: 14374 - RNA, 19 nt, artificial
  Oligomer
aacucuaauagugcuuaaa

SEQ ID NO: 14375 - RNA, 19 nt, artificial
  Oligomer
aagacuagaggcuugcaua

SEQ ID NO: 14376 - RNA, 19 nt, artificial
  Oligomer
guacuuuguauauuccaaa

SEQ ID NO: 14377 - RNA, 19 nt, artificial
  Oligomer
guuucccuuagcuauggaa

SEQ ID NO: 14378 - RNA, 19 nt, artificial
  Oligomer
ugugaaaugaaaacaugua

SEQ ID NO: 14379 - RNA, 19 nt, artificial
  Oligomer
augauguuuuccuauaaua

SEQ ID NO: 14380 - RNA, 19 nt, artificial
  Oligomer
ccuugugaucaaugaaacu

SEQ ID NO: 14381 - RNA, 19 nt, artificial
  Oligomer
ccuuuuaacucaccucuca

SEQ ID NO: 14382 - RNA, 19 nt, artificial
  Oligomer
uaccagugcugaucauuua

SEQ ID NO: 14383 - RNA, 19 nt, artificial
  Oligomer
caucaucuuuggagaagca

SEQ ID NO: 14384 - RNA, 19 nt, artificial
  Oligomer
gauuuugaaugcuuccuga

SEQ ID NO: 14385 - RNA, 19 nt, artificial
  Oligomer
gugcauuuuugugaaauga

SEQ ID NO: 14386 - RNA, 19 nt, artificial
  Oligomer
cuuuuaacucaccucucaa

SEQ ID NO: 14387 - RNA, 19 nt, artificial
  Oligomer
agaccacaggguucaaaau

SEQ ID NO: 14388 - RNA, 19 nt, artificial
  Oligomer
gagaauguagauauuguga

SEQ ID NO: 14389 - RNA, 19 nt, artificial
  Oligomer
aguacauauuaggaaaaua

SEQ ID NO: 14390 - RNA, 19 nt, artificial
  Oligomer
aggaucuggugaugaugga

SEQ ID NO: 14391 - RNA, 19 nt, artificial
  Oligomer
cuaaagagagaauguagau

SEQ ID NO: 14392 - RNA, 19 nt, artificial
  Oligomer
aaugauguuuuccuauaau

SEQ ID NO: 14393 - RNA, 19 nt, artificial
  Oligomer
aaaaaaaggagcugaggaa

SEQ ID NO: 14394 - RNA, 19 nt, artificial
  Oligomer
gacggaagaacauagaacu

SEQ ID NO: 14395 - RNA, 19 nt, artificial
  Oligomer
cugagaguauuuaggcaga

SEQ ID NO: 14396 - RNA, 19 nt, artificial
  Oligomer
gaauguagauauugugaag

SEQ ID NO: 14397 - RNA, 19 nt, artificial
  Oligomer
aauggaggaauaugacgga

SEQ ID NO: 14398 - RNA, 19 nt, artificial
  Oligomer
uguacuuuguauauuccaa

SEQ ID NO: 14399 - RNA, 19 nt, artificial
  Oligomer
acagcaucaucuuuggaga

SEQ ID NO: 14400 - RNA, 19 nt, artificial
  Oligomer
gugaaguacauauuaggaa

SEQ ID NO: 14401 - RNA, 19 nt, artificial
  Oligomer
caaucuuaccagugcugau

SEQ ID NO: 14402 - RNA, 19 nt, artificial
  Oligomer
acuaaagagagaauguaga

SEQ ID NO: 14403 - RNA, 19 nt, artificial
  Oligomer
cagcucuuccaccuacaga

SEQ ID NO: 14404 - RNA, 19 nt, artificial
  Oligomer
cuuagcuauggaaacucua

SEQ ID NO: 14405 - RNA, 19 nt, artificial
  Oligomer
uggagugaaguauaagaag

SEQ ID NO: 14406 - RNA, 19 nt, artificial
  Oligomer
guacauauuaggaaaauau

SEQ ID NO: 14407 - RNA, 19 nt, artificial
  Oligomer
uauauaagcucuaagagaa

SEQ ID NO: 14408 - RNA, 19 nt, artificial
  Oligomer
aaguccaacucaaggucca

SEQ ID NO: 14409 - RNA, 19 nt, artificial
  Oligomer
ugugaaguacauauuagga

SEQ ID NO: 14410 - RNA, 19 nt, artificial
  Oligomer
gcugaucauuuauauguca

SEQ ID NO: 14411 - RNA, 19 nt, artificial
  Oligomer
ugaagaagagagggaacca

SEQ ID NO: 14412 - RNA, 19 nt, artificial
  Oligomer
cauuuauaugucaacguau

SEQ ID NO: 14413 - RNA, 19 nt, artificial
  Oligomer
agaauguagauauugugaa

SEQ ID NO: 14414 - RNA, 19 nt, artificial
  Oligomer
augacggaagaacauagaa

SEQ ID NO: 14415 - RNA, 19 nt, artificial
  Oligomer
ucaaguaagaagacaugaa

SEQ ID NO: 14416 - RNA, 19 nt, artificial
  Oligomer
guaagaagacaugaaccaa

SEQ ID NO: 14417 - RNA, 19 nt, artificial
  Oligomer
gacuaaagagagaauguag

SEQ ID NO: 14418 - RNA, 19 nt, artificial
  Oligomer
ggaagacuagaggcuugca

SEQ ID NO: 14419 - RNA, 19 nt, artificial
  Oligomer
gauauugugaaguacauau

SEQ ID NO: 14420 - RNA, 19 nt, artificial
  Oligomer
ccucaacucaccuaauguu

SEQ ID NO: 14421 - RNA, 19 nt, artificial
  Oligomer
cauuuggucaagauuuuga

SEQ ID NO: 14422 - RNA, 19 nt, artificial
  Oligomer
ucuaauagugcuuaaaaau

SEQ ID NO: 14423 - RNA, 19 nt, artificial
  Oligomer
auuuaacaggcaaguccaa

SEQ ID NO: 14424 - RNA, 19 nt, artificial
  Oligomer
ggaaugggaagacaccuau

SEQ ID NO: 14425 - RNA, 19 nt, artificial
  Oligomer
ugggcuguacuuuguauau

SEQ ID NO: 14426 - RNA, 19 nt, artificial
  Oligomer
ggaagaacauagaacucug

SEQ ID NO: 14427 - RNA, 19 nt, artificial
  Oligomer
cugacaaucaacucuaaua

SEQ ID NO: 14428 - RNA, 19 nt, artificial
  Oligomer
cuaaugauguuuuccuaua

SEQ ID NO: 14429 - RNA, 19 nt, artificial
  Oligomer
cugggcuguacuuuguaua

SEQ ID NO: 14430 - RNA, 19 nt, artificial
  Oligomer
gggaagacaccuauggaau

SEQ ID NO: 14431 - RNA, 19 nt, artificial
  Oligomer
ugaggauuuaagggaugga

SEQ ID NO: 14432 - RNA, 19 nt, artificial
  Oligomer
aguggaccuugagaccaca

SEQ ID NO: 14433 - RNA, 19 nt, artificial
  Oligomer
augcauuugaggucaagua

SEQ ID NO: 14434 - RNA, 19 nt, artificial
  Oligomer
ugauguuuuucaugguucu

SEQ ID NO: 14435 - RNA, 19 nt, artificial
  Oligomer
gagggucuucuuacaugca

SEQ ID NO: 14436 - RNA, 19 nt, artificial
  Oligomer
uauuuccagugcaauugua

SEQ ID NO: 14437 - RNA, 19 nt, artificial
  Oligomer
accugaggauuuaagggau

SEQ ID NO: 14438 - RNA, 19 nt, artificial
  Oligomer
gaaaaaaaggagcugagga

SEQ ID NO: 14439 - RNA, 19 nt, artificial
  Oligomer
gaaccaaguggaccuugag

SEQ ID NO: 14440 - RNA, 19 nt, artificial
  Oligomer
ccagugcugaucauuuaua

SEQ ID NO: 14441 - RNA, 19 nt, artificial
  Oligomer
acaugaggaacucuaagua

SEQ ID NO: 14442 - RNA, 19 nt, artificial
  Oligomer
agcuccucaacucaccuaa

SEQ ID NO: 14443 - RNA, 19 nt, artificial
  Oligomer
gccugagaguauuuaggca

SEQ ID NO: 14444 - RNA, 19 nt, artificial
  Oligomer
cuaacagauaagcaagaga

SEQ ID NO: 14445 - RNA, 19 nt, artificial
  Oligomer
ugcauuuggucaagauuuu

SEQ ID NO: 14446 - RNA, 19 nt, artificial
  Oligomer
cauuaugauucuuuguuac

SEQ ID NO: 14447 - RNA, 19 nt, artificial
  Oligomer
acaaggucuacaugaggaa

SEQ ID NO: 14448 - RNA, 19 nt, artificial
  Oligomer
guucuacacucaucuuagu

SEQ ID NO: 14449 - RNA, 19 nt, artificial
  Oligomer
agcccuucaauuacccaua

SEQ ID NO: 14450 - RNA, 19 nt, artificial
  Oligomer
auguagauauugugaagua

SEQ ID NO: 14451 - RNA, 19 nt, artificial
  Oligomer
ucggugaaacuaacagaua

SEQ ID NO: 14452 - RNA, 19 nt, artificial
  Oligomer
auuugaggucaaguaagaa

SEQ ID NO: 14453 - RNA, 19 nt, artificial
  Oligomer
aguccaacucaagguccau

SEQ ID NO: 14454 - RNA, 19 nt, artificial
  Oligomer
gguguucuacacucaucuu

SEQ ID NO: 14455 - RNA, 19 nt, artificial
  Oligomer
ucuggucaauuuugaggaa

SEQ ID NO: 14456 - RNA, 19 nt, artificial
  Oligomer
gugcuuaaaaaucauugau

SEQ ID NO: 14457 - RNA, 19 nt, artificial
  Oligomer
uagcuauggaaacucuaua

SEQ ID NO: 14458 - RNA, 19 nt, artificial
  Oligomer
aggcaccgagaauguugua

SEQ ID NO: 14459 - RNA, 19 nt, artificial
  Oligomer
caugaaaaagcagcuacca

SEQ ID NO: 14460 - RNA, 19 nt, artificial
  Oligomer
ccaugugaagagggagaag

SEQ ID NO: 14461 - RNA, 19 nt, artificial
  Oligomer
ugaaaugaaaacauguaau

SEQ ID NO: 14462 - RNA, 19 nt, artificial
  Oligomer
aagaagagagggaaccaca

SEQ ID NO: 14463 - RNA, 19 nt, artificial
  Oligomer
cuuucagauacaugguugu

SEQ ID NO: 14464 - RNA, 19 nt, artificial
  Oligomer
caauuuugaggaaucucag

SEQ ID NO: 14465 - RNA, 19 nt, artificial
  Oligomer
ugaaccaaguggaccuuga

SEQ ID NO: 14466 - RNA, 19 nt, artificial
  Oligomer
ucauuuauaugucaacgua

SEQ ID NO: 14467 - RNA, 19 nt, artificial
  Oligomer
gcauuugaggucaaguaag

SEQ ID NO: 14468 - RNA, 19 nt, artificial
  Oligomer
gggcuguacuuuguauauu

SEQ ID NO: 14469 - RNA, 19 nt, artificial
  Oligomer
auggaaacucuauaagaga

SEQ ID NO: 14470 - RNA, 19 nt, artificial
  Oligomer
aggcagauugaaaaggaca

SEQ ID NO: 14471 - RNA, 19 nt, artificial
  Oligomer
caugaggaacucuaaguau

SEQ ID NO: 14472 - RNA, 19 nt, artificial
  Oligomer
acucuauaagagagaucca

SEQ ID NO: 14473 - RNA, 19 nt, artificial
  Oligomer
caccgagaauguuguauuc

SEQ ID NO: 14474 - RNA, 19 nt, artificial
  Oligomer
auggaaaaggaagacuaga

SEQ ID NO: 14475 - RNA, 19 nt, artificial
  Oligomer
uuuaagggauggaaaagga

SEQ ID NO: 14476 - RNA, 19 nt, artificial
  Oligomer
agaaggccuggucaaagga

SEQ ID NO: 14477 - RNA, 19 nt, artificial
  Oligomer
uuguauauuccaaaguaua

SEQ ID NO: 14478 - RNA, 19 nt, artificial
  Oligomer
cacaaggucuacaugagga

SEQ ID NO: 14479 - RNA, 19 nt, artificial
  Oligomer
gggucaaucuugcaacaac

SEQ ID NO: 14480 - RNA, 19 nt, artificial
  Oligomer
ggagugaaguauaagaagg

SEQ ID NO: 14481 - RNA, 19 nt, artificial
  Oligomer
guguauuuccagugcaauu

SEQ ID NO: 14482 - RNA, 19 nt, artificial
  Oligomer
aauuuugaggaaucucaga

SEQ ID NO: 14483 - RNA, 19 nt, artificial
  Oligomer
aauuguccugcuuucugga

SEQ ID NO: 14484 - RNA, 19 nt, artificial
  Oligomer
gaaaacauguaauaaaaag

SEQ ID NO: 14485 - RNA, 19 nt, artificial
  Oligomer
aagguccaugccucuggaa

SEQ ID NO: 14486 - RNA, 19 nt, artificial
  Oligomer
gucuccuugugauguuuuu

SEQ ID NO: 14487 - RNA, 19 nt, artificial
  Oligomer
ggaaacucuauaagagaga

SEQ ID NO: 14488 - RNA, 19 nt, artificial
  Oligomer
gggagaagcaugaaaaagc

SEQ ID NO: 14489 - RNA, 19 nt, artificial
  Oligomer
auggaggaauaugacggaa

SEQ ID NO: 14490 - RNA, 19 nt, artificial
  Oligomer
augggaagacaccuaugga

SEQ ID NO: 14491 - RNA, 19 nt, artificial
  Oligomer
agaauguuguauucaguga

SEQ ID NO: 14492 - RNA, 19 nt, artificial
  Oligomer
gucagcuacuaaugauguu

SEQ ID NO: 14493 - RNA, 19 nt, artificial
  Oligomer
cuucacuucuaaaugcaua

SEQ ID NO: 14494 - RNA, 19 nt, artificial
  Oligomer
aggucaaguaagaagacau

SEQ ID NO: 14495 - RNA, 19 nt, artificial
  Oligomer
uguagaugugcauuuuugu

SEQ ID NO: 14496 - RNA, 19 nt, artificial
  Oligomer
gauucuuuccauuaugauu

SEQ ID NO: 14497 - RNA, 19 nt, artificial
  Oligomer
cugaucauuuauaugucaa

SEQ ID NO: 14498 - RNA, 19 nt, artificial
  Oligomer
aggaaaauauggguugcau

SEQ ID NO: 14499 - RNA, 19 nt, artificial
  Oligomer
ugugaagagggagaagcau

SEQ ID NO: 14500 - RNA, 19 nt, artificial
  Oligomer
gaggaaucucagacguuuu

SEQ ID NO: 14501 - RNA, 19 nt, artificial
  Oligomer
uccuugugauguuuuucau

SEQ ID NO: 14502 - RNA, 19 nt, artificial
  Oligomer
ggcuugcauaauaagcuaa

SEQ ID NO: 14503 - RNA, 19 nt, artificial
  Oligomer
uuaggcagauugaaaagga

SEQ ID NO: 14504 - RNA, 19 nt, artificial
  Oligomer
guugcauuuggucaagauu

SEQ ID NO: 14505 - RNA, 19 nt, artificial
  Oligomer
cagaucuacuggguggaca

SEQ ID NO: 14506 - RNA, 19 nt, artificial
  Oligomer
gaaaauauggguugcauuu

SEQ ID NO: 14507 - RNA, 19 nt, artificial
  Oligomer
ccugacaaucaacucuaau

SEQ ID NO: 14508 - RNA, 19 nt, artificial
  Oligomer
caacguaucugagcucucu

SEQ ID NO: 14509 - RNA, 19 nt, artificial
  Oligomer
aacuaacagauaagcaaga

SEQ ID NO: 14510 - RNA, 19 nt, artificial
  Oligomer
gagaguauuuaggcagauu

SEQ ID NO: 14511 - RNA, 19 nt, artificial
  Oligomer
ccucuggaaugggaagaca

SEQ ID NO: 14512 - RNA, 19 nt, artificial
  Oligomer
caaugaaacugggcuguac

SEQ ID NO: 14513 - RNA, 19 nt, artificial
  Oligomer
ugcuuucuggagugaagua

SEQ ID NO: 14514 - RNA, 19 nt, artificial
  Oligomer
uaagcuaaagaggcugaaa

SEQ ID NO: 14515 - RNA, 19 nt, artificial
  Oligomer
agaagaaguaaaaccguuu

SEQ ID NO: 14516 - RNA, 19 nt, artificial
  Oligomer
ugagaagaaguaaaaccgu

SEQ ID NO: 14517 - RNA, 19 nt, artificial
  Oligomer
ucagauacaugguugugac

SEQ ID NO: 14518 - RNA, 19 nt, artificial
  Oligomer
gaaacucuauaagagagau

SEQ ID NO: 14519 - RNA, 19 nt, artificial
  Oligomer
ggucaauuuugaggaaucu

SEQ ID NO: 14520 - RNA, 19 nt, artificial
  Oligomer
ugcagcagcccuucaauua

SEQ ID NO: 14521 - RNA, 19 nt, artificial
  Oligomer
cuauggaauuguccugcuu

SEQ ID NO: 14522 - RNA, 19 nt, artificial
  Oligomer
ggcuguacuuuguauauuc

SEQ ID NO: 14523 - RNA, 19 nt, artificial
  Oligomer
ucggcuuauauaagcucua

SEQ ID NO: 14524 - RNA, 19 nt, artificial
  Oligomer
cagacguuuuucggcuuau

SEQ ID NO: 14525 - RNA, 19 nt, artificial
  Oligomer
accagguguucuacacuca

SEQ ID NO: 14526 - RNA, 19 nt, artificial
  Oligomer
aagacaugaaccaagugga

SEQ ID NO: 14527 - RNA, 19 nt, artificial
  Oligomer
uugggauucuuuccauuau

SEQ ID NO: 14528 - RNA, 19 nt, artificial
  Oligomer
agaucuacuggguggacag

SEQ ID NO: 14529 - RNA, 19 nt, artificial
  Oligomer
auugauugucagcuacuaa

SEQ ID NO: 14530 - RNA, 19 nt, artificial
  Oligomer
cuucuuacaugcauuugag

SEQ ID NO: 14531 - RNA, 19 nt, artificial
  Oligomer
gcagcagcccuucaauuac

SEQ ID NO: 14532 - RNA, 19 nt, artificial
  Oligomer
uggaaugggaagacaccua

SEQ ID NO: 14533 - RNA, 19 nt, artificial
  Oligomer
ccugaagaagagagggaac

SEQ ID NO: 14534 - RNA, 19 nt, artificial
  Oligomer
uacaugcauuugaggucaa

SEQ ID NO: 14535 - RNA, 19 nt, artificial
  Oligomer
cuguacuuuguauauucca

SEQ ID NO: 14536 - RNA, 19 nt, artificial
  Oligomer
gcagcccuucaauuaccca

SEQ ID NO: 14537 - RNA, 19 nt, artificial
  Oligomer
uguuucccuuagcuaugga

SEQ ID NO: 14538 - RNA, 19 nt, artificial
  Oligomer
caggcaccgagaauguugu

SEQ ID NO: 14539 - RNA, 19 nt, artificial
  Oligomer
caugcauuugaggucaagu

SEQ ID NO: 14540 - RNA, 19 nt, artificial
  Oligomer
caggguucaaaaugucugu

SEQ ID NO: 14541 - RNA, 19 nt, artificial
  Oligomer
ucaacucaccuaauguuua

SEQ ID NO: 14542 - RNA, 19 nt, artificial
  Oligomer
aacugggcuguacuuugua

SEQ ID NO: 14543 - RNA, 19 nt, artificial
  Oligomer
ugaaacuaacagauaagca

SEQ ID NO: 14544 - RNA, 19 nt, artificial
  Oligomer
gaagcaugaaaaagcagcu

SEQ ID NO: 14545 - RNA, 19 nt, artificial
  Oligomer
uaugacggaagaacauaga

SEQ ID NO: 14546 - RNA, 19 nt, artificial
  Oligomer
aaucauugauugucagcua

SEQ ID NO: 14547 - RNA, 19 nt, artificial
  Oligomer
agcucucucuggucaauuu

SEQ ID NO: 14548 - RNA, 19 nt, artificial
  Oligomer
cuugcauaauaagcuaaag

SEQ ID NO: 14549 - RNA, 19 nt, artificial
  Oligomer
gaagcacuuugggauucuu

SEQ ID NO: 14550 - RNA, 19 nt, artificial
  Oligomer
aaagagagaauguagauau

SEQ ID NO: 14551 - RNA, 19 nt, artificial
  Oligomer
ggucaagauuuugaaugcu

SEQ ID NO: 14552 - RNA, 19 nt, artificial
  Oligomer
gucuacaugaggaacucua

SEQ ID NO: 14553 - RNA, 19 nt, artificial
  Oligomer
gaggucaaguaagaagaca

SEQ ID NO: 14554 - RNA, 19 nt, artificial
  Oligomer
cagcuacuaaugauguuuu

SEQ ID NO: 14555 - RNA, 19 nt, artificial
  Oligomer
uaggcagauugaaaaggac

SEQ ID NO: 14556 - RNA, 19 nt, artificial
  Oligomer
ggcccauuuaacaggcaag

SEQ ID NO: 14557 - RNA, 19 nt, artificial
  Oligomer
gagugaaguauaagaaggg

SEQ ID NO: 14558 - RNA, 19 nt, artificial
  Oligomer
accagugcugaucauuuau

SEQ ID NO: 14559 - RNA, 19 nt, artificial
  Oligomer
gccuugugaucaaugaaac

SEQ ID NO: 14560 - RNA, 19 nt, artificial
  Oligomer
agagaauguagauauugug

SEQ ID NO: 14561 - RNA, 19 nt, artificial
  Oligomer
cuccuugugauguuuuuca

SEQ ID NO: 14562 - RNA, 19 nt, artificial
  Oligomer
gaaguaaaaccguuugcug

SEQ ID NO: 14563 - RNA, 19 nt, artificial
  Oligomer
gaagacuagaggcuugcau

SEQ ID NO: 14564 - RNA, 19 nt, artificial
  Oligomer
ccuuagcuauggaaacucu

SEQ ID NO: 14565 - RNA, 19 nt, artificial
  Oligomer
agcucuaagagaagcacuu

SEQ ID NO: 14566 - RNA, 19 nt, artificial
  Oligomer
uuguuacaggcaccgagaa

SEQ ID NO: 14567 - RNA, 19 nt, artificial
  Oligomer
uugagaccacaggguucaa

SEQ ID NO: 14568 - RNA, 19 nt, artificial
  Oligomer
aaugucuguagcuccucaa

SEQ ID NO: 14569 - RNA, 19 nt, artificial
  Oligomer
aaaaaaggagcugaggaaa

SEQ ID NO: 14570 - RNA, 19 nt, artificial
  Oligomer
cuacaugaggaacucuaag

SEQ ID NO: 14571 - RNA, 19 nt, artificial
  Oligomer
cuuugggauucuuuccauu

SEQ ID NO: 14572 - RNA, 19 nt, artificial
  Oligomer
aaccaaguggaccuugaga

SEQ ID NO: 14573 - RNA, 19 nt, artificial
  Oligomer
uguuuuucaugguucuggu

SEQ ID NO: 14574 - RNA, 19 nt, artificial
  Oligomer
agaagagagggaaccacag

SEQ ID NO: 14575 - RNA, 19 nt, artificial
  Oligomer
augguugugaccugaggau

SEQ ID NO: 14576 - RNA, 19 nt, artificial
  Oligomer
ggcuuauauaagcucuaag

SEQ ID NO: 14577 - RNA, 19 nt, artificial
  Oligomer
uuugaaugcuuccugacaa

SEQ ID NO: 14578 - RNA, 19 nt, artificial
  Oligomer
gaauguuguauucagugag

SEQ ID NO: 14579 - RNA, 19 nt, artificial
  Oligomer
gacuagaggcuugcauaau

SEQ ID NO: 14580 - RNA, 19 nt, artificial
  Oligomer
gguguuucccuuagcuaug

SEQ ID NO: 14581 - RNA, 19 nt, artificial
  Oligomer
ccugaaaaaaaggagcuga

SEQ ID NO: 14582 - RNA, 19 nt, artificial
  Oligomer
gacucauuucauuccuaac

SEQ ID NO: 14583 - RNA, 19 nt, artificial
  Oligomer
gacaaucaacucuaauagu

SEQ ID NO: 14584 - RNA, 19 nt, artificial
  Oligomer
ggaagaugaugagcuacug

SEQ ID NO: 14585 - RNA, 19 nt, artificial
  Oligomer
aaaugucuguagcuccuca

SEQ ID NO: 14586 - RNA, 19 nt, artificial
  Oligomer
ggcagauugaaaaggacac

SEQ ID NO: 14587 - RNA, 19 nt, artificial
  Oligomer
guuucagcucuuccaccua

SEQ ID NO: 14588 - RNA, 19 nt, artificial
  Oligomer
gaccugaggauuuaaggga

SEQ ID NO: 14589 - RNA, 19 nt, artificial
  Oligomer
uuauauaagcucuaagaga

SEQ ID NO: 14590 - RNA, 19 nt, artificial
  Oligomer
acugggcuguacuuuguau

SEQ ID NO: 14591 - RNA, 19 nt, artificial
  Oligomer
guauuuccagugcaauugu

SEQ ID NO: 14592 - RNA, 19 nt, artificial
  Oligomer
guguucuacacucaucuua

SEQ ID NO: 14593 - RNA, 19 nt, artificial
  Oligomer
uaagcaagagagauguuuu

SEQ ID NO: 14594 - RNA, 19 nt, artificial
  Oligomer
caaaaugucuguagcuccu

SEQ ID NO: 14595 - RNA, 19 nt, artificial
  Oligomer
cugcuuucuggagugaagu

SEQ ID NO: 14596 - RNA, 19 nt, artificial
  Oligomer
gaaugcuuccugacaauca

SEQ ID NO: 14597 - RNA, 19 nt, artificial
  Oligomer
gcuuaaaaaucauugauug

SEQ ID NO: 14598 - RNA, 19 nt, artificial
  Oligomer
cagcccuucaauuacccau

SEQ ID NO: 14599 - RNA, 19 nt, artificial
  Oligomer
uccucuugagcagucagca

SEQ ID NO: 14600 - RNA, 19 nt, artificial
  Oligomer
gggacugucuuucagauac

SEQ ID NO: 14601 - RNA, 19 nt, artificial
  Oligomer
uauggaaacucuauaagag

SEQ ID NO: 14602 - RNA, 19 nt, artificial
  Oligomer
ugagaguauuuaggcagau

SEQ ID NO: 14603 - RNA, 19 nt, artificial
  Oligomer
ccaucggugaaacuaacag

SEQ ID NO: 14604 - RNA, 19 nt, artificial
  Oligomer
uugcauaauaagcuaaaga

SEQ ID NO: 14605 - RNA, 19 nt, artificial
  Oligomer
ucucucuggucaauuuuga

SEQ ID NO: 14606 - RNA, 19 nt, artificial
  Oligomer
gacugagaagaaguaaaac

SEQ ID NO: 14607 - RNA, 19 nt, artificial
  Oligomer
augaugagcuacugcacua

SEQ ID NO: 14608 - RNA, 19 nt, artificial
  Oligomer
gcaccgagaauguuguauu

SEQ ID NO: 14609 - RNA, 19 nt, artificial
  Oligomer
ugugaucaaugaaacuggg

SEQ ID NO: 14610 - RNA, 19 nt, artificial
  Oligomer
cugaaaaaaaggagcugag

SEQ ID NO: 14611 - RNA, 19 nt, artificial
  Oligomer
gugaccugaggauuuaagg

SEQ ID NO: 14612 - RNA, 19 nt, artificial
  Oligomer
gaacuccgagagucuacca

SEQ ID NO: 14613 - RNA, 19 nt, artificial
  Oligomer
gaaaaagcagcuaccaggu

SEQ ID NO: 14614 - RNA, 19 nt, artificial
  Oligomer
uuuguauauuccaaaguau

SEQ ID NO: 14615 - RNA, 19 nt, artificial
  Oligomer
ugagcucucucuggucaau

SEQ ID NO: 14616 - RNA, 19 nt, artificial
  Oligomer
uuuggucaagauuuugaau

SEQ ID NO: 14617 - RNA, 19 nt, artificial
  Oligomer
agguguucuacacucaucu

SEQ ID NO: 14618 - RNA, 19 nt, artificial
  Oligomer
gauaagcaagagagauguu

SEQ ID NO: 14619 - RNA, 19 nt, artificial
  Oligomer
auacaugguugugaccuga

SEQ ID NO: 14620 - RNA, 19 nt, artificial
  Oligomer
cacuuugggauucuuucca

SEQ ID NO: 14621 - RNA, 19 nt, artificial
  Oligomer
aagaagacaugaaccaagu

SEQ ID NO: 14622 - RNA, 19 nt, artificial
  Oligomer
aucggugaaacuaacagau

SEQ ID NO: 14623 - RNA, 19 nt, artificial
  Oligomer
ggucaaguaagaagacaug

SEQ ID NO: 14624 - RNA, 19 nt, artificial
  Oligomer
agggucuucuuacaugcau

SEQ ID NO: 14625 - RNA, 19 nt, artificial
  Oligomer
uugugaaaugaaaacaugu

SEQ ID NO: 14626 - RNA, 19 nt, artificial
  Oligomer
ugagaccacaggguucaaa

SEQ ID NO: 14627 - RNA, 19 nt, artificial
  Oligomer
gaggcuugcauaauaagcu

SEQ ID NO: 14628 - RNA, 19 nt, artificial
  Oligomer
ucuuccaccuacagaagga

SEQ ID NO: 14629 - RNA, 19 nt, artificial
  Oligomer
acuucuaaaugcauauccu

SEQ ID NO: 14630 - RNA, 19 nt, artificial
  Oligomer
agugaaguauaagaagggu

SEQ ID NO: 14631 - RNA, 19 nt, artificial
  Oligomer
cucaccuaauguuuaugag

SEQ ID NO: 14632 - RNA, 19 nt, artificial
  Oligomer
guucuucccuguccaaccu

SEQ ID NO: 14633 - RNA, 19 nt, artificial
  Oligomer
augacuaaagagagaaugu

SEQ ID NO: 14634 - RNA, 19 nt, artificial
  Oligomer
auugucagcuacuaaugau

SEQ ID NO: 14635 - RNA, 19 nt, artificial
  Oligomer
ggcaaguccaacucaaggu

SEQ ID NO: 14636 - RNA, 19 nt, artificial
  Oligomer
cugguugccuugguaggau

SEQ ID NO: 14637 - RNA, 19 nt, artificial
  Oligomer
ggucaaucuugcaacaacc

SEQ ID NO: 14638 - RNA, 19 nt, artificial
  Oligomer
gauacaugguugugaccug

SEQ ID NO: 14639 - RNA, 19 nt, artificial
  Oligomer
ugggauucuuuccauuaug

SEQ ID NO: 14640 - RNA, 19 nt, artificial
  Oligomer
uaagagaagcacuuuggga

SEQ ID NO: 14641 - RNA, 19 nt, artificial
  Oligomer
agggagaagcaugaaaaag

SEQ ID NO: 14642 - RNA, 19 nt, artificial
  Oligomer
uugaaaaggacaccuuuua

SEQ ID NO: 14643 - RNA, 19 nt, artificial
  Oligomer
uaaaaaucauugauuguca

SEQ ID NO: 14644 - RNA, 19 nt, artificial
  Oligomer
aauauggguugcauuuggu

SEQ ID NO: 14645 - RNA, 19 nt, artificial
  Oligomer
acuuugggauucuuuccau

SEQ ID NO: 14646 - RNA, 19 nt, artificial
  Oligomer
gggaagaugaugagcuacu

SEQ ID NO: 14647 - RNA, 19 nt, artificial
  Oligomer
gaagaaguaaaaccguuug

SEQ ID NO: 14648 - RNA, 19 nt, artificial
  Oligomer
gcucucucuggucaauuuu

SEQ ID NO: 14649 - RNA, 19 nt, artificial
  Oligomer
uucagcucuuccaccuaca

SEQ ID NO: 14650 - RNA, 19 nt, artificial
  Oligomer
uuucccuuagcuauggaaa

SEQ ID NO: 14651 - RNA, 19 nt, artificial
  Oligomer
agagaagcacuuugggauu

SEQ ID NO: 14652 - RNA, 19 nt, artificial
  Oligomer
gcauaauaagcuaaagagg

SEQ ID NO: 14653 - RNA, 19 nt, artificial
  Oligomer
acaaauggaggaauaugac

SEQ ID NO: 14654 - RNA, 19 nt, artificial
  Oligomer
cugagaagaaguaaaaccg

SEQ ID NO: 14655 - RNA, 19 nt, artificial
  Oligomer
ugugaccugaggauuuaag

SEQ ID NO: 14656 - RNA, 19 nt, artificial
  Oligomer
gcucuaagagaagcacuuu

SEQ ID NO: 14657 - RNA, 19 nt, artificial
  Oligomer
ccuauggaauuguccugcu

SEQ ID NO: 14658 - RNA, 19 nt, artificial
  Oligomer
aaggacaccuuuuaacuca

SEQ ID NO: 14659 - RNA, 19 nt, artificial
  Oligomer
uccugcuuucuggagugaa

SEQ ID NO: 14660 - RNA, 19 nt, artificial
  Oligomer
ucuguagcuccucaacuca

SEQ ID NO: 14661 - RNA, 19 nt, artificial
  Oligomer
uugauugucagcuacuaau

SEQ ID NO: 14662 - RNA, 19 nt, artificial
  Oligomer
uuagcuauggaaacucuau

SEQ ID NO: 14663 - RNA, 19 nt, artificial
  Oligomer
aagagaagcacuuugggau

SEQ ID NO: 14664 - RNA, 19 nt, artificial
  Oligomer
ucaugguucugguugccuu

SEQ ID NO: 14665 - RNA, 19 nt, artificial
  Oligomer
uguucuacacucaucuuag

SEQ ID NO: 14666 - RNA, 19 nt, artificial
  Oligomer
gauuuaagggauggaaaag

SEQ ID NO: 14667 - RNA, 19 nt, artificial
  Oligomer
aaugaaacugggcuguacu

SEQ ID NO: 14668 - RNA, 19 nt, artificial
  Oligomer
agguccaugccucuggaau

SEQ ID NO: 14669 - RNA, 19 nt, artificial
  Oligomer
acagauaagcaagagagau

SEQ ID NO: 14670 - RNA, 19 nt, artificial
  Oligomer
cugucuuucagauacaugg

SEQ ID NO: 14671 - RNA, 19 nt, artificial
  Oligomer
aagagagggaaccacagca

SEQ ID NO: 14672 - RNA, 19 nt, artificial
  Oligomer
ucuucuuacaugcauuuga

SEQ ID NO: 14673 - RNA, 19 nt, artificial
  Oligomer
uggguugcauuuggucaag

SEQ ID NO: 14674 - RNA, 19 nt, artificial
  Oligomer
agaaguaaaaccguuugcu

SEQ ID NO: 14675 - RNA, 19 nt, artificial
  Oligomer
caguguucaaucuuaccag

SEQ ID NO: 14676 - RNA, 19 nt, artificial
  Oligomer
acucauuucauuccuaaca

SEQ ID NO: 14677 - RNA, 19 nt, artificial
  Oligomer
gcccauuuaacaggcaagu

SEQ ID NO: 14678 - RNA, 19 nt, artificial
  Oligomer
guagcuccucaacucaccu

SEQ ID NO: 14679 - RNA, 19 nt, artificial
  Oligomer
aguaagaagacaugaacca

SEQ ID NO: 14680 - RNA, 19 nt, artificial
  Oligomer
agccucuacaggacugaga

SEQ ID NO: 14681 - RNA, 19 nt, artificial
  Oligomer
uugaggucaaguaagaaga

SEQ ID NO: 14682 - RNA, 19 nt, artificial
  Oligomer
uugugauguuuuucauggu

SEQ ID NO: 14683 - RNA, 19 nt, artificial
  Oligomer
uauggguugcauuugguca

SEQ ID NO: 14684 - RNA, 19 nt, artificial
  Oligomer
caaguaagaagacaugaac

SEQ ID NO: 14685 - RNA, 19 nt, artificial
  Oligomer
cuacaggacugagaagaag

SEQ ID NO: 14686 - RNA, 19 nt, artificial
  Oligomer
gaaugggaagacaccuaug

SEQ ID NO: 14687 - RNA, 19 nt, artificial
  Oligomer
uaaagagagaauguagaua

SEQ ID NO: 14688 - RNA, 19 nt, artificial
  Oligomer
ggucuucuuacaugcauuu

SEQ ID NO: 14689 - RNA, 19 nt, artificial
  Oligomer
uguuguauucagugagggu

SEQ ID NO: 14690 - RNA, 19 nt, artificial
  Oligomer
caucuuagugccugagagu

SEQ ID NO: 14691 - RNA, 19 nt, artificial
  Oligomer
uuuugugaaaugaaaacau

SEQ ID NO: 14692 - RNA, 19 nt, artificial
  Oligomer
gcaugaaaaagcagcuacc

SEQ ID NO: 14693 - RNA, 19 nt, artificial
  Oligomer
aucuuuggagaagcaaaua

SEQ ID NO: 14694 - RNA, 19 nt, artificial
  Oligomer
caugguucugguugccuug

SEQ ID NO: 14695 - RNA, 19 nt, artificial
  Oligomer
aagcaagagagauguuuug

SEQ ID NO: 14696 - RNA, 19 nt, artificial
  Oligomer
acaugguugugaccugagg

SEQ ID NO: 14697 - RNA, 19 nt, artificial
  Oligomer
cucauuucauuccuaacac

SEQ ID NO: 14698 - RNA, 19 nt, artificial
  Oligomer
uugaaugcuuccugacaau

SEQ ID NO: 14699 - RNA, 19 nt, artificial
  Oligomer
uccucaacucaccuaaugu

SEQ ID NO: 14700 - RNA, 19 nt, artificial
  Oligomer
cuugacaccucagccucua

SEQ ID NO: 14701 - RNA, 19 nt, artificial
  Oligomer
auuaugauucuuuguuaca

SEQ ID NO: 14702 - RNA, 19 nt, artificial
  Oligomer
cuaagagaagcacuuuggg

SEQ ID NO: 14703 - RNA, 19 nt, artificial
  Oligomer
uucagugagggucuucuua

SEQ ID NO: 14704 - RNA, 19 nt, artificial
  Oligomer
uaaaaaguauauguuagga

SEQ ID NO: 14705 - RNA, 19 nt, artificial
  Oligomer
auauugugaaguacauauu

SEQ ID NO: 14706 - RNA, 19 nt, artificial
  Oligomer
ugugcauuuuugugaaaug

SEQ ID NO: 14707 - RNA, 19 nt, artificial
  Oligomer
aaguacauauuaggaaaau

SEQ ID NO: 14708 - RNA, 19 nt, artificial
  Oligomer
acaccuauggaauuguccu

SEQ ID NO: 14709 - RNA, 19 nt, artificial
  Oligomer
cuuagugccugagaguauu

SEQ ID NO: 14710 - RNA, 19 nt, artificial
  Oligomer
gcaagagagauguuuuggg

SEQ ID NO: 14711 - RNA, 19 nt, artificial
  Oligomer
gagaagcaugaaaaagcag

SEQ ID NO: 14712 - RNA, 19 nt, artificial
  Oligomer
gcaucuucacuucuaaaug

SEQ ID NO: 14713 - RNA, 19 nt, artificial
  Oligomer
ccucuacaggacugagaag

SEQ ID NO: 14714 - RNA, 19 nt, artificial
  Oligomer
ggaaaaggaagacuagagg

SEQ ID NO: 14715 - RNA, 19 nt, artificial
  Oligomer
ucaauuuugaggaaucuca

SEQ ID NO: 14716 - RNA, 19 nt, artificial
  Oligomer
uggaaaaggaagacuagag

SEQ ID NO: 14717 - RNA, 19 nt, artificial
  Oligomer
ccugaggauuuaagggaug

SEQ ID NO: 14718 - RNA, 19 nt, artificial
  Oligomer
aaaaggagcugaggaaagu

SEQ ID NO: 14719 - RNA, 19 nt, artificial
  Oligomer
ugucuuucagauacauggu

SEQ ID NO: 14720 - RNA, 19 nt, artificial
  Oligomer
agcuacuaaugauguuuuc

SEQ ID NO: 14721 - RNA, 19 nt, artificial
  Oligomer
cuauaagagagauccagcu

SEQ ID NO: 14722 - RNA, 19 nt, artificial
  Oligomer
uucuaaaugcauauccuga

SEQ ID NO: 14723 - RNA, 19 nt, artificial
  Oligomer
gcaguguucaaucuuacca

SEQ ID NO: 14724 - RNA, 19 nt, artificial
  Oligomer
ugguugccuugguaggauu

SEQ ID NO: 14725 - RNA, 19 nt, artificial
  Oligomer
uuaucuguuaguuucaccg

SEQ ID NO: 14726 - RNA, 19 nt, artificial
  Oligomer
uuuuucaugcuucucccuc

SEQ ID NO: 14727 - RNA, 19 nt, artificial
  Oligomer
uuuuuaagcacuauuagag

SEQ ID NO: 14728 - RNA, 19 nt, artificial
  Oligomer
uuuuccaucccuuaaaucc

SEQ ID NO: 14729 - RNA, 19 nt, artificial
  Oligomer
ucuuccgucauauuccucc

SEQ ID NO: 14730 - RNA, 19 nt, artificial
  Oligomer
uuucauuucacaaaaaugc

SEQ ID NO: 14731 - RNA, 19 nt, artificial
  Oligomer
ugcuuuuucaugcuucucc

SEQ ID NO: 14732 - RNA, 19 nt, artificial
  Oligomer
uuagaagugaagaugcugc

SEQ ID NO: 14733 - RNA, 19 nt, artificial
  Oligomer
uuuuacuucuucucagucc

SEQ ID NO: 14734 - RNA, 19 nt, artificial
  Oligomer
uguucuuccgucauauucc

SEQ ID NO: 14735 - RNA, 19 nt, artificial
  Oligomer
uuauauaagccgaaaaacg

SEQ ID NO: 14736 - RNA, 19 nt, artificial
  Oligomer
uguaagaagacccucacug

SEQ ID NO: 14737 - RNA, 19 nt, artificial
  Oligomer
uaacaaagaaucauaaugg

SEQ ID NO: 14738 - RNA, 19 nt, artificial
  Oligomer
uuaagcacuauuagaguug

SEQ ID NO: 14739 - RNA, 19 nt, artificial
  Oligomer
uuauuaugcaagccucuag

SEQ ID NO: 14740 - RNA, 19 nt, artificial
  Oligomer
acugaauacaacauucucg

SEQ ID NO: 14741 - RNA, 19 nt, artificial
  Oligomer
uucuuccgucauauuccuc

SEQ ID NO: 14742 - RNA, 19 nt, artificial
  Oligomer
uggaagagcugaaacaucc

SEQ ID NO: 14743 - RNA, 19 nt, artificial
  Oligomer
uuagagcuuauauaagccg

SEQ ID NO: 14744 - RNA, 19 nt, artificial
  Oligomer
uuaggaaugaaaugagucc

SEQ ID NO: 14745 - RNA, 19 nt, artificial
  Oligomer
uuuucauuucacaaaaaug

SEQ ID NO: 14746 - RNA, 19 nt, artificial
  Oligomer
uuuucaugcuucucccucu

SEQ ID NO: 14747 - RNA, 19 nt, artificial
  Oligomer
uucuuauacuucacuccag

SEQ ID NO: 14748 - RNA, 19 nt, artificial
  Oligomer
aucuugaccaaaugcaacc

SEQ ID NO: 14749 - RNA, 19 nt, artificial
  Oligomer
ucaaucugccuaaauacuc

SEQ ID NO: 14750 - RNA, 19 nt, artificial
  Oligomer
uugcuuaucuguuaguuuc

SEQ ID NO: 14751 - RNA, 19 nt, artificial
  Oligomer
auguucuuccgucauauuc

SEQ ID NO: 14752 - RNA, 19 nt, artificial
  Oligomer
uuuagaagugaagaugcug

SEQ ID NO: 14753 - RNA, 19 nt, artificial
  Oligomer
uugcugacugcucaagagg

SEQ ID NO: 14754 - RNA, 19 nt, artificial
  Oligomer
uuuccaucccuuaaauccu

SEQ ID NO: 14755 - RNA, 19 nt, artificial
  Oligomer
uucacaaaaaugcacaucu

SEQ ID NO: 14756 - RNA, 19 nt, artificial
  Oligomer
uguaucugaaagacagucc

SEQ ID NO: 14757 - RNA, 19 nt, artificial
  Oligomer
uauuccuccauuugucugg

SEQ ID NO: 14758 - RNA, 19 nt, artificial
  Oligomer
uuccaucccuuaaauccuc

SEQ ID NO: 14759 - RNA, 19 nt, artificial
  Oligomer
uugaguuggacuugccugu

SEQ ID NO: 14760 - RNA, 19 nt, artificial
  Oligomer
uuuugaacccuguggucuc

SEQ ID NO: 14761 - RNA, 19 nt, artificial
  Oligomer
uucuguagguggaagagcu

SEQ ID NO: 14762 - RNA, 19 nt, artificial
  Oligomer
uaggaaugaaaugaguccc

SEQ ID NO: 14763 - RNA, 19 nt, artificial
  Oligomer
uuacauguuuucauuucac

SEQ ID NO: 14764 - RNA, 19 nt, artificial
  Oligomer
uuucauugaucacaaggcc

SEQ ID NO: 14765 - RNA, 19 nt, artificial
  Oligomer
uucucaguccuguagaggc

SEQ ID NO: 14766 - RNA, 19 nt, artificial
  Oligomer
uaccaaggcaaccagaacc

SEQ ID NO: 14767 - RNA, 19 nt, artificial
  Oligomer
ucuuacuugaccucaaaug

SEQ ID NO: 14768 - RNA, 19 nt, artificial
  Oligomer
uuucaaucugccuaaauac

SEQ ID NO: 14769 - RNA, 19 nt, artificial
  Oligomer
uucaugcuucucccucuuc

SEQ ID NO: 14770 - RNA, 19 nt, artificial
  Oligomer
uuaugcaagccucuagucu

SEQ ID NO: 14771 - RNA, 19 nt, artificial
  Oligomer
uagucuuccuuuuccaucc

SEQ ID NO: 14772 - RNA, 19 nt, artificial
  Oligomer
uucccucucuucuucaggg

SEQ ID NO: 14773 - RNA, 19 nt, artificial
  Oligomer
aauaucuacauucucucuu

SEQ ID NO: 14774 - RNA, 19 nt, artificial
  Oligomer
augaguguagaacaccugg

SEQ ID NO: 14775 - RNA, 19 nt, artificial
  Oligomer
uuuuaagcacuauuagagu

SEQ ID NO: 14776 - RNA, 19 nt, artificial
  Oligomer
uuuacuucuucucaguccu

SEQ ID NO: 14777 - RNA, 19 nt, artificial
  Oligomer
uauauuauaggaaaacauc

SEQ ID NO: 14778 - RNA, 19 nt, artificial
  Oligomer
uuauaggaaaacaucauua

SEQ ID NO: 14779 - RNA, 19 nt, artificial
  Oligomer
uuuccuaauauguacuuca

SEQ ID NO: 14780 - RNA, 19 nt, artificial
  Oligomer
uccucaggucacaaccaug

SEQ ID NO: 14781 - RNA, 19 nt, artificial
  Oligomer
uuaaauccucaggucacaa

SEQ ID NO: 14782 - RNA, 19 nt, artificial
  Oligomer
ucauauuccuccauuuguc

SEQ ID NO: 14783 - RNA, 19 nt, artificial
  Oligomer
auguaucugaaagacaguc

SEQ ID NO: 14784 - RNA, 19 nt, artificial
  Oligomer
ucuuucagccucuuuagcu

SEQ ID NO: 14785 - RNA, 19 nt, artificial
  Oligomer
auauaaaugaucagcacug

SEQ ID NO: 14786 - RNA, 19 nt, artificial
  Oligomer
uagaacaccugguagcugc

SEQ ID NO: 14787 - RNA, 19 nt, artificial
  Oligomer
uuagaguuccucauguaga

SEQ ID NO: 14788 - RNA, 19 nt, artificial
  Oligomer
ucauaauggaaagaauccc

SEQ ID NO: 14789 - RNA, 19 nt, artificial
  Oligomer
uauaagccgaaaaacgucu

SEQ ID NO: 14790 - RNA, 19 nt, artificial
  Oligomer
cugaauacaacauucucgg

SEQ ID NO: 14791 - RNA, 19 nt, artificial
  Oligomer
ucuuauagaguuuccauag

SEQ ID NO: 14792 - RNA, 19 nt, artificial
  Oligomer
uauauaagccgaaaaacgu

SEQ ID NO: 14793 - RNA, 19 nt, artificial
  Oligomer
aucaucaccagauccuggg

SEQ ID NO: 14794 - RNA, 19 nt, artificial
  Oligomer
augauuuuuaagcacuauu

SEQ ID NO: 14795 - RNA, 19 nt, artificial
  Oligomer
uugauugucaggaagcauu

SEQ ID NO: 14796 - RNA, 19 nt, artificial
  Oligomer
ucuuccuuuuccaucccuu

SEQ ID NO: 14797 - RNA, 19 nt, artificial
  Oligomer
auugaagggcugcugcaug

SEQ ID NO: 14798 - RNA, 19 nt, artificial
  Oligomer
acaauaucuacauucucuc

SEQ ID NO: 14799 - RNA, 19 nt, artificial
  Oligomer
uauuaugcaagccucuagu

SEQ ID NO: 14800 - RNA, 19 nt, artificial
  Oligomer
uuagaguugauugucagga

SEQ ID NO: 14801 - RNA, 19 nt, artificial
  Oligomer
uuaaaagguguccuuuuca

SEQ ID NO: 14802 - RNA, 19 nt, artificial
  Oligomer
uagcuaagggaaacaccuc

SEQ ID NO: 14803 - RNA, 19 nt, artificial
  Oligomer
ucuguuaguuucaccgaug

SEQ ID NO: 14804 - RNA, 19 nt, artificial
  Oligomer
uucaaaaucuugaccaaau

SEQ ID NO: 14805 - RNA, 19 nt, artificial
  Oligomer
auaaacauuaggugaguug

SEQ ID NO: 14806 - RNA, 19 nt, artificial
  Oligomer
auauuccuccauuugucug

SEQ ID NO: 14807 - RNA, 19 nt, artificial
  Oligomer
ucaugcuucucccucuuca

SEQ ID NO: 14808 - RNA, 19 nt, artificial
  Oligomer
uucuccaaagaugaugcug

SEQ ID NO: 14809 - RNA, 19 nt, artificial
  Oligomer
uuauagaguuuccauagcu

SEQ ID NO: 14810 - RNA, 19 nt, artificial
  Oligomer
auagcuaagggaaacaccu

SEQ ID NO: 14811 - RNA, 19 nt, artificial
  Oligomer
ucuugaccaaaugcaaccc

SEQ ID NO: 14812 - RNA, 19 nt, artificial
  Oligomer
uuacuugaccucaaaugca

SEQ ID NO: 14813 - RNA, 19 nt, artificial
  Oligomer
ucaggcacuaagaugagug

SEQ ID NO: 14814 - RNA, 19 nt, artificial
  Oligomer
uggacagggaagaacugug

SEQ ID NO: 14815 - RNA, 19 nt, artificial
  Oligomer
uuacuucuucucaguccug

SEQ ID NO: 14816 - RNA, 19 nt, artificial
  Oligomer
uuccauaggugucuuccca

SEQ ID NO: 14817 - RNA, 19 nt, artificial
  Oligomer
uauuacauguuuucauuuc

SEQ ID NO: 14818 - RNA, 19 nt, artificial
  Oligomer
auuugcuucuccaaagaug

SEQ ID NO: 14819 - RNA, 19 nt, artificial
  Oligomer
uauacuucacuccagaaag

SEQ ID NO: 14820 - RNA, 19 nt, artificial
  Oligomer
auguacuucacaauaucua

SEQ ID NO: 14821 - RNA, 19 nt, artificial
  Oligomer
auuaggugaguugaggagc

SEQ ID NO: 14822 - RNA, 19 nt, artificial
  Oligomer
uucauuucacaaaaaugca

SEQ ID NO: 14823 - RNA, 19 nt, artificial
  Oligomer
ucuuauacuucacuccaga

SEQ ID NO: 14824 - RNA, 19 nt, artificial
  Oligomer
uuucacaaaaaugcacauc

SEQ ID NO: 14825 - RNA, 19 nt, artificial
  Oligomer
uagaagugaagaugcugcc

SEQ ID NO: 14826 - RNA, 19 nt, artificial
  Oligomer
auauuauaggaaaacauca

SEQ ID NO: 14827 - RNA, 19 nt, artificial
  Oligomer
uugaccaaaugcaacccau

SEQ ID NO: 14828 - RNA, 19 nt, artificial
  Oligomer
uuucaugcuucucccucuu

SEQ ID NO: 14829 - RNA, 19 nt, artificial
  Oligomer
uucaaucugccuaaauacu

SEQ ID NO: 14830 - RNA, 19 nt, artificial
  Oligomer
cuugaguuggacuugccug

SEQ ID NO: 14831 - RNA, 19 nt, artificial
  Oligomer
uauccuaacauauacuuuu

SEQ ID NO: 14832 - RNA, 19 nt, artificial
  Oligomer
auauaagccgaaaaacguc

SEQ ID NO: 14833 - RNA, 19 nt, artificial
  Oligomer
uuuagcuuauuaugcaagc

SEQ ID NO: 14834 - RNA, 19 nt, artificial
  Oligomer
uauguacuucacaauaucu

SEQ ID NO: 14835 - RNA, 19 nt, artificial
  Oligomer
uaguagcugacaaucaaug

SEQ ID NO: 14836 - RNA, 19 nt, artificial
  Oligomer
uguacuucacaauaucuac

SEQ ID NO: 14837 - RNA, 19 nt, artificial
  Oligomer
ucuuagagcuuauauaagc

SEQ ID NO: 14838 - RNA, 19 nt, artificial
  Oligomer
uuccuuuuccaucccuuaa

SEQ ID NO: 14839 - RNA, 19 nt, artificial
  Oligomer
aucauaauggaaagaaucc

SEQ ID NO: 14840 - RNA, 19 nt, artificial
  Oligomer
ucaaugauuuuuaagcacu

SEQ ID NO: 14841 - RNA, 19 nt, artificial
  Oligomer
uacauucucucuuuaguca

SEQ ID NO: 14842 - RNA, 19 nt, artificial
  Oligomer
ucauuaguagcugacaauc

SEQ ID NO: 14843 - RNA, 19 nt, artificial
  Oligomer
cuucacuccagaaagcagg

SEQ ID NO: 14844 - RNA, 19 nt, artificial
  Oligomer
uguugcugacugcucaaga

SEQ ID NO: 14845 - RNA, 19 nt, artificial
  Oligomer
uuugcuucuccaaagauga

SEQ ID NO: 14846 - RNA, 19 nt, artificial
  Oligomer
uucccauuccagaggcaug

SEQ ID NO: 14847 - RNA, 19 nt, artificial
  Oligomer
uggacuugccuguuaaaug

SEQ ID NO: 14848 - RNA, 19 nt, artificial
  Oligomer
aaugcaacccauauuuucc

SEQ ID NO: 14849 - RNA, 19 nt, artificial
  Oligomer
uuauacuucacuccagaaa

SEQ ID NO: 14850 - RNA, 19 nt, artificial
  Oligomer
ugcuucucccucuucacau

SEQ ID NO: 14851 - RNA, 19 nt, artificial
  Oligomer
cuuaucuguuaguuucacc

SEQ ID NO: 14852 - RNA, 19 nt, artificial
  Oligomer
auauggguaauugaagggc

SEQ ID NO: 14853 - RNA, 19 nt, artificial
  Oligomer
ucucucuugcuuaucuguu

SEQ ID NO: 14854 - RNA, 19 nt, artificial
  Oligomer
uuggacagggaagaacugu

SEQ ID NO: 14855 - RNA, 19 nt, artificial
  Oligomer
uagcuuauuaugcaagccu

SEQ ID NO: 14856 - RNA, 19 nt, artificial
  Oligomer
aaugcauguaagaagaccc

SEQ ID NO: 14857 - RNA, 19 nt, artificial
  Oligomer
uuuuccuaauauguacuuc

SEQ ID NO: 14858 - RNA, 19 nt, artificial
  Oligomer
uaauauguacuucacaaua

SEQ ID NO: 14859 - RNA, 19 nt, artificial
  Oligomer
uagacucucggaguucugc

SEQ ID NO: 14860 - RNA, 19 nt, artificial
  Oligomer
uacuucuucucaguccugu

SEQ ID NO: 14861 - RNA, 19 nt, artificial
  Oligomer
uucuucucaguccuguaga

SEQ ID NO: 14862 - RNA, 19 nt, artificial
  Oligomer
cuagucuuccuuuuccauc

SEQ ID NO: 14863 - RNA, 19 nt, artificial
  Oligomer
ugauuuuuaagcacuauua

SEQ ID NO: 14864 - RNA, 19 nt, artificial
  Oligomer
aauuccauaggugucuucc

SEQ ID NO: 14865 - RNA, 19 nt, artificial
  Oligomer
uacuuuggaauauacaaag

SEQ ID NO: 14866 - RNA, 19 nt, artificial
  Oligomer
uaggaaaacaucauuagua

SEQ ID NO: 14867 - RNA, 19 nt, artificial
  Oligomer
uuuucaaucugccuaaaua

SEQ ID NO: 14868 - RNA, 19 nt, artificial
  Oligomer
aacgguuuuacuucuucuc

SEQ ID NO: 14869 - RNA, 19 nt, artificial
  Oligomer
uugaccagagagagcucag

SEQ ID NO: 14870 - RNA, 19 nt, artificial
  Oligomer
aaagguguccuuuucaauc

SEQ ID NO: 14871 - RNA, 19 nt, artificial
  Oligomer
uaaauccucaggucacaac

SEQ ID NO: 14872 - RNA, 19 nt, artificial
  Oligomer
aaauccucaggucacaacc

SEQ ID NO: 14873 - RNA, 19 nt, artificial
  Oligomer
guaagauugaacacugccc

SEQ ID NO: 14874 - RNA, 19 nt, artificial
  Oligomer
uuuaagcacuauuagaguu

SEQ ID NO: 14875 - RNA, 19 nt, artificial
  Oligomer
uaugcaagccucuagucuu

SEQ ID NO: 14876 - RNA, 19 nt, artificial
  Oligomer
uuuggaauauacaaaguac

SEQ ID NO: 14877 - RNA, 19 nt, artificial
  Oligomer
uuccauagcuaagggaaac

SEQ ID NO: 14878 - RNA, 19 nt, artificial
  Oligomer
uacauguuuucauuucaca

SEQ ID NO: 14879 - RNA, 19 nt, artificial
  Oligomer
uauuauaggaaaacaucau

SEQ ID NO: 14880 - RNA, 19 nt, artificial
  Oligomer
aguuucauugaucacaagg

SEQ ID NO: 14881 - RNA, 19 nt, artificial
  Oligomer
ugagaggugaguuaaaagg

SEQ ID NO: 14882 - RNA, 19 nt, artificial
  Oligomer
uaaaugaucagcacuggua

SEQ ID NO: 14883 - RNA, 19 nt, artificial
  Oligomer
ugcuucuccaaagaugaug

SEQ ID NO: 14884 - RNA, 19 nt, artificial
  Oligomer
ucaggaagcauucaaaauc

SEQ ID NO: 14885 - RNA, 19 nt, artificial
  Oligomer
ucauuucacaaaaaugcac

SEQ ID NO: 14886 - RNA, 19 nt, artificial
  Oligomer
uugagaggugaguuaaaag

SEQ ID NO: 14887 - RNA, 19 nt, artificial
  Oligomer
auuuugaacccuguggucu

SEQ ID NO: 14888 - RNA, 19 nt, artificial
  Oligomer
ucacaauaucuacauucuc

SEQ ID NO: 14889 - RNA, 19 nt, artificial
  Oligomer
uauuuuccuaauauguacu

SEQ ID NO: 14890 - RNA, 19 nt, artificial
  Oligomer
uccaucaucaccagauccu

SEQ ID NO: 14891 - RNA, 19 nt, artificial
  Oligomer
aucuacauucucucuuuag

SEQ ID NO: 14892 - RNA, 19 nt, artificial
  Oligomer
auuauaggaaaacaucauu

SEQ ID NO: 14893 - RNA, 19 nt, artificial
  Oligomer
uuccucagcuccuuuuuuu

SEQ ID NO: 14894 - RNA, 19 nt, artificial
  Oligomer
aguucuauguucuuccguc

SEQ ID NO: 14895 - RNA, 19 nt, artificial
  Oligomer
ucugccuaaauacucucag

SEQ ID NO: 14896 - RNA, 19 nt, artificial
  Oligomer
cuucacaauaucuacauuc

SEQ ID NO: 14897 - RNA, 19 nt, artificial
  Oligomer
uccgucauauuccuccauu

SEQ ID NO: 14898 - RNA, 19 nt, artificial
  Oligomer
uuggaauauacaaaguaca

SEQ ID NO: 14899 - RNA, 19 nt, artificial
  Oligomer
ucuccaaagaugaugcugu

SEQ ID NO: 14900 - RNA, 19 nt, artificial
  Oligomer
uuccuaauauguacuucac

SEQ ID NO: 14901 - RNA, 19 nt, artificial
  Oligomer
aucagcacugguaagauug

SEQ ID NO: 14902 - RNA, 19 nt, artificial
  Oligomer
ucuacauucucucuuuagu

SEQ ID NO: 14903 - RNA, 19 nt, artificial
  Oligomer
ucuguagguggaagagcug

SEQ ID NO: 14904 - RNA, 19 nt, artificial
  Oligomer
uagaguuuccauagcuaag

SEQ ID NO: 14905 - RNA, 19 nt, artificial
  Oligomer
cuucuuauacuucacucca

SEQ ID NO: 14906 - RNA, 19 nt, artificial
  Oligomer
auauuuuccuaauauguac

SEQ ID NO: 14907 - RNA, 19 nt, artificial
  Oligomer
uucucuuagagcuuauaua

SEQ ID NO: 14908 - RNA, 19 nt, artificial
  Oligomer
uggaccuugaguuggacuu

SEQ ID NO: 14909 - RNA, 19 nt, artificial
  Oligomer
uccuaauauguacuucaca

SEQ ID NO: 14910 - RNA, 19 nt, artificial
  Oligomer
ugacauauaaaugaucagc

SEQ ID NO: 14911 - RNA, 19 nt, artificial
  Oligomer
ugguucccucucuucuuca

SEQ ID NO: 14912 - RNA, 19 nt, artificial
  Oligomer
auacguugacauauaaaug

SEQ ID NO: 14913 - RNA, 19 nt, artificial
  Oligomer
uucacaauaucuacauucu

SEQ ID NO: 14914 - RNA, 19 nt, artificial
  Oligomer
uucuauguucuuccgucau

SEQ ID NO: 14915 - RNA, 19 nt, artificial
  Oligomer
uucaugucuucuuacuuga

SEQ ID NO: 14916 - RNA, 19 nt, artificial
  Oligomer
uugguucaugucuucuuac

SEQ ID NO: 14917 - RNA, 19 nt, artificial
  Oligomer
cuacauucucucuuuaguc

SEQ ID NO: 14918 - RNA, 19 nt, artificial
  Oligomer
ugcaagccucuagucuucc

SEQ ID NO: 14919 - RNA, 19 nt, artificial
  Oligomer
auauguacuucacaauauc

SEQ ID NO: 14920 - RNA, 19 nt, artificial
  Oligomer
aacauuaggugaguugagg

SEQ ID NO: 14921 - RNA, 19 nt, artificial
  Oligomer
ucaaaaucuugaccaaaug

SEQ ID NO: 14922 - RNA, 19 nt, artificial
  Oligomer
auuuuuaagcacuauuaga

SEQ ID NO: 14923 - RNA, 19 nt, artificial
  Oligomer
uuggacuugccuguuaaau

SEQ ID NO: 14924 - RNA, 19 nt, artificial
  Oligomer
auaggugucuucccauucc

SEQ ID NO: 14925 - RNA, 19 nt, artificial
  Oligomer
auauacaaaguacagccca

SEQ ID NO: 14926 - RNA, 19 nt, artificial
  Oligomer
cagaguucuauguucuucc

SEQ ID NO: 14927 - RNA, 19 nt, artificial
  Oligomer
uauuagaguugauugucag

SEQ ID NO: 14928 - RNA, 19 nt, artificial
  Oligomer
uauaggaaaacaucauuag

SEQ ID NO: 14929 - RNA, 19 nt, artificial
  Oligomer
uauacaaaguacagcccag

SEQ ID NO: 14930 - RNA, 19 nt, artificial
  Oligomer
auuccauaggugucuuccc

SEQ ID NO: 14931 - RNA, 19 nt, artificial
  Oligomer
uccaucccuuaaauccuca

SEQ ID NO: 14932 - RNA, 19 nt, artificial
  Oligomer
uguggucucaagguccacu

SEQ ID NO: 14933 - RNA, 19 nt, artificial
  Oligomer
uacuugaccucaaaugcau

SEQ ID NO: 14934 - RNA, 19 nt, artificial
  Oligomer
agaaccaugaaaaacauca

SEQ ID NO: 14935 - RNA, 19 nt, artificial
  Oligomer
ugcauguaagaagacccuc

SEQ ID NO: 14936 - RNA, 19 nt, artificial
  Oligomer
uacaauugcacuggaaaua

SEQ ID NO: 14937 - RNA, 19 nt, artificial
  Oligomer
aucccuuaaauccucaggu

SEQ ID NO: 14938 - RNA, 19 nt, artificial
  Oligomer
uccucagcuccuuuuuuuc

SEQ ID NO: 14939 - RNA, 19 nt, artificial
  Oligomer
cucaagguccacuugguuc

SEQ ID NO: 14940 - RNA, 19 nt, artificial
  Oligomer
uauaaaugaucagcacugg

SEQ ID NO: 14941 - RNA, 19 nt, artificial
  Oligomer
uacuuagaguuccucaugu

SEQ ID NO: 14942 - RNA, 19 nt, artificial
  Oligomer
uuaggugaguugaggagcu

SEQ ID NO: 14943 - RNA, 19 nt, artificial
  Oligomer
ugccuaaauacucucaggc

SEQ ID NO: 14944 - RNA, 19 nt, artificial
  Oligomer
ucucuugcuuaucuguuag

SEQ ID NO: 14945 - RNA, 19 nt, artificial
  Oligomer
aaaaucuugaccaaaugca

SEQ ID NO: 14946 - RNA, 19 nt, artificial
  Oligomer
guaacaaagaaucauaaug

SEQ ID NO: 14947 - RNA, 19 nt, artificial
  Oligomer
uuccucauguagaccuugu

SEQ ID NO: 14948 - RNA, 19 nt, artificial
  Oligomer
acuaagaugaguguagaac

SEQ ID NO: 14949 - RNA, 19 nt, artificial
  Oligomer
uauggguaauugaagggcu

SEQ ID NO: 14950 - RNA, 19 nt, artificial
  Oligomer
uacuucacaauaucuacau

SEQ ID NO: 14951 - RNA, 19 nt, artificial
  Oligomer
uaucuguuaguuucaccga

SEQ ID NO: 14952 - RNA, 19 nt, artificial
  Oligomer
uucuuacuugaccucaaau

SEQ ID NO: 14953 - RNA, 19 nt, artificial
  Oligomer
auggaccuugaguuggacu

SEQ ID NO: 14954 - RNA, 19 nt, artificial
  Oligomer
aagaugaguguagaacacc

SEQ ID NO: 14955 - RNA, 19 nt, artificial
  Oligomer
uuccucaaaauugaccaga

SEQ ID NO: 14956 - RNA, 19 nt, artificial
  Oligomer
aucaaugauuuuuaagcac

SEQ ID NO: 14957 - RNA, 19 nt, artificial
  Oligomer
uauagaguuuccauagcua

SEQ ID NO: 14958 - RNA, 19 nt, artificial
  Oligomer
uacaacauucucggugccu

SEQ ID NO: 14959 - RNA, 19 nt, artificial
  Oligomer
ugguagcugcuuuuucaug

SEQ ID NO: 14960 - RNA, 19 nt, artificial
  Oligomer
cuucucccucuucacaugg

SEQ ID NO: 14961 - RNA, 19 nt, artificial
  Oligomer
auuacauguuuucauuuca

SEQ ID NO: 14962 - RNA, 19 nt, artificial
  Oligomer
ugugguucccucucuucuu

SEQ ID NO: 14963 - RNA, 19 nt, artificial
  Oligomer
acaaccauguaucugaaag

SEQ ID NO: 14964 - RNA, 19 nt, artificial
  Oligomer
cugagauuccucaaaauug

SEQ ID NO: 14965 - RNA, 19 nt, artificial
  Oligomer
ucaagguccacuugguuca

SEQ ID NO: 14966 - RNA, 19 nt, artificial
  Oligomer
uacguugacauauaaauga

SEQ ID NO: 14967 - RNA, 19 nt, artificial
  Oligomer
cuuacuugaccucaaaugc

SEQ ID NO: 14968 - RNA, 19 nt, artificial
  Oligomer
aauauacaaaguacagccc

SEQ ID NO: 14969 - RNA, 19 nt, artificial
  Oligomer
ucucuuauagaguuuccau

SEQ ID NO: 14970 - RNA, 19 nt, artificial
  Oligomer
uguccuuuucaaucugccu

SEQ ID NO: 14971 - RNA, 19 nt, artificial
  Oligomer
auacuuagaguuccucaug

SEQ ID NO: 14972 - RNA, 19 nt, artificial
  Oligomer
uggaucucucuuauagagu

SEQ ID NO: 14973 - RNA, 19 nt, artificial
  Oligomer
gaauacaacauucucggug

SEQ ID NO: 14974 - RNA, 19 nt, artificial
  Oligomer
ucuagucuuccuuuuccau

SEQ ID NO: 14975 - RNA, 19 nt, artificial
  Oligomer
uccuuuuccaucccuuaaa

SEQ ID NO: 14976 - RNA, 19 nt, artificial
  Oligomer
uccuuugaccaggccuucu

SEQ ID NO: 14977 - RNA, 19 nt, artificial
  Oligomer
uauacuuuggaauauacaa

SEQ ID NO: 14978 - RNA, 19 nt, artificial
  Oligomer
uccucauguagaccuugug

SEQ ID NO: 14979 - RNA, 19 nt, artificial
  Oligomer
guuguugcaagauugaccc

SEQ ID NO: 14980 - RNA, 19 nt, artificial
  Oligomer
ccuucuuauacuucacucc

SEQ ID NO: 14981 - RNA, 19 nt, artificial
  Oligomer
aauugcacuggaaauacac

SEQ ID NO: 14982 - RNA, 19 nt, artificial
  Oligomer
ucugagauuccucaaaauu

SEQ ID NO: 14983 - RNA, 19 nt, artificial
  Oligomer
uccagaaagcaggacaauu

SEQ ID NO: 14984 - RNA, 19 nt, artificial
  Oligomer
cuuuuuauuacauguuuuc

SEQ ID NO: 14985 - RNA, 19 nt, artificial
  Oligomer
uuccagaggcauggaccuu

SEQ ID NO: 14986 - RNA, 19 nt, artificial
  Oligomer
aaaaacaucacaaggagac

SEQ ID NO: 14987 - RNA, 19 nt, artificial
  Oligomer
ucucucuuauagaguuucc

SEQ ID NO: 14988 - RNA, 19 nt, artificial
  Oligomer
gcuuuuucaugcuucuccc

SEQ ID NO: 14989 - RNA, 19 nt, artificial
  Oligomer
uuccgucauauuccuccau

SEQ ID NO: 14990 - RNA, 19 nt, artificial
  Oligomer
uccauaggugucuucccau

SEQ ID NO: 14991 - RNA, 19 nt, artificial
  Oligomer
ucacugaauacaacauucu

SEQ ID NO: 14992 - RNA, 19 nt, artificial
  Oligomer
aacaucauuaguagcugac

SEQ ID NO: 14993 - RNA, 19 nt, artificial
  Oligomer
uaugcauuuagaagugaag

SEQ ID NO: 14994 - RNA, 19 nt, artificial
  Oligomer
augucuucuuacuugaccu

SEQ ID NO: 14995 - RNA, 19 nt, artificial
  Oligomer
acaaaaaugcacaucuaca

SEQ ID NO: 14996 - RNA, 19 nt, artificial
  Oligomer
aaucauaauggaaagaauc

SEQ ID NO: 14997 - RNA, 19 nt, artificial
  Oligomer
uugacauauaaaugaucag

SEQ ID NO: 14998 - RNA, 19 nt, artificial
  Oligomer
augcaacccauauuuuccu

SEQ ID NO: 14999 - RNA, 19 nt, artificial
  Oligomer
augcuucucccucuucaca

SEQ ID NO: 15000 - RNA, 19 nt, artificial
  Oligomer
aaaacgucugagauuccuc

SEQ ID NO: 15001 - RNA, 19 nt, artificial
  Oligomer
augaaaaacaucacaagga

SEQ ID NO: 15002 - RNA, 19 nt, artificial
  Oligomer
uuagcuuauuaugcaagcc

SEQ ID NO: 15003 - RNA, 19 nt, artificial
  Oligomer
uccuuuucaaucugccuaa

SEQ ID NO: 15004 - RNA, 19 nt, artificial
  Oligomer
aaucuugaccaaaugcaac

SEQ ID NO: 15005 - RNA, 19 nt, artificial
  Oligomer
uguccacccaguagaucug

SEQ ID NO: 15006 - RNA, 19 nt, artificial
  Oligomer
aaaugcaacccauauuuuc

SEQ ID NO: 15007 - RNA, 19 nt, artificial
  Oligomer
auuagaguugauugucagg

SEQ ID NO: 15008 - RNA, 19 nt, artificial
  Oligomer
agagagcucagauacguug

SEQ ID NO: 15009 - RNA, 19 nt, artificial
  Oligomer
ucuugcuuaucuguuaguu

SEQ ID NO: 15010 - RNA, 19 nt, artificial
  Oligomer
aaucugccuaaauacucuc

SEQ ID NO: 15011 - RNA, 19 nt, artificial
  Oligomer
ugucuucccauuccagagg

SEQ ID NO: 15012 - RNA, 19 nt, artificial
  Oligomer
guacagcccaguuucauug

SEQ ID NO: 15013 - RNA, 19 nt, artificial
  Oligomer
uacuucacuccagaaagca

SEQ ID NO: 15014 - RNA, 19 nt, artificial
  Oligomer
uuucagccucuuuagcuua

SEQ ID NO: 15015 - RNA, 19 nt, artificial
  Oligomer
aaacgguuuuacuucuucu

SEQ ID NO: 15016 - RNA, 19 nt, artificial
  Oligomer
acgguuuuacuucuucuca

SEQ ID NO: 15017 - RNA, 19 nt, artificial
  Oligomer
gucacaaccauguaucuga

SEQ ID NO: 15018 - RNA, 19 nt, artificial
  Oligomer
aucucucuuauagaguuuc

SEQ ID NO: 15019 - RNA, 19 nt, artificial
  Oligomer
agauuccucaaaauugacc

SEQ ID NO: 15020 - RNA, 19 nt, artificial
  Oligomer
uaauugaagggcugcugca

SEQ ID NO: 15021 - RNA, 19 nt, artificial
  Oligomer
aagcaggacaauuccauag

SEQ ID NO: 15022 - RNA, 19 nt, artificial
  Oligomer
gaauauacaaaguacagcc

SEQ ID NO: 15023 - RNA, 19 nt, artificial
  Oligomer
uagagcuuauauaagccga

SEQ ID NO: 15024 - RNA, 19 nt, artificial
  Oligomer
auaagccgaaaaacgucug

SEQ ID NO: 15025 - RNA, 19 nt, artificial
  Oligomer
ugaguguagaacaccuggu

SEQ ID NO: 15026 - RNA, 19 nt, artificial
  Oligomer
uccacuugguucaugucuu

SEQ ID NO: 15027 - RNA, 19 nt, artificial
  Oligomer
auaauggaaagaaucccaa

SEQ ID NO: 15028 - RNA, 19 nt, artificial
  Oligomer
cuguccacccaguagaucu

SEQ ID NO: 15029 - RNA, 19 nt, artificial
  Oligomer
uuaguagcugacaaucaau

SEQ ID NO: 15030 - RNA, 19 nt, artificial
  Oligomer
cucaaaugcauguaagaag

SEQ ID NO: 15031 - RNA, 19 nt, artificial
  Oligomer
guaauugaagggcugcugc

SEQ ID NO: 15032 - RNA, 19 nt, artificial
  Oligomer
uaggugucuucccauucca

SEQ ID NO: 15033 - RNA, 19 nt, artificial
  Oligomer
guucccucucuucuucagg

SEQ ID NO: 15034 - RNA, 19 nt, artificial
  Oligomer
uugaccucaaaugcaugua

SEQ ID NO: 15035 - RNA, 19 nt, artificial
  Oligomer
uggaauauacaaaguacag

SEQ ID NO: 15036 - RNA, 19 nt, artificial
  Oligomer
uggguaauugaagggcugc

SEQ ID NO: 15037 - RNA, 19 nt, artificial
  Oligomer
uccauagcuaagggaaaca

SEQ ID NO: 15038 - RNA, 19 nt, artificial
  Oligomer
acaacauucucggugccug

SEQ ID NO: 15039 - RNA, 19 nt, artificial
  Oligomer
acuugaccucaaaugcaug

SEQ ID NO: 15040 - RNA, 19 nt, artificial
  Oligomer
acagacauuuugaacccug

SEQ ID NO: 15041 - RNA, 19 nt, artificial
  Oligomer
uaaacauuaggugaguuga

SEQ ID NO: 15042 - RNA, 19 nt, artificial
  Oligomer
uacaaaguacagcccaguu

SEQ ID NO: 15043 - RNA, 19 nt, artificial
  Oligomer
ugcuuaucuguuaguuuca

SEQ ID NO: 15044 - RNA, 19 nt, artificial
  Oligomer
agcugcuuuuucaugcuuc

SEQ ID NO: 15045 - RNA, 19 nt, artificial
  Oligomer
ucuauguucuuccgucaua

SEQ ID NO: 15046 - RNA, 19 nt, artificial
  Oligomer
uagcugacaaucaaugauu

SEQ ID NO: 15047 - RNA, 19 nt, artificial
  Oligomer
aaauugaccagagagagcu

SEQ ID NO: 15048 - RNA, 19 nt, artificial
  Oligomer
cuuuagcuuauuaugcaag

SEQ ID NO: 15049 - RNA, 19 nt, artificial
  Oligomer
aagaaucccaaagugcuuc

SEQ ID NO: 15050 - RNA, 19 nt, artificial
  Oligomer
auaucuacauucucucuuu

SEQ ID NO: 15051 - RNA, 19 nt, artificial
  Oligomer
agcauucaaaaucuugacc

SEQ ID NO: 15052 - RNA, 19 nt, artificial
  Oligomer
uagaguuccucauguagac

SEQ ID NO: 15053 - RNA, 19 nt, artificial
  Oligomer
ugucuucuuacuugaccuc

SEQ ID NO: 15054 - RNA, 19 nt, artificial
  Oligomer
aaaacaucauuaguagcug

SEQ ID NO: 15055 - RNA, 19 nt, artificial
  Oligomer
guccuuuucaaucugccua

SEQ ID NO: 15056 - RNA, 19 nt, artificial
  Oligomer
cuugccuguuaaaugggcc

SEQ ID NO: 15057 - RNA, 19 nt, artificial
  Oligomer
cccuucuuauacuucacuc

SEQ ID NO: 15058 - RNA, 19 nt, artificial
  Oligomer
auaaaugaucagcacuggu

SEQ ID NO: 15059 - RNA, 19 nt, artificial
  Oligomer
guuucauugaucacaaggc

SEQ ID NO: 15060 - RNA, 19 nt, artificial
  Oligomer
cacaauaucuacauucucu

SEQ ID NO: 15061 - RNA, 19 nt, artificial
  Oligomer
ugaaaaacaucacaaggag

SEQ ID NO: 15062 - RNA, 19 nt, artificial
  Oligomer
cagcaaacgguuuuacuuc

SEQ ID NO: 15063 - RNA, 19 nt, artificial
  Oligomer
augcaagccucuagucuuc

SEQ ID NO: 15064 - RNA, 19 nt, artificial
  Oligomer
agaguuuccauagcuaagg

SEQ ID NO: 15065 - RNA, 19 nt, artificial
  Oligomer
aagugcuucucuuagagcu

SEQ ID NO: 15066 - RNA, 19 nt, artificial
  Oligomer
uucucggugccuguaacaa

SEQ ID NO: 15067 - RNA, 19 nt, artificial
  Oligomer
uugaacccuguggucucaa

SEQ ID NO: 15068 - RNA, 19 nt, artificial
  Oligomer
uugaggagcuacagacauu

SEQ ID NO: 15069 - RNA, 19 nt, artificial
  Oligomer
uuuccucagcuccuuuuuu

SEQ ID NO: 15070 - RNA, 19 nt, artificial
  Oligomer
cuuagaguuccucauguag

SEQ ID NO: 15071 - RNA, 19 nt, artificial
  Oligomer
aauggaaagaaucccaaag

SEQ ID NO: 15072 - RNA, 19 nt, artificial
  Oligomer
ucucaagguccacuugguu

SEQ ID NO: 15073 - RNA, 19 nt, artificial
  Oligomer
accagaaccaugaaaaaca

SEQ ID NO: 15074 - RNA, 19 nt, artificial
  Oligomer
cugugguucccucucuucu

SEQ ID NO: 15075 - RNA, 19 nt, artificial
  Oligomer
auccucaggucacaaccau

SEQ ID NO: 15076 - RNA, 19 nt, artificial
  Oligomer
cuuagagcuuauauaagcc

SEQ ID NO: 15077 - RNA, 19 nt, artificial
  Oligomer
uugucaggaagcauucaaa

SEQ ID NO: 15078 - RNA, 19 nt, artificial
  Oligomer
cucacugaauacaacauuc

SEQ ID NO: 15079 - RNA, 19 nt, artificial
  Oligomer
auuaugcaagccucuaguc

SEQ ID NO: 15080 - RNA, 19 nt, artificial
  Oligomer
cauagcuaagggaaacacc

SEQ ID NO: 15081 - RNA, 19 nt, artificial
  Oligomer
ucagcuccuuuuuuucagg

SEQ ID NO: 15082 - RNA, 19 nt, artificial
  Oligomer
guuaggaaugaaaugaguc

SEQ ID NO: 15083 - RNA, 19 nt, artificial
  Oligomer
acuauuagaguugauuguc

SEQ ID NO: 15084 - RNA, 19 nt, artificial
  Oligomer
caguagcucaucaucuucc

SEQ ID NO: 15085 - RNA, 19 nt, artificial
  Oligomer
ugaggagcuacagacauuu

SEQ ID NO: 15086 - RNA, 19 nt, artificial
  Oligomer
guguccuuuucaaucugcc

SEQ ID NO: 15087 - RNA, 19 nt, artificial
  Oligomer
uagguggaagagcugaaac

SEQ ID NO: 15088 - RNA, 19 nt, artificial
  Oligomer
ucccuuaaauccucagguc

SEQ ID NO: 15089 - RNA, 19 nt, artificial
  Oligomer
ucucuuagagcuuauauaa

SEQ ID NO: 15090 - RNA, 19 nt, artificial
  Oligomer
auacaaaguacagcccagu

SEQ ID NO: 15091 - RNA, 19 nt, artificial
  Oligomer
acaauugcacuggaaauac

SEQ ID NO: 15092 - RNA, 19 nt, artificial
  Oligomer
uaagaugaguguagaacac

SEQ ID NO: 15093 - RNA, 19 nt, artificial
  Oligomer
aaaacaucucucuugcuua

SEQ ID NO: 15094 - RNA, 19 nt, artificial
  Oligomer
aggagcuacagacauuuug

SEQ ID NO: 15095 - RNA, 19 nt, artificial
  Oligomer
acuucacuccagaaagcag

SEQ ID NO: 15096 - RNA, 19 nt, artificial
  Oligomer
ugauugucaggaagcauuc

SEQ ID NO: 15097 - RNA, 19 nt, artificial
  Oligomer
caaucaaugauuuuuaagc

SEQ ID NO: 15098 - RNA, 19 nt, artificial
  Oligomer
auggguaauugaagggcug

SEQ ID NO: 15099 - RNA, 19 nt, artificial
  Oligomer
ugcugacugcucaagagga

SEQ ID NO: 15100 - RNA, 19 nt, artificial
  Oligomer
guaucugaaagacaguccc

SEQ ID NO: 15101 - RNA, 19 nt, artificial
  Oligomer
cucuuauagaguuuccaua

SEQ ID NO: 15102 - RNA, 19 nt, artificial
  Oligomer
aucugccuaaauacucuca

SEQ ID NO: 15103 - RNA, 19 nt, artificial
  Oligomer
cuguuaguuucaccgaugg

SEQ ID NO: 15104 - RNA, 19 nt, artificial
  Oligomer
ucuuuagcuuauuaugcaa

SEQ ID NO: 15105 - RNA, 19 nt, artificial
  Oligomer
ucaaaauugaccagagaga

SEQ ID NO: 15106 - RNA, 19 nt, artificial
  Oligomer
guuuuacuucuucucaguc

SEQ ID NO: 15107 - RNA, 19 nt, artificial
  Oligomer
uagugcaguagcucaucau

SEQ ID NO: 15108 - RNA, 19 nt, artificial
  Oligomer
aauacaacauucucggugc

SEQ ID NO: 15109 - RNA, 19 nt, artificial
  Oligomer
cccaguuucauugaucaca

SEQ ID NO: 15110 - RNA, 19 nt, artificial
  Oligomer
cucagcuccuuuuuuucag

SEQ ID NO: 15111 - RNA, 19 nt, artificial
  Oligomer
ccuuaaauccucaggucac

SEQ ID NO: 15112 - RNA, 19 nt, artificial
  Oligomer
ugguagacucucggaguuc

SEQ ID NO: 15113 - RNA, 19 nt, artificial
  Oligomer
accugguagcugcuuuuuc

SEQ ID NO: 15114 - RNA, 19 nt, artificial
  Oligomer
auacuuuggaauauacaaa

SEQ ID NO: 15115 - RNA, 19 nt, artificial
  Oligomer
auugaccagagagagcuca

SEQ ID NO: 15116 - RNA, 19 nt, artificial
  Oligomer
auucaaaaucuugaccaaa

SEQ ID NO: 15117 - RNA, 19 nt, artificial
  Oligomer
agaugaguguagaacaccu

SEQ ID NO: 15118 - RNA, 19 nt, artificial
  Oligomer
aacaucucucuugcuuauc

SEQ ID NO: 15119 - RNA, 19 nt, artificial
  Oligomer
ucaggucacaaccauguau

SEQ ID NO: 15120 - RNA, 19 nt, artificial
  Oligomer
uggaaagaaucccaaagug

SEQ ID NO: 15121 - RNA, 19 nt, artificial
  Oligomer
acuugguucaugucuucuu

SEQ ID NO: 15122 - RNA, 19 nt, artificial
  Oligomer
aucuguuaguuucaccgau

SEQ ID NO: 15123 - RNA, 19 nt, artificial
  Oligomer
caugucuucuuacuugacc

SEQ ID NO: 15124 - RNA, 19 nt, artificial
  Oligomer
augcauguaagaagacccu

SEQ ID NO: 15125 - RNA, 19 nt, artificial
  Oligomer
acauguuuucauuucacaa

SEQ ID NO: 15126 - RNA, 19 nt, artificial
  Oligomer
uuugaacccuguggucuca

SEQ ID NO: 15127 - RNA, 19 nt, artificial
  Oligomer
agcuuauuaugcaagccuc

SEQ ID NO: 15128 - RNA, 19 nt, artificial
  Oligomer
uccuucuguagguggaaga

SEQ ID NO: 15129 - RNA, 19 nt, artificial
  Oligomer
aggauaugcauuuagaagu

SEQ ID NO: 15130 - RNA, 19 nt, artificial
  Oligomer
acccuucuuauacuucacu

SEQ ID NO: 15131 - RNA, 19 nt, artificial
  Oligomer
cucauaaacauuaggugag

SEQ ID NO: 15132 - RNA, 19 nt, artificial
  Oligomer
agguuggacagggaagaac

SEQ ID NO: 15133 - RNA, 19 nt, artificial
  Oligomer
acauucucucuuuagucau

SEQ ID NO: 15134 - RNA, 19 nt, artificial
  Oligomer
aucauuaguagcugacaau

SEQ ID NO: 15135 - RNA, 19 nt, artificial
  Oligomer
accuugaguuggacuugcc

SEQ ID NO: 15136 - RNA, 19 nt, artificial
  Oligomer
auccuaccaaggcaaccag

SEQ ID NO: 15137 - RNA, 19 nt, artificial
  Oligomer
gguuguugcaagauugacc

SEQ ID NO: 15138 - RNA, 19 nt, artificial
  Oligomer
caggucacaaccauguauc

SEQ ID NO: 15139 - RNA, 19 nt, artificial
  Oligomer
cauaauggaaagaauccca

SEQ ID NO: 15140 - RNA, 19 nt, artificial
  Oligomer
ucccaaagugcuucucuua

SEQ ID NO: 15141 - RNA, 19 nt, artificial
  Oligomer
cuuuuucaugcuucucccu

SEQ ID NO: 15142 - RNA, 19 nt, artificial
  Oligomer
uaaaagguguccuuuucaa

SEQ ID NO: 15143 - RNA, 19 nt, artificial
  Oligomer
ugacaaucaaugauuuuua

SEQ ID NO: 15144 - RNA, 19 nt, artificial
  Oligomer
accaaaugcaacccauauu

SEQ ID NO: 15145 - RNA, 19 nt, artificial
  Oligomer
auggaaagaaucccaaagu

SEQ ID NO: 15146 - RNA, 19 nt, artificial
  Oligomer
aguagcucaucaucuuccc

SEQ ID NO: 15147 - RNA, 19 nt, artificial
  Oligomer
caaacgguuuuacuucuuc

SEQ ID NO: 15148 - RNA, 19 nt, artificial
  Oligomer
aaaauugaccagagagagc

SEQ ID NO: 15149 - RNA, 19 nt, artificial
  Oligomer
uguagguggaagagcugaa

SEQ ID NO: 15150 - RNA, 19 nt, artificial
  Oligomer
uuuccauagcuaagggaaa

SEQ ID NO: 15151 - RNA, 19 nt, artificial
  Oligomer
aaucccaaagugcuucucu

SEQ ID NO: 15152 - RNA, 19 nt, artificial
  Oligomer
ccucuuuagcuuauuaugc

SEQ ID NO: 15153 - RNA, 19 nt, artificial
  Oligomer
gucauauuccuccauuugu

SEQ ID NO: 15154 - RNA, 19 nt, artificial
  Oligomer
cgguuuuacuucuucucag

SEQ ID NO: 15155 - RNA, 19 nt, artificial
  Oligomer
cuuaaauccucaggucaca

SEQ ID NO: 15156 - RNA, 19 nt, artificial
  Oligomer
aaagugcuucucuuagagc

SEQ ID NO: 15157 - RNA, 19 nt, artificial
  Oligomer
agcaggacaauuccauagg

SEQ ID NO: 15158 - RNA, 19 nt, artificial
  Oligomer
ugaguuaaaagguguccuu

SEQ ID NO: 15159 - RNA, 19 nt, artificial
  Oligomer
uucacuccagaaagcagga

SEQ ID NO: 15160 - RNA, 19 nt, artificial
  Oligomer
ugaguugaggagcuacaga

SEQ ID NO: 15161 - RNA, 19 nt, artificial
  Oligomer
auuaguagcugacaaucaa

SEQ ID NO: 15162 - RNA, 19 nt, artificial
  Oligomer
auagaguuuccauagcuaa

SEQ ID NO: 15163 - RNA, 19 nt, artificial
  Oligomer
aucccaaagugcuucucuu

SEQ ID NO: 15164 - RNA, 19 nt, artificial
  Oligomer
aaggcaaccagaaccauga

SEQ ID NO: 15165 - RNA, 19 nt, artificial
  Oligomer
cuaagaugaguguagaaca

SEQ ID NO: 15166 - RNA, 19 nt, artificial
  Oligomer
cuuuuccaucccuuaaauc

SEQ ID NO: 15167 - RNA, 19 nt, artificial
  Oligomer
aguacagcccaguuucauu

SEQ ID NO: 15168 - RNA, 19 nt, artificial
  Oligomer
auuccagaggcauggaccu

SEQ ID NO: 15169 - RNA, 19 nt, artificial
  Oligomer
aucucucuugcuuaucugu

SEQ ID NO: 15170 - RNA, 19 nt, artificial
  Oligomer
ccauguaucugaaagacag

SEQ ID NO: 15171 - RNA, 19 nt, artificial
  Oligomer
ugcugugguucccucucuu

SEQ ID NO: 15172 - RNA, 19 nt, artificial
  Oligomer
ucaaaugcauguaagaaga

SEQ ID NO: 15173 - RNA, 19 nt, artificial
  Oligomer
cuugaccaaaugcaaccca

SEQ ID NO: 15174 - RNA, 19 nt, artificial
  Oligomer
agcaaacgguuuuacuucu

SEQ ID NO: 15175 - RNA, 19 nt, artificial
  Oligomer
cugguaagauugaacacug

SEQ ID NO: 15176 - RNA, 19 nt, artificial
  Oligomer
uguuaggaaugaaaugagu

SEQ ID NO: 15177 - RNA, 19 nt, artificial
  Oligomer
acuugccuguuaaaugggc

SEQ ID NO: 15178 - RNA, 19 nt, artificial
  Oligomer
aggugaguugaggagcuac

SEQ ID NO: 15179 - RNA, 19 nt, artificial
  Oligomer
ugguucaugucuucuuacu

SEQ ID NO: 15180 - RNA, 19 nt, artificial
  Oligomer
ucucaguccuguagaggcu

SEQ ID NO: 15181 - RNA, 19 nt, artificial
  Oligomer
ucuucuuacuugaccucaa

SEQ ID NO: 15182 - RNA, 19 nt, artificial
  Oligomer
accaugaaaaacaucacaa

SEQ ID NO: 15183 - RNA, 19 nt, artificial
  Oligomer
ugaccaaaugcaacccaua

SEQ ID NO: 15184 - RNA, 19 nt, artificial
  Oligomer
guucaugucuucuuacuug

SEQ ID NO: 15185 - RNA, 19 nt, artificial
  Oligomer
cuucuucucaguccuguag

SEQ ID NO: 15186 - RNA, 19 nt, artificial
  Oligomer
cauaggugucuucccauuc

SEQ ID NO: 15187 - RNA, 19 nt, artificial
  Oligomer
uaucuacauucucucuuua

SEQ ID NO: 15188 - RNA, 19 nt, artificial
  Oligomer
aaaugcauguaagaagacc

SEQ ID NO: 15189 - RNA, 19 nt, artificial
  Oligomer
acccucacugaauacaaca

SEQ ID NO: 15190 - RNA, 19 nt, artificial
  Oligomer
acucucaggcacuaagaug

SEQ ID NO: 15191 - RNA, 19 nt, artificial
  Oligomer
auguuuucauuucacaaaa

SEQ ID NO: 15192 - RNA, 19 nt, artificial
  Oligomer
gguagcugcuuuuucaugc

SEQ ID NO: 15193 - RNA, 19 nt, artificial
  Oligomer
uauuugcuucuccaaagau

SEQ ID NO: 15194 - RNA, 19 nt, artificial
  Oligomer
caaggcaaccagaaccaug

SEQ ID NO: 15195 - RNA, 19 nt, artificial
  Oligomer
caaaacaucucucuugcuu

SEQ ID NO: 15196 - RNA, 19 nt, artificial
  Oligomer
ccucaggucacaaccaugu

SEQ ID NO: 15197 - RNA, 19 nt, artificial
  Oligomer
guguuaggaaugaaaugag

SEQ ID NO: 15198 - RNA, 19 nt, artificial
  Oligomer
auugucaggaagcauucaa

SEQ ID NO: 15199 - RNA, 19 nt, artificial
  Oligomer
acauuaggugaguugagga

SEQ ID NO: 15200 - RNA, 19 nt, artificial
  Oligomer
uagaggcugaggugucaag

SEQ ID NO: 15201 - RNA, 19 nt, artificial
  Oligomer
uguaacaaagaaucauaau

SEQ ID NO: 15202 - RNA, 19 nt, artificial
  Oligomer
cccaaagugcuucucuuag

SEQ ID NO: 15203 - RNA, 19 nt, artificial
  Oligomer
uaagaagacccucacugaa

SEQ ID NO: 15204 - RNA, 19 nt, artificial
  Oligomer
uccuaacauauacuuuuua

SEQ ID NO: 15205 - RNA, 19 nt, artificial
  Oligomer
aauauguacuucacaauau

SEQ ID NO: 15206 - RNA, 19 nt, artificial
  Oligomer
cauuucacaaaaaugcaca

SEQ ID NO: 15207 - RNA, 19 nt, artificial
  Oligomer
auuuuccuaauauguacuu

SEQ ID NO: 15208 - RNA, 19 nt, artificial
  Oligomer
aggacaauuccauaggugu

SEQ ID NO: 15209 - RNA, 19 nt, artificial
  Oligomer
aauacucucaggcacuaag

SEQ ID NO: 15210 - RNA, 19 nt, artificial
  Oligomer
cccaaaacaucucucuugc

SEQ ID NO: 15211 - RNA, 19 nt, artificial
  Oligomer
cugcuuuuucaugcuucuc

SEQ ID NO: 15212 - RNA, 19 nt, artificial
  Oligomer
cauuuagaagugaagaugc

SEQ ID NO: 15213 - RNA, 19 nt, artificial
  Oligomer
cuucucaguccuguagagg

SEQ ID NO: 15214 - RNA, 19 nt, artificial
  Oligomer
ccucuagucuuccuuuucc

SEQ ID NO: 15215 - RNA, 19 nt, artificial
  Oligomer
ugagauuccucaaaauuga

SEQ ID NO: 15216 - RNA, 19 nt, artificial
  Oligomer
cucuagucuuccuuuucca

SEQ ID NO: 15217 - RNA, 19 nt, artificial
  Oligomer
caucccuuaaauccucagg

SEQ ID NO: 15218 - RNA, 19 nt, artificial
  Oligomer
acuuuccucagcuccuuuu

SEQ ID NO: 15219 - RNA, 19 nt, artificial
  Oligomer
accauguaucugaaagaca

SEQ ID NO: 15220 - RNA, 19 nt, artificial
  Oligomer
gaaaacaucauuaguagcu

SEQ ID NO: 15221 - RNA, 19 nt, artificial
  Oligomer
agcuggaucucucuuauag

SEQ ID NO: 15222 - RNA, 19 nt, artificial
  Oligomer
ucaggauaugcauuuagaa

SEQ ID NO: 15223 - RNA, 19 nt, artificial
  Oligomer
ugguaagauugaacacugc

SEQ ID NO: 15224 - RNA, 19 nt, artificial
  Oligomer
aauccuaccaaggcaacca

SEQ ID NO: 15225 - RNA, 19 nt, artificial
  Oligomer
cgcugaggauucagacuaa

SEQ ID NO: 15226 - RNA, 19 nt, artificial
  Oligomer
gcaacauauuauaguaaaa

SEQ ID NO: 15227 - RNA, 19 nt, artificial
  Oligomer
gagaaacacugaccuuaua

SEQ ID NO: 15228 - RNA, 19 nt, artificial
  Oligomer
gggagcagaugguacaaaa

SEQ ID NO: 15229 - RNA, 19 nt, artificial
  Oligomer
caauguggaauacauucaa

SEQ ID NO: 15230 - RNA, 19 nt, artificial
  Oligomer
cgagaaacacugaccuuau

SEQ ID NO: 15231 - RNA, 19 nt, artificial
  Oligomer
ccaaaaggcuagagguaaa

SEQ ID NO: 15232 - RNA, 19 nt, artificial
  Oligomer
gggaggugauuggagugaa

SEQ ID NO: 15233 - RNA, 19 nt, artificial
  Oligomer
cggagucaguacaacuuca

SEQ ID NO: 15234 - RNA, 19 nt, artificial
  Oligomer
ccugagggaagcuccauaa

SEQ ID NO: 15235 - RNA, 19 nt, artificial
  Oligomer
ugcugaagauguuuaugaa

SEQ ID NO: 15236 - RNA, 19 nt, artificial
  Oligomer
cgauguucagcauggugua

SEQ ID NO: 15237 - RNA, 19 nt, artificial
  Oligomer
ggugaaaacuucugcuuga

SEQ ID NO: 15238 - RNA, 19 nt, artificial
  Oligomer
aaaccaauguggaauacau

SEQ ID NO: 15239 - RNA, 19 nt, artificial
  Oligomer
ugguguacucauccauaaa

SEQ ID NO: 15240 - RNA, 19 nt, artificial
  Oligomer
ggcucugaagaaucacaga

SEQ ID NO: 15241 - RNA, 19 nt, artificial
  Oligomer
caccgagacagaggguuaa

SEQ ID NO: 15242 - RNA, 19 nt, artificial
  Oligomer
gagacagaggguuaaauga

SEQ ID NO: 15243 - RNA, 19 nt, artificial
  Oligomer
ccugggcucugaagaauca

SEQ ID NO: 15244 - RNA, 19 nt, artificial
  Oligomer
gcagcuauugauuuuggaa

SEQ ID NO: 15245 - RNA, 19 nt, artificial
  Oligomer
ggaauacauucaaacugau

SEQ ID NO: 15246 - RNA, 19 nt, artificial
  Oligomer
cagcauccuugcugaacua

SEQ ID NO: 15247 - RNA, 19 nt, artificial
  Oligomer
cagaaugaauagaucacca

SEQ ID NO: 15248 - RNA, 19 nt, artificial
  Oligomer
caugaaggucacagcugga

SEQ ID NO: 15249 - RNA, 19 nt, artificial
  Oligomer
agacagaggguuaaaugaa

SEQ ID NO: 15250 - RNA, 19 nt, artificial
  Oligomer
gaagcuguucgaacccaau

SEQ ID NO: 15251 - RNA, 19 nt, artificial
  Oligomer
ggcuagagguaaagcugua

SEQ ID NO: 15252 - RNA, 19 nt, artificial
  Oligomer
cccugaggucacagaauga

SEQ ID NO: 15253 - RNA, 19 nt, artificial
  Oligomer
ggagcagaugguacaaaau

SEQ ID NO: 15254 - RNA, 19 nt, artificial
  Oligomer
ggaggugauuggagugaac

SEQ ID NO: 15255 - RNA, 19 nt, artificial
  Oligomer
cagaaacacuuuuuauaua

SEQ ID NO: 15256 - RNA, 19 nt, artificial
  Oligomer
gaugguacaaaaugcugaa

SEQ ID NO: 15257 - RNA, 19 nt, artificial
  Oligomer
aauguggaauacauucaaa

SEQ ID NO: 15258 - RNA, 19 nt, artificial
  Oligomer
cuagcaacauauuauagua

SEQ ID NO: 15259 - RNA, 19 nt, artificial
  Oligomer
acuccugggcucugaagaa

SEQ ID NO: 15260 - RNA, 19 nt, artificial
  Oligomer
cauccugaccuccuauuaa

SEQ ID NO: 15261 - RNA, 19 nt, artificial
  Oligomer
caugguguacucauccaua

SEQ ID NO: 15262 - RNA, 19 nt, artificial
  Oligomer
gguacaaaaugcugaagau

SEQ ID NO: 15263 - RNA, 19 nt, artificial
  Oligomer
caagcuuucccgauguuca

SEQ ID NO: 15264 - RNA, 19 nt, artificial
  Oligomer
cacagaaacacuuuuuaua

SEQ ID NO: 15265 - RNA, 19 nt, artificial
  Oligomer
cagcuauugauuuuggaaa

SEQ ID NO: 15266 - RNA, 19 nt, artificial
  Oligomer
cucugaagaaucacagaaa

SEQ ID NO: 15267 - RNA, 19 nt, artificial
  Oligomer
cuuaccggugcgagucaaa

SEQ ID NO: 15268 - RNA, 19 nt, artificial
  Oligomer
gucccuuugcacugcagaa

SEQ ID NO: 15269 - RNA, 19 nt, artificial
  Oligomer
aauagaucaccaagaguau

SEQ ID NO: 15270 - RNA, 19 nt, artificial
  Oligomer
caugggaagucccuuugca

SEQ ID NO: 15271 - RNA, 19 nt, artificial
  Oligomer
augguguacucauccauaa

SEQ ID NO: 15272 - RNA, 19 nt, artificial
  Oligomer
aacugaugcagcuauugau

SEQ ID NO: 15273 - RNA, 19 nt, artificial
  Oligomer
cucugaaggagggugaaaa

SEQ ID NO: 15274 - RNA, 19 nt, artificial
  Oligomer
agaaugaauagaucaccaa

SEQ ID NO: 15275 - RNA, 19 nt, artificial
  Oligomer
cugaccuccuauuaaagaa

SEQ ID NO: 15276 - RNA, 19 nt, artificial
  Oligomer
agcaacauauuauaguaaa

SEQ ID NO: 15277 - RNA, 19 nt, artificial
  Oligomer
gaccuccuauuaaagaaaa

SEQ ID NO: 15278 - RNA, 19 nt, artificial
  Oligomer
gaauagaucaccaagagua

SEQ ID NO: 15279 - RNA, 19 nt, artificial
  Oligomer
uaccuagcaacauauuaua

SEQ ID NO: 15280 - RNA, 19 nt, artificial
  Oligomer
gagugaacaccaugaaggu

SEQ ID NO: 15281 - RNA, 19 nt, artificial
  Oligomer
ccucugaaggagggugaaa

SEQ ID NO: 15282 - RNA, 19 nt, artificial
  Oligomer
aagaauuccuccuccggaa

SEQ ID NO: 15283 - RNA, 19 nt, artificial
  Oligomer
aauuauaccuagcaacaua

SEQ ID NO: 15284 - RNA, 19 nt, artificial
  Oligomer
ccgagacagaggguuaaau

SEQ ID NO: 15285 - RNA, 19 nt, artificial
  Oligomer
ugaagcuguucgaacccaa

SEQ ID NO: 15286 - RNA, 19 nt, artificial
  Oligomer
guccgugugagacugcuaa

SEQ ID NO: 15287 - RNA, 19 nt, artificial
  Oligomer
ugaccauccugaccuccua

SEQ ID NO: 15288 - RNA, 19 nt, artificial
  Oligomer
cggcauuguuagcucugcu

SEQ ID NO: 15289 - RNA, 19 nt, artificial
  Oligomer
ugcagcuauugauuuugga

SEQ ID NO: 15290 - RNA, 19 nt, artificial
  Oligomer
gagggaagcuccauaacug

SEQ ID NO: 15291 - RNA, 19 nt, artificial
  Oligomer
uggaauacauucaaacuga

SEQ ID NO: 15292 - RNA, 19 nt, artificial
  Oligomer
ugaugagugcgguugcuga

SEQ ID NO: 15293 - RNA, 19 nt, artificial
  Oligomer
cccuucugaucgucuucga

SEQ ID NO: 15294 - RNA, 19 nt, artificial
  Oligomer
cugccguggucuauaucga

SEQ ID NO: 15295 - RNA, 19 nt, artificial
  Oligomer
gaagaaucacagaaacacu

SEQ ID NO: 15296 - RNA, 19 nt, artificial
  Oligomer
cauucaaacugaugcagcu

SEQ ID NO: 15297 - RNA, 19 nt, artificial
  Oligomer
gcucugaagaaucacagaa

SEQ ID NO: 15298 - RNA, 19 nt, artificial
  Oligomer
caccugccguggucuauau

SEQ ID NO: 15299 - RNA, 19 nt, artificial
  Oligomer
uuggagugaacaccaugaa

SEQ ID NO: 15300 - RNA, 19 nt, artificial
  Oligomer
accgagacagaggguuaaa

SEQ ID NO: 15301 - RNA, 19 nt, artificial
  Oligomer
auccugaccuccuauuaaa

SEQ ID NO: 15302 - RNA, 19 nt, artificial
  Oligomer
ugaggucacagaaugaaua

SEQ ID NO: 15303 - RNA, 19 nt, artificial
  Oligomer
ccugaggucacagaaugaa

SEQ ID NO: 15304 - RNA, 19 nt, artificial
  Oligomer
ucgcagaugugguggagaa

SEQ ID NO: 15305 - RNA, 19 nt, artificial
  Oligomer
gccucagagaacucuggaa

SEQ ID NO: 15306 - RNA, 19 nt, artificial
  Oligomer
gggcagugcuguuguuguu

SEQ ID NO: 15307 - RNA, 19 nt, artificial
  Oligomer
cccaaaccaauguggaaua

SEQ ID NO: 15308 - RNA, 19 nt, artificial
  Oligomer
agauguuuaugaagcuguu

SEQ ID NO: 15309 - RNA, 19 nt, artificial
  Oligomer
cugaggucacagaaugaau

SEQ ID NO: 15310 - RNA, 19 nt, artificial
  Oligomer
uaccggugcgagucaaaga

SEQ ID NO: 15311 - RNA, 19 nt, artificial
  Oligomer
aaugaauagaucaccaaga

SEQ ID NO: 15312 - RNA, 19 nt, artificial
  Oligomer
ggacgagaaacacugaccu

SEQ ID NO: 15313 - RNA, 19 nt, artificial
  Oligomer
cgagacagaggguuaaaug

SEQ ID NO: 15314 - RNA, 19 nt, artificial
  Oligomer
gaaggagggugaaaacuuc

SEQ ID NO: 15315 - RNA, 19 nt, artificial
  Oligomer
gaaugaauagaucaccaag

SEQ ID NO: 15316 - RNA, 19 nt, artificial
  Oligomer
ggucacagaaugaauagau

SEQ ID NO: 15317 - RNA, 19 nt, artificial
  Oligomer
aguacaacuucaucgcaga

SEQ ID NO: 15318 - RNA, 19 nt, artificial
  Oligomer
ugauuggagugaacaccau

SEQ ID NO: 15319 - RNA, 19 nt, artificial
  Oligomer
caccaaaaggcuagaggua

SEQ ID NO: 15320 - RNA, 19 nt, artificial
  Oligomer
ugaugaugcugacccugag

SEQ ID NO: 15321 - RNA, 19 nt, artificial
  Oligomer
cuccauaacugcugcuuca

SEQ ID NO: 15322 - RNA, 19 nt, artificial
  Oligomer
ggagucaguacaacuucau

SEQ ID NO: 15323 - RNA, 19 nt, artificial
  Oligomer
cccggagucaguacaacuu

SEQ ID NO: 15324 - RNA, 19 nt, artificial
  Oligomer
ugacaguuccacauccaua

SEQ ID NO: 15325 - RNA, 19 nt, artificial
  Oligomer
ugaccuccuauuaaagaaa

SEQ ID NO: 15326 - RNA, 19 nt, artificial
  Oligomer
ugggcucugaagaaucaca

SEQ ID NO: 15327 - RNA, 19 nt, artificial
  Oligomer
cugaagaaucacagaaaca

SEQ ID NO: 15328 - RNA, 19 nt, artificial
  Oligomer
gacauggguuucuugguaa

SEQ ID NO: 15329 - RNA, 19 nt, artificial
  Oligomer
gaagaauuccuccuccgga

SEQ ID NO: 15330 - RNA, 19 nt, artificial
  Oligomer
cccuuugcacugcagaaca

SEQ ID NO: 15331 - RNA, 19 nt, artificial
  Oligomer
cuccuauuaaagaaaauga

SEQ ID NO: 15332 - RNA, 19 nt, artificial
  Oligomer
caucuuuugugggcaguua

SEQ ID NO: 15333 - RNA, 19 nt, artificial
  Oligomer
aaccaauguggaauacauu

SEQ ID NO: 15334 - RNA, 19 nt, artificial
  Oligomer
gacagaggguuaaaugaac

SEQ ID NO: 15335 - RNA, 19 nt, artificial
  Oligomer
auaaaauuauaccuagcaa

SEQ ID NO: 15336 - RNA, 19 nt, artificial
  Oligomer
gugauuggagugaacacca

SEQ ID NO: 15337 - RNA, 19 nt, artificial
  Oligomer
cagaggguuaaaugaacca

SEQ ID NO: 15338 - RNA, 19 nt, artificial
  Oligomer
cugcuugacaguuccacau

SEQ ID NO: 15339 - RNA, 19 nt, artificial
  Oligomer
cugcagaacacgaucacau

SEQ ID NO: 15340 - RNA, 19 nt, artificial
  Oligomer
augggcucauugucaccaa

SEQ ID NO: 15341 - RNA, 19 nt, artificial
  Oligomer
gccguggucuauaucgaga

SEQ ID NO: 15342 - RNA, 19 nt, artificial
  Oligomer
caaaccaauguggaauaca

SEQ ID NO: 15343 - RNA, 19 nt, artificial
  Oligomer
ccguggucuauaucgagau

SEQ ID NO: 15344 - RNA, 19 nt, artificial
  Oligomer
aaaugcugaagauguuuau

SEQ ID NO: 15345 - RNA, 19 nt, artificial
  Oligomer
cuacagcuucgagaaccaa

SEQ ID NO: 15346 - RNA, 19 nt, artificial
  Oligomer
gcaugguguacucauccau

SEQ ID NO: 15347 - RNA, 19 nt, artificial
  Oligomer
cuugacaguuccacaucca

SEQ ID NO: 15348 - RNA, 19 nt, artificial
  Oligomer
acaaaaugcugaagauguu

SEQ ID NO: 15349 - RNA, 19 nt, artificial
  Oligomer
gcauccuugcugaacuaca

SEQ ID NO: 15350 - RNA, 19 nt, artificial
  Oligomer
ccugaccuccuauuaaaga

SEQ ID NO: 15351 - RNA, 19 nt, artificial
  Oligomer
agaugugguggagaagaca

SEQ ID NO: 15352 - RNA, 19 nt, artificial
  Oligomer
ccauccugaccuccuauua

SEQ ID NO: 15353 - RNA, 19 nt, artificial
  Oligomer
gagggugaaaacuucugcu

SEQ ID NO: 15354 - RNA, 19 nt, artificial
  Oligomer
guucgaacccaaucccagu

SEQ ID NO: 15355 - RNA, 19 nt, artificial
  Oligomer
acuacagcuucgagaacca

SEQ ID NO: 15356 - RNA, 19 nt, artificial
  Oligomer
accuccuauuaaagaaaau

SEQ ID NO: 15357 - RNA, 19 nt, artificial
  Oligomer
guuccacauccauagugca

SEQ ID NO: 15358 - RNA, 19 nt, artificial
  Oligomer
ccaauguggaauacauuca

SEQ ID NO: 15359 - RNA, 19 nt, artificial
  Oligomer
guguacucauccauaaagu

SEQ ID NO: 15360 - RNA, 19 nt, artificial
  Oligomer
ucugcuugacaguuccaca

SEQ ID NO: 15361 - RNA, 19 nt, artificial
  Oligomer
cgaucacauccggcauugu

SEQ ID NO: 15362 - RNA, 19 nt, artificial
  Oligomer
gucaggugcugcucuuugu

SEQ ID NO: 15363 - RNA, 19 nt, artificial
  Oligomer
gguaagcuccugagguaau

SEQ ID NO: 15364 - RNA, 19 nt, artificial
  Oligomer
ugguaagcuccugagguaa

SEQ ID NO: 15365 - RNA, 19 nt, artificial
  Oligomer
ugaggauucagacuaagga

SEQ ID NO: 15366 - RNA, 19 nt, artificial
  Oligomer
cauccauagugcauggucu

SEQ ID NO: 15367 - RNA, 19 nt, artificial
  Oligomer
aggucacagaaugaauaga

SEQ ID NO: 15368 - RNA, 19 nt, artificial
  Oligomer
cauaacugcugcuucagga

SEQ ID NO: 15369 - RNA, 19 nt, artificial
  Oligomer
acagaaacacuuuuuauau

SEQ ID NO: 15370 - RNA, 19 nt, artificial
  Oligomer
ccagcauccuugcugaacu

SEQ ID NO: 15371 - RNA, 19 nt, artificial
  Oligomer
gaggugauuggagugaaca

SEQ ID NO: 15372 - RNA, 19 nt, artificial
  Oligomer
cauagugcauggucugaug

SEQ ID NO: 15373 - RNA, 19 nt, artificial
  Oligomer
gacgagaaacacugaccuu

SEQ ID NO: 15374 - RNA, 19 nt, artificial
  Oligomer
ugacgucaggaacuucuga

SEQ ID NO: 15375 - RNA, 19 nt, artificial
  Oligomer
ugaaggucacagcuggaau

SEQ ID NO: 15376 - RNA, 19 nt, artificial
  Oligomer
ccaccaaaaggcuagaggu

SEQ ID NO: 15377 - RNA, 19 nt, artificial
  Oligomer
ccaagaguaugaggcuccu

SEQ ID NO: 15378 - RNA, 19 nt, artificial
  Oligomer
cugggagcaaagauuccca

SEQ ID NO: 15379 - RNA, 19 nt, artificial
  Oligomer
gaggguuaaaugaaccagu

SEQ ID NO: 15380 - RNA, 19 nt, artificial
  Oligomer
auaccuagcaacauauuau

SEQ ID NO: 15381 - RNA, 19 nt, artificial
  Oligomer
acugcagaacacgaucaca

SEQ ID NO: 15382 - RNA, 19 nt, artificial
  Oligomer
ugggagggcuggaucuuuu

SEQ ID NO: 15383 - RNA, 19 nt, artificial
  Oligomer
agaguaugaggcuccugcu

SEQ ID NO: 15384 - RNA, 19 nt, artificial
  Oligomer
gcagaugugguggagaaga

SEQ ID NO: 15385 - RNA, 19 nt, artificial
  Oligomer
gggcucugaagaaucacag

SEQ ID NO: 15386 - RNA, 19 nt, artificial
  Oligomer
aguccgugugagacugcua

SEQ ID NO: 15387 - RNA, 19 nt, artificial
  Oligomer
gagcaguaggaagcaguca

SEQ ID NO: 15388 - RNA, 19 nt, artificial
  Oligomer
uggagugaacaccaugaag

SEQ ID NO: 15389 - RNA, 19 nt, artificial
  Oligomer
cauugucaccaacgcccau

SEQ ID NO: 15390 - RNA, 19 nt, artificial
  Oligomer
gagaaccaagcuuucccga

SEQ ID NO: 15391 - RNA, 19 nt, artificial
  Oligomer
aaacugaugcagcuauuga

SEQ ID NO: 15392 - RNA, 19 nt, artificial
  Oligomer
gcaacgcugaggauucaga

SEQ ID NO: 15393 - RNA, 19 nt, artificial
  Oligomer
cacaauucccggcauucgu

SEQ ID NO: 15394 - RNA, 19 nt, artificial
  Oligomer
ugacauggguuucuuggua

SEQ ID NO: 15395 - RNA, 19 nt, artificial
  Oligomer
acacugaccuuauauguga

SEQ ID NO: 15396 - RNA, 19 nt, artificial
  Oligomer
uguuuaugaagcuguucga

SEQ ID NO: 15397 - RNA, 19 nt, artificial
  Oligomer
uguggaauacauucaaacu

SEQ ID NO: 15398 - RNA, 19 nt, artificial
  Oligomer
ugaugcagcuauugauuuu

SEQ ID NO: 15399 - RNA, 19 nt, artificial
  Oligomer
gaggucacagaaugaauag

SEQ ID NO: 15400 - RNA, 19 nt, artificial
  Oligomer
agaucaccaagaguaugag

SEQ ID NO: 15401 - RNA, 19 nt, artificial
  Oligomer
ugagggaagcuccauaacu

SEQ ID NO: 15402 - RNA, 19 nt, artificial
  Oligomer
uugguaagcuccugaggua

SEQ ID NO: 15403 - RNA, 19 nt, artificial
  Oligomer
uagaucaccaagaguauga

SEQ ID NO: 15404 - RNA, 19 nt, artificial
  Oligomer
ucuuaccggugcgagucaa

SEQ ID NO: 15405 - RNA, 19 nt, artificial
  Oligomer
guuuaugaagcuguucgaa

SEQ ID NO: 15406 - RNA, 19 nt, artificial
  Oligomer
aguaaaaaaugagguggga

SEQ ID NO: 15407 - RNA, 19 nt, artificial
  Oligomer
cauuguuagcucugcucag

SEQ ID NO: 15408 - RNA, 19 nt, artificial
  Oligomer
cuguucgaacccaauccca

SEQ ID NO: 15409 - RNA, 19 nt, artificial
  Oligomer
ucacagaaacacuuuuuau

SEQ ID NO: 15410 - RNA, 19 nt, artificial
  Oligomer
ucaaacugaugcagcuauu

SEQ ID NO: 15411 - RNA, 19 nt, artificial
  Oligomer
cauccuugcugaacuacag

SEQ ID NO: 15412 - RNA, 19 nt, artificial
  Oligomer
gagcaaagauucccaugcu

SEQ ID NO: 15413 - RNA, 19 nt, artificial
  Oligomer
agaaacacugaccuuauau

SEQ ID NO: 15414 - RNA, 19 nt, artificial
  Oligomer
gaaucacagaaacacuuuu

SEQ ID NO: 15415 - RNA, 19 nt, artificial
  Oligomer
uggucuauaucgagauccu

SEQ ID NO: 15416 - RNA, 19 nt, artificial
  Oligomer
aucacauccggcauuguua

SEQ ID NO: 15417 - RNA, 19 nt, artificial
  Oligomer
ugaggcuccugcucugauu

SEQ ID NO: 15418 - RNA, 19 nt, artificial
  Oligomer
ugaacuacagcuucgagaa

SEQ ID NO: 15419 - RNA, 19 nt, artificial
  Oligomer
uagcaacauauuauaguaa

SEQ ID NO: 15420 - RNA, 19 nt, artificial
  Oligomer
agaccacaauucccggcau

SEQ ID NO: 15421 - RNA, 19 nt, artificial
  Oligomer
cuccugggcucugaagaau

SEQ ID NO: 15422 - RNA, 19 nt, artificial
  Oligomer
ugaaaacuucugcuugaca

SEQ ID NO: 15423 - RNA, 19 nt, artificial
  Oligomer
aggugauuggagugaacac

SEQ ID NO: 15424 - RNA, 19 nt, artificial
  Oligomer
gaagucccuuugcacugca

SEQ ID NO: 15425 - RNA, 19 nt, artificial
  Oligomer
ucccagcauccuugcugaa

SEQ ID NO: 15426 - RNA, 19 nt, artificial
  Oligomer
caucccuucugaucgucuu

SEQ ID NO: 15427 - RNA, 19 nt, artificial
  Oligomer
gcacugcagaacacgauca

SEQ ID NO: 15428 - RNA, 19 nt, artificial
  Oligomer
uauaccuagcaacauauua

SEQ ID NO: 15429 - RNA, 19 nt, artificial
  Oligomer
aagcuuucccgauguucag

SEQ ID NO: 15430 - RNA, 19 nt, artificial
  Oligomer
uacucauccauaaagucau

SEQ ID NO: 15431 - RNA, 19 nt, artificial
  Oligomer
aaaauuauaccuagcaaca

SEQ ID NO: 15432 - RNA, 19 nt, artificial
  Oligomer
agagaacucuggaacccgu

SEQ ID NO: 15433 - RNA, 19 nt, artificial
  Oligomer
ugaaggagggugaaaacuu

SEQ ID NO: 15434 - RNA, 19 nt, artificial
  Oligomer
cuucugcuugacaguucca

SEQ ID NO: 15435 - RNA, 19 nt, artificial
  Oligomer
ucgcaacgcugaggauuca

SEQ ID NO: 15436 - RNA, 19 nt, artificial
  Oligomer
augaauagaucaccaagag

SEQ ID NO: 15437 - RNA, 19 nt, artificial
  Oligomer
ugagugcgguugcugacau

SEQ ID NO: 15438 - RNA, 19 nt, artificial
  Oligomer
cagaugugguggagaagac

SEQ ID NO: 15439 - RNA, 19 nt, artificial
  Oligomer
auacauucaaacugaugca

SEQ ID NO: 15440 - RNA, 19 nt, artificial
  Oligomer
gaaccaagcuuucccgaug

SEQ ID NO: 15441 - RNA, 19 nt, artificial
  Oligomer
ucacagaaugaauagauca

SEQ ID NO: 15442 - RNA, 19 nt, artificial
  Oligomer
auuggagugaacaccauga

SEQ ID NO: 15443 - RNA, 19 nt, artificial
  Oligomer
ugaauagaucaccaagagu

SEQ ID NO: 15444 - RNA, 19 nt, artificial
  Oligomer
ccuagcaacauauuauagu

SEQ ID NO: 15445 - RNA, 19 nt, artificial
  Oligomer
gcagaugguacaaaaugcu

SEQ ID NO: 15446 - RNA, 19 nt, artificial
  Oligomer
gacaguuccacauccauag

SEQ ID NO: 15447 - RNA, 19 nt, artificial
  Oligomer
acugaugcagcuauugauu

SEQ ID NO: 15448 - RNA, 19 nt, artificial
  Oligomer
acgagaaacacugaccuua

SEQ ID NO: 15449 - RNA, 19 nt, artificial
  Oligomer
uggucugaugagugcgguu

SEQ ID NO: 15450 - RNA, 19 nt, artificial
  Oligomer
gggaagcuccauaacugcu

SEQ ID NO: 15451 - RNA, 19 nt, artificial
  Oligomer
acacgaucacauccggcau

SEQ ID NO: 15452 - RNA, 19 nt, artificial
  Oligomer
uugggaaggcggagucuuu

SEQ ID NO: 15453 - RNA, 19 nt, artificial
  Oligomer
gaucacauccggcauuguu

SEQ ID NO: 15454 - RNA, 19 nt, artificial
  Oligomer
gaccauccugaccuccuau

SEQ ID NO: 15455 - RNA, 19 nt, artificial
  Oligomer
uaagcggcgacacguauga

SEQ ID NO: 15456 - RNA, 19 nt, artificial
  Oligomer
agugcauggucugaugagu

SEQ ID NO: 15457 - RNA, 19 nt, artificial
  Oligomer
gaaaacuucugcuugacag

SEQ ID NO: 15458 - RNA, 19 nt, artificial
  Oligomer
cuucugaucgucuucgaga

SEQ ID NO: 15459 - RNA, 19 nt, artificial
  Oligomer
gagaacucuggaacccguu

SEQ ID NO: 15460 - RNA, 19 nt, artificial
  Oligomer
gguguacucauccauaaag

SEQ ID NO: 15461 - RNA, 19 nt, artificial
  Oligomer
caccaugaaggucacagcu

SEQ ID NO: 15462 - RNA, 19 nt, artificial
  Oligomer
ccauagugcauggucugau

SEQ ID NO: 15463 - RNA, 19 nt, artificial
  Oligomer
gcauuguuagcucugcuca

SEQ ID NO: 15464 - RNA, 19 nt, artificial
  Oligomer
gaugaugcugacccugagu

SEQ ID NO: 15465 - RNA, 19 nt, artificial
  Oligomer
cuucgagaaccaagcuuuc

SEQ ID NO: 15466 - RNA, 19 nt, artificial
  Oligomer
ugaucgucuucgagaguuu

SEQ ID NO: 15467 - RNA, 19 nt, artificial
  Oligomer
cagcuucgagaaccaagcu

SEQ ID NO: 15468 - RNA, 19 nt, artificial
  Oligomer
gcuucgagaaccaagcuuu

SEQ ID NO: 15469 - RNA, 19 nt, artificial
  Oligomer
ccuucugaucgucuucgag

SEQ ID NO: 15470 - RNA, 19 nt, artificial
  Oligomer
uugacaguuccacauccau

SEQ ID NO: 15471 - RNA, 19 nt, artificial
  Oligomer
agcaugguguacucaucca

SEQ ID NO: 15472 - RNA, 19 nt, artificial
  Oligomer
cgugcacuucugaaggacu

SEQ ID NO: 15473 - RNA, 19 nt, artificial
  Oligomer
ugaagauguuuaugaagcu

SEQ ID NO: 15474 - RNA, 19 nt, artificial
  Oligomer
ugaacaccaugaaggucac

SEQ ID NO: 15475 - RNA, 19 nt, artificial
  Oligomer
agaaccaagcuuucccgau

SEQ ID NO: 15476 - RNA, 19 nt, artificial
  Oligomer
aucacagaaacacuuuuua

SEQ ID NO: 15477 - RNA, 19 nt, artificial
  Oligomer
caacgcugaggauucagac

SEQ ID NO: 15478 - RNA, 19 nt, artificial
  Oligomer
cugagggaagcuccauaac

SEQ ID NO: 15479 - RNA, 19 nt, artificial
  Oligomer
cugcugacgucaggaacuu

SEQ ID NO: 15480 - RNA, 19 nt, artificial
  Oligomer
gggugaaaacuucugcuug

SEQ ID NO: 15481 - RNA, 19 nt, artificial
  Oligomer
gaccacaauucccggcauu

SEQ ID NO: 15482 - RNA, 19 nt, artificial
  Oligomer
aaccaagcuuucccgaugu

SEQ ID NO: 15483 - RNA, 19 nt, artificial
  Oligomer
caguuagucaggugcugcu

SEQ ID NO: 15484 - RNA, 19 nt, artificial
  Oligomer
gucacagcuggaaucuccu

SEQ ID NO: 15485 - RNA, 19 nt, artificial
  Oligomer
cgguugcugacauggguuu

SEQ ID NO: 15486 - RNA, 19 nt, artificial
  Oligomer
accaaaaggcuagagguaa

SEQ ID NO: 15487 - RNA, 19 nt, artificial
  Oligomer
agaugguacaaaaugcuga

SEQ ID NO: 15488 - RNA, 19 nt, artificial
  Oligomer
acaucgcaacgcugaggau

SEQ ID NO: 15489 - RNA, 19 nt, artificial
  Oligomer
aaauuauaccuagcaacau

SEQ ID NO: 15490 - RNA, 19 nt, artificial
  Oligomer
guacaacuucaucgcagau

SEQ ID NO: 15491 - RNA, 19 nt, artificial
  Oligomer
ucugaaggagggugaaaac

SEQ ID NO: 15492 - RNA, 19 nt, artificial
  Oligomer
ugauuuuggaaacucugga

SEQ ID NO: 15493 - RNA, 19 nt, artificial
  Oligomer
agucccuuugcacugcaga

SEQ ID NO: 15494 - RNA, 19 nt, artificial
  Oligomer
gugaugaugcugacccuga

SEQ ID NO: 15495 - RNA, 19 nt, artificial
  Oligomer
gugcacuucugaaggacuu

SEQ ID NO: 15496 - RNA, 19 nt, artificial
  Oligomer
ugcagaacacgaucacauc

SEQ ID NO: 15497 - RNA, 19 nt, artificial
  Oligomer
ccacauccauagugcaugg

SEQ ID NO: 15498 - RNA, 19 nt, artificial
  Oligomer
uauugauuuuggaaacucu

SEQ ID NO: 15499 - RNA, 19 nt, artificial
  Oligomer
cacagaaugaauagaucac

SEQ ID NO: 15500 - RNA, 19 nt, artificial
  Oligomer
ucuauaucgagauccugga

SEQ ID NO: 15501 - RNA, 19 nt, artificial
  Oligomer
agauacuggagcugaccau

SEQ ID NO: 15502 - RNA, 19 nt, artificial
  Oligomer
caaagauucccaugcuugg

SEQ ID NO: 15503 - RNA, 19 nt, artificial
  Oligomer
uuugcacugcagaacacga

SEQ ID NO: 15504 - RNA, 19 nt, artificial
  Oligomer
cuuucccgauguucagcau

SEQ ID NO: 15505 - RNA, 19 nt, artificial
  Oligomer
aaggagggugaaaacuucu

SEQ ID NO: 15506 - RNA, 19 nt, artificial
  Oligomer
agcaaagauucccaugcuu

SEQ ID NO: 15507 - RNA, 19 nt, artificial
  Oligomer
ugccguggucuauaucgag

SEQ ID NO: 15508 - RNA, 19 nt, artificial
  Oligomer
uuuugugggcaguuaguca

SEQ ID NO: 15509 - RNA, 19 nt, artificial
  Oligomer
gaggcuccugcucugauuu

SEQ ID NO: 15510 - RNA, 19 nt, artificial
  Oligomer
guacucauccauaaaguca

SEQ ID NO: 15511 - RNA, 19 nt, artificial
  Oligomer
gaacaccaugaaggucaca

SEQ ID NO: 15512 - RNA, 19 nt, artificial
  Oligomer
accaagcuuucccgauguu

SEQ ID NO: 15513 - RNA, 19 nt, artificial
  Oligomer
gcugaagauguuuaugaag

SEQ ID NO: 15514 - RNA, 19 nt, artificial
  Oligomer
ccuuugcacugcagaacac

SEQ ID NO: 15515 - RNA, 19 nt, artificial
  Oligomer
aagaaucacagaaacacuu

SEQ ID NO: 15516 - RNA, 19 nt, artificial
  Oligomer
gaaacacugaccuuauaug

SEQ ID NO: 15517 - RNA, 19 nt, artificial
  Oligomer
gagauacuggagcugacca

SEQ ID NO: 15518 - RNA, 19 nt, artificial
  Oligomer
agggaagcuccauaacugc

SEQ ID NO: 15519 - RNA, 19 nt, artificial
  Oligomer
gcugaggauucagacuaag

SEQ ID NO: 15520 - RNA, 19 nt, artificial
  Oligomer
gcugacgucaggaacuucu

SEQ ID NO: 15521 - RNA, 19 nt, artificial
  Oligomer
cacugaccuuauaugugac

SEQ ID NO: 15522 - RNA, 19 nt, artificial
  Oligomer
aggcuagagguaaagcugu

SEQ ID NO: 15523 - RNA, 19 nt, artificial
  Oligomer
uugcacugcagaacacgau

SEQ ID NO: 15524 - RNA, 19 nt, artificial
  Oligomer
acauggguuucuugguaag

SEQ ID NO: 15525 - RNA, 19 nt, artificial
  Oligomer
gaaggucacagcuggaauc

SEQ ID NO: 15526 - RNA, 19 nt, artificial
  Oligomer
cagugcuguuguuguugug

SEQ ID NO: 15527 - RNA, 19 nt, artificial
  Oligomer
gaggauucagacuaaggag

SEQ ID NO: 15528 - RNA, 19 nt, artificial
  Oligomer
acaacuucaucgcagaugu

SEQ ID NO: 15529 - RNA, 19 nt, artificial
  Oligomer
gggaaaagaagaauuccuc

SEQ ID NO: 15530 - RNA, 19 nt, artificial
  Oligomer
cugacauggguuucuuggu

SEQ ID NO: 15531 - RNA, 19 nt, artificial
  Oligomer
gagaguuucugcaucgugg

SEQ ID NO: 15532 - RNA, 19 nt, artificial
  Oligomer
aaaacuucugcuugacagu

SEQ ID NO: 15533 - RNA, 19 nt, artificial
  Oligomer
ucuuuugugggcaguuagu

SEQ ID NO: 15534 - RNA, 19 nt, artificial
  Oligomer
gucacagaaugaauagauc

SEQ ID NO: 15535 - RNA, 19 nt, artificial
  Oligomer
cacugcagaacacgaucac

SEQ ID NO: 15536 - RNA, 19 nt, artificial
  Oligomer
auuauaccuagcaacauau

SEQ ID NO: 15537 - RNA, 19 nt, artificial
  Oligomer
augaaggucacagcuggaa

SEQ ID NO: 15538 - RNA, 19 nt, artificial
  Oligomer
gauuggagugaacaccaug

SEQ ID NO: 15539 - RNA, 19 nt, artificial
  Oligomer
ucccgauguucagcauggu

SEQ ID NO: 15540 - RNA, 19 nt, artificial
  Oligomer
cguggucuauaucgagauc

SEQ ID NO: 15541 - RNA, 19 nt, artificial
  Oligomer
aauuccuccuccggaauca

SEQ ID NO: 15542 - RNA, 19 nt, artificial
  Oligomer
cauccauaaagucauccug

SEQ ID NO: 15543 - RNA, 19 nt, artificial
  Oligomer
cggccuggugaugugauuu

SEQ ID NO: 15544 - RNA, 19 nt, artificial
  Oligomer
aaacacugaccuuauaugu

SEQ ID NO: 15545 - RNA, 19 nt, artificial
  Oligomer
ucugaagaaucacagaaac

SEQ ID NO: 15546 - RNA, 19 nt, artificial
  Oligomer
agaauuccuccuccggaau

SEQ ID NO: 15547 - RNA, 19 nt, artificial
  Oligomer
ucaccaagaguaugaggcu

SEQ ID NO: 15548 - RNA, 19 nt, artificial
  Oligomer
cacuucugaaggacuucag

SEQ ID NO: 15549 - RNA, 19 nt, artificial
  Oligomer
ugggagcaaagauucccau

SEQ ID NO: 15550 - RNA, 19 nt, artificial
  Oligomer
agggugaaaacuucugcuu

SEQ ID NO: 15551 - RNA, 19 nt, artificial
  Oligomer
aggugcugcucuuuguggu

SEQ ID NO: 15552 - RNA, 19 nt, artificial
  Oligomer
agcuauugauuuuggaaac

SEQ ID NO: 15553 - RNA, 19 nt, artificial
  Oligomer
ugugguggagaagacagca

SEQ ID NO: 15554 - RNA, 19 nt, artificial
  Oligomer
uccuauuaaagaaaaugag

SEQ ID NO: 15555 - RNA, 19 nt, artificial
  Oligomer
cugacgucaggaacuucug

SEQ ID NO: 15556 - RNA, 19 nt, artificial
  Oligomer
cacgaucacauccggcauu

SEQ ID NO: 15557 - RNA, 19 nt, artificial
  Oligomer
gaucaccaagaguaugagg

SEQ ID NO: 15558 - RNA, 19 nt, artificial
  Oligomer
cgagaguuucugcaucgug

SEQ ID NO: 15559 - RNA, 19 nt, artificial
  Oligomer
cugaaggagggugaaaacu

SEQ ID NO: 15560 - RNA, 19 nt, artificial
  Oligomer
aggguuaaaugaaccagug

SEQ ID NO: 15561 - RNA, 19 nt, artificial
  Oligomer
cugaugcagcuauugauuu

SEQ ID NO: 15562 - RNA, 19 nt, artificial
  Oligomer
ugggaagucccuuugcacu

SEQ ID NO: 15563 - RNA, 19 nt, artificial
  Oligomer
caaaaggcuagagguaaag

SEQ ID NO: 15564 - RNA, 19 nt, artificial
  Oligomer
cugggcucugaagaaucac

SEQ ID NO: 15565 - RNA, 19 nt, artificial
  Oligomer
gagucaguacaacuucauc

SEQ ID NO: 15566 - RNA, 19 nt, artificial
  Oligomer
gcuagagguaaagcuguau

SEQ ID NO: 15567 - RNA, 19 nt, artificial
  Oligomer
aauaaaauuauaccuagca

SEQ ID NO: 15568 - RNA, 19 nt, artificial
  Oligomer
ccaucuuuugugggcaguu

SEQ ID NO: 15569 - RNA, 19 nt, artificial
  Oligomer
ugggcucauugucaccaac

SEQ ID NO: 15570 - RNA, 19 nt, artificial
  Oligomer
ggcuacagauacugacagc

SEQ ID NO: 15571 - RNA, 19 nt, artificial
  Oligomer
gcacuucugaaggacuuca

SEQ ID NO: 15572 - RNA, 19 nt, artificial
  Oligomer
uucugaaggacuucaggua

SEQ ID NO: 15573 - RNA, 19 nt, artificial
  Oligomer
cagcuggaaucuccuuugc

SEQ ID NO: 15574 - RNA, 19 nt, artificial
  Oligomer
ggccuggugaugugauuuu

SEQ ID NO: 15575 - RNA, 19 nt, artificial
  Oligomer
ccggagucaguacaacuuc

SEQ ID NO: 15576 - RNA, 19 nt, artificial
  Oligomer
ucugaugagugcgguugcu

SEQ ID NO: 15577 - RNA, 19 nt, artificial
  Oligomer
caacuucaucgcagaugug

SEQ ID NO: 15578 - RNA, 19 nt, artificial
  Oligomer
ggagggugaaaacuucugc

SEQ ID NO: 15579 - RNA, 19 nt, artificial
  Oligomer
caguacaacuucaucgcag

SEQ ID NO: 15580 - RNA, 19 nt, artificial
  Oligomer
cugauuuccuccuugccuu

SEQ ID NO: 15581 - RNA, 19 nt, artificial
  Oligomer
ugcugaacuacagcuucga

SEQ ID NO: 15582 - RNA, 19 nt, artificial
  Oligomer
auagugcauggucugauga

SEQ ID NO: 15583 - RNA, 19 nt, artificial
  Oligomer
aaaggcuagagguaaagcu

SEQ ID NO: 15584 - RNA, 19 nt, artificial
  Oligomer
ggagugaacaccaugaagg

SEQ ID NO: 15585 - RNA, 19 nt, artificial
  Oligomer
augagugcgguugcugaca

SEQ ID NO: 15586 - RNA, 19 nt, artificial
  Oligomer
aucucgaacggcucaggau

SEQ ID NO: 15587 - RNA, 19 nt, artificial
  Oligomer
ucaguacaacuucaucgca

SEQ ID NO: 15588 - RNA, 19 nt, artificial
  Oligomer
acaguuccacauccauagu

SEQ ID NO: 15589 - RNA, 19 nt, artificial
  Oligomer
caaaaugcugaagauguuu

SEQ ID NO: 15590 - RNA, 19 nt, artificial
  Oligomer
acgagcaguaggaagcagu

SEQ ID NO: 15591 - RNA, 19 nt, artificial
  Oligomer
ggucuauaucgagauccug

SEQ ID NO: 15592 - RNA, 19 nt, artificial
  Oligomer
uacuggagcugaccauccu

SEQ ID NO: 15593 - RNA, 19 nt, artificial
  Oligomer
uccgugugagacugcuaag

SEQ ID NO: 15594 - RNA, 19 nt, artificial
  Oligomer
uuauaccuagcaacauauu

SEQ ID NO: 15595 - RNA, 19 nt, artificial
  Oligomer
uguucgaacccaaucccag

SEQ ID NO: 15596 - RNA, 19 nt, artificial
  Oligomer
ucacauccggcauuguuag

SEQ ID NO: 15597 - RNA, 19 nt, artificial
  Oligomer
acgcugaggauucagacua

SEQ ID NO: 15598 - RNA, 19 nt, artificial
  Oligomer
gcuccugcucugauuuccu

SEQ ID NO: 15599 - RNA, 19 nt, artificial
  Oligomer
ccuggugaugugauuuugg

SEQ ID NO: 15600 - RNA, 19 nt, artificial
  Oligomer
agaaucacagaaacacuuu

SEQ ID NO: 15601 - RNA, 19 nt, artificial
  Oligomer
caaacugaugcagcuauug

SEQ ID NO: 15602 - RNA, 19 nt, artificial
  Oligomer
gugaaaacuucugcuugac

SEQ ID NO: 15603 - RNA, 19 nt, artificial
  Oligomer
gugaacaccaugaagguca

SEQ ID NO: 15604 - RNA, 19 nt, artificial
  Oligomer
uagugcauggucugaugag

SEQ ID NO: 15605 - RNA, 19 nt, artificial
  Oligomer
gcagugcuguuguuguugu

SEQ ID NO: 15606 - RNA, 19 nt, artificial
  Oligomer
cugaacuacagcuucgaga

SEQ ID NO: 15607 - RNA, 19 nt, artificial
  Oligomer
ccaaaccaauguggaauac

SEQ ID NO: 15608 - RNA, 19 nt, artificial
  Oligomer
acucauccauaaagucauc

SEQ ID NO: 15609 - RNA, 19 nt, artificial
  Oligomer
auguggaauacauucaaac

SEQ ID NO: 15610 - RNA, 19 nt, artificial
  Oligomer
augcugaagauguuuauga

SEQ ID NO: 15611 - RNA, 19 nt, artificial
  Oligomer
gagcagaugguacaaaaug

SEQ ID NO: 15612 - RNA, 19 nt, artificial
  Oligomer
ucucgaacggcucaggauu

SEQ ID NO: 15613 - RNA, 19 nt, artificial
  Oligomer
uucugaucgucuucgagag

SEQ ID NO: 15614 - RNA, 19 nt, artificial
  Oligomer
ucauugucaccaacgccca

SEQ ID NO: 15615 - RNA, 19 nt, artificial
  Oligomer
accuagcaacauauuauag

SEQ ID NO: 15616 - RNA, 19 nt, artificial
  Oligomer
uccugaccuccuauuaaag

SEQ ID NO: 15617 - RNA, 19 nt, artificial
  Oligomer
acuucaucgcagauguggu

SEQ ID NO: 15618 - RNA, 19 nt, artificial
  Oligomer
cuauuaaagaaaaugagcu

SEQ ID NO: 15619 - RNA, 19 nt, artificial
  Oligomer
guaagcuccugagguaaug

SEQ ID NO: 15620 - RNA, 19 nt, artificial
  Oligomer
gcuuucccgauguucagca

SEQ ID NO: 15621 - RNA, 19 nt, artificial
  Oligomer
cuugguaagcuccugaggu

SEQ ID NO: 15622 - RNA, 19 nt, artificial
  Oligomer
ugcucuuugugguguggug

SEQ ID NO: 15623 - RNA, 19 nt, artificial
  Oligomer
uaucucgaacggcucagga

SEQ ID NO: 15624 - RNA, 19 nt, artificial
  Oligomer
gcuugacaguuccacaucc

SEQ ID NO: 15625 - RNA, 19 nt, artificial
  Oligomer
auucaaacugaugcagcua

SEQ ID NO: 15626 - RNA, 19 nt, artificial
  Oligomer
gccuggugaugugauuuug

SEQ ID NO: 15627 - RNA, 19 nt, artificial
  Oligomer
augggaagucccuuugcac

SEQ ID NO: 15628 - RNA, 19 nt, artificial
  Oligomer
ggaaaagaagaauuccucc

SEQ ID NO: 15629 - RNA, 19 nt, artificial
  Oligomer
guggaauacauucaaacug

SEQ ID NO: 15630 - RNA, 19 nt, artificial
  Oligomer
cacagcuggaaucuccuuu

SEQ ID NO: 15631 - RNA, 19 nt, artificial
  Oligomer
auagaucaccaagaguaug

SEQ ID NO: 15632 - RNA, 19 nt, artificial
  Oligomer
agcagaugguacaaaaugc

SEQ ID NO: 15633 - RNA, 19 nt, artificial
  Oligomer
gugcauggucugaugagug

SEQ ID NO: 15634 - RNA, 19 nt, artificial
  Oligomer
ccuccuauuaaagaaaaug

SEQ ID NO: 15635 - RNA, 19 nt, artificial
  Oligomer
ugguacaaaaugcugaaga

SEQ ID NO: 15636 - RNA, 19 nt, artificial
  Oligomer
agaacacgaucacauccgg

SEQ ID NO: 15637 - RNA, 19 nt, artificial
  Oligomer
gguuucuugguaagcuccu

SEQ ID NO: 15638 - RNA, 19 nt, artificial
  Oligomer
uggguuucuugguaagcuc

SEQ ID NO: 15639 - RNA, 19 nt, artificial
  Oligomer
uguucagcaugguguacuc

SEQ ID NO: 15640 - RNA, 19 nt, artificial
  Oligomer
gaaaagaagaauuccuccu

SEQ ID NO: 15641 - RNA, 19 nt, artificial
  Oligomer
gucuucgagaguuucugca

SEQ ID NO: 15642 - RNA, 19 nt, artificial
  Oligomer
agcaguaggaagcagucac

SEQ ID NO: 15643 - RNA, 19 nt, artificial
  Oligomer
aacacgaucacauccggca

SEQ ID NO: 15644 - RNA, 19 nt, artificial
  Oligomer
aaggcuagagguaaagcug

SEQ ID NO: 15645 - RNA, 19 nt, artificial
  Oligomer
aaaaugcugaagauguuua

SEQ ID NO: 15646 - RNA, 19 nt, artificial
  Oligomer
gcugaacuacagcuucgag

SEQ ID NO: 15647 - RNA, 19 nt, artificial
  Oligomer
aacgcugaggauucagacu

SEQ ID NO: 15648 - RNA, 19 nt, artificial
  Oligomer
gcuauugauuuuggaaacu

SEQ ID NO: 15649 - RNA, 19 nt, artificial
  Oligomer
aggagggugaaaacuucug

SEQ ID NO: 15650 - RNA, 19 nt, artificial
  Oligomer
ugaagaaucacagaaacac

SEQ ID NO: 15651 - RNA, 19 nt, artificial
  Oligomer
ucacagcuggaaucuccuu

SEQ ID NO: 15652 - RNA, 19 nt, artificial
  Oligomer
ggaagcuccauaacugcug

SEQ ID NO: 15653 - RNA, 19 nt, artificial
  Oligomer
acaccaugaaggucacagc

SEQ ID NO: 15654 - RNA, 19 nt, artificial
  Oligomer
ucagcaugguguacucauc

SEQ ID NO: 15655 - RNA, 19 nt, artificial
  Oligomer
ccauaaagucauccugggc

SEQ ID NO: 15656 - RNA, 19 nt, artificial
  Oligomer
cuucugaaggacuucaggu

SEQ ID NO: 15657 - RNA, 19 nt, artificial
  Oligomer
ccgauguucagcauggugu

SEQ ID NO: 15658 - RNA, 19 nt, artificial
  Oligomer
gcagaacacgaucacaucc

SEQ ID NO: 15659 - RNA, 19 nt, artificial
  Oligomer
ggguuaaaugaaccagugg

SEQ ID NO: 15660 - RNA, 19 nt, artificial
  Oligomer
acuucugcuugacaguucc

SEQ ID NO: 15661 - RNA, 19 nt, artificial
  Oligomer
ugcugacauggguuucuug

SEQ ID NO: 15662 - RNA, 19 nt, artificial
  Oligomer
augaggcuccugcucugau

SEQ ID NO: 15663 - RNA, 19 nt, artificial
  Oligomer
aaauaaaauuauaccuagc

SEQ ID NO: 15664 - RNA, 19 nt, artificial
  Oligomer
uguuagcucugcucagcgu

SEQ ID NO: 15665 - RNA, 19 nt, artificial
  Oligomer
cauccggcauuguuagcuc

SEQ ID NO: 15666 - RNA, 19 nt, artificial
  Oligomer
uacagauacugacagcugg

SEQ ID NO: 15667 - RNA, 19 nt, artificial
  Oligomer
ccaucccuucugaucgucu

SEQ ID NO: 15668 - RNA, 19 nt, artificial
  Oligomer
ucgagaguuucugcaucgu

SEQ ID NO: 15669 - RNA, 19 nt, artificial
  Oligomer
aaucacagaaacacuuuuu

SEQ ID NO: 15670 - RNA, 19 nt, artificial
  Oligomer
uccauaaagucauccuggg

SEQ ID NO: 15671 - RNA, 19 nt, artificial
  Oligomer
cgucuucgagaguuucugc

SEQ ID NO: 15672 - RNA, 19 nt, artificial
  Oligomer
ccuauuaaagaaaaugagc

SEQ ID NO: 15673 - RNA, 19 nt, artificial
  Oligomer
gaugugguggagaagacag

SEQ ID NO: 15674 - RNA, 19 nt, artificial
  Oligomer
ucuucgagaguuucugcau

SEQ ID NO: 15675 - RNA, 19 nt, artificial
  Oligomer
ucaggugcugcucuuugug

SEQ ID NO: 15676 - RNA, 19 nt, artificial
  Oligomer
aagucccuuugcacugcag

SEQ ID NO: 15677 - RNA, 19 nt, artificial
  Oligomer
cuacagauacugacagcug

SEQ ID NO: 15678 - RNA, 19 nt, artificial
  Oligomer
gcuacagauacugacagcu

SEQ ID NO: 15679 - RNA, 19 nt, artificial
  Oligomer
uuaccggugcgagucaaag

SEQ ID NO: 15680 - RNA, 19 nt, artificial
  Oligomer
caucgcaacgcugaggauu

SEQ ID NO: 15681 - RNA, 19 nt, artificial
  Oligomer
uccauagugcauggucuga

SEQ ID NO: 15682 - RNA, 19 nt, artificial
  Oligomer
gaacuacagcuucgagaac

SEQ ID NO: 15683 - RNA, 19 nt, artificial
  Oligomer
gaagcuccauaacugcugc

SEQ ID NO: 15684 - RNA, 19 nt, artificial
  Oligomer
gaauacauucaaacugaug

SEQ ID NO: 15685 - RNA, 19 nt, artificial
  Oligomer
gcuccauaacugcugcuuc

SEQ ID NO: 15686 - RNA, 19 nt, artificial
  Oligomer
cugaggauucagacuaagg

SEQ ID NO: 15687 - RNA, 19 nt, artificial
  Oligomer
ccuugcugaacuacagcuu

SEQ ID NO: 15688 - RNA, 19 nt, artificial
  Oligomer
acagcuucgagaaccaagc

SEQ ID NO: 15689 - RNA, 19 nt, artificial
  Oligomer
ucaucgcagauguggugga

SEQ ID NO: 15690 - RNA, 19 nt, artificial
  Oligomer
ccaagcuuucccgauguuc

SEQ ID NO: 15691 - RNA, 19 nt, artificial
  Oligomer
ggugauuggagugaacacc

SEQ ID NO: 15692 - RNA, 19 nt, artificial
  Oligomer
ugugggcaguuagucaggu

SEQ ID NO: 15693 - RNA, 19 nt, artificial
  Oligomer
aggucacagcuggaaucuc

SEQ ID NO: 15694 - RNA, 19 nt, artificial
  Oligomer
gauuuuggaaacucuggag

SEQ ID NO: 15695 - RNA, 19 nt, artificial
  Oligomer
gggagcaaagauucccaug

SEQ ID NO: 15696 - RNA, 19 nt, artificial
  Oligomer
ugcacugcagaacacgauc

SEQ ID NO: 15697 - RNA, 19 nt, artificial
  Oligomer
aucuuuugugggcaguuag

SEQ ID NO: 15698 - RNA, 19 nt, artificial
  Oligomer
acagcuggaaucuccuuug

SEQ ID NO: 15699 - RNA, 19 nt, artificial
  Oligomer
cugcucugauuuccuccuu

SEQ ID NO: 15700 - RNA, 19 nt, artificial
  Oligomer
uuucuugguaagcuccuga

SEQ ID NO: 15701 - RNA, 19 nt, artificial
  Oligomer
gauucagacuaaggagccu

SEQ ID NO: 15702 - RNA, 19 nt, artificial
  Oligomer
ccauaacugcugcuucagg

SEQ ID NO: 15703 - RNA, 19 nt, artificial
  Oligomer
gaugcagcuauugauuuug

SEQ ID NO: 15704 - RNA, 19 nt, artificial
  Oligomer
uaaagaaaaugagcugcug

SEQ ID NO: 15705 - RNA, 19 nt, artificial
  Oligomer
gugcuguuguuguuguggg

SEQ ID NO: 15706 - RNA, 19 nt, artificial
  Oligomer
acuucugaaggacuucagg

SEQ ID NO: 15707 - RNA, 19 nt, artificial
  Oligomer
uguacucauccauaaaguc

SEQ ID NO: 15708 - RNA, 19 nt, artificial
  Oligomer
gaugggcucauugucacca

SEQ ID NO: 15709 - RNA, 19 nt, artificial
  Oligomer
uucaaacugaugcagcuau

SEQ ID NO: 15710 - RNA, 19 nt, artificial
  Oligomer
ggcauuguuagcucugcuc

SEQ ID NO: 15711 - RNA, 19 nt, artificial
  Oligomer
ucauccauaaagucauccu

SEQ ID NO: 15712 - RNA, 19 nt, artificial
  Oligomer
gacgucaggaacuucugac

SEQ ID NO: 15713 - RNA, 19 nt, artificial
  Oligomer
auccggcauuguuagcucu

SEQ ID NO: 15714 - RNA, 19 nt, artificial
  Oligomer
uccugggcucugaagaauc

SEQ ID NO: 15715 - RNA, 19 nt, artificial
  Oligomer
agcuucgagaaccaagcuu

SEQ ID NO: 15716 - RNA, 19 nt, artificial
  Oligomer
cagcaugguguacucaucc

SEQ ID NO: 15717 - RNA, 19 nt, artificial
  Oligomer
ccucagagaacucuggaac

SEQ ID NO: 15718 - RNA, 19 nt, artificial
  Oligomer
aagaagaauuccuccuccg

SEQ ID NO: 15719 - RNA, 19 nt, artificial
  Oligomer
aucgcagaugugguggaga

SEQ ID NO: 15720 - RNA, 19 nt, artificial
  Oligomer
uugcugacauggguuucuu

SEQ ID NO: 15721 - RNA, 19 nt, artificial
  Oligomer
uuagucaggugcugcucuu

SEQ ID NO: 15722 - RNA, 19 nt, artificial
  Oligomer
agaguuucugcaucguggg

SEQ ID NO: 15723 - RNA, 19 nt, artificial
  Oligomer
ugauuuccuccuugccuuu

SEQ ID NO: 15724 - RNA, 19 nt, artificial
  Oligomer
auggguuucuugguaagcu

SEQ ID NO: 15725 - RNA, 19 nt, artificial
  Oligomer
uuagucugaauccucagcg

SEQ ID NO: 15726 - RNA, 19 nt, artificial
  Oligomer
uuuuacuauaauauguugc

SEQ ID NO: 15727 - RNA, 19 nt, artificial
  Oligomer
uauaaggucaguguuucuc

SEQ ID NO: 15728 - RNA, 19 nt, artificial
  Oligomer
uuuuguaccaucugcuccc

SEQ ID NO: 15729 - RNA, 19 nt, artificial
  Oligomer
uugaauguauuccacauug

SEQ ID NO: 15730 - RNA, 19 nt, artificial
  Oligomer
auaaggucaguguuucucg

SEQ ID NO: 15731 - RNA, 19 nt, artificial
  Oligomer
uuuaccucuagccuuuugg

SEQ ID NO: 15732 - RNA, 19 nt, artificial
  Oligomer
uucacuccaaucaccuccc

SEQ ID NO: 15733 - RNA, 19 nt, artificial
  Oligomer
ugaaguuguacugacuccg

SEQ ID NO: 15734 - RNA, 19 nt, artificial
  Oligomer
uuauggagcuucccucagg

SEQ ID NO: 15735 - RNA, 19 nt, artificial
  Oligomer
uucauaaacaucuucagca

SEQ ID NO: 15736 - RNA, 19 nt, artificial
  Oligomer
uacaccaugcugaacaucg

SEQ ID NO: 15737 - RNA, 19 nt, artificial
  Oligomer
ucaagcagaaguuuucacc

SEQ ID NO: 15738 - RNA, 19 nt, artificial
  Oligomer
auguauuccacauugguuu

SEQ ID NO: 15739 - RNA, 19 nt, artificial
  Oligomer
uuuauggaugaguacacca

SEQ ID NO: 15740 - RNA, 19 nt, artificial
  Oligomer
ucugugauucuucagagcc

SEQ ID NO: 15741 - RNA, 19 nt, artificial
  Oligomer
uuaacccucugucucggug

SEQ ID NO: 15742 - RNA, 19 nt, artificial
  Oligomer
ucauuuaacccucugucuc

SEQ ID NO: 15743 - RNA, 19 nt, artificial
  Oligomer
ugauucuucagagcccagg

SEQ ID NO: 15744 - RNA, 19 nt, artificial
  Oligomer
uuccaaaaucaauagcugc

SEQ ID NO: 15745 - RNA, 19 nt, artificial
  Oligomer
aucaguuugaauguauucc

SEQ ID NO: 15746 - RNA, 19 nt, artificial
  Oligomer
uaguucagcaaggaugcug

SEQ ID NO: 15747 - RNA, 19 nt, artificial
  Oligomer
uggugaucuauucauucug

SEQ ID NO: 15748 - RNA, 19 nt, artificial
  Oligomer
uccagcugugaccuucaug

SEQ ID NO: 15749 - RNA, 19 nt, artificial
  Oligomer
uucauuuaacccucugucu

SEQ ID NO: 15750 - RNA, 19 nt, artificial
  Oligomer
auuggguucgaacagcuuc

SEQ ID NO: 15751 - RNA, 19 nt, artificial
  Oligomer
uacagcuuuaccucuagcc

SEQ ID NO: 15752 - RNA, 19 nt, artificial
  Oligomer
ucauucugugaccucaggg

SEQ ID NO: 15753 - RNA, 19 nt, artificial
  Oligomer
auuuuguaccaucugcucc

SEQ ID NO: 15754 - RNA, 19 nt, artificial
  Oligomer
guucacuccaaucaccucc

SEQ ID NO: 15755 - RNA, 19 nt, artificial
  Oligomer
uauauaaaaaguguuucug

SEQ ID NO: 15756 - RNA, 19 nt, artificial
  Oligomer
uucagcauuuuguaccauc

SEQ ID NO: 15757 - RNA, 19 nt, artificial
  Oligomer
uuugaauguauuccacauu

SEQ ID NO: 15758 - RNA, 19 nt, artificial
  Oligomer
uacuauaauauguugcuag

SEQ ID NO: 15759 - RNA, 19 nt, artificial
  Oligomer
uucuucagagcccaggagu

SEQ ID NO: 15760 - RNA, 19 nt, artificial
  Oligomer
uuaauaggaggucaggaug

SEQ ID NO: 15761 - RNA, 19 nt, artificial
  Oligomer
uauggaugaguacaccaug

SEQ ID NO: 15762 - RNA, 19 nt, artificial
  Oligomer
aucuucagcauuuuguacc

SEQ ID NO: 15763 - RNA, 19 nt, artificial
  Oligomer
ugaacaucgggaaagcuug

SEQ ID NO: 15764 - RNA, 19 nt, artificial
  Oligomer
uauaaaaaguguuucugug

SEQ ID NO: 15765 - RNA, 19 nt, artificial
  Oligomer
uuuccaaaaucaauagcug

SEQ ID NO: 15766 - RNA, 19 nt, artificial
  Oligomer
uuucugugauucuucagag

SEQ ID NO: 15767 - RNA, 19 nt, artificial
  Oligomer
uuugacucgcaccgguaag

SEQ ID NO: 15768 - RNA, 19 nt, artificial
  Oligomer
uucugcagugcaaagggac

SEQ ID NO: 15769 - RNA, 19 nt, artificial
  Oligomer
auacucuuggugaucuauu

SEQ ID NO: 15770 - RNA, 19 nt, artificial
  Oligomer
ugcaaagggacuucccaug

SEQ ID NO: 15771 - RNA, 19 nt, artificial
  Oligomer
uuauggaugaguacaccau

SEQ ID NO: 15772 - RNA, 19 nt, artificial
  Oligomer
aucaauagcugcaucaguu

SEQ ID NO: 15773 - RNA, 19 nt, artificial
  Oligomer
uuuucacccuccuucagag

SEQ ID NO: 15774 - RNA, 19 nt, artificial
  Oligomer
uuggugaucuauucauucu

SEQ ID NO: 15775 - RNA, 19 nt, artificial
  Oligomer
uucuuuaauaggaggucag

SEQ ID NO: 15776 - RNA, 19 nt, artificial
  Oligomer
uuuacuauaauauguugcu

SEQ ID NO: 15777 - RNA, 19 nt, artificial
  Oligomer
uuuucuuuaauaggagguc

SEQ ID NO: 15778 - RNA, 19 nt, artificial
  Oligomer
uacucuuggugaucuauuc

SEQ ID NO: 15779 - RNA, 19 nt, artificial
  Oligomer
uauaauauguugcuaggua

SEQ ID NO: 15780 - RNA, 19 nt, artificial
  Oligomer
accuucaugguguucacuc

SEQ ID NO: 15781 - RNA, 19 nt, artificial
  Oligomer
uuucacccuccuucagagg

SEQ ID NO: 15782 - RNA, 19 nt, artificial
  Oligomer
uuccggaggaggaauucuu

SEQ ID NO: 15783 - RNA, 19 nt, artificial
  Oligomer
uauguugcuagguauaauu

SEQ ID NO: 15784 - RNA, 19 nt, artificial
  Oligomer
auuuaacccucugucucgg

SEQ ID NO: 15785 - RNA, 19 nt, artificial
  Oligomer
uuggguucgaacagcuuca

SEQ ID NO: 15786 - RNA, 19 nt, artificial
  Oligomer
uuagcagucucacacggac

SEQ ID NO: 15787 - RNA, 19 nt, artificial
  Oligomer
uaggaggucaggaugguca

SEQ ID NO: 15788 - RNA, 19 nt, artificial
  Oligomer
agcagagcuaacaaugccg

SEQ ID NO: 15789 - RNA, 19 nt, artificial
  Oligomer
uccaaaaucaauagcugca

SEQ ID NO: 15790 - RNA, 19 nt, artificial
  Oligomer
caguuauggagcuucccuc

SEQ ID NO: 15791 - RNA, 19 nt, artificial
  Oligomer
ucaguuugaauguauucca

SEQ ID NO: 15792 - RNA, 19 nt, artificial
  Oligomer
ucagcaaccgcacucauca

SEQ ID NO: 15793 - RNA, 19 nt, artificial
  Oligomer
ucgaagacgaucagaaggg

SEQ ID NO: 15794 - RNA, 19 nt, artificial
  Oligomer
ucgauauagaccacggcag

SEQ ID NO: 15795 - RNA, 19 nt, artificial
  Oligomer
aguguuucugugauucuuc

SEQ ID NO: 15796 - RNA, 19 nt, artificial
  Oligomer
agcugcaucaguuugaaug

SEQ ID NO: 15797 - RNA, 19 nt, artificial
  Oligomer
uucugugauucuucagagc

SEQ ID NO: 15798 - RNA, 19 nt, artificial
  Oligomer
auauagaccacggcaggug

SEQ ID NO: 15799 - RNA, 19 nt, artificial
  Oligomer
uucaugguguucacuccaa

SEQ ID NO: 15800 - RNA, 19 nt, artificial
  Oligomer
uuuaacccucugucucggu

SEQ ID NO: 15801 - RNA, 19 nt, artificial
  Oligomer
uuuaauaggaggucaggau

SEQ ID NO: 15802 - RNA, 19 nt, artificial
  Oligomer
uauucauucugugaccuca

SEQ ID NO: 15803 - RNA, 19 nt, artificial
  Oligomer
uucauucugugaccucagg

SEQ ID NO: 15804 - RNA, 19 nt, artificial
  Oligomer
uucuccaccacaucugcga

SEQ ID NO: 15805 - RNA, 19 nt, artificial
  Oligomer
uuccagaguucucugaggc

SEQ ID NO: 15806 - RNA, 19 nt, artificial
  Oligomer
aacaacaacagcacugccc

SEQ ID NO: 15807 - RNA, 19 nt, artificial
  Oligomer
uauuccacauugguuuggg

SEQ ID NO: 15808 - RNA, 19 nt, artificial
  Oligomer
aacagcuucauaaacaucu

SEQ ID NO: 15809 - RNA, 19 nt, artificial
  Oligomer
auucauucugugaccucag

SEQ ID NO: 15810 - RNA, 19 nt, artificial
  Oligomer
ucuuugacucgcaccggua

SEQ ID NO: 15811 - RNA, 19 nt, artificial
  Oligomer
ucuuggugaucuauucauu

SEQ ID NO: 15812 - RNA, 19 nt, artificial
  Oligomer
aggucaguguuucucgucc

SEQ ID NO: 15813 - RNA, 19 nt, artificial
  Oligomer
cauuuaacccucugucucg

SEQ ID NO: 15814 - RNA, 19 nt, artificial
  Oligomer
gaaguuuucacccuccuuc

SEQ ID NO: 15815 - RNA, 19 nt, artificial
  Oligomer
cuuggugaucuauucauuc

SEQ ID NO: 15816 - RNA, 19 nt, artificial
  Oligomer
aucuauucauucugugacc

SEQ ID NO: 15817 - RNA, 19 nt, artificial
  Oligomer
ucugcgaugaaguuguacu

SEQ ID NO: 15818 - RNA, 19 nt, artificial
  Oligomer
augguguucacuccaauca

SEQ ID NO: 15819 - RNA, 19 nt, artificial
  Oligomer
uaccucuagccuuuuggug

SEQ ID NO: 15820 - RNA, 19 nt, artificial
  Oligomer
cucagggucagcaucauca

SEQ ID NO: 15821 - RNA, 19 nt, artificial
  Oligomer
ugaagcagcaguuauggag

SEQ ID NO: 15822 - RNA, 19 nt, artificial
  Oligomer
augaaguuguacugacucc

SEQ ID NO: 15823 - RNA, 19 nt, artificial
  Oligomer
aaguuguacugacuccggg

SEQ ID NO: 15824 - RNA, 19 nt, artificial
  Oligomer
uauggauguggaacuguca

SEQ ID NO: 15825 - RNA, 19 nt, artificial
  Oligomer
uuucuuuaauaggagguca

SEQ ID NO: 15826 - RNA, 19 nt, artificial
  Oligomer
ugugauucuucagagccca

SEQ ID NO: 15827 - RNA, 19 nt, artificial
  Oligomer
uguuucugugauucuucag

SEQ ID NO: 15828 - RNA, 19 nt, artificial
  Oligomer
uuaccaagaaacccauguc

SEQ ID NO: 15829 - RNA, 19 nt, artificial
  Oligomer
uccggaggaggaauucuuc

SEQ ID NO: 15830 - RNA, 19 nt, artificial
  Oligomer
uguucugcagugcaaaggg

SEQ ID NO: 15831 - RNA, 19 nt, artificial
  Oligomer
ucauuuucuuuaauaggag

SEQ ID NO: 15832 - RNA, 19 nt, artificial
  Oligomer
uaacugcccacaaaagaug

SEQ ID NO: 15833 - RNA, 19 nt, artificial
  Oligomer
aauguauuccacauugguu

SEQ ID NO: 15834 - RNA, 19 nt, artificial
  Oligomer
guucauuuaacccucuguc

SEQ ID NO: 15835 - RNA, 19 nt, artificial
  Oligomer
uugcuagguauaauuuuau

SEQ ID NO: 15836 - RNA, 19 nt, artificial
  Oligomer
ugguguucacuccaaucac

SEQ ID NO: 15837 - RNA, 19 nt, artificial
  Oligomer
ugguucauuuaacccucug

SEQ ID NO: 15838 - RNA, 19 nt, artificial
  Oligomer
auguggaacugucaagcag

SEQ ID NO: 15839 - RNA, 19 nt, artificial
  Oligomer
augugaucguguucugcag

SEQ ID NO: 15840 - RNA, 19 nt, artificial
  Oligomer
uuggugacaaugagcccau

SEQ ID NO: 15841 - RNA, 19 nt, artificial
  Oligomer
ucucgauauagaccacggc

SEQ ID NO: 15842 - RNA, 19 nt, artificial
  Oligomer
uguauuccacauugguuug

SEQ ID NO: 15843 - RNA, 19 nt, artificial
  Oligomer
aucucgauauagaccacgg

SEQ ID NO: 15844 - RNA, 19 nt, artificial
  Oligomer
auaaacaucuucagcauuu

SEQ ID NO: 15845 - RNA, 19 nt, artificial
  Oligomer
uugguucucgaagcuguag

SEQ ID NO: 15846 - RNA, 19 nt, artificial
  Oligomer
auggaugaguacaccaugc

SEQ ID NO: 15847 - RNA, 19 nt, artificial
  Oligomer
uggauguggaacugucaag

SEQ ID NO: 15848 - RNA, 19 nt, artificial
  Oligomer
aacaucuucagcauuuugu

SEQ ID NO: 15849 - RNA, 19 nt, artificial
  Oligomer
uguaguucagcaaggaugc

SEQ ID NO: 15850 - RNA, 19 nt, artificial
  Oligomer
ucuuuaauaggaggucagg

SEQ ID NO: 15851 - RNA, 19 nt, artificial
  Oligomer
ugucuucuccaccacaucu

SEQ ID NO: 15852 - RNA, 19 nt, artificial
  Oligomer
uaauaggaggucaggaugg

SEQ ID NO: 15853 - RNA, 19 nt, artificial
  Oligomer
agcagaaguuuucacccuc

SEQ ID NO: 15854 - RNA, 19 nt, artificial
  Oligomer
acugggauuggguucgaac

SEQ ID NO: 15855 - RNA, 19 nt, artificial
  Oligomer
ugguucucgaagcuguagu

SEQ ID NO: 15856 - RNA, 19 nt, artificial
  Oligomer
auuuucuuuaauaggaggu

SEQ ID NO: 15857 - RNA, 19 nt, artificial
  Oligomer
ugcacuauggauguggaac

SEQ ID NO: 15858 - RNA, 19 nt, artificial
  Oligomer
ugaauguauuccacauugg

SEQ ID NO: 15859 - RNA, 19 nt, artificial
  Oligomer
acuuuauggaugaguacac

SEQ ID NO: 15860 - RNA, 19 nt, artificial
  Oligomer
uguggaacugucaagcaga

SEQ ID NO: 15861 - RNA, 19 nt, artificial
  Oligomer
acaaugccggaugugaucg

SEQ ID NO: 15862 - RNA, 19 nt, artificial
  Oligomer
acaaagagcagcaccugac

SEQ ID NO: 15863 - RNA, 19 nt, artificial
  Oligomer
auuaccucaggagcuuacc

SEQ ID NO: 15864 - RNA, 19 nt, artificial
  Oligomer
uuaccucaggagcuuacca

SEQ ID NO: 15865 - RNA, 19 nt, artificial
  Oligomer
uccuuagucugaauccuca

SEQ ID NO: 15866 - RNA, 19 nt, artificial
  Oligomer
agaccaugcacuauggaug

SEQ ID NO: 15867 - RNA, 19 nt, artificial
  Oligomer
ucuauucauucugugaccu

SEQ ID NO: 15868 - RNA, 19 nt, artificial
  Oligomer
uccugaagcagcaguuaug

SEQ ID NO: 15869 - RNA, 19 nt, artificial
  Oligomer
auauaaaaaguguuucugu

SEQ ID NO: 15870 - RNA, 19 nt, artificial
  Oligomer
aguucagcaaggaugcugg

SEQ ID NO: 15871 - RNA, 19 nt, artificial
  Oligomer
uguucacuccaaucaccuc

SEQ ID NO: 15872 - RNA, 19 nt, artificial
  Oligomer
caucagaccaugcacuaug

SEQ ID NO: 15873 - RNA, 19 nt, artificial
  Oligomer
aaggucaguguuucucguc

SEQ ID NO: 15874 - RNA, 19 nt, artificial
  Oligomer
ucagaaguuccugacguca

SEQ ID NO: 15875 - RNA, 19 nt, artificial
  Oligomer
auuccagcugugaccuuca

SEQ ID NO: 15876 - RNA, 19 nt, artificial
  Oligomer
accucuagccuuuuggugg

SEQ ID NO: 15877 - RNA, 19 nt, artificial
  Oligomer
aggagccucauacucuugg

SEQ ID NO: 15878 - RNA, 19 nt, artificial
  Oligomer
ugggaaucuuugcucccag

SEQ ID NO: 15879 - RNA, 19 nt, artificial
  Oligomer
acugguucauuuaacccuc

SEQ ID NO: 15880 - RNA, 19 nt, artificial
  Oligomer
auaauauguugcuagguau

SEQ ID NO: 15881 - RNA, 19 nt, artificial
  Oligomer
ugugaucguguucugcagu

SEQ ID NO: 15882 - RNA, 19 nt, artificial
  Oligomer
aaaagauccagcccuccca

SEQ ID NO: 15883 - RNA, 19 nt, artificial
  Oligomer
agcaggagccucauacucu

SEQ ID NO: 15884 - RNA, 19 nt, artificial
  Oligomer
ucuucuccaccacaucugc

SEQ ID NO: 15885 - RNA, 19 nt, artificial
  Oligomer
cugugauucuucagagccc

SEQ ID NO: 15886 - RNA, 19 nt, artificial
  Oligomer
uagcagucucacacggacu

SEQ ID NO: 15887 - RNA, 19 nt, artificial
  Oligomer
ugacugcuuccuacugcuc

SEQ ID NO: 15888 - RNA, 19 nt, artificial
  Oligomer
cuucaugguguucacucca

SEQ ID NO: 15889 - RNA, 19 nt, artificial
  Oligomer
augggcguuggugacaaug

SEQ ID NO: 15890 - RNA, 19 nt, artificial
  Oligomer
ucgggaaagcuugguucuc

SEQ ID NO: 15891 - RNA, 19 nt, artificial
  Oligomer
ucaauagcugcaucaguuu

SEQ ID NO: 15892 - RNA, 19 nt, artificial
  Oligomer
ucugaauccucagcguugc

SEQ ID NO: 15893 - RNA, 19 nt, artificial
  Oligomer
acgaaugccgggaauugug

SEQ ID NO: 15894 - RNA, 19 nt, artificial
  Oligomer
uaccaagaaacccauguca

SEQ ID NO: 15895 - RNA, 19 nt, artificial
  Oligomer
ucacauauaaggucagugu

SEQ ID NO: 15896 - RNA, 19 nt, artificial
  Oligomer
ucgaacagcuucauaaaca

SEQ ID NO: 15897 - RNA, 19 nt, artificial
  Oligomer
aguuugaauguauuccaca

SEQ ID NO: 15898 - RNA, 19 nt, artificial
  Oligomer
aaaaucaauagcugcauca

SEQ ID NO: 15899 - RNA, 19 nt, artificial
  Oligomer
cuauucauucugugaccuc

SEQ ID NO: 15900 - RNA, 19 nt, artificial
  Oligomer
cucauacucuuggugaucu

SEQ ID NO: 15901 - RNA, 19 nt, artificial
  Oligomer
aguuauggagcuucccuca

SEQ ID NO: 15902 - RNA, 19 nt, artificial
  Oligomer
uaccucaggagcuuaccaa

SEQ ID NO: 15903 - RNA, 19 nt, artificial
  Oligomer
ucauacucuuggugaucua

SEQ ID NO: 15904 - RNA, 19 nt, artificial
  Oligomer
uugacucgcaccgguaaga

SEQ ID NO: 15905 - RNA, 19 nt, artificial
  Oligomer
uucgaacagcuucauaaac

SEQ ID NO: 15906 - RNA, 19 nt, artificial
  Oligomer
ucccaccucauuuuuuacu

SEQ ID NO: 15907 - RNA, 19 nt, artificial
  Oligomer
cugagcagagcuaacaaug

SEQ ID NO: 15908 - RNA, 19 nt, artificial
  Oligomer
ugggauuggguucgaacag

SEQ ID NO: 15909 - RNA, 19 nt, artificial
  Oligomer
auaaaaaguguuucuguga

SEQ ID NO: 15910 - RNA, 19 nt, artificial
  Oligomer
aauagcugcaucaguuuga

SEQ ID NO: 15911 - RNA, 19 nt, artificial
  Oligomer
cuguaguucagcaaggaug

SEQ ID NO: 15912 - RNA, 19 nt, artificial
  Oligomer
agcaugggaaucuuugcuc

SEQ ID NO: 15913 - RNA, 19 nt, artificial
  Oligomer
auauaaggucaguguuucu

SEQ ID NO: 15914 - RNA, 19 nt, artificial
  Oligomer
aaaaguguuucugugauuc

SEQ ID NO: 15915 - RNA, 19 nt, artificial
  Oligomer
aggaucucgauauagacca

SEQ ID NO: 15916 - RNA, 19 nt, artificial
  Oligomer
uaacaaugccggaugugau

SEQ ID NO: 15917 - RNA, 19 nt, artificial
  Oligomer
aaucagagcaggagccuca

SEQ ID NO: 15918 - RNA, 19 nt, artificial
  Oligomer
uucucgaagcuguaguuca

SEQ ID NO: 15919 - RNA, 19 nt, artificial
  Oligomer
uuacuauaauauguugcua

SEQ ID NO: 15920 - RNA, 19 nt, artificial
  Oligomer
augccgggaauuguggucu

SEQ ID NO: 15921 - RNA, 19 nt, artificial
  Oligomer
auucuucagagcccaggag

SEQ ID NO: 15922 - RNA, 19 nt, artificial
  Oligomer
ugucaagcagaaguuuuca

SEQ ID NO: 15923 - RNA, 19 nt, artificial
  Oligomer
guguucacuccaaucaccu

SEQ ID NO: 15924 - RNA, 19 nt, artificial
  Oligomer
ugcagugcaaagggacuuc

SEQ ID NO: 15925 - RNA, 19 nt, artificial
  Oligomer
uucagcaaggaugcuggga

SEQ ID NO: 15926 - RNA, 19 nt, artificial
  Oligomer
aagacgaucagaagggaug

SEQ ID NO: 15927 - RNA, 19 nt, artificial
  Oligomer
ugaucguguucugcagugc

SEQ ID NO: 15928 - RNA, 19 nt, artificial
  Oligomer
uaauauguugcuagguaua

SEQ ID NO: 15929 - RNA, 19 nt, artificial
  Oligomer
cugaacaucgggaaagcuu

SEQ ID NO: 15930 - RNA, 19 nt, artificial
  Oligomer
augacuuuauggaugagua

SEQ ID NO: 15931 - RNA, 19 nt, artificial
  Oligomer
uguugcuagguauaauuuu

SEQ ID NO: 15932 - RNA, 19 nt, artificial
  Oligomer
acggguuccagaguucucu

SEQ ID NO: 15933 - RNA, 19 nt, artificial
  Oligomer
aaguuuucacccuccuuca

SEQ ID NO: 15934 - RNA, 19 nt, artificial
  Oligomer
uggaacugucaagcagaag

SEQ ID NO: 15935 - RNA, 19 nt, artificial
  Oligomer
ugaauccucagcguugcga

SEQ ID NO: 15936 - RNA, 19 nt, artificial
  Oligomer
cucuuggugaucuauucau

SEQ ID NO: 15937 - RNA, 19 nt, artificial
  Oligomer
augucagcaaccgcacuca

SEQ ID NO: 15938 - RNA, 19 nt, artificial
  Oligomer
gucuucuccaccacaucug

SEQ ID NO: 15939 - RNA, 19 nt, artificial
  Oligomer
ugcaucaguuugaauguau

SEQ ID NO: 15940 - RNA, 19 nt, artificial
  Oligomer
caucgggaaagcuugguuc

SEQ ID NO: 15941 - RNA, 19 nt, artificial
  Oligomer
ugaucuauucauucuguga

SEQ ID NO: 15942 - RNA, 19 nt, artificial
  Oligomer
ucaugguguucacuccaau

SEQ ID NO: 15943 - RNA, 19 nt, artificial
  Oligomer
acucuuggugaucuauuca

SEQ ID NO: 15944 - RNA, 19 nt, artificial
  Oligomer
acuauaauauguugcuagg

SEQ ID NO: 15945 - RNA, 19 nt, artificial
  Oligomer
agcauuuuguaccaucugc

SEQ ID NO: 15946 - RNA, 19 nt, artificial
  Oligomer
cuauggauguggaacuguc

SEQ ID NO: 15947 - RNA, 19 nt, artificial
  Oligomer
aaucaauagcugcaucagu

SEQ ID NO: 15948 - RNA, 19 nt, artificial
  Oligomer
uaaggucaguguuucucgu

SEQ ID NO: 15949 - RNA, 19 nt, artificial
  Oligomer
aaccgcacucaucagacca

SEQ ID NO: 15950 - RNA, 19 nt, artificial
  Oligomer
agcaguuauggagcuuccc

SEQ ID NO: 15951 - RNA, 19 nt, artificial
  Oligomer
augccggaugugaucgugu

SEQ ID NO: 15952 - RNA, 19 nt, artificial
  Oligomer
aaagacuccgccuucccaa

SEQ ID NO: 15953 - RNA, 19 nt, artificial
  Oligomer
aacaaugccggaugugauc

SEQ ID NO: 15954 - RNA, 19 nt, artificial
  Oligomer
auaggaggucaggaugguc

SEQ ID NO: 15955 - RNA, 19 nt, artificial
  Oligomer
ucauacgugucgccgcuua

SEQ ID NO: 15956 - RNA, 19 nt, artificial
  Oligomer
acucaucagaccaugcacu

SEQ ID NO: 15957 - RNA, 19 nt, artificial
  Oligomer
cugucaagcagaaguuuuc

SEQ ID NO: 15958 - RNA, 19 nt, artificial
  Oligomer
ucucgaagacgaucagaag

SEQ ID NO: 15959 - RNA, 19 nt, artificial
  Oligomer
aacggguuccagaguucuc

SEQ ID NO: 15960 - RNA, 19 nt, artificial
  Oligomer
cuuuauggaugaguacacc

SEQ ID NO: 15961 - RNA, 19 nt, artificial
  Oligomer
agcugugaccuucauggug

SEQ ID NO: 15962 - RNA, 19 nt, artificial
  Oligomer
aucagaccaugcacuaugg

SEQ ID NO: 15963 - RNA, 19 nt, artificial
  Oligomer
ugagcagagcuaacaaugc

SEQ ID NO: 15964 - RNA, 19 nt, artificial
  Oligomer
acucagggucagcaucauc

SEQ ID NO: 15965 - RNA, 19 nt, artificial
  Oligomer
gaaagcuugguucucgaag

SEQ ID NO: 15966 - RNA, 19 nt, artificial
  Oligomer
aaacucucgaagacgauca

SEQ ID NO: 15967 - RNA, 19 nt, artificial
  Oligomer
agcuugguucucgaagcug

SEQ ID NO: 15968 - RNA, 19 nt, artificial
  Oligomer
aaagcuugguucucgaagc

SEQ ID NO: 15969 - RNA, 19 nt, artificial
  Oligomer
cucgaagacgaucagaagg

SEQ ID NO: 15970 - RNA, 19 nt, artificial
  Oligomer
auggauguggaacugucaa

SEQ ID NO: 15971 - RNA, 19 nt, artificial
  Oligomer
uggaugaguacaccaugcu

SEQ ID NO: 15972 - RNA, 19 nt, artificial
  Oligomer
aguccuucagaagugcacg

SEQ ID NO: 15973 - RNA, 19 nt, artificial
  Oligomer
agcuucauaaacaucuuca

SEQ ID NO: 15974 - RNA, 19 nt, artificial
  Oligomer
gugaccuucaugguguuca

SEQ ID NO: 15975 - RNA, 19 nt, artificial
  Oligomer
aucgggaaagcuugguucu

SEQ ID NO: 15976 - RNA, 19 nt, artificial
  Oligomer
uaaaaaguguuucugugau

SEQ ID NO: 15977 - RNA, 19 nt, artificial
  Oligomer
gucugaauccucagcguug

SEQ ID NO: 15978 - RNA, 19 nt, artificial
  Oligomer
guuauggagcuucccucag

SEQ ID NO: 15979 - RNA, 19 nt, artificial
  Oligomer
aaguuccugacgucagcag

SEQ ID NO: 15980 - RNA, 19 nt, artificial
  Oligomer
caagcagaaguuuucaccc

SEQ ID NO: 15981 - RNA, 19 nt, artificial
  Oligomer
aaugccgggaauugugguc

SEQ ID NO: 15982 - RNA, 19 nt, artificial
  Oligomer
acaucgggaaagcuugguu

SEQ ID NO: 15983 - RNA, 19 nt, artificial
  Oligomer
agcagcaccugacuaacug

SEQ ID NO: 15984 - RNA, 19 nt, artificial
  Oligomer
aggagauuccagcugugac

SEQ ID NO: 15985 - RNA, 19 nt, artificial
  Oligomer
aaacccaugucagcaaccg

SEQ ID NO: 15986 - RNA, 19 nt, artificial
  Oligomer
uuaccucuagccuuuuggu

SEQ ID NO: 15987 - RNA, 19 nt, artificial
  Oligomer
ucagcauuuuguaccaucu

SEQ ID NO: 15988 - RNA, 19 nt, artificial
  Oligomer
auccucagcguugcgaugu

SEQ ID NO: 15989 - RNA, 19 nt, artificial
  Oligomer
auguugcuagguauaauuu

SEQ ID NO: 15990 - RNA, 19 nt, artificial
  Oligomer
aucugcgaugaaguuguac

SEQ ID NO: 15991 - RNA, 19 nt, artificial
  Oligomer
guuuucacccuccuucaga

SEQ ID NO: 15992 - RNA, 19 nt, artificial
  Oligomer
uccagaguuuccaaaauca

SEQ ID NO: 15993 - RNA, 19 nt, artificial
  Oligomer
ucugcagugcaaagggacu

SEQ ID NO: 15994 - RNA, 19 nt, artificial
  Oligomer
ucagggucagcaucaucac

SEQ ID NO: 15995 - RNA, 19 nt, artificial
  Oligomer
aaguccuucagaagugcac

SEQ ID NO: 15996 - RNA, 19 nt, artificial
  Oligomer
gaugugaucguguucugca

SEQ ID NO: 15997 - RNA, 19 nt, artificial
  Oligomer
ccaugcacuauggaugugg

SEQ ID NO: 15998 - RNA, 19 nt, artificial
  Oligomer
agaguuuccaaaaucaaua

SEQ ID NO: 15999 - RNA, 19 nt, artificial
  Oligomer
gugaucuauucauucugug

SEQ ID NO: 16000 - RNA, 19 nt, artificial
  Oligomer
uccaggaucucgauauaga

SEQ ID NO: 16001 - RNA, 19 nt, artificial
  Oligomer
auggucagcuccaguaucu

SEQ ID NO: 16002 - RNA, 19 nt, artificial
  Oligomer
ccaagcaugggaaucuuug

SEQ ID NO: 16003 - RNA, 19 nt, artificial
  Oligomer
ucguguucugcagugcaaa

SEQ ID NO: 16004 - RNA, 19 nt, artificial
  Oligomer
augcugaacaucgggaaag

SEQ ID NO: 16005 - RNA, 19 nt, artificial
  Oligomer
agaaguuuucacccuccuu

SEQ ID NO: 16006 - RNA, 19 nt, artificial
  Oligomer
aagcaugggaaucuuugcu

SEQ ID NO: 16007 - RNA, 19 nt, artificial
  Oligomer
cucgauauagaccacggca

SEQ ID NO: 16008 - RNA, 19 nt, artificial
  Oligomer
ugacuaacugcccacaaaa

SEQ ID NO: 16009 - RNA, 19 nt, artificial
  Oligomer
aaaucagagcaggagccuc

SEQ ID NO: 16010 - RNA, 19 nt, artificial
  Oligomer
ugacuuuauggaugaguac

SEQ ID NO: 16011 - RNA, 19 nt, artificial
  Oligomer
ugugaccuucaugguguuc

SEQ ID NO: 16012 - RNA, 19 nt, artificial
  Oligomer
aacaucgggaaagcuuggu

SEQ ID NO: 16013 - RNA, 19 nt, artificial
  Oligomer
cuucauaaacaucuucagc

SEQ ID NO: 16014 - RNA, 19 nt, artificial
  Oligomer
guguucugcagugcaaagg

SEQ ID NO: 16015 - RNA, 19 nt, artificial
  Oligomer
aaguguuucugugauucuu

SEQ ID NO: 16016 - RNA, 19 nt, artificial
  Oligomer
cauauaaggucaguguuuc

SEQ ID NO: 16017 - RNA, 19 nt, artificial
  Oligomer
uggucagcuccaguaucuc

SEQ ID NO: 16018 - RNA, 19 nt, artificial
  Oligomer
gcaguuauggagcuucccu

SEQ ID NO: 16019 - RNA, 19 nt, artificial
  Oligomer
cuuagucugaauccucagc

SEQ ID NO: 16020 - RNA, 19 nt, artificial
  Oligomer
agaaguuccugacgucagc

SEQ ID NO: 16021 - RNA, 19 nt, artificial
  Oligomer
gucacauauaaggucagug

SEQ ID NO: 16022 - RNA, 19 nt, artificial
  Oligomer
acagcuuuaccucuagccu

SEQ ID NO: 16023 - RNA, 19 nt, artificial
  Oligomer
aucguguucugcagugcaa

SEQ ID NO: 16024 - RNA, 19 nt, artificial
  Oligomer
cuuaccaagaaacccaugu

SEQ ID NO: 16025 - RNA, 19 nt, artificial
  Oligomer
gauuccagcugugaccuuc

SEQ ID NO: 16026 - RNA, 19 nt, artificial
  Oligomer
cacaacaacaacagcacug

SEQ ID NO: 16027 - RNA, 19 nt, artificial
  Oligomer
cuccuuagucugaauccuc

SEQ ID NO: 16028 - RNA, 19 nt, artificial
  Oligomer
acaucugcgaugaaguugu

SEQ ID NO: 16029 - RNA, 19 nt, artificial
  Oligomer
gaggaauucuucuuuuccc

SEQ ID NO: 16030 - RNA, 19 nt, artificial
  Oligomer
accaagaaacccaugucag

SEQ ID NO: 16031 - RNA, 19 nt, artificial
  Oligomer
ccacgaugcagaaacucuc

SEQ ID NO: 16032 - RNA, 19 nt, artificial
  Oligomer
acugucaagcagaaguuuu

SEQ ID NO: 16033 - RNA, 19 nt, artificial
  Oligomer
acuaacugcccacaaaaga

SEQ ID NO: 16034 - RNA, 19 nt, artificial
  Oligomer
gaucuauucauucugugac

SEQ ID NO: 16035 - RNA, 19 nt, artificial
  Oligomer
gugaucguguucugcagug

SEQ ID NO: 16036 - RNA, 19 nt, artificial
  Oligomer
auauguugcuagguauaau

SEQ ID NO: 16037 - RNA, 19 nt, artificial
  Oligomer
uuccagcugugaccuucau

SEQ ID NO: 16038 - RNA, 19 nt, artificial
  Oligomer
caugguguucacuccaauc

SEQ ID NO: 16039 - RNA, 19 nt, artificial
  Oligomer
accaugcugaacaucggga

SEQ ID NO: 16040 - RNA, 19 nt, artificial
  Oligomer
gaucucgauauagaccacg

SEQ ID NO: 16041 - RNA, 19 nt, artificial
  Oligomer
ugauuccggaggaggaauu

SEQ ID NO: 16042 - RNA, 19 nt, artificial
  Oligomer
caggaugacuuuauggaug

SEQ ID NO: 16043 - RNA, 19 nt, artificial
  Oligomer
aaaucacaucaccaggccg

SEQ ID NO: 16044 - RNA, 19 nt, artificial
  Oligomer
acauauaaggucaguguuu

SEQ ID NO: 16045 - RNA, 19 nt, artificial
  Oligomer
guuucugugauucuucaga

SEQ ID NO: 16046 - RNA, 19 nt, artificial
  Oligomer
auuccggaggaggaauucu

SEQ ID NO: 16047 - RNA, 19 nt, artificial
  Oligomer
agccucauacucuugguga

SEQ ID NO: 16048 - RNA, 19 nt, artificial
  Oligomer
cugaaguccuucagaagug

SEQ ID NO: 16049 - RNA, 19 nt, artificial
  Oligomer
augggaaucuuugcuccca

SEQ ID NO: 16050 - RNA, 19 nt, artificial
  Oligomer
aagcagaaguuuucacccu

SEQ ID NO: 16051 - RNA, 19 nt, artificial
  Oligomer
accacaaagagcagcaccu

SEQ ID NO: 16052 - RNA, 19 nt, artificial
  Oligomer
guuuccaaaaucaauagcu

SEQ ID NO: 16053 - RNA, 19 nt, artificial
  Oligomer
ugcugucuucuccaccaca

SEQ ID NO: 16054 - RNA, 19 nt, artificial
  Oligomer
cucauuuucuuuaauagga

SEQ ID NO: 16055 - RNA, 19 nt, artificial
  Oligomer
cagaaguuccugacgucag

SEQ ID NO: 16056 - RNA, 19 nt, artificial
  Oligomer
aaugccggaugugaucgug

SEQ ID NO: 16057 - RNA, 19 nt, artificial
  Oligomer
ccucauacucuuggugauc

SEQ ID NO: 16058 - RNA, 19 nt, artificial
  Oligomer
cacgaugcagaaacucucg

SEQ ID NO: 16059 - RNA, 19 nt, artificial
  Oligomer
aguuuucacccuccuucag

SEQ ID NO: 16060 - RNA, 19 nt, artificial
  Oligomer
cacugguucauuuaacccu

SEQ ID NO: 16061 - RNA, 19 nt, artificial
  Oligomer
aaaucaauagcugcaucag

SEQ ID NO: 16062 - RNA, 19 nt, artificial
  Oligomer
agugcaaagggacuuccca

SEQ ID NO: 16063 - RNA, 19 nt, artificial
  Oligomer
cuuuaccucuagccuuuug

SEQ ID NO: 16064 - RNA, 19 nt, artificial
  Oligomer
gugauucuucagagcccag

SEQ ID NO: 16065 - RNA, 19 nt, artificial
  Oligomer
gaugaaguuguacugacuc

SEQ ID NO: 16066 - RNA, 19 nt, artificial
  Oligomer
auacagcuuuaccucuagc

SEQ ID NO: 16067 - RNA, 19 nt, artificial
  Oligomer
ugcuagguauaauuuuauu

SEQ ID NO: 16068 - RNA, 19 nt, artificial
  Oligomer
aacugcccacaaaagaugg

SEQ ID NO: 16069 - RNA, 19 nt, artificial
  Oligomer
guuggugacaaugagccca

SEQ ID NO: 16070 - RNA, 19 nt, artificial
  Oligomer
gcugucaguaucuguagcc

SEQ ID NO: 16071 - RNA, 19 nt, artificial
  Oligomer
ugaaguccuucagaagugc

SEQ ID NO: 16072 - RNA, 19 nt, artificial
  Oligomer
uaccugaaguccuucagaa

SEQ ID NO: 16073 - RNA, 19 nt, artificial
  Oligomer
gcaaaggagauuccagcug

SEQ ID NO: 16074 - RNA, 19 nt, artificial
  Oligomer
aaaaucacaucaccaggcc

SEQ ID NO: 16075 - RNA, 19 nt, artificial
  Oligomer
gaaguuguacugacuccgg

SEQ ID NO: 16076 - RNA, 19 nt, artificial
  Oligomer
agcaaccgcacucaucaga

SEQ ID NO: 16077 - RNA, 19 nt, artificial
  Oligomer
cacaucugcgaugaaguug

SEQ ID NO: 16078 - RNA, 19 nt, artificial
  Oligomer
gcagaaguuuucacccucc

SEQ ID NO: 16079 - RNA, 19 nt, artificial
  Oligomer
cugcgaugaaguuguacug

SEQ ID NO: 16080 - RNA, 19 nt, artificial
  Oligomer
aaggcaaggaggaaaucag

SEQ ID NO: 16081 - RNA, 19 nt, artificial
  Oligomer
ucgaagcuguaguucagca

SEQ ID NO: 16082 - RNA, 19 nt, artificial
  Oligomer
ucaucagaccaugcacuau

SEQ ID NO: 16083 - RNA, 19 nt, artificial
  Oligomer
agcuuuaccucuagccuuu

SEQ ID NO: 16084 - RNA, 19 nt, artificial
  Oligomer
ccuucaugguguucacucc

SEQ ID NO: 16085 - RNA, 19 nt, artificial
  Oligomer
ugucagcaaccgcacucau

SEQ ID NO: 16086 - RNA, 19 nt, artificial
  Oligomer
auccugagccguucgagau

SEQ ID NO: 16087 - RNA, 19 nt, artificial
  Oligomer
ugcgaugaaguuguacuga

SEQ ID NO: 16088 - RNA, 19 nt, artificial
  Oligomer
acuauggauguggaacugu

SEQ ID NO: 16089 - RNA, 19 nt, artificial
  Oligomer
aaacaucuucagcauuuug

SEQ ID NO: 16090 - RNA, 19 nt, artificial
  Oligomer
acugcuuccuacugcucgu

SEQ ID NO: 16091 - RNA, 19 nt, artificial
  Oligomer
caggaucucgauauagacc

SEQ ID NO: 16092 - RNA, 19 nt, artificial
  Oligomer
aggauggucagcuccagua

SEQ ID NO: 16093 - RNA, 19 nt, artificial
  Oligomer
cuuagcagucucacacgga

SEQ ID NO: 16094 - RNA, 19 nt, artificial
  Oligomer
aauauguugcuagguauaa

SEQ ID NO: 16095 - RNA, 19 nt, artificial
  Oligomer
cugggauuggguucgaaca

SEQ ID NO: 16096 - RNA, 19 nt, artificial
  Oligomer
cuaacaaugccggauguga

SEQ ID NO: 16097 - RNA, 19 nt, artificial
  Oligomer
uagucugaauccucagcgu

SEQ ID NO: 16098 - RNA, 19 nt, artificial
  Oligomer
aggaaaucagagcaggagc

SEQ ID NO: 16099 - RNA, 19 nt, artificial
  Oligomer
ccaaaaucacaucaccagg

SEQ ID NO: 16100 - RNA, 19 nt, artificial
  Oligomer
aaaguguuucugugauucu

SEQ ID NO: 16101 - RNA, 19 nt, artificial
  Oligomer
caauagcugcaucaguuug

SEQ ID NO: 16102 - RNA, 19 nt, artificial
  Oligomer
gucaagcagaaguuuucac

SEQ ID NO: 16103 - RNA, 19 nt, artificial
  Oligomer
ugaccuucaugguguucac

SEQ ID NO: 16104 - RNA, 19 nt, artificial
  Oligomer
cucaucagaccaugcacua

SEQ ID NO: 16105 - RNA, 19 nt, artificial
  Oligomer
acaacaacaacagcacugc

SEQ ID NO: 16106 - RNA, 19 nt, artificial
  Oligomer
ucucgaagcuguaguucag

SEQ ID NO: 16107 - RNA, 19 nt, artificial
  Oligomer
guauuccacauugguuugg

SEQ ID NO: 16108 - RNA, 19 nt, artificial
  Oligomer
gaugacuuuauggaugagu

SEQ ID NO: 16109 - RNA, 19 nt, artificial
  Oligomer
guuugaauguauuccacau

SEQ ID NO: 16110 - RNA, 19 nt, artificial
  Oligomer
ucauaaacaucuucagcau

SEQ ID NO: 16111 - RNA, 19 nt, artificial
  Oligomer
cauuuuguaccaucugcuc

SEQ ID NO: 16112 - RNA, 19 nt, artificial
  Oligomer
aauccugagccguucgaga

SEQ ID NO: 16113 - RNA, 19 nt, artificial
  Oligomer
cucucgaagacgaucagaa

SEQ ID NO: 16114 - RNA, 19 nt, artificial
  Oligomer
ugggcguuggugacaauga

SEQ ID NO: 16115 - RNA, 19 nt, artificial
  Oligomer
cuauaauauguugcuaggu

SEQ ID NO: 16116 - RNA, 19 nt, artificial
  Oligomer
cuuuaauaggaggucagga

SEQ ID NO: 16117 - RNA, 19 nt, artificial
  Oligomer
accacaucugcgaugaagu

SEQ ID NO: 16118 - RNA, 19 nt, artificial
  Oligomer
agcucauuuucuuuaauag

SEQ ID NO: 16119 - RNA, 19 nt, artificial
  Oligomer
cauuaccucaggagcuuac

SEQ ID NO: 16120 - RNA, 19 nt, artificial
  Oligomer
ugcugaacaucgggaaagc

SEQ ID NO: 16121 - RNA, 19 nt, artificial
  Oligomer
accucaggagcuuaccaag

SEQ ID NO: 16122 - RNA, 19 nt, artificial
  Oligomer
caccacaccacaaagagca

SEQ ID NO: 16123 - RNA, 19 nt, artificial
  Oligomer
uccugagccguucgagaua

SEQ ID NO: 16124 - RNA, 19 nt, artificial
  Oligomer
ggauguggaacugucaagc

SEQ ID NO: 16125 - RNA, 19 nt, artificial
  Oligomer
uagcugcaucaguuugaau

SEQ ID NO: 16126 - RNA, 19 nt, artificial
  Oligomer
caaaaucacaucaccaggc

SEQ ID NO: 16127 - RNA, 19 nt, artificial
  Oligomer
gugcaaagggacuucccau

SEQ ID NO: 16128 - RNA, 19 nt, artificial
  Oligomer
ggaggaauucuucuuuucc

SEQ ID NO: 16129 - RNA, 19 nt, artificial
  Oligomer
caguuugaauguauuccac

SEQ ID NO: 16130 - RNA, 19 nt, artificial
  Oligomer
aaaggagauuccagcugug

SEQ ID NO: 16131 - RNA, 19 nt, artificial
  Oligomer
cauacucuuggugaucuau

SEQ ID NO: 16132 - RNA, 19 nt, artificial
  Oligomer
gcauuuuguaccaucugcu

SEQ ID NO: 16133 - RNA, 19 nt, artificial
  Oligomer
cacucaucagaccaugcac

SEQ ID NO: 16134 - RNA, 19 nt, artificial
  Oligomer
cauuuucuuuaauaggagg

SEQ ID NO: 16135 - RNA, 19 nt, artificial
  Oligomer
ucuucagcauuuuguacca

SEQ ID NO: 16136 - RNA, 19 nt, artificial
  Oligomer
ccggaugugaucguguucu

SEQ ID NO: 16137 - RNA, 19 nt, artificial
  Oligomer
aggagcuuaccaagaaacc

SEQ ID NO: 16138 - RNA, 19 nt, artificial
  Oligomer
gagcuuaccaagaaaccca

SEQ ID NO: 16139 - RNA, 19 nt, artificial
  Oligomer
gaguacaccaugcugaaca

SEQ ID NO: 16140 - RNA, 19 nt, artificial
  Oligomer
aggaggaauucuucuuuuc

SEQ ID NO: 16141 - RNA, 19 nt, artificial
  Oligomer
ugcagaaacucucgaagac

SEQ ID NO: 16142 - RNA, 19 nt, artificial
  Oligomer
gugacugcuuccuacugcu

SEQ ID NO: 16143 - RNA, 19 nt, artificial
  Oligomer
ugccggaugugaucguguu

SEQ ID NO: 16144 - RNA, 19 nt, artificial
  Oligomer
cagcuuuaccucuagccuu

SEQ ID NO: 16145 - RNA, 19 nt, artificial
  Oligomer
uaaacaucuucagcauuuu

SEQ ID NO: 16146 - RNA, 19 nt, artificial
  Oligomer
cucgaagcuguaguucagc

SEQ ID NO: 16147 - RNA, 19 nt, artificial
  Oligomer
agucugaauccucagcguu

SEQ ID NO: 16148 - RNA, 19 nt, artificial
  Oligomer
aguuuccaaaaucaauagc

SEQ ID NO: 16149 - RNA, 19 nt, artificial
  Oligomer
cagaaguuuucacccuccu

SEQ ID NO: 16150 - RNA, 19 nt, artificial
  Oligomer
guguuucugugauucuuca

SEQ ID NO: 16151 - RNA, 19 nt, artificial
  Oligomer
aaggagauuccagcuguga

SEQ ID NO: 16152 - RNA, 19 nt, artificial
  Oligomer
cagcaguuauggagcuucc

SEQ ID NO: 16153 - RNA, 19 nt, artificial
  Oligomer
gcugugaccuucauggugu

SEQ ID NO: 16154 - RNA, 19 nt, artificial
  Oligomer
gaugaguacaccaugcuga

SEQ ID NO: 16155 - RNA, 19 nt, artificial
  Oligomer
gcccaggaugacuuuaugg

SEQ ID NO: 16156 - RNA, 19 nt, artificial
  Oligomer
accugaaguccuucagaag

SEQ ID NO: 16157 - RNA, 19 nt, artificial
  Oligomer
acaccaugcugaacaucgg

SEQ ID NO: 16158 - RNA, 19 nt, artificial
  Oligomer
ggaugugaucguguucugc

SEQ ID NO: 16159 - RNA, 19 nt, artificial
  Oligomer
ccacugguucauuuaaccc

SEQ ID NO: 16160 - RNA, 19 nt, artificial
  Oligomer
ggaacugucaagcagaagu

SEQ ID NO: 16161 - RNA, 19 nt, artificial
  Oligomer
caagaaacccaugucagca

SEQ ID NO: 16162 - RNA, 19 nt, artificial
  Oligomer
aucagagcaggagccucau

SEQ ID NO: 16163 - RNA, 19 nt, artificial
  Oligomer
gcuagguauaauuuuauuu

SEQ ID NO: 16164 - RNA, 19 nt, artificial
  Oligomer
acgcugagcagagcuaaca

SEQ ID NO: 16165 - RNA, 19 nt, artificial
  Oligomer
gagcuaacaaugccggaug

SEQ ID NO: 16166 - RNA, 19 nt, artificial
  Oligomer
ccagcugucaguaucugua

SEQ ID NO: 16167 - RNA, 19 nt, artificial
  Oligomer
agacgaucagaagggaugg

SEQ ID NO: 16168 - RNA, 19 nt, artificial
  Oligomer
acgaugcagaaacucucga

SEQ ID NO: 16169 - RNA, 19 nt, artificial
  Oligomer
aaaaaguguuucugugauu

SEQ ID NO: 16170 - RNA, 19 nt, artificial
  Oligomer
cccaggaugacuuuaugga

SEQ ID NO: 16171 - RNA, 19 nt, artificial
  Oligomer
gcagaaacucucgaagacg

SEQ ID NO: 16172 - RNA, 19 nt, artificial
  Oligomer
gcucauuuucuuuaauagg

SEQ ID NO: 16173 - RNA, 19 nt, artificial
  Oligomer
cugucuucuccaccacauc

SEQ ID NO: 16174 - RNA, 19 nt, artificial
  Oligomer
augcagaaacucucgaaga

SEQ ID NO: 16175 - RNA, 19 nt, artificial
  Oligomer
cacaaagagcagcaccuga

SEQ ID NO: 16176 - RNA, 19 nt, artificial
  Oligomer
cugcagugcaaagggacuu

SEQ ID NO: 16177 - RNA, 19 nt, artificial
  Oligomer
cagcugucaguaucuguag

SEQ ID NO: 16178 - RNA, 19 nt, artificial
  Oligomer
agcugucaguaucuguagc

SEQ ID NO: 16179 - RNA, 19 nt, artificial
  Oligomer
cuuugacucgcaccgguaa

SEQ ID NO: 16180 - RNA, 19 nt, artificial
  Oligomer
aauccucagcguugcgaug

SEQ ID NO: 16181 - RNA, 19 nt, artificial
  Oligomer
ucagaccaugcacuaugga

SEQ ID NO: 16182 - RNA, 19 nt, artificial
  Oligomer
guucucgaagcuguaguuc

SEQ ID NO: 16183 - RNA, 19 nt, artificial
  Oligomer
gcagcaguuauggagcuuc

SEQ ID NO: 16184 - RNA, 19 nt, artificial
  Oligomer
caucaguuugaauguauuc

SEQ ID NO: 16185 - RNA, 19 nt, artificial
  Oligomer
gaagcagcaguuauggagc

SEQ ID NO: 16186 - RNA, 19 nt, artificial
  Oligomer
ccuuagucugaauccucag

SEQ ID NO: 16187 - RNA, 19 nt, artificial
  Oligomer
aagcuguaguucagcaagg

SEQ ID NO: 16188 - RNA, 19 nt, artificial
  Oligomer
gcuugguucucgaagcugu

SEQ ID NO: 16189 - RNA, 19 nt, artificial
  Oligomer
uccaccacaucugcgauga

SEQ ID NO: 16190 - RNA, 19 nt, artificial
  Oligomer
gaacaucgggaaagcuugg

SEQ ID NO: 16191 - RNA, 19 nt, artificial
  Oligomer
gguguucacuccaaucacc

SEQ ID NO: 16192 - RNA, 19 nt, artificial
  Oligomer
accugacuaacugcccaca

SEQ ID NO: 16193 - RNA, 19 nt, artificial
  Oligomer
gagauuccagcugugaccu

SEQ ID NO: 16194 - RNA, 19 nt, artificial
  Oligomer
cuccagaguuuccaaaauc

SEQ ID NO: 16195 - RNA, 19 nt, artificial
  Oligomer
caugggaaucuuugcuccc

SEQ ID NO: 16196 - RNA, 19 nt, artificial
  Oligomer
gaucguguucugcagugca

SEQ ID NO: 16197 - RNA, 19 nt, artificial
  Oligomer
cuaacugcccacaaaagau

SEQ ID NO: 16198 - RNA, 19 nt, artificial
  Oligomer
caaaggagauuccagcugu

SEQ ID NO: 16199 - RNA, 19 nt, artificial
  Oligomer
aaggaggaaaucagagcag

SEQ ID NO: 16200 - RNA, 19 nt, artificial
  Oligomer
ucaggagcuuaccaagaaa

SEQ ID NO: 16201 - RNA, 19 nt, artificial
  Oligomer
aggcuccuuagucugaauc

SEQ ID NO: 16202 - RNA, 19 nt, artificial
  Oligomer
ccugaagcagcaguuaugg

SEQ ID NO: 16203 - RNA, 19 nt, artificial
  Oligomer
caaaaucaauagcugcauc

SEQ ID NO: 16204 - RNA, 19 nt, artificial
  Oligomer
cagcagcucauuuucuuua

SEQ ID NO: 16205 - RNA, 19 nt, artificial
  Oligomer
cccacaacaacaacagcac

SEQ ID NO: 16206 - RNA, 19 nt, artificial
  Oligomer
ccugaaguccuucagaagu

SEQ ID NO: 16207 - RNA, 19 nt, artificial
  Oligomer
gacuuuauggaugaguaca

SEQ ID NO: 16208 - RNA, 19 nt, artificial
  Oligomer
uggugacaaugagcccauc

SEQ ID NO: 16209 - RNA, 19 nt, artificial
  Oligomer
auagcugcaucaguuugaa

SEQ ID NO: 16210 - RNA, 19 nt, artificial
  Oligomer
gagcagagcuaacaaugcc

SEQ ID NO: 16211 - RNA, 19 nt, artificial
  Oligomer
aggaugacuuuauggauga

SEQ ID NO: 16212 - RNA, 19 nt, artificial
  Oligomer
gucagaaguuccugacguc

SEQ ID NO: 16213 - RNA, 19 nt, artificial
  Oligomer
agagcuaacaaugccggau

SEQ ID NO: 16214 - RNA, 19 nt, artificial
  Oligomer
gauucuucagagcccagga

SEQ ID NO: 16215 - RNA, 19 nt, artificial
  Oligomer
aagcuugguucucgaagcu

SEQ ID NO: 16216 - RNA, 19 nt, artificial
  Oligomer
ggaugaguacaccaugcug

SEQ ID NO: 16217 - RNA, 19 nt, artificial
  Oligomer
guuccagaguucucugagg

SEQ ID NO: 16218 - RNA, 19 nt, artificial
  Oligomer
cggaggaggaauucuucuu

SEQ ID NO: 16219 - RNA, 19 nt, artificial
  Oligomer
ucuccaccacaucugcgau

SEQ ID NO: 16220 - RNA, 19 nt, artificial
  Oligomer
aagaaacccaugucagcaa

SEQ ID NO: 16221 - RNA, 19 nt, artificial
  Oligomer
aagagcagcaccugacuaa

SEQ ID NO: 16222 - RNA, 19 nt, artificial
  Oligomer
cccacgaugcagaaacucu

SEQ ID NO: 16223 - RNA, 19 nt, artificial
  Oligomer
aaaggcaaggaggaaauca

SEQ ID NO: 16224 - RNA, 19 nt, artificial
  Oligomer
agcuuaccaagaaacccau

SEQ ID NO: 16225 - RNA, 19 nt, artificial
  Oligomer
gggcaaaaauacaguccaa

SEQ ID NO: 16226 - RNA, 19 nt, artificial
  Oligomer
cauggagcgccucauugaa

SEQ ID NO: 16227 - RNA, 19 nt, artificial
  Oligomer
gaaugaucacagcaaugaa

SEQ ID NO: 16228 - RNA, 19 nt, artificial
  Oligomer
cauuguuuuuguacaaaaa

SEQ ID NO: 16229 - RNA, 19 nt, artificial
  Oligomer
ggcgaaugaucacagcaau

SEQ ID NO: 16230 - RNA, 19 nt, artificial
  Oligomer
cgaacuuccugcagaugca

SEQ ID NO: 16231 - RNA, 19 nt, artificial
  Oligomer
ggaugggccuguacauaga

SEQ ID NO: 16232 - RNA, 19 nt, artificial
  Oligomer
ggucaaguacgacugcgaa

SEQ ID NO: 16233 - RNA, 19 nt, artificial
  Oligomer
cuguaauuuuccaaggaaa

SEQ ID NO: 16234 - RNA, 19 nt, artificial
  Oligomer
gggaguacaucuacaugca

SEQ ID NO: 16235 - RNA, 19 nt, artificial
  Oligomer
caggaugccucaguguuaa

SEQ ID NO: 16236 - RNA, 19 nt, artificial
  Oligomer
cauccagcccugucuucaa

SEQ ID NO: 16237 - RNA, 19 nt, artificial
  Oligomer
cgggacaaaccgccuuaau

SEQ ID NO: 16238 - RNA, 19 nt, artificial
  Oligomer
gaguguuacgacccagaua

SEQ ID NO: 16239 - RNA, 19 nt, artificial
  Oligomer
aaaugacaucucaaaagaa

SEQ ID NO: 16240 - RNA, 19 nt, artificial
  Oligomer
aaccgggacuaaaagaaaa

SEQ ID NO: 16241 - RNA, 19 nt, artificial
  Oligomer
acaaaaaccgggacuaaaa

SEQ ID NO: 16242 - RNA, 19 nt, artificial
  Oligomer
ccaggaugccucaguguua

SEQ ID NO: 16243 - RNA, 19 nt, artificial
  Oligomer
gcaucaacugggucaagua

SEQ ID NO: 16244 - RNA, 19 nt, artificial
  Oligomer
gcuacgauguggaaacaga

SEQ ID NO: 16245 - RNA, 19 nt, artificial
  Oligomer
gggacuaaaagaaaagaca

SEQ ID NO: 16246 - RNA, 19 nt, artificial
  Oligomer
gaguguuacuacccagaga

SEQ ID NO: 16247 - RNA, 19 nt, artificial
  Oligomer
cguccuuggaggcuaugau

SEQ ID NO: 16248 - RNA, 19 nt, artificial
  Oligomer
ugcagaugcagcugcagaa

SEQ ID NO: 16249 - RNA, 19 nt, artificial
  Oligomer
gaguaucauuguuuuugua

SEQ ID NO: 16250 - RNA, 19 nt, artificial
  Oligomer
ccuguaauuuuccaaggaa

SEQ ID NO: 16251 - RNA, 19 nt, artificial
  Oligomer
ggaguguuacgacccagau

SEQ ID NO: 16252 - RNA, 19 nt, artificial
  Oligomer
gaugggccuguacauagaa

SEQ ID NO: 16253 - RNA, 19 nt, artificial
  Oligomer
guguuacgacccagauaca

SEQ ID NO: 16254 - RNA, 19 nt, artificial
  Oligomer
guguuaaaaugacaucuca

SEQ ID NO: 16255 - RNA, 19 nt, artificial
  Oligomer
gggacaaaccgccuuaauu

SEQ ID NO: 16256 - RNA, 19 nt, artificial
  Oligomer
agguggugguguugcuuau

SEQ ID NO: 16257 - RNA, 19 nt, artificial
  Oligomer
uggacaguguggaguguua

SEQ ID NO: 16258 - RNA, 19 nt, artificial
  Oligomer
acgucacacugcaggucaa

SEQ ID NO: 16259 - RNA, 19 nt, artificial
  Oligomer
guguccuccacgucaugaa

SEQ ID NO: 16260 - RNA, 19 nt, artificial
  Oligomer
cccuggaggaucauaccaa

SEQ ID NO: 16261 - RNA, 19 nt, artificial
  Oligomer
aaaccgggacuaaaagaaa

SEQ ID NO: 16262 - RNA, 19 nt, artificial
  Oligomer
ccagauacagacaccugga

SEQ ID NO: 16263 - RNA, 19 nt, artificial
  Oligomer
agcagauugaccagcagaa

SEQ ID NO: 16264 - RNA, 19 nt, artificial
  Oligomer
ggacaguuauuuuguugau

SEQ ID NO: 16265 - RNA, 19 nt, artificial
  Oligomer
guuaaaaugacaucucaaa

SEQ ID NO: 16266 - RNA, 19 nt, artificial
  Oligomer
uguuaaaaugacaucucaa

SEQ ID NO: 16267 - RNA, 19 nt, artificial
  Oligomer
uggaggugguguccauuga

SEQ ID NO: 16268 - RNA, 19 nt, artificial
  Oligomer
aagacagcacugcaaauaa

SEQ ID NO: 16269 - RNA, 19 nt, artificial
  Oligomer
ggaguaucauuguuuuugu

SEQ ID NO: 16270 - RNA, 19 nt, artificial
  Oligomer
ccucaaucgucuccuuuau

SEQ ID NO: 16271 - RNA, 19 nt, artificial
  Oligomer
ccucaguguuaaaaugaca

SEQ ID NO: 16272 - RNA, 19 nt, artificial
  Oligomer
gcaaggacuaccuggucaa

SEQ ID NO: 16273 - RNA, 19 nt, artificial
  Oligomer
ccgggacuaaaagaaaaga

SEQ ID NO: 16274 - RNA, 19 nt, artificial
  Oligomer
ccaccggauggacaguuau

SEQ ID NO: 16275 - RNA, 19 nt, artificial
  Oligomer
ccggauggacaguuauuuu

SEQ ID NO: 16276 - RNA, 19 nt, artificial
  Oligomer
caaggaaaauaaagaacag

SEQ ID NO: 16277 - RNA, 19 nt, artificial
  Oligomer
guacaaaaaccgggacuaa

SEQ ID NO: 16278 - RNA, 19 nt, artificial
  Oligomer
aggaugccucaguguuaaa

SEQ ID NO: 16279 - RNA, 19 nt, artificial
  Oligomer
aggacuaccuggucaagau

SEQ ID NO: 16280 - RNA, 19 nt, artificial
  Oligomer
ccuggaggaucauaccaag

SEQ ID NO: 16281 - RNA, 19 nt, artificial
  Oligomer
acaguuauuuuguugauaa

SEQ ID NO: 16282 - RNA, 19 nt, artificial
  Oligomer
ccgccuuaauucagcugag

SEQ ID NO: 16283 - RNA, 19 nt, artificial
  Oligomer
ggucaaguaccaggaugca

SEQ ID NO: 16284 - RNA, 19 nt, artificial
  Oligomer
guggaaacagagacgugga

SEQ ID NO: 16285 - RNA, 19 nt, artificial
  Oligomer
uguugcuuaucuucuggaa

SEQ ID NO: 16286 - RNA, 19 nt, artificial
  Oligomer
gaaaagacagcacugcaaa

SEQ ID NO: 16287 - RNA, 19 nt, artificial
  Oligomer
gcgcuacgauguggaaaca

SEQ ID NO: 16288 - RNA, 19 nt, artificial
  Oligomer
uguggaguguuacgaccca

SEQ ID NO: 16289 - RNA, 19 nt, artificial
  Oligomer
uguaauuuuccaaggaaaa

SEQ ID NO: 16290 - RNA, 19 nt, artificial
  Oligomer
uggucaagaucuucgagga

SEQ ID NO: 16291 - RNA, 19 nt, artificial
  Oligomer
caguuauuuuguugauaag

SEQ ID NO: 16292 - RNA, 19 nt, artificial
  Oligomer
cccuguaauuuuccaagga

SEQ ID NO: 16293 - RNA, 19 nt, artificial
  Oligomer
cugucauguaccagaucga

SEQ ID NO: 16294 - RNA, 19 nt, artificial
  Oligomer
ggugcugucauguaccaga

SEQ ID NO: 16295 - RNA, 19 nt, artificial
  Oligomer
cccgggaguacaucuacau

SEQ ID NO: 16296 - RNA, 19 nt, artificial
  Oligomer
cuacgauguggaaacagag

SEQ ID NO: 16297 - RNA, 19 nt, artificial
  Oligomer
gcagaacuguaccuguuga

SEQ ID NO: 16298 - RNA, 19 nt, artificial
  Oligomer
acaacaguguggagaggua

SEQ ID NO: 16299 - RNA, 19 nt, artificial
  Oligomer
ccaaggaaaauaaagaaca

SEQ ID NO: 16300 - RNA, 19 nt, artificial
  Oligomer
agaaaagacagcacugcaa

SEQ ID NO: 16301 - RNA, 19 nt, artificial
  Oligomer
caucucaaaagaaguccaa

SEQ ID NO: 16302 - RNA, 19 nt, artificial
  Oligomer
ggaguacaucuacaugcau

SEQ ID NO: 16303 - RNA, 19 nt, artificial
  Oligomer
ggaugccucaguguuaaaa

SEQ ID NO: 16304 - RNA, 19 nt, artificial
  Oligomer
gaugccucaguguuaaaau

SEQ ID NO: 16305 - RNA, 19 nt, artificial
  Oligomer
guuacuacccagagaggaa

SEQ ID NO: 16306 - RNA, 19 nt, artificial
  Oligomer
acgggacaaaccgccuuaa

SEQ ID NO: 16307 - RNA, 19 nt, artificial
  Oligomer
ucauggagcgccucauuga

SEQ ID NO: 16308 - RNA, 19 nt, artificial
  Oligomer
agcaagaggaguucuucaa

SEQ ID NO: 16309 - RNA, 19 nt, artificial
  Oligomer
cacugcaggucaaguacca

SEQ ID NO: 16310 - RNA, 19 nt, artificial
  Oligomer
guuacgacccagauacaga

SEQ ID NO: 16311 - RNA, 19 nt, artificial
  Oligomer
cuacguccuuggaggcuau

SEQ ID NO: 16312 - RNA, 19 nt, artificial
  Oligomer
uggugguguugcuuaucuu

SEQ ID NO: 16313 - RNA, 19 nt, artificial
  Oligomer
ccugcacaacuguaucuau

SEQ ID NO: 16314 - RNA, 19 nt, artificial
  Oligomer
agcugaguguuacuaccca

SEQ ID NO: 16315 - RNA, 19 nt, artificial
  Oligomer
ucauuguuuuuguacaaaa

SEQ ID NO: 16316 - RNA, 19 nt, artificial
  Oligomer
gagaaucuacguccuugga

SEQ ID NO: 16317 - RNA, 19 nt, artificial
  Oligomer
aauuuuccaaggaaaauaa

SEQ ID NO: 16318 - RNA, 19 nt, artificial
  Oligomer
ggaggaucauaccaagcag

SEQ ID NO: 16319 - RNA, 19 nt, artificial
  Oligomer
gcuaccuggaggcuuacaa

SEQ ID NO: 16320 - RNA, 19 nt, artificial
  Oligomer
agggaugggccuguacaua

SEQ ID NO: 16321 - RNA, 19 nt, artificial
  Oligomer
gaaaauaaagaacagacua

SEQ ID NO: 16322 - RNA, 19 nt, artificial
  Oligomer
uuccaaggaaaauaaagaa

SEQ ID NO: 16323 - RNA, 19 nt, artificial
  Oligomer
uaucauuguuuuuguacaa

SEQ ID NO: 16324 - RNA, 19 nt, artificial
  Oligomer
uacaaaaaccgggacuaaa

SEQ ID NO: 16325 - RNA, 19 nt, artificial
  Oligomer
ggaagcagauugaccagca

SEQ ID NO: 16326 - RNA, 19 nt, artificial
  Oligomer
caccggauggacaguuauu

SEQ ID NO: 16327 - RNA, 19 nt, artificial
  Oligomer
uggaguguuacgacccaga

SEQ ID NO: 16328 - RNA, 19 nt, artificial
  Oligomer
guaucauuguuuuuguaca

SEQ ID NO: 16329 - RNA, 19 nt, artificial
  Oligomer
guugauaaguaacccugua

SEQ ID NO: 16330 - RNA, 19 nt, artificial
  Oligomer
gcaaugaacaccauccgaa

SEQ ID NO: 16331 - RNA, 19 nt, artificial
  Oligomer
cagacuaacuagugucuuu

SEQ ID NO: 16332 - RNA, 19 nt, artificial
  Oligomer
cgccuuaauucagcugagu

SEQ ID NO: 16333 - RNA, 19 nt, artificial
  Oligomer
aagcaagaggaguucuuca

SEQ ID NO: 16334 - RNA, 19 nt, artificial
  Oligomer
aaaaugacaucucaaaaga

SEQ ID NO: 16335 - RNA, 19 nt, artificial
  Oligomer
gagcgcuacgauguggaaa

SEQ ID NO: 16336 - RNA, 19 nt, artificial
  Oligomer
ugguguccauugaggguau

SEQ ID NO: 16337 - RNA, 19 nt, artificial
  Oligomer
caacaguguggagagguau

SEQ ID NO: 16338 - RNA, 19 nt, artificial
  Oligomer
gauggacaguuauuuuguu

SEQ ID NO: 16339 - RNA, 19 nt, artificial
  Oligomer
uuaaaaugacaucucaaaa

SEQ ID NO: 16340 - RNA, 19 nt, artificial
  Oligomer
cugucaccaugugauuuau

SEQ ID NO: 16341 - RNA, 19 nt, artificial
  Oligomer
caguguggaguguuacgac

SEQ ID NO: 16342 - RNA, 19 nt, artificial
  Oligomer
ucaacugggucaaguacga

SEQ ID NO: 16343 - RNA, 19 nt, artificial
  Oligomer
gugcugucauguaccagau

SEQ ID NO: 16344 - RNA, 19 nt, artificial
  Oligomer
gacuaacuagugucuuuca

SEQ ID NO: 16345 - RNA, 19 nt, artificial
  Oligomer
accuggucaagaucuucga

SEQ ID NO: 16346 - RNA, 19 nt, artificial
  Oligomer
gccucauugaauucgccua

SEQ ID NO: 16347 - RNA, 19 nt, artificial
  Oligomer
aacuguaccuguugaggca

SEQ ID NO: 16348 - RNA, 19 nt, artificial
  Oligomer
ccugcaucaacugggucaa

SEQ ID NO: 16349 - RNA, 19 nt, artificial
  Oligomer
gaggugacccgaaugacau

SEQ ID NO: 16350 - RNA, 19 nt, artificial
  Oligomer
caaugaacaccauccgaag

SEQ ID NO: 16351 - RNA, 19 nt, artificial
  Oligomer
gacaguuauuuuguugaua

SEQ ID NO: 16352 - RNA, 19 nt, artificial
  Oligomer
gcaggucaaguaccaggau

SEQ ID NO: 16353 - RNA, 19 nt, artificial
  Oligomer
ggaggcuaugauggucaca

SEQ ID NO: 16354 - RNA, 19 nt, artificial
  Oligomer
cagcagaacuguaccuguu

SEQ ID NO: 16355 - RNA, 19 nt, artificial
  Oligomer
ccaacuucgcugagcagau

SEQ ID NO: 16356 - RNA, 19 nt, artificial
  Oligomer
aaccgcaccuucagcuaca

SEQ ID NO: 16357 - RNA, 19 nt, artificial
  Oligomer
ggaaaauaaagaacagacu

SEQ ID NO: 16358 - RNA, 19 nt, artificial
  Oligomer
ucagcuaccuggaggcuua

SEQ ID NO: 16359 - RNA, 19 nt, artificial
  Oligomer
caguguggagagguaugag

SEQ ID NO: 16360 - RNA, 19 nt, artificial
  Oligomer
guuauuuuguugauaagua

SEQ ID NO: 16361 - RNA, 19 nt, artificial
  Oligomer
gccucaguguuaaaaugac

SEQ ID NO: 16362 - RNA, 19 nt, artificial
  Oligomer
aaaauaaagaacagacuaa

SEQ ID NO: 16363 - RNA, 19 nt, artificial
  Oligomer
ggacuaaaagaaaagacag

SEQ ID NO: 16364 - RNA, 19 nt, artificial
  Oligomer
auuuuccaaggaaaauaaa

SEQ ID NO: 16365 - RNA, 19 nt, artificial
  Oligomer
cgaaugaucacagcaauga

SEQ ID NO: 16366 - RNA, 19 nt, artificial
  Oligomer
ccagcagaacuguaccugu

SEQ ID NO: 16367 - RNA, 19 nt, artificial
  Oligomer
gacaaaccgccuuaauuca

SEQ ID NO: 16368 - RNA, 19 nt, artificial
  Oligomer
agaagugcgagauccugca

SEQ ID NO: 16369 - RNA, 19 nt, artificial
  Oligomer
cagagacguggacuuucgu

SEQ ID NO: 16370 - RNA, 19 nt, artificial
  Oligomer
caaaaaccgggacuaaaag

SEQ ID NO: 16371 - RNA, 19 nt, artificial
  Oligomer
gcguccugcacaacuguau

SEQ ID NO: 16372 - RNA, 19 nt, artificial
  Oligomer
uacgauguggaaacagaga

SEQ ID NO: 16373 - RNA, 19 nt, artificial
  Oligomer
ccuguugaggcacuuuugu

SEQ ID NO: 16374 - RNA, 19 nt, artificial
  Oligomer
cagcugucaccaugugauu

SEQ ID NO: 16375 - RNA, 19 nt, artificial
  Oligomer
caugugauuuauucuugga

SEQ ID NO: 16376 - RNA, 19 nt, artificial
  Oligomer
acacguuccuggacagugu

SEQ ID NO: 16377 - RNA, 19 nt, artificial
  Oligomer
gaagcagauugaccagcag

SEQ ID NO: 16378 - RNA, 19 nt, artificial
  Oligomer
uguuucuugggcaaaaaua

SEQ ID NO: 16379 - RNA, 19 nt, artificial
  Oligomer
aaaaccgggacuaaaagaa

SEQ ID NO: 16380 - RNA, 19 nt, artificial
  Oligomer
gagguggugguguugcuua

SEQ ID NO: 16381 - RNA, 19 nt, artificial
  Oligomer
cucauugaauucgccuaca

SEQ ID NO: 16382 - RNA, 19 nt, artificial
  Oligomer
ugugauuuauucuuggaua

SEQ ID NO: 16383 - RNA, 19 nt, artificial
  Oligomer
gcagcugucaccaugugau

SEQ ID NO: 16384 - RNA, 19 nt, artificial
  Oligomer
ugggcaaaaauacagucca

SEQ ID NO: 16385 - RNA, 19 nt, artificial
  Oligomer
uuuguuucuugggcaaaaa

SEQ ID NO: 16386 - RNA, 19 nt, artificial
  Oligomer
ccuuggaggcuaugauggu

SEQ ID NO: 16387 - RNA, 19 nt, artificial
  Oligomer
ggauggacaguuauuuugu

SEQ ID NO: 16388 - RNA, 19 nt, artificial
  Oligomer
cugaguguuacuacccaga

SEQ ID NO: 16389 - RNA, 19 nt, artificial
  Oligomer
ggcuaugauggucacacgu

SEQ ID NO: 16390 - RNA, 19 nt, artificial
  Oligomer
uggagcgccucauugaauu

SEQ ID NO: 16391 - RNA, 19 nt, artificial
  Oligomer
cgggacuaaaagaaaagac

SEQ ID NO: 16392 - RNA, 19 nt, artificial
  Oligomer
gauaaguaacccuguaauu

SEQ ID NO: 16393 - RNA, 19 nt, artificial
  Oligomer
aaaagacagcacugcaaau

SEQ ID NO: 16394 - RNA, 19 nt, artificial
  Oligomer
gcugaguguuacuacccag

SEQ ID NO: 16395 - RNA, 19 nt, artificial
  Oligomer
cuggaaaugugguucccag

SEQ ID NO: 16396 - RNA, 19 nt, artificial
  Oligomer
auggucaggaccagcugaa

SEQ ID NO: 16397 - RNA, 19 nt, artificial
  Oligomer
cauggaggugguguccauu

SEQ ID NO: 16398 - RNA, 19 nt, artificial
  Oligomer
aucucaaaagaaguccaaa

SEQ ID NO: 16399 - RNA, 19 nt, artificial
  Oligomer
aguccaaagcgggaaucau

SEQ ID NO: 16400 - RNA, 19 nt, artificial
  Oligomer
acggugcugucauguacca

SEQ ID NO: 16401 - RNA, 19 nt, artificial
  Oligomer
aagaaaagacagcacugca

SEQ ID NO: 16402 - RNA, 19 nt, artificial
  Oligomer
aaaugugguucccagggau

SEQ ID NO: 16403 - RNA, 19 nt, artificial
  Oligomer
gaacggugcugucauguac

SEQ ID NO: 16404 - RNA, 19 nt, artificial
  Oligomer
caaugcugacacgaaggau

SEQ ID NO: 16405 - RNA, 19 nt, artificial
  Oligomer
gcugucaccaugugauuua

SEQ ID NO: 16406 - RNA, 19 nt, artificial
  Oligomer
ugauaaguaacccuguaau

SEQ ID NO: 16407 - RNA, 19 nt, artificial
  Oligomer
gauugaccagcagaacugu

SEQ ID NO: 16408 - RNA, 19 nt, artificial
  Oligomer
ugaacggugcugucaugua

SEQ ID NO: 16409 - RNA, 19 nt, artificial
  Oligomer
ucacagcaaugaacaccau

SEQ ID NO: 16410 - RNA, 19 nt, artificial
  Oligomer
agagacguggacuuucgua

SEQ ID NO: 16411 - RNA, 19 nt, artificial
  Oligomer
guaccagaucgacagcguu

SEQ ID NO: 16412 - RNA, 19 nt, artificial
  Oligomer
gaguacaucuacaugcauu

SEQ ID NO: 16413 - RNA, 19 nt, artificial
  Oligomer
aaagaaguccaaagcggga

SEQ ID NO: 16414 - RNA, 19 nt, artificial
  Oligomer
cauugaauucgccuacacg

SEQ ID NO: 16415 - RNA, 19 nt, artificial
  Oligomer
cagcacugcaaauaaccca

SEQ ID NO: 16416 - RNA, 19 nt, artificial
  Oligomer
aguucuucaaccuguccca

SEQ ID NO: 16417 - RNA, 19 nt, artificial
  Oligomer
uuuuguuucuugggcaaaa

SEQ ID NO: 16418 - RNA, 19 nt, artificial
  Oligomer
acucguugacgccgaacuu

SEQ ID NO: 16419 - RNA, 19 nt, artificial
  Oligomer
agaacagacuaacuagugu

SEQ ID NO: 16420 - RNA, 19 nt, artificial
  Oligomer
cagauugaccagcagaacu

SEQ ID NO: 16421 - RNA, 19 nt, artificial
  Oligomer
ccgggaguacaucuacaug

SEQ ID NO: 16422 - RNA, 19 nt, artificial
  Oligomer
aggcuaugauggucacacg

SEQ ID NO: 16423 - RNA, 19 nt, artificial
  Oligomer
acaguguggagagguauga

SEQ ID NO: 16424 - RNA, 19 nt, artificial
  Oligomer
gaggaguucuucaaccugu

SEQ ID NO: 16425 - RNA, 19 nt, artificial
  Oligomer
agaugcagcugcagaagug

SEQ ID NO: 16426 - RNA, 19 nt, artificial
  Oligomer
gcgaaugaucacagcaaug

SEQ ID NO: 16427 - RNA, 19 nt, artificial
  Oligomer
agacagcacugcaaauaac

SEQ ID NO: 16428 - RNA, 19 nt, artificial
  Oligomer
caacuggugacccucauca

SEQ ID NO: 16429 - RNA, 19 nt, artificial
  Oligomer
cgauguggaaacagagacg

SEQ ID NO: 16430 - RNA, 19 nt, artificial
  Oligomer
ugauguacgccuccacuga

SEQ ID NO: 16431 - RNA, 19 nt, artificial
  Oligomer
gaaacagagacguggacuu

SEQ ID NO: 16432 - RNA, 19 nt, artificial
  Oligomer
ggcaaaaauacaguccaau

SEQ ID NO: 16433 - RNA, 19 nt, artificial
  Oligomer
agcaaugaacaccauccga

SEQ ID NO: 16434 - RNA, 19 nt, artificial
  Oligomer
cacuuuuguuucuugggca

SEQ ID NO: 16435 - RNA, 19 nt, artificial
  Oligomer
ggacaaaccgccuuaauuc

SEQ ID NO: 16436 - RNA, 19 nt, artificial
  Oligomer
ccaagcaagaggaguucuu

SEQ ID NO: 16437 - RNA, 19 nt, artificial
  Oligomer
uguccauugaggguaucca

SEQ ID NO: 16438 - RNA, 19 nt, artificial
  Oligomer
aguacaucuacaugcauuu

SEQ ID NO: 16439 - RNA, 19 nt, artificial
  Oligomer
cuaccuggaggcuuacaac

SEQ ID NO: 16440 - RNA, 19 nt, artificial
  Oligomer
cuguugaggcacuuuuguu

SEQ ID NO: 16441 - RNA, 19 nt, artificial
  Oligomer
ccuuaauucagcugagugu

SEQ ID NO: 16442 - RNA, 19 nt, artificial
  Oligomer
aaggaaaauaaagaacaga

SEQ ID NO: 16443 - RNA, 19 nt, artificial
  Oligomer
uggaaagagcaggcuucca

SEQ ID NO: 16444 - RNA, 19 nt, artificial
  Oligomer
gaaaugugguucccaggga

SEQ ID NO: 16445 - RNA, 19 nt, artificial
  Oligomer
ggacaguguggaguguuac

SEQ ID NO: 16446 - RNA, 19 nt, artificial
  Oligomer
augacaucucaaaagaagu

SEQ ID NO: 16447 - RNA, 19 nt, artificial
  Oligomer
uuuccaaggaaaauaaaga

SEQ ID NO: 16448 - RNA, 19 nt, artificial
  Oligomer
caacuucgcugagcagauu

SEQ ID NO: 16449 - RNA, 19 nt, artificial
  Oligomer
acuuuuguuucuugggcaa

SEQ ID NO: 16450 - RNA, 19 nt, artificial
  Oligomer
ugguguugcuuaucuucug

SEQ ID NO: 16451 - RNA, 19 nt, artificial
  Oligomer
aaaaaccgggacuaaaaga

SEQ ID NO: 16452 - RNA, 19 nt, artificial
  Oligomer
ccaugugauuuauucuugg

SEQ ID NO: 16453 - RNA, 19 nt, artificial
  Oligomer
caaguacgacugcgaacag

SEQ ID NO: 16454 - RNA, 19 nt, artificial
  Oligomer
cucaguguuaaaaugacau

SEQ ID NO: 16455 - RNA, 19 nt, artificial
  Oligomer
gcaagaggaguucuucaac

SEQ ID NO: 16456 - RNA, 19 nt, artificial
  Oligomer
acuaccuggucaagaucuu

SEQ ID NO: 16457 - RNA, 19 nt, artificial
  Oligomer
guccauugaggguauccac

SEQ ID NO: 16458 - RNA, 19 nt, artificial
  Oligomer
guaauuuuccaaggaaaau

SEQ ID NO: 16459 - RNA, 19 nt, artificial
  Oligomer
uuucuugggcaaaaauaca

SEQ ID NO: 16460 - RNA, 19 nt, artificial
  Oligomer
uccucaaucgucuccuuua

SEQ ID NO: 16461 - RNA, 19 nt, artificial
  Oligomer
ugcagaagugcgagauccu

SEQ ID NO: 16462 - RNA, 19 nt, artificial
  Oligomer
aaagagcaggcuuccagga

SEQ ID NO: 16463 - RNA, 19 nt, artificial
  Oligomer
caugaacggugcugucaug

SEQ ID NO: 16464 - RNA, 19 nt, artificial
  Oligomer
aacuggugacccucaucag

SEQ ID NO: 16465 - RNA, 19 nt, artificial
  Oligomer
ccaaugcugacacgaagga

SEQ ID NO: 16466 - RNA, 19 nt, artificial
  Oligomer
aagcagauugaccagcaga

SEQ ID NO: 16467 - RNA, 19 nt, artificial
  Oligomer
gucauguaccagaucgaca

SEQ ID NO: 16468 - RNA, 19 nt, artificial
  Oligomer
gcacaacuguaucuaugcu

SEQ ID NO: 16469 - RNA, 19 nt, artificial
  Oligomer
cagaugcagcugcagaagu

SEQ ID NO: 16470 - RNA, 19 nt, artificial
  Oligomer
caccaugugauuuauucuu

SEQ ID NO: 16471 - RNA, 19 nt, artificial
  Oligomer
ggagaaucuacguccuugg

SEQ ID NO: 16472 - RNA, 19 nt, artificial
  Oligomer
cacugcaaauaacccaucu

SEQ ID NO: 16473 - RNA, 19 nt, artificial
  Oligomer
gcagauugaccagcagaac

SEQ ID NO: 16474 - RNA, 19 nt, artificial
  Oligomer
aaugacaucucaaaagaag

SEQ ID NO: 16475 - RNA, 19 nt, artificial
  Oligomer
guaacccuguaauuuucca

SEQ ID NO: 16476 - RNA, 19 nt, artificial
  Oligomer
guuucuugggcaaaaauac

SEQ ID NO: 16477 - RNA, 19 nt, artificial
  Oligomer
gacaguguggaguguuacg

SEQ ID NO: 16478 - RNA, 19 nt, artificial
  Oligomer
ucaugaacggugcugucau

SEQ ID NO: 16479 - RNA, 19 nt, artificial
  Oligomer
cuaugauggucaggaccag

SEQ ID NO: 16480 - RNA, 19 nt, artificial
  Oligomer
aauucagcugaguguuacu

SEQ ID NO: 16481 - RNA, 19 nt, artificial
  Oligomer
ugccucaguguuaaaauga

SEQ ID NO: 16482 - RNA, 19 nt, artificial
  Oligomer
accggauggacaguuauuu

SEQ ID NO: 16483 - RNA, 19 nt, artificial
  Oligomer
ucaagaucuucgaggagcu

SEQ ID NO: 16484 - RNA, 19 nt, artificial
  Oligomer
cugcauccaccacaacagu

SEQ ID NO: 16485 - RNA, 19 nt, artificial
  Oligomer
cgccucauugaauucgccu

SEQ ID NO: 16486 - RNA, 19 nt, artificial
  Oligomer
gaggcacuuuuguuucuug

SEQ ID NO: 16487 - RNA, 19 nt, artificial
  Oligomer
aaagaacagacuaacuagu

SEQ ID NO: 16488 - RNA, 19 nt, artificial
  Oligomer
uacccagagaggaacgagu

SEQ ID NO: 16489 - RNA, 19 nt, artificial
  Oligomer
ccuggucaagaucuucgag

SEQ ID NO: 16490 - RNA, 19 nt, artificial
  Oligomer
cuacacccuggaggaucau

SEQ ID NO: 16491 - RNA, 19 nt, artificial
  Oligomer
auugaccagcagaacugua

SEQ ID NO: 16492 - RNA, 19 nt, artificial
  Oligomer
accuguugaggcacuuuug

SEQ ID NO: 16493 - RNA, 19 nt, artificial
  Oligomer
caacuguaucuaugcugcu

SEQ ID NO: 16494 - RNA, 19 nt, artificial
  Oligomer
caguguuaaaaugacaucu

SEQ ID NO: 16495 - RNA, 19 nt, artificial
  Oligomer
cguccugcacaacuguauc

SEQ ID NO: 16496 - RNA, 19 nt, artificial
  Oligomer
cggauggacaguuauuuug

SEQ ID NO: 16497 - RNA, 19 nt, artificial
  Oligomer
ggucaagaucuucgaggag

SEQ ID NO: 16498 - RNA, 19 nt, artificial
  Oligomer
auggagcgccucauugaau

SEQ ID NO: 16499 - RNA, 19 nt, artificial
  Oligomer
uaaagaacagacuaacuag

SEQ ID NO: 16500 - RNA, 19 nt, artificial
  Oligomer
auaaagaacagacuaacua

SEQ ID NO: 16501 - RNA, 19 nt, artificial
  Oligomer
accgggacuaaaagaaaag

SEQ ID NO: 16502 - RNA, 19 nt, artificial
  Oligomer
ucuuccacgccugcaucaa

SEQ ID NO: 16503 - RNA, 19 nt, artificial
  Oligomer
guguugcuuaucuucugga

SEQ ID NO: 16504 - RNA, 19 nt, artificial
  Oligomer
gaaucuacguccuuggagg

SEQ ID NO: 16505 - RNA, 19 nt, artificial
  Oligomer
uggacaguuauuuuguuga

SEQ ID NO: 16506 - RNA, 19 nt, artificial
  Oligomer
ggugguguugcuuaucuuc

SEQ ID NO: 16507 - RNA, 19 nt, artificial
  Oligomer
ucacacugcaggucaagua

SEQ ID NO: 16508 - RNA, 19 nt, artificial
  Oligomer
acaucucaaaagaagucca

SEQ ID NO: 16509 - RNA, 19 nt, artificial
  Oligomer
ugcaggucaaguaccagga

SEQ ID NO: 16510 - RNA, 19 nt, artificial
  Oligomer
uaauuuuccaaggaaaaua

SEQ ID NO: 16511 - RNA, 19 nt, artificial
  Oligomer
ugcguccugcacaacugua

SEQ ID NO: 16512 - RNA, 19 nt, artificial
  Oligomer
uaacccuguaauuuuccaa

SEQ ID NO: 16513 - RNA, 19 nt, artificial
  Oligomer
uggaggcuaugauggucac

SEQ ID NO: 16514 - RNA, 19 nt, artificial
  Oligomer
uugauaaguaacccuguaa

SEQ ID NO: 16515 - RNA, 19 nt, artificial
  Oligomer
ugaucacagcaaugaacac

SEQ ID NO: 16516 - RNA, 19 nt, artificial
  Oligomer
guguggaaagagcaggcuu

SEQ ID NO: 16517 - RNA, 19 nt, artificial
  Oligomer
cagaacuguaccuguugag

SEQ ID NO: 16518 - RNA, 19 nt, artificial
  Oligomer
caaggacuaccuggucaag

SEQ ID NO: 16519 - RNA, 19 nt, artificial
  Oligomer
acccuggaggaucauacca

SEQ ID NO: 16520 - RNA, 19 nt, artificial
  Oligomer
acaucuacaugcauuuugg

SEQ ID NO: 16521 - RNA, 19 nt, artificial
  Oligomer
aauaaagaacagacuaacu

SEQ ID NO: 16522 - RNA, 19 nt, artificial
  Oligomer
augaucacagcaaugaaca

SEQ ID NO: 16523 - RNA, 19 nt, artificial
  Oligomer
guggugguguugcuuaucu

SEQ ID NO: 16524 - RNA, 19 nt, artificial
  Oligomer
uaaguaacccuguaauuuu

SEQ ID NO: 16525 - RNA, 19 nt, artificial
  Oligomer
acaguguggaguguuacga

SEQ ID NO: 16526 - RNA, 19 nt, artificial
  Oligomer
agaaguccaaagcgggaau

SEQ ID NO: 16527 - RNA, 19 nt, artificial
  Oligomer
uuguuucuugggcaaaaau

SEQ ID NO: 16528 - RNA, 19 nt, artificial
  Oligomer
aaggacuaccuggucaaga

SEQ ID NO: 16529 - RNA, 19 nt, artificial
  Oligomer
uguugauaaguaacccugu

SEQ ID NO: 16530 - RNA, 19 nt, artificial
  Oligomer
cuaugauggucacacguuc

SEQ ID NO: 16531 - RNA, 19 nt, artificial
  Oligomer
uuacgacccagauacagac

SEQ ID NO: 16532 - RNA, 19 nt, artificial
  Oligomer
ggacuaccuggucaagauc

SEQ ID NO: 16533 - RNA, 19 nt, artificial
  Oligomer
gcuaugauggucaggacca

SEQ ID NO: 16534 - RNA, 19 nt, artificial
  Oligomer
uguugaggcacuuuuguuu

SEQ ID NO: 16535 - RNA, 19 nt, artificial
  Oligomer
uguacaaaaaccgggacua

SEQ ID NO: 16536 - RNA, 19 nt, artificial
  Oligomer
uacgacccagauacagaca

SEQ ID NO: 16537 - RNA, 19 nt, artificial
  Oligomer
caucaacugggucaaguac

SEQ ID NO: 16538 - RNA, 19 nt, artificial
  Oligomer
aaaccgccuuaauucagcu

SEQ ID NO: 16539 - RNA, 19 nt, artificial
  Oligomer
agagguggugguguugcuu

SEQ ID NO: 16540 - RNA, 19 nt, artificial
  Oligomer
cgcuacgauguggaaacag

SEQ ID NO: 16541 - RNA, 19 nt, artificial
  Oligomer
ucaccaugugauuuauucu

SEQ ID NO: 16542 - RNA, 19 nt, artificial
  Oligomer
uggaggaucauaccaagca

SEQ ID NO: 16543 - RNA, 19 nt, artificial
  Oligomer
uauucuuggauaccuggga

SEQ ID NO: 16544 - RNA, 19 nt, artificial
  Oligomer
acugcaaauaacccaucuu

SEQ ID NO: 16545 - RNA, 19 nt, artificial
  Oligomer
guacaucuacaugcauuuu

SEQ ID NO: 16546 - RNA, 19 nt, artificial
  Oligomer
acguccuuggaggcuauga

SEQ ID NO: 16547 - RNA, 19 nt, artificial
  Oligomer
augccucaguguuaaaaug

SEQ ID NO: 16548 - RNA, 19 nt, artificial
  Oligomer
agcacugcaaauaacccau

SEQ ID NO: 16549 - RNA, 19 nt, artificial
  Oligomer
gcaaaaauacaguccaaug

SEQ ID NO: 16550 - RNA, 19 nt, artificial
  Oligomer
uguccucaaucgucuccuu

SEQ ID NO: 16551 - RNA, 19 nt, artificial
  Oligomer
gaccagcagaacuguaccu

SEQ ID NO: 16552 - RNA, 19 nt, artificial
  Oligomer
aagaggaguucuucaaccu

SEQ ID NO: 16553 - RNA, 19 nt, artificial
  Oligomer
guaccuguugaggcacuuu

SEQ ID NO: 16554 - RNA, 19 nt, artificial
  Oligomer
gacccagauacagacaccu

SEQ ID NO: 16555 - RNA, 19 nt, artificial
  Oligomer
ucauugaauucgccuacac

SEQ ID NO: 16556 - RNA, 19 nt, artificial
  Oligomer
guccaaagcgggaaucaug

SEQ ID NO: 16557 - RNA, 19 nt, artificial
  Oligomer
ugucaccaugugauuuauu

SEQ ID NO: 16558 - RNA, 19 nt, artificial
  Oligomer
guccuuggaggcuaugaug

SEQ ID NO: 16559 - RNA, 19 nt, artificial
  Oligomer
ugcaaggacuaccugguca

SEQ ID NO: 16560 - RNA, 19 nt, artificial
  Oligomer
uuuuguacaaaaaccggga

SEQ ID NO: 16561 - RNA, 19 nt, artificial
  Oligomer
gggagaaucuacguccuug

SEQ ID NO: 16562 - RNA, 19 nt, artificial
  Oligomer
gaacuuccugcagaugcag

SEQ ID NO: 16563 - RNA, 19 nt, artificial
  Oligomer
cagauacagacaccuggag

SEQ ID NO: 16564 - RNA, 19 nt, artificial
  Oligomer
ucauguaccagaucgacag

SEQ ID NO: 16565 - RNA, 19 nt, artificial
  Oligomer
gguggugguguugcuuauc

SEQ ID NO: 16566 - RNA, 19 nt, artificial
  Oligomer
cagcaaugaacaccauccg

SEQ ID NO: 16567 - RNA, 19 nt, artificial
  Oligomer
auggucacacguuccugga

SEQ ID NO: 16568 - RNA, 19 nt, artificial
  Oligomer
ccucauugaauucgccuac

SEQ ID NO: 16569 - RNA, 19 nt, artificial
  Oligomer
cuuuuguuucuugggcaaa

SEQ ID NO: 16570 - RNA, 19 nt, artificial
  Oligomer
ggagcgccucauugaauuc

SEQ ID NO: 16571 - RNA, 19 nt, artificial
  Oligomer
aguguuacgacccagauac

SEQ ID NO: 16572 - RNA, 19 nt, artificial
  Oligomer
uguaccuguugaggcacuu

SEQ ID NO: 16573 - RNA, 19 nt, artificial
  Oligomer
gguguugcuuaucuucugg

SEQ ID NO: 16574 - RNA, 19 nt, artificial
  Oligomer
gcuaugauggucacacguu

SEQ ID NO: 16575 - RNA, 19 nt, artificial
  Oligomer
uuaauucagcugaguguua

SEQ ID NO: 16576 - RNA, 19 nt, artificial
  Oligomer
agcgcuacgauguggaaac

SEQ ID NO: 16577 - RNA, 19 nt, artificial
  Oligomer
aucauuguuuuuguacaaa

SEQ ID NO: 16578 - RNA, 19 nt, artificial
  Oligomer
gcauccaccacaacagugu

SEQ ID NO: 16579 - RNA, 19 nt, artificial
  Oligomer
uguccuccacgucaugaac

SEQ ID NO: 16580 - RNA, 19 nt, artificial
  Oligomer
caucuacaugcauuuuggg

SEQ ID NO: 16581 - RNA, 19 nt, artificial
  Oligomer
aucacagcaaugaacacca

SEQ ID NO: 16582 - RNA, 19 nt, artificial
  Oligomer
aggaguucuucaaccuguc

SEQ ID NO: 16583 - RNA, 19 nt, artificial
  Oligomer
agaucuucgaggagcucac

SEQ ID NO: 16584 - RNA, 19 nt, artificial
  Oligomer
caagcaagaggaguucuuc

SEQ ID NO: 16585 - RNA, 19 nt, artificial
  Oligomer
uguuacuacccagagagga

SEQ ID NO: 16586 - RNA, 19 nt, artificial
  Oligomer
caagaggaguucuucaacc

SEQ ID NO: 16587 - RNA, 19 nt, artificial
  Oligomer
gugguguugcuuaucuucu

SEQ ID NO: 16588 - RNA, 19 nt, artificial
  Oligomer
aggaaaauaaagaacagac

SEQ ID NO: 16589 - RNA, 19 nt, artificial
  Oligomer
cgggaguacaucuacaugc

SEQ ID NO: 16590 - RNA, 19 nt, artificial
  Oligomer
aagaaguccaaagcgggaa

SEQ ID NO: 16591 - RNA, 19 nt, artificial
  Oligomer
cuguaccuguugaggcacu

SEQ ID NO: 16592 - RNA, 19 nt, artificial
  Oligomer
ucucaaaagaaguccaaag

SEQ ID NO: 16593 - RNA, 19 nt, artificial
  Oligomer
aaugaucacagcaaugaac

SEQ ID NO: 16594 - RNA, 19 nt, artificial
  Oligomer
gauuuauucuuggauaccu

SEQ ID NO: 16595 - RNA, 19 nt, artificial
  Oligomer
uccaaagcgggaaucaugu

SEQ ID NO: 16596 - RNA, 19 nt, artificial
  Oligomer
gagacguggacuuucguag

SEQ ID NO: 16597 - RNA, 19 nt, artificial
  Oligomer
ucuggaaaugugguuccca

SEQ ID NO: 16598 - RNA, 19 nt, artificial
  Oligomer
caccacaacaguguggaga

SEQ ID NO: 16599 - RNA, 19 nt, artificial
  Oligomer
ccaugaccaaucagugguc

SEQ ID NO: 16600 - RNA, 19 nt, artificial
  Oligomer
aacaguguggagagguaug

SEQ ID NO: 16601 - RNA, 19 nt, artificial
  Oligomer
acuuccugcagaugcagcu

SEQ ID NO: 16602 - RNA, 19 nt, artificial
  Oligomer
agcugcagaagugcgagau

SEQ ID NO: 16603 - RNA, 19 nt, artificial
  Oligomer
ucaaguacgacugcgaaca

SEQ ID NO: 16604 - RNA, 19 nt, artificial
  Oligomer
aaagacagcacugcaaaua

SEQ ID NO: 16605 - RNA, 19 nt, artificial
  Oligomer
uaccuguugaggcacuuuu

SEQ ID NO: 16606 - RNA, 19 nt, artificial
  Oligomer
acagagacguggacuuucg

SEQ ID NO: 16607 - RNA, 19 nt, artificial
  Oligomer
cauccaccacaacagugug

SEQ ID NO: 16608 - RNA, 19 nt, artificial
  Oligomer
aaguaacccuguaauuuuc

SEQ ID NO: 16609 - RNA, 19 nt, artificial
  Oligomer
gcaaauaacccaucuuccg

SEQ ID NO: 16610 - RNA, 19 nt, artificial
  Oligomer
aggugacccgaaugacauc

SEQ ID NO: 16611 - RNA, 19 nt, artificial
  Oligomer
uaaaaugacaucucaaaag

SEQ ID NO: 16612 - RNA, 19 nt, artificial
  Oligomer
gguguccauugaggguauc

SEQ ID NO: 16613 - RNA, 19 nt, artificial
  Oligomer
gccuuaauucagcugagug

SEQ ID NO: 16614 - RNA, 19 nt, artificial
  Oligomer
cacacugcaggucaaguac

SEQ ID NO: 16615 - RNA, 19 nt, artificial
  Oligomer
uggaaacagagacguggac

SEQ ID NO: 16616 - RNA, 19 nt, artificial
  Oligomer
cuuaauucagcugaguguu

SEQ ID NO: 16617 - RNA, 19 nt, artificial
  Oligomer
ggcacuuuuguuucuuggg

SEQ ID NO: 16618 - RNA, 19 nt, artificial
  Oligomer
gaucauaccaagcaggccu

SEQ ID NO: 16619 - RNA, 19 nt, artificial
  Oligomer
ugaggcacuuuuguuucuu

SEQ ID NO: 16620 - RNA, 19 nt, artificial
  Oligomer
uguuacgacccagauacag

SEQ ID NO: 16621 - RNA, 19 nt, artificial
  Oligomer
accacaacaguguggagag

SEQ ID NO: 16622 - RNA, 19 nt, artificial
  Oligomer
gugguguccauugagggua

SEQ ID NO: 16623 - RNA, 19 nt, artificial
  Oligomer
caaaccgccuuaauucagc

SEQ ID NO: 16624 - RNA, 19 nt, artificial
  Oligomer
gucaaguacgacugcgaac

SEQ ID NO: 16625 - RNA, 19 nt, artificial
  Oligomer
accgccuuaauucagcuga

SEQ ID NO: 16626 - RNA, 19 nt, artificial
  Oligomer
caggucaaguaccaggaug

SEQ ID NO: 16627 - RNA, 19 nt, artificial
  Oligomer
aaguccaaagcgggaauca

SEQ ID NO: 16628 - RNA, 19 nt, artificial
  Oligomer
augggccuguacauagaag

SEQ ID NO: 16629 - RNA, 19 nt, artificial
  Oligomer
cugcacaacuguaucuaug

SEQ ID NO: 16630 - RNA, 19 nt, artificial
  Oligomer
aguuauuuuguugauaagu

SEQ ID NO: 16631 - RNA, 19 nt, artificial
  Oligomer
gaggcuaugauggucacac

SEQ ID NO: 16632 - RNA, 19 nt, artificial
  Oligomer
caaaagaaguccaaagcgg

SEQ ID NO: 16633 - RNA, 19 nt, artificial
  Oligomer
aggcacuuuuguuucuugg

SEQ ID NO: 16634 - RNA, 19 nt, artificial
  Oligomer
aaauaaagaacagacuaac

SEQ ID NO: 16635 - RNA, 19 nt, artificial
  Oligomer
aacagcgacgguucuacgu

SEQ ID NO: 16636 - RNA, 19 nt, artificial
  Oligomer
agauugaccagcagaacug

SEQ ID NO: 16637 - RNA, 19 nt, artificial
  Oligomer
cccaugaccaaucaguggu

SEQ ID NO: 16638 - RNA, 19 nt, artificial
  Oligomer
agcgccucauugaauucgc

SEQ ID NO: 16639 - RNA, 19 nt, artificial
  Oligomer
ucagcugaguguuacuacc

SEQ ID NO: 16640 - RNA, 19 nt, artificial
  Oligomer
ugaccagcagaacuguacc

SEQ ID NO: 16641 - RNA, 19 nt, artificial
  Oligomer
ucuacguccuuggaggcua

SEQ ID NO: 16642 - RNA, 19 nt, artificial
  Oligomer
agcuaccuggaggcuuaca

SEQ ID NO: 16643 - RNA, 19 nt, artificial
  Oligomer
aguguggaguguuacgacc

SEQ ID NO: 16644 - RNA, 19 nt, artificial
  Oligomer
augugauuuauucuuggau

SEQ ID NO: 16645 - RNA, 19 nt, artificial
  Oligomer
cuggacaguguggaguguu

SEQ ID NO: 16646 - RNA, 19 nt, artificial
  Oligomer
gugauuuauucuuggauac

SEQ ID NO: 16647 - RNA, 19 nt, artificial
  Oligomer
aaacagagacguggacuuu

SEQ ID NO: 16648 - RNA, 19 nt, artificial
  Oligomer
cuguaucuaugcugcuggg

SEQ ID NO: 16649 - RNA, 19 nt, artificial
  Oligomer
acacccuggaggaucauac

SEQ ID NO: 16650 - RNA, 19 nt, artificial
  Oligomer
gaggaucauaccaagcagg

SEQ ID NO: 16651 - RNA, 19 nt, artificial
  Oligomer
aguguuacuacccagagag

SEQ ID NO: 16652 - RNA, 19 nt, artificial
  Oligomer
ccaaagcgggaaucaugug

SEQ ID NO: 16653 - RNA, 19 nt, artificial
  Oligomer
ugaguguuacuacccagag

SEQ ID NO: 16654 - RNA, 19 nt, artificial
  Oligomer
aaaagaaaagacagcacug

SEQ ID NO: 16655 - RNA, 19 nt, artificial
  Oligomer
uccugcacaacuguaucua

SEQ ID NO: 16656 - RNA, 19 nt, artificial
  Oligomer
uguaccagaucgacagcgu

SEQ ID NO: 16657 - RNA, 19 nt, artificial
  Oligomer
gacuaccuggucaagaucu

SEQ ID NO: 16658 - RNA, 19 nt, artificial
  Oligomer
guguuacuacccagagagg

SEQ ID NO: 16659 - RNA, 19 nt, artificial
  Oligomer
gggaguaucauuguuuuug

SEQ ID NO: 16660 - RNA, 19 nt, artificial
  Oligomer
ggaaacagagacguggacu

SEQ ID NO: 16661 - RNA, 19 nt, artificial
  Oligomer
guugcuuaucuucuggaac

SEQ ID NO: 16662 - RNA, 19 nt, artificial
  Oligomer
caaaaauacaguccaaugg

SEQ ID NO: 16663 - RNA, 19 nt, artificial
  Oligomer
acuaaaagaaaagacagca

SEQ ID NO: 16664 - RNA, 19 nt, artificial
  Oligomer
agaggaguucuucaaccug

SEQ ID NO: 16665 - RNA, 19 nt, artificial
  Oligomer
cugcaucaacugggucaag

SEQ ID NO: 16666 - RNA, 19 nt, artificial
  Oligomer
aacuagugucuuucacccu

SEQ ID NO: 16667 - RNA, 19 nt, artificial
  Oligomer
ucuugggcaaaaauacagu

SEQ ID NO: 16668 - RNA, 19 nt, artificial
  Oligomer
uacacccuggaggaucaua

SEQ ID NO: 16669 - RNA, 19 nt, artificial
  Oligomer
ucauccagcccugucuuca

SEQ ID NO: 16670 - RNA, 19 nt, artificial
  Oligomer
cuaccuggucaagaucuuc

SEQ ID NO: 16671 - RNA, 19 nt, artificial
  Oligomer
uuccacgccugcaucaacu

SEQ ID NO: 16672 - RNA, 19 nt, artificial
  Oligomer
cugcaaauaacccaucuuc

SEQ ID NO: 16673 - RNA, 19 nt, artificial
  Oligomer
cuuggaggcuaugaugguc

SEQ ID NO: 16674 - RNA, 19 nt, artificial
  Oligomer
ugucauguaccagaucgac

SEQ ID NO: 16675 - RNA, 19 nt, artificial
  Oligomer
auccagcccugucuucaag

SEQ ID NO: 16676 - RNA, 19 nt, artificial
  Oligomer
uggaaaugugguucccagg

SEQ ID NO: 16677 - RNA, 19 nt, artificial
  Oligomer
aggucaaguaccaggaugc

SEQ ID NO: 16678 - RNA, 19 nt, artificial
  Oligomer
uuggaggcuaugaugguca

SEQ ID NO: 16679 - RNA, 19 nt, artificial
  Oligomer
acagacuaacuagugucuu

SEQ ID NO: 16680 - RNA, 19 nt, artificial
  Oligomer
caacugggucaaguacgac

SEQ ID NO: 16681 - RNA, 19 nt, artificial
  Oligomer
caaucgucuccuuuaugcc

SEQ ID NO: 16682 - RNA, 19 nt, artificial
  Oligomer
aauaacccaucuuccggga

SEQ ID NO: 16683 - RNA, 19 nt, artificial
  Oligomer
auacagacaccuggagcga

SEQ ID NO: 16684 - RNA, 19 nt, artificial
  Oligomer
acuaacuagugucuuucac

SEQ ID NO: 16685 - RNA, 19 nt, artificial
  Oligomer
aguguuaaaaugacaucuc

SEQ ID NO: 16686 - RNA, 19 nt, artificial
  Oligomer
aacugggucaaguacgacu

SEQ ID NO: 16687 - RNA, 19 nt, artificial
  Oligomer
cucaaucgucuccuuuaug

SEQ ID NO: 16688 - RNA, 19 nt, artificial
  Oligomer
agcugucaccaugugauuu

SEQ ID NO: 16689 - RNA, 19 nt, artificial
  Oligomer
gucaccaugugauuuauuc

SEQ ID NO: 16690 - RNA, 19 nt, artificial
  Oligomer
accagaucgacagcguugu

SEQ ID NO: 16691 - RNA, 19 nt, artificial
  Oligomer
gaacuguaccuguugaggc

SEQ ID NO: 16692 - RNA, 19 nt, artificial
  Oligomer
acuacccagagaggaacga

SEQ ID NO: 16693 - RNA, 19 nt, artificial
  Oligomer
ugggccuguacauagaagc

SEQ ID NO: 16694 - RNA, 19 nt, artificial
  Oligomer
gauguggaaacagagacgu

SEQ ID NO: 16695 - RNA, 19 nt, artificial
  Oligomer
cuaaaagaaaagacagcac

SEQ ID NO: 16696 - RNA, 19 nt, artificial
  Oligomer
gucacacugcaggucaagu

SEQ ID NO: 16697 - RNA, 19 nt, artificial
  Oligomer
gacagcacugcaaauaacc

SEQ ID NO: 16698 - RNA, 19 nt, artificial
  Oligomer
cucaaaagaaguccaaagc

SEQ ID NO: 16699 - RNA, 19 nt, artificial
  Oligomer
agacguggacuuucguagc

SEQ ID NO: 16700 - RNA, 19 nt, artificial
  Oligomer
gucaugaacggugcuguca

SEQ ID NO: 16701 - RNA, 19 nt, artificial
  Oligomer
cuaacuagugucuuucacc

SEQ ID NO: 16702 - RNA, 19 nt, artificial
  Oligomer
agcagaacuguaccuguug

SEQ ID NO: 16703 - RNA, 19 nt, artificial
  Oligomer
gaacagacuaacuaguguc

SEQ ID NO: 16704 - RNA, 19 nt, artificial
  Oligomer
aacagacuaacuagugucu

SEQ ID NO: 16705 - RNA, 19 nt, artificial
  Oligomer
guuuuuguacaaaaaccgg

SEQ ID NO: 16706 - RNA, 19 nt, artificial
  Oligomer
uugaggcacuuuuguuucu

SEQ ID NO: 16707 - RNA, 19 nt, artificial
  Oligomer
aguguggagagguaugagc

SEQ ID NO: 16708 - RNA, 19 nt, artificial
  Oligomer
uuuuccaaggaaaauaaag

SEQ ID NO: 16709 - RNA, 19 nt, artificial
  Oligomer
aaaagaaguccaaagcggg

SEQ ID NO: 16710 - RNA, 19 nt, artificial
  Oligomer
uguggaaagagcaggcuuc

SEQ ID NO: 16711 - RNA, 19 nt, artificial
  Oligomer
ugacaucucaaaagaaguc

SEQ ID NO: 16712 - RNA, 19 nt, artificial
  Oligomer
acgauguggaaacagagac

SEQ ID NO: 16713 - RNA, 19 nt, artificial
  Oligomer
auaaguaacccuguaauuu

SEQ ID NO: 16714 - RNA, 19 nt, artificial
  Oligomer
ugcaucaacugggucaagu

SEQ ID NO: 16715 - RNA, 19 nt, artificial
  Oligomer
cauguaccagaucgacagc

SEQ ID NO: 16716 - RNA, 19 nt, artificial
  Oligomer
acgucaugaacggugcugu

SEQ ID NO: 16717 - RNA, 19 nt, artificial
  Oligomer
gacuaaaagaaaagacagc

SEQ ID NO: 16718 - RNA, 19 nt, artificial
  Oligomer
aaugcugacacgaaggauc

SEQ ID NO: 16719 - RNA, 19 nt, artificial
  Oligomer
aagaacagacuaacuagug

SEQ ID NO: 16720 - RNA, 19 nt, artificial
  Oligomer
ucgucuccuuuaugccgug

SEQ ID NO: 16721 - RNA, 19 nt, artificial
  Oligomer
auguggaaacagagacgug

SEQ ID NO: 16722 - RNA, 19 nt, artificial
  Oligomer
uguggaaacagagacgugg

SEQ ID NO: 16723 - RNA, 19 nt, artificial
  Oligomer
acuagugucuuucacccug

SEQ ID NO: 16724 - RNA, 19 nt, artificial
  Oligomer
guccugcacaacuguaucu

SEQ ID NO: 16725 - RNA, 19 nt, artificial
  Oligomer
uuggacuguauuuuugccc

SEQ ID NO: 16726 - RNA, 19 nt, artificial
  Oligomer
uucaaugaggcgcuccaug

SEQ ID NO: 16727 - RNA, 19 nt, artificial
  Oligomer
uucauugcugugaucauuc

SEQ ID NO: 16728 - RNA, 19 nt, artificial
  Oligomer
uuuuuguacaaaaacaaug

SEQ ID NO: 16729 - RNA, 19 nt, artificial
  Oligomer
auugcugugaucauucgcc

SEQ ID NO: 16730 - RNA, 19 nt, artificial
  Oligomer
ugcaucugcaggaaguucg

SEQ ID NO: 16731 - RNA, 19 nt, artificial
  Oligomer
ucuauguacaggcccaucc

SEQ ID NO: 16732 - RNA, 19 nt, artificial
  Oligomer
uucgcagucguacuugacc

SEQ ID NO: 16733 - RNA, 19 nt, artificial
  Oligomer
uuuccuuggaaaauuacag

SEQ ID NO: 16734 - RNA, 19 nt, artificial
  Oligomer
ugcauguagauguacuccc

SEQ ID NO: 16735 - RNA, 19 nt, artificial
  Oligomer
uuaacacugaggcauccug

SEQ ID NO: 16736 - RNA, 19 nt, artificial
  Oligomer
uugaagacagggcuggaug

SEQ ID NO: 16737 - RNA, 19 nt, artificial
  Oligomer
auuaaggcgguuugucccg

SEQ ID NO: 16738 - RNA, 19 nt, artificial
  Oligomer
uaucugggucguaacacuc

SEQ ID NO: 16739 - RNA, 19 nt, artificial
  Oligomer
uucuuuugagaugucauuu

SEQ ID NO: 16740 - RNA, 19 nt, artificial
  Oligomer
uuuucuuuuagucccgguu

SEQ ID NO: 16741 - RNA, 19 nt, artificial
  Oligomer
uuuuagucccgguuuuugu

SEQ ID NO: 16742 - RNA, 19 nt, artificial
  Oligomer
uaacacugaggcauccugg

SEQ ID NO: 16743 - RNA, 19 nt, artificial
  Oligomer
uacuugacccaguugaugc

SEQ ID NO: 16744 - RNA, 19 nt, artificial
  Oligomer
ucuguuuccacaucguagc

SEQ ID NO: 16745 - RNA, 19 nt, artificial
  Oligomer
ugucuuuucuuuuaguccc

SEQ ID NO: 16746 - RNA, 19 nt, artificial
  Oligomer
ucucuggguaguaacacuc

SEQ ID NO: 16747 - RNA, 19 nt, artificial
  Oligomer
aucauagccuccaaggacg

SEQ ID NO: 16748 - RNA, 19 nt, artificial
  Oligomer
uucugcagcugcaucugca

SEQ ID NO: 16749 - RNA, 19 nt, artificial
  Oligomer
uacaaaaacaaugauacuc

SEQ ID NO: 16750 - RNA, 19 nt, artificial
  Oligomer
uuccuuggaaaauuacagg

SEQ ID NO: 16751 - RNA, 19 nt, artificial
  Oligomer
aucugggucguaacacucc

SEQ ID NO: 16752 - RNA, 19 nt, artificial
  Oligomer
uucuauguacaggcccauc

SEQ ID NO: 16753 - RNA, 19 nt, artificial
  Oligomer
uguaucugggucguaacac

SEQ ID NO: 16754 - RNA, 19 nt, artificial
  Oligomer
ugagaugucauuuuaacac

SEQ ID NO: 16755 - RNA, 19 nt, artificial
  Oligomer
aauuaaggcgguuuguccc

SEQ ID NO: 16756 - RNA, 19 nt, artificial
  Oligomer
auaagcaacaccaccaccu

SEQ ID NO: 16757 - RNA, 19 nt, artificial
  Oligomer
uaacacuccacacugucca

SEQ ID NO: 16758 - RNA, 19 nt, artificial
  Oligomer
uugaccugcagugugacgu

SEQ ID NO: 16759 - RNA, 19 nt, artificial
  Oligomer
uucaugacguggaggacac

SEQ ID NO: 16760 - RNA, 19 nt, artificial
  Oligomer
uugguaugauccuccaggg

SEQ ID NO: 16761 - RNA, 19 nt, artificial
  Oligomer
uuucuuuuagucccgguuu

SEQ ID NO: 16762 - RNA, 19 nt, artificial
  Oligomer
uccaggugucuguaucugg

SEQ ID NO: 16763 - RNA, 19 nt, artificial
  Oligomer
uucugcuggucaaucugcu

SEQ ID NO: 16764 - RNA, 19 nt, artificial
  Oligomer
aucaacaaaauaacugucc

SEQ ID NO: 16765 - RNA, 19 nt, artificial
  Oligomer
uuugagaugucauuuuaac

SEQ ID NO: 16766 - RNA, 19 nt, artificial
  Oligomer
uugagaugucauuuuaaca

SEQ ID NO: 16767 - RNA, 19 nt, artificial
  Oligomer
ucaauggacaccaccucca

SEQ ID NO: 16768 - RNA, 19 nt, artificial
  Oligomer
uuauuugcagugcugucuu

SEQ ID NO: 16769 - RNA, 19 nt, artificial
  Oligomer
acaaaaacaaugauacucc

SEQ ID NO: 16770 - RNA, 19 nt, artificial
  Oligomer
auaaaggagacgauugagg

SEQ ID NO: 16771 - RNA, 19 nt, artificial
  Oligomer
ugucauuuuaacacugagg

SEQ ID NO: 16772 - RNA, 19 nt, artificial
  Oligomer
uugaccagguaguccuugc

SEQ ID NO: 16773 - RNA, 19 nt, artificial
  Oligomer
ucuuuucuuuuagucccgg

SEQ ID NO: 16774 - RNA, 19 nt, artificial
  Oligomer
auaacuguccauccggugg

SEQ ID NO: 16775 - RNA, 19 nt, artificial
  Oligomer
aaaauaacuguccauccgg

SEQ ID NO: 16776 - RNA, 19 nt, artificial
  Oligomer
cuguucuuuauuuuccuug

SEQ ID NO: 16777 - RNA, 19 nt, artificial
  Oligomer
uuagucccgguuuuuguac

SEQ ID NO: 16778 - RNA, 19 nt, artificial
  Oligomer
uuuaacacugaggcauccu

SEQ ID NO: 16779 - RNA, 19 nt, artificial
  Oligomer
aucuugaccagguaguccu

SEQ ID NO: 16780 - RNA, 19 nt, artificial
  Oligomer
cuugguaugauccuccagg

SEQ ID NO: 16781 - RNA, 19 nt, artificial
  Oligomer
uuaucaacaaaauaacugu

SEQ ID NO: 16782 - RNA, 19 nt, artificial
  Oligomer
cucagcugaauuaaggcgg

SEQ ID NO: 16783 - RNA, 19 nt, artificial
  Oligomer
ugcauccugguacuugacc

SEQ ID NO: 16784 - RNA, 19 nt, artificial
  Oligomer
uccacgucucuguuuccac

SEQ ID NO: 16785 - RNA, 19 nt, artificial
  Oligomer
uuccagaagauaagcaaca

SEQ ID NO: 16786 - RNA, 19 nt, artificial
  Oligomer
uuugcagugcugucuuuuc

SEQ ID NO: 16787 - RNA, 19 nt, artificial
  Oligomer
uguuuccacaucguagcgc

SEQ ID NO: 16788 - RNA, 19 nt, artificial
  Oligomer
ugggucguaacacuccaca

SEQ ID NO: 16789 - RNA, 19 nt, artificial
  Oligomer
uuuuccuuggaaaauuaca

SEQ ID NO: 16790 - RNA, 19 nt, artificial
  Oligomer
uccucgaagaucuugacca

SEQ ID NO: 16791 - RNA, 19 nt, artificial
  Oligomer
cuuaucaacaaaauaacug

SEQ ID NO: 16792 - RNA, 19 nt, artificial
  Oligomer
uccuuggaaaauuacaggg

SEQ ID NO: 16793 - RNA, 19 nt, artificial
  Oligomer
ucgaucugguacaugacag

SEQ ID NO: 16794 - RNA, 19 nt, artificial
  Oligomer
ucugguacaugacagcacc

SEQ ID NO: 16795 - RNA, 19 nt, artificial
  Oligomer
auguagauguacucccggg

SEQ ID NO: 16796 - RNA, 19 nt, artificial
  Oligomer
cucuguuuccacaucguag

SEQ ID NO: 16797 - RNA, 19 nt, artificial
  Oligomer
ucaacagguacaguucugc

SEQ ID NO: 16798 - RNA, 19 nt, artificial
  Oligomer
uaccucuccacacuguugu

SEQ ID NO: 16799 - RNA, 19 nt, artificial
  Oligomer
uguucuuuauuuuccuugg

SEQ ID NO: 16800 - RNA, 19 nt, artificial
  Oligomer
uugcagugcugucuuuucu

SEQ ID NO: 16801 - RNA, 19 nt, artificial
  Oligomer
uuggacuucuuuugagaug

SEQ ID NO: 16802 - RNA, 19 nt, artificial
  Oligomer
augcauguagauguacucc

SEQ ID NO: 16803 - RNA, 19 nt, artificial
  Oligomer
uuuuaacacugaggcaucc

SEQ ID NO: 16804 - RNA, 19 nt, artificial
  Oligomer
auuuuaacacugaggcauc

SEQ ID NO: 16805 - RNA, 19 nt, artificial
  Oligomer
uuccucucuggguaguaac

SEQ ID NO: 16806 - RNA, 19 nt, artificial
  Oligomer
uuaaggcgguuugucccgu

SEQ ID NO: 16807 - RNA, 19 nt, artificial
  Oligomer
ucaaugaggcgcuccauga

SEQ ID NO: 16808 - RNA, 19 nt, artificial
  Oligomer
uugaagaacuccucuugcu

SEQ ID NO: 16809 - RNA, 19 nt, artificial
  Oligomer
ugguacuugaccugcagug

SEQ ID NO: 16810 - RNA, 19 nt, artificial
  Oligomer
ucuguaucugggucguaac

SEQ ID NO: 16811 - RNA, 19 nt, artificial
  Oligomer
auagccuccaaggacguag

SEQ ID NO: 16812 - RNA, 19 nt, artificial
  Oligomer
aagauaagcaacaccacca

SEQ ID NO: 16813 - RNA, 19 nt, artificial
  Oligomer
auagauacaguugugcagg

SEQ ID NO: 16814 - RNA, 19 nt, artificial
  Oligomer
uggguaguaacacucagcu

SEQ ID NO: 16815 - RNA, 19 nt, artificial
  Oligomer
uuuuguacaaaaacaauga

SEQ ID NO: 16816 - RNA, 19 nt, artificial
  Oligomer
uccaaggacguagauucuc

SEQ ID NO: 16817 - RNA, 19 nt, artificial
  Oligomer
uuauuuuccuuggaaaauu

SEQ ID NO: 16818 - RNA, 19 nt, artificial
  Oligomer
cugcuugguaugauccucc

SEQ ID NO: 16819 - RNA, 19 nt, artificial
  Oligomer
uuguaagccuccagguagc

SEQ ID NO: 16820 - RNA, 19 nt, artificial
  Oligomer
uauguacaggcccaucccu

SEQ ID NO: 16821 - RNA, 19 nt, artificial
  Oligomer
uagucuguucuuuauuuuc

SEQ ID NO: 16822 - RNA, 19 nt, artificial
  Oligomer
uucuuuauuuuccuuggaa

SEQ ID NO: 16823 - RNA, 19 nt, artificial
  Oligomer
uuguacaaaaacaaugaua

SEQ ID NO: 16824 - RNA, 19 nt, artificial
  Oligomer
uuuagucccgguuuuugua

SEQ ID NO: 16825 - RNA, 19 nt, artificial
  Oligomer
ugcuggucaaucugcuucc

SEQ ID NO: 16826 - RNA, 19 nt, artificial
  Oligomer
aauaacuguccauccggug

SEQ ID NO: 16827 - RNA, 19 nt, artificial
  Oligomer
ucugggucguaacacucca

SEQ ID NO: 16828 - RNA, 19 nt, artificial
  Oligomer
uguacaaaaacaaugauac

SEQ ID NO: 16829 - RNA, 19 nt, artificial
  Oligomer
uacaggguuacuuaucaac

SEQ ID NO: 16830 - RNA, 19 nt, artificial
  Oligomer
uucggaugguguucauugc

SEQ ID NO: 16831 - RNA, 19 nt, artificial
  Oligomer
aaagacacuaguuagucug

SEQ ID NO: 16832 - RNA, 19 nt, artificial
  Oligomer
acucagcugaauuaaggcg

SEQ ID NO: 16833 - RNA, 19 nt, artificial
  Oligomer
ugaagaacuccucuugcuu

SEQ ID NO: 16834 - RNA, 19 nt, artificial
  Oligomer
ucuuuugagaugucauuuu

SEQ ID NO: 16835 - RNA, 19 nt, artificial
  Oligomer
uuuccacaucguagcgcuc

SEQ ID NO: 16836 - RNA, 19 nt, artificial
  Oligomer
auacccucaauggacacca

SEQ ID NO: 16837 - RNA, 19 nt, artificial
  Oligomer
auaccucuccacacuguug

SEQ ID NO: 16838 - RNA, 19 nt, artificial
  Oligomer
aacaaaauaacuguccauc

SEQ ID NO: 16839 - RNA, 19 nt, artificial
  Oligomer
uuuugagaugucauuuuaa

SEQ ID NO: 16840 - RNA, 19 nt, artificial
  Oligomer
auaaaucacauggugacag

SEQ ID NO: 16841 - RNA, 19 nt, artificial
  Oligomer
gucguaacacuccacacug

SEQ ID NO: 16842 - RNA, 19 nt, artificial
  Oligomer
ucguacuugacccaguuga

SEQ ID NO: 16843 - RNA, 19 nt, artificial
  Oligomer
aucugguacaugacagcac

SEQ ID NO: 16844 - RNA, 19 nt, artificial
  Oligomer
ugaaagacacuaguuaguc

SEQ ID NO: 16845 - RNA, 19 nt, artificial
  Oligomer
ucgaagaucuugaccaggu

SEQ ID NO: 16846 - RNA, 19 nt, artificial
  Oligomer
uaggcgaauucaaugaggc

SEQ ID NO: 16847 - RNA, 19 nt, artificial
  Oligomer
ugccucaacagguacaguu

SEQ ID NO: 16848 - RNA, 19 nt, artificial
  Oligomer
uugacccaguugaugcagg

SEQ ID NO: 16849 - RNA, 19 nt, artificial
  Oligomer
augucauucgggucaccuc

SEQ ID NO: 16850 - RNA, 19 nt, artificial
  Oligomer
cuucggaugguguucauug

SEQ ID NO: 16851 - RNA, 19 nt, artificial
  Oligomer
uaucaacaaaauaacuguc

SEQ ID NO: 16852 - RNA, 19 nt, artificial
  Oligomer
auccugguacuugaccugc

SEQ ID NO: 16853 - RNA, 19 nt, artificial
  Oligomer
ugugaccaucauagccucc

SEQ ID NO: 16854 - RNA, 19 nt, artificial
  Oligomer
aacagguacaguucugcug

SEQ ID NO: 16855 - RNA, 19 nt, artificial
  Oligomer
aucugcucagcgaaguugg

SEQ ID NO: 16856 - RNA, 19 nt, artificial
  Oligomer
uguagcugaaggugcgguu

SEQ ID NO: 16857 - RNA, 19 nt, artificial
  Oligomer
agucuguucuuuauuuucc

SEQ ID NO: 16858 - RNA, 19 nt, artificial
  Oligomer
uaagccuccagguagcuga

SEQ ID NO: 16859 - RNA, 19 nt, artificial
  Oligomer
cucauaccucuccacacug

SEQ ID NO: 16860 - RNA, 19 nt, artificial
  Oligomer
uacuuaucaacaaaauaac

SEQ ID NO: 16861 - RNA, 19 nt, artificial
  Oligomer
gucauuuuaacacugaggc

SEQ ID NO: 16862 - RNA, 19 nt, artificial
  Oligomer
uuagucuguucuuuauuuu

SEQ ID NO: 16863 - RNA, 19 nt, artificial
  Oligomer
cugucuuuucuuuuagucc

SEQ ID NO: 16864 - RNA, 19 nt, artificial
  Oligomer
uuuauuuuccuuggaaaau

SEQ ID NO: 16865 - RNA, 19 nt, artificial
  Oligomer
ucauugcugugaucauucg

SEQ ID NO: 16866 - RNA, 19 nt, artificial
  Oligomer
acagguacaguucugcugg

SEQ ID NO: 16867 - RNA, 19 nt, artificial
  Oligomer
ugaauuaaggcgguuuguc

SEQ ID NO: 16868 - RNA, 19 nt, artificial
  Oligomer
ugcaggaucucgcacuucu

SEQ ID NO: 16869 - RNA, 19 nt, artificial
  Oligomer
acgaaaguccacgucucug

SEQ ID NO: 16870 - RNA, 19 nt, artificial
  Oligomer
cuuuuagucccgguuuuug

SEQ ID NO: 16871 - RNA, 19 nt, artificial
  Oligomer
auacaguugugcaggacgc

SEQ ID NO: 16872 - RNA, 19 nt, artificial
  Oligomer
ucucuguuuccacaucgua

SEQ ID NO: 16873 - RNA, 19 nt, artificial
  Oligomer
acaaaagugccucaacagg

SEQ ID NO: 16874 - RNA, 19 nt, artificial
  Oligomer
aaucacauggugacagcug

SEQ ID NO: 16875 - RNA, 19 nt, artificial
  Oligomer
uccaagaauaaaucacaug

SEQ ID NO: 16876 - RNA, 19 nt, artificial
  Oligomer
acacuguccaggaacgugu

SEQ ID NO: 16877 - RNA, 19 nt, artificial
  Oligomer
cugcuggucaaucugcuuc

SEQ ID NO: 16878 - RNA, 19 nt, artificial
  Oligomer
uauuuuugcccaagaaaca

SEQ ID NO: 16879 - RNA, 19 nt, artificial
  Oligomer
uucuuuuagucccgguuuu

SEQ ID NO: 16880 - RNA, 19 nt, artificial
  Oligomer
uaagcaacaccaccaccuc

SEQ ID NO: 16881 - RNA, 19 nt, artificial
  Oligomer
uguaggcgaauucaaugag

SEQ ID NO: 16882 - RNA, 19 nt, artificial
  Oligomer
uauccaagaauaaaucaca

SEQ ID NO: 16883 - RNA, 19 nt, artificial
  Oligomer
aucacauggugacagcugc

SEQ ID NO: 16884 - RNA, 19 nt, artificial
  Oligomer
uggacuguauuuuugccca

SEQ ID NO: 16885 - RNA, 19 nt, artificial
  Oligomer
uuuuugcccaagaaacaaa

SEQ ID NO: 16886 - RNA, 19 nt, artificial
  Oligomer
accaucauagccuccaagg

SEQ ID NO: 16887 - RNA, 19 nt, artificial
  Oligomer
acaaaauaacuguccaucc

SEQ ID NO: 16888 - RNA, 19 nt, artificial
  Oligomer
ucuggguaguaacacucag

SEQ ID NO: 16889 - RNA, 19 nt, artificial
  Oligomer
acgugugaccaucauagcc

SEQ ID NO: 16890 - RNA, 19 nt, artificial
  Oligomer
aauucaaugaggcgcucca

SEQ ID NO: 16891 - RNA, 19 nt, artificial
  Oligomer
gucuuuucuuuuagucccg

SEQ ID NO: 16892 - RNA, 19 nt, artificial
  Oligomer
aauuacaggguuacuuauc

SEQ ID NO: 16893 - RNA, 19 nt, artificial
  Oligomer
auuugcagugcugucuuuu

SEQ ID NO: 16894 - RNA, 19 nt, artificial
  Oligomer
cuggguaguaacacucagc

SEQ ID NO: 16895 - RNA, 19 nt, artificial
  Oligomer
cugggaaccacauuuccag

SEQ ID NO: 16896 - RNA, 19 nt, artificial
  Oligomer
uucagcugguccugaccau

SEQ ID NO: 16897 - RNA, 19 nt, artificial
  Oligomer
aauggacaccaccuccaug

SEQ ID NO: 16898 - RNA, 19 nt, artificial
  Oligomer
uuuggacuucuuuugagau

SEQ ID NO: 16899 - RNA, 19 nt, artificial
  Oligomer
augauucccgcuuuggacu

SEQ ID NO: 16900 - RNA, 19 nt, artificial
  Oligomer
ugguacaugacagcaccgu

SEQ ID NO: 16901 - RNA, 19 nt, artificial
  Oligomer
ugcagugcugucuuuucuu

SEQ ID NO: 16902 - RNA, 19 nt, artificial
  Oligomer
aucccugggaaccacauuu

SEQ ID NO: 16903 - RNA, 19 nt, artificial
  Oligomer
guacaugacagcaccguuc

SEQ ID NO: 16904 - RNA, 19 nt, artificial
  Oligomer
auccuucgugucagcauug

SEQ ID NO: 16905 - RNA, 19 nt, artificial
  Oligomer
uaaaucacauggugacagc

SEQ ID NO: 16906 - RNA, 19 nt, artificial
  Oligomer
auuacaggguuacuuauca

SEQ ID NO: 16907 - RNA, 19 nt, artificial
  Oligomer
acaguucugcuggucaauc

SEQ ID NO: 16908 - RNA, 19 nt, artificial
  Oligomer
uacaugacagcaccguuca

SEQ ID NO: 16909 - RNA, 19 nt, artificial
  Oligomer
augguguucauugcuguga

SEQ ID NO: 16910 - RNA, 19 nt, artificial
  Oligomer
uacgaaaguccacgucucu

SEQ ID NO: 16911 - RNA, 19 nt, artificial
  Oligomer
aacgcugucgaucugguac

SEQ ID NO: 16912 - RNA, 19 nt, artificial
  Oligomer
aaugcauguagauguacuc

SEQ ID NO: 16913 - RNA, 19 nt, artificial
  Oligomer
ucccgcuuuggacuucuuu

SEQ ID NO: 16914 - RNA, 19 nt, artificial
  Oligomer
cguguaggcgaauucaaug

SEQ ID NO: 16915 - RNA, 19 nt, artificial
  Oligomer
uggguuauuugcagugcug

SEQ ID NO: 16916 - RNA, 19 nt, artificial
  Oligomer
ugggacagguugaagaacu

SEQ ID NO: 16917 - RNA, 19 nt, artificial
  Oligomer
uuuugcccaagaaacaaaa

SEQ ID NO: 16918 - RNA, 19 nt, artificial
  Oligomer
aaguucggcgucaacgagu

SEQ ID NO: 16919 - RNA, 19 nt, artificial
  Oligomer
acacuaguuagucuguucu

SEQ ID NO: 16920 - RNA, 19 nt, artificial
  Oligomer
aguucugcuggucaaucug

SEQ ID NO: 16921 - RNA, 19 nt, artificial
  Oligomer
cauguagauguacucccgg

SEQ ID NO: 16922 - RNA, 19 nt, artificial
  Oligomer
cgugugaccaucauagccu

SEQ ID NO: 16923 - RNA, 19 nt, artificial
  Oligomer
ucauaccucuccacacugu

SEQ ID NO: 16924 - RNA, 19 nt, artificial
  Oligomer
acagguugaagaacuccuc

SEQ ID NO: 16925 - RNA, 19 nt, artificial
  Oligomer
cacuucugcagcugcaucu

SEQ ID NO: 16926 - RNA, 19 nt, artificial
  Oligomer
cauugcugugaucauucgc

SEQ ID NO: 16927 - RNA, 19 nt, artificial
  Oligomer
guuauuugcagugcugucu

SEQ ID NO: 16928 - RNA, 19 nt, artificial
  Oligomer
ugaugagggucaccaguug

SEQ ID NO: 16929 - RNA, 19 nt, artificial
  Oligomer
cgucucuguuuccacaucg

SEQ ID NO: 16930 - RNA, 19 nt, artificial
  Oligomer
ucaguggaggcguacauca

SEQ ID NO: 16931 - RNA, 19 nt, artificial
  Oligomer
aaguccacgucucuguuuc

SEQ ID NO: 16932 - RNA, 19 nt, artificial
  Oligomer
auuggacuguauuuuugcc

SEQ ID NO: 16933 - RNA, 19 nt, artificial
  Oligomer
ucggaugguguucauugcu

SEQ ID NO: 16934 - RNA, 19 nt, artificial
  Oligomer
ugcccaagaaacaaaagug

SEQ ID NO: 16935 - RNA, 19 nt, artificial
  Oligomer
gaauuaaggcgguuugucc

SEQ ID NO: 16936 - RNA, 19 nt, artificial
  Oligomer
aagaacuccucuugcuugg

SEQ ID NO: 16937 - RNA, 19 nt, artificial
  Oligomer
uggauacccucaauggaca

SEQ ID NO: 16938 - RNA, 19 nt, artificial
  Oligomer
aaaugcauguagauguacu

SEQ ID NO: 16939 - RNA, 19 nt, artificial
  Oligomer
guuguaagccuccagguag

SEQ ID NO: 16940 - RNA, 19 nt, artificial
  Oligomer
aacaaaagugccucaacag

SEQ ID NO: 16941 - RNA, 19 nt, artificial
  Oligomer
acacucagcugaauuaagg

SEQ ID NO: 16942 - RNA, 19 nt, artificial
  Oligomer
ucuguucuuuauuuuccuu

SEQ ID NO: 16943 - RNA, 19 nt, artificial
  Oligomer
uggaagccugcucuuucca

SEQ ID NO: 16944 - RNA, 19 nt, artificial
  Oligomer
ucccugggaaccacauuuc

SEQ ID NO: 16945 - RNA, 19 nt, artificial
  Oligomer
guaacacuccacacugucc

SEQ ID NO: 16946 - RNA, 19 nt, artificial
  Oligomer
acuucuuuugagaugucau

SEQ ID NO: 16947 - RNA, 19 nt, artificial
  Oligomer
ucuuuauuuuccuuggaaa

SEQ ID NO: 16948 - RNA, 19 nt, artificial
  Oligomer
aaucugcucagcgaaguug

SEQ ID NO: 16949 - RNA, 19 nt, artificial
  Oligomer
uugcccaagaaacaaaagu

SEQ ID NO: 16950 - RNA, 19 nt, artificial
  Oligomer
cagaagauaagcaacacca

SEQ ID NO: 16951 - RNA, 19 nt, artificial
  Oligomer
ucuuuuagucccgguuuuu

SEQ ID NO: 16952 - RNA, 19 nt, artificial
  Oligomer
ccaagaauaaaucacaugg

SEQ ID NO: 16953 - RNA, 19 nt, artificial
  Oligomer
cuguucgcagucguacuug

SEQ ID NO: 16954 - RNA, 19 nt, artificial
  Oligomer
augucauuuuaacacugag

SEQ ID NO: 16955 - RNA, 19 nt, artificial
  Oligomer
guugaagaacuccucuugc

SEQ ID NO: 16956 - RNA, 19 nt, artificial
  Oligomer
aagaucuugaccagguagu

SEQ ID NO: 16957 - RNA, 19 nt, artificial
  Oligomer
guggauacccucaauggac

SEQ ID NO: 16958 - RNA, 19 nt, artificial
  Oligomer
auuuuccuuggaaaauuac

SEQ ID NO: 16959 - RNA, 19 nt, artificial
  Oligomer
uguauuuuugcccaagaaa

SEQ ID NO: 16960 - RNA, 19 nt, artificial
  Oligomer
uaaaggagacgauugagga

SEQ ID NO: 16961 - RNA, 19 nt, artificial
  Oligomer
aggaucucgcacuucugca

SEQ ID NO: 16962 - RNA, 19 nt, artificial
  Oligomer
uccuggaagccugcucuuu

SEQ ID NO: 16963 - RNA, 19 nt, artificial
  Oligomer
caugacagcaccguucaug

SEQ ID NO: 16964 - RNA, 19 nt, artificial
  Oligomer
cugaugagggucaccaguu

SEQ ID NO: 16965 - RNA, 19 nt, artificial
  Oligomer
uccuucgugucagcauugg

SEQ ID NO: 16966 - RNA, 19 nt, artificial
  Oligomer
ucugcuggucaaucugcuu

SEQ ID NO: 16967 - RNA, 19 nt, artificial
  Oligomer
ugucgaucugguacaugac

SEQ ID NO: 16968 - RNA, 19 nt, artificial
  Oligomer
agcauagauacaguugugc

SEQ ID NO: 16969 - RNA, 19 nt, artificial
  Oligomer
acuucugcagcugcaucug

SEQ ID NO: 16970 - RNA, 19 nt, artificial
  Oligomer
aagaauaaaucacauggug

SEQ ID NO: 16971 - RNA, 19 nt, artificial
  Oligomer
ccaaggacguagauucucc

SEQ ID NO: 16972 - RNA, 19 nt, artificial
  Oligomer
agauggguuauuugcagug

SEQ ID NO: 16973 - RNA, 19 nt, artificial
  Oligomer
guucugcuggucaaucugc

SEQ ID NO: 16974 - RNA, 19 nt, artificial
  Oligomer
cuucuuuugagaugucauu

SEQ ID NO: 16975 - RNA, 19 nt, artificial
  Oligomer
uggaaaauuacaggguuac

SEQ ID NO: 16976 - RNA, 19 nt, artificial
  Oligomer
guauuuuugcccaagaaac

SEQ ID NO: 16977 - RNA, 19 nt, artificial
  Oligomer
cguaacacuccacacuguc

SEQ ID NO: 16978 - RNA, 19 nt, artificial
  Oligomer
augacagcaccguucauga

SEQ ID NO: 16979 - RNA, 19 nt, artificial
  Oligomer
cugguccugaccaucauag

SEQ ID NO: 16980 - RNA, 19 nt, artificial
  Oligomer
aguaacacucagcugaauu

SEQ ID NO: 16981 - RNA, 19 nt, artificial
  Oligomer
ucauuuuaacacugaggca

SEQ ID NO: 16982 - RNA, 19 nt, artificial
  Oligomer
aaauaacuguccauccggu

SEQ ID NO: 16983 - RNA, 19 nt, artificial
  Oligomer
agcuccucgaagaucuuga

SEQ ID NO: 16984 - RNA, 19 nt, artificial
  Oligomer
acuguugugguggaugcag

SEQ ID NO: 16985 - RNA, 19 nt, artificial
  Oligomer
aggcgaauucaaugaggcg

SEQ ID NO: 16986 - RNA, 19 nt, artificial
  Oligomer
caagaaacaaaagugccuc

SEQ ID NO: 16987 - RNA, 19 nt, artificial
  Oligomer
acuaguuagucuguucuuu

SEQ ID NO: 16988 - RNA, 19 nt, artificial
  Oligomer
acucguuccucucugggua

SEQ ID NO: 16989 - RNA, 19 nt, artificial
  Oligomer
cucgaagaucuugaccagg

SEQ ID NO: 16990 - RNA, 19 nt, artificial
  Oligomer
augauccuccaggguguag

SEQ ID NO: 16991 - RNA, 19 nt, artificial
  Oligomer
uacaguucugcuggucaau

SEQ ID NO: 16992 - RNA, 19 nt, artificial
  Oligomer
caaaagugccucaacaggu

SEQ ID NO: 16993 - RNA, 19 nt, artificial
  Oligomer
agcagcauagauacaguug

SEQ ID NO: 16994 - RNA, 19 nt, artificial
  Oligomer
agaugucauuuuaacacug

SEQ ID NO: 16995 - RNA, 19 nt, artificial
  Oligomer
gauacaguugugcaggacg

SEQ ID NO: 16996 - RNA, 19 nt, artificial
  Oligomer
caaaauaacuguccauccg

SEQ ID NO: 16997 - RNA, 19 nt, artificial
  Oligomer
cuccucgaagaucuugacc

SEQ ID NO: 16998 - RNA, 19 nt, artificial
  Oligomer
auucaaugaggcgcuccau

SEQ ID NO: 16999 - RNA, 19 nt, artificial
  Oligomer
cuaguuagucuguucuuua

SEQ ID NO: 17000 - RNA, 19 nt, artificial
  Oligomer
uaguuagucuguucuuuau

SEQ ID NO: 17001 - RNA, 19 nt, artificial
  Oligomer
cuuuucuuuuagucccggu

SEQ ID NO: 17002 - RNA, 19 nt, artificial
  Oligomer
uugaugcaggcguggaaga

SEQ ID NO: 17003 - RNA, 19 nt, artificial
  Oligomer
uccagaagauaagcaacac

SEQ ID NO: 17004 - RNA, 19 nt, artificial
  Oligomer
ccuccaaggacguagauuc

SEQ ID NO: 17005 - RNA, 19 nt, artificial
  Oligomer
ucaacaaaauaacugucca

SEQ ID NO: 17006 - RNA, 19 nt, artificial
  Oligomer
gaagauaagcaacaccacc

SEQ ID NO: 17007 - RNA, 19 nt, artificial
  Oligomer
uacuugaccugcaguguga

SEQ ID NO: 17008 - RNA, 19 nt, artificial
  Oligomer
uggacuucuuuugagaugu

SEQ ID NO: 17009 - RNA, 19 nt, artificial
  Oligomer
uccugguacuugaccugca

SEQ ID NO: 17010 - RNA, 19 nt, artificial
  Oligomer
uauuuuccuuggaaaauua

SEQ ID NO: 17011 - RNA, 19 nt, artificial
  Oligomer
uacaguugugcaggacgca

SEQ ID NO: 17012 - RNA, 19 nt, artificial
  Oligomer
uuggaaaauuacaggguua

SEQ ID NO: 17013 - RNA, 19 nt, artificial
  Oligomer
gugaccaucauagccucca

SEQ ID NO: 17014 - RNA, 19 nt, artificial
  Oligomer
uuacaggguuacuuaucaa

SEQ ID NO: 17015 - RNA, 19 nt, artificial
  Oligomer
guguucauugcugugauca

SEQ ID NO: 17016 - RNA, 19 nt, artificial
  Oligomer
aagccugcucuuuccacac

SEQ ID NO: 17017 - RNA, 19 nt, artificial
  Oligomer
cucaacagguacaguucug

SEQ ID NO: 17018 - RNA, 19 nt, artificial
  Oligomer
cuugaccagguaguccuug

SEQ ID NO: 17019 - RNA, 19 nt, artificial
  Oligomer
ugguaugauccuccagggu

SEQ ID NO: 17020 - RNA, 19 nt, artificial
  Oligomer
ccaaaaugcauguagaugu

SEQ ID NO: 17021 - RNA, 19 nt, artificial
  Oligomer
aguuagucuguucuuuauu

SEQ ID NO: 17022 - RNA, 19 nt, artificial
  Oligomer
uguucauugcugugaucau

SEQ ID NO: 17023 - RNA, 19 nt, artificial
  Oligomer
agauaagcaacaccaccac

SEQ ID NO: 17024 - RNA, 19 nt, artificial
  Oligomer
aaaauuacaggguuacuua

SEQ ID NO: 17025 - RNA, 19 nt, artificial
  Oligomer
ucguaacacuccacacugu

SEQ ID NO: 17026 - RNA, 19 nt, artificial
  Oligomer
auucccgcuuuggacuucu

SEQ ID NO: 17027 - RNA, 19 nt, artificial
  Oligomer
auuuuugcccaagaaacaa

SEQ ID NO: 17028 - RNA, 19 nt, artificial
  Oligomer
ucuugaccagguaguccuu

SEQ ID NO: 17029 - RNA, 19 nt, artificial
  Oligomer
acaggguuacuuaucaaca

SEQ ID NO: 17030 - RNA, 19 nt, artificial
  Oligomer
gaacgugugaccaucauag

SEQ ID NO: 17031 - RNA, 19 nt, artificial
  Oligomer
gucuguaucugggucguaa

SEQ ID NO: 17032 - RNA, 19 nt, artificial
  Oligomer
gaucuugaccagguagucc

SEQ ID NO: 17033 - RNA, 19 nt, artificial
  Oligomer
ugguccugaccaucauagc

SEQ ID NO: 17034 - RNA, 19 nt, artificial
  Oligomer
aaacaaaagugccucaaca

SEQ ID NO: 17035 - RNA, 19 nt, artificial
  Oligomer
uagucccgguuuuuguaca

SEQ ID NO: 17036 - RNA, 19 nt, artificial
  Oligomer
ugucuguaucugggucgua

SEQ ID NO: 17037 - RNA, 19 nt, artificial
  Oligomer
guacuugacccaguugaug

SEQ ID NO: 17038 - RNA, 19 nt, artificial
  Oligomer
agcugaauuaaggcgguuu

SEQ ID NO: 17039 - RNA, 19 nt, artificial
  Oligomer
aagcaacaccaccaccucu

SEQ ID NO: 17040 - RNA, 19 nt, artificial
  Oligomer
cuguuuccacaucguagcg

SEQ ID NO: 17041 - RNA, 19 nt, artificial
  Oligomer
agaauaaaucacaugguga

SEQ ID NO: 17042 - RNA, 19 nt, artificial
  Oligomer
ugcuugguaugauccucca

SEQ ID NO: 17043 - RNA, 19 nt, artificial
  Oligomer
ucccagguauccaagaaua

SEQ ID NO: 17044 - RNA, 19 nt, artificial
  Oligomer
aagauggguuauuugcagu

SEQ ID NO: 17045 - RNA, 19 nt, artificial
  Oligomer
aaaaugcauguagauguac

SEQ ID NO: 17046 - RNA, 19 nt, artificial
  Oligomer
ucauagccuccaaggacgu

SEQ ID NO: 17047 - RNA, 19 nt, artificial
  Oligomer
cauuuuaacacugaggcau

SEQ ID NO: 17048 - RNA, 19 nt, artificial
  Oligomer
auggguuauuugcagugcu

SEQ ID NO: 17049 - RNA, 19 nt, artificial
  Oligomer
cauuggacuguauuuuugc

SEQ ID NO: 17050 - RNA, 19 nt, artificial
  Oligomer
aaggagacgauugaggaca

SEQ ID NO: 17051 - RNA, 19 nt, artificial
  Oligomer
agguacaguucugcugguc

SEQ ID NO: 17052 - RNA, 19 nt, artificial
  Oligomer
agguugaagaacuccucuu

SEQ ID NO: 17053 - RNA, 19 nt, artificial
  Oligomer
aaagugccucaacagguac

SEQ ID NO: 17054 - RNA, 19 nt, artificial
  Oligomer
aggugucuguaucuggguc

SEQ ID NO: 17055 - RNA, 19 nt, artificial
  Oligomer
guguaggcgaauucaauga

SEQ ID NO: 17056 - RNA, 19 nt, artificial
  Oligomer
caugauucccgcuuuggac

SEQ ID NO: 17057 - RNA, 19 nt, artificial
  Oligomer
aauaaaucacauggugaca

SEQ ID NO: 17058 - RNA, 19 nt, artificial
  Oligomer
caucauagccuccaaggac

SEQ ID NO: 17059 - RNA, 19 nt, artificial
  Oligomer
ugaccagguaguccuugca

SEQ ID NO: 17060 - RNA, 19 nt, artificial
  Oligomer
ucccgguuuuuguacaaaa

SEQ ID NO: 17061 - RNA, 19 nt, artificial
  Oligomer
caaggacguagauucuccc

SEQ ID NO: 17062 - RNA, 19 nt, artificial
  Oligomer
cugcaucugcaggaaguuc

SEQ ID NO: 17063 - RNA, 19 nt, artificial
  Oligomer
cuccaggugucuguaucug

SEQ ID NO: 17064 - RNA, 19 nt, artificial
  Oligomer
cugucgaucugguacauga

SEQ ID NO: 17065 - RNA, 19 nt, artificial
  Oligomer
gauaagcaacaccaccacc

SEQ ID NO: 17066 - RNA, 19 nt, artificial
  Oligomer
cggaugguguucauugcug

SEQ ID NO: 17067 - RNA, 19 nt, artificial
  Oligomer
uccaggaacgugugaccau

SEQ ID NO: 17068 - RNA, 19 nt, artificial
  Oligomer
guaggcgaauucaaugagg

SEQ ID NO: 17069 - RNA, 19 nt, artificial
  Oligomer
uuugcccaagaaacaaaag

SEQ ID NO: 17070 - RNA, 19 nt, artificial
  Oligomer
gaauucaaugaggcgcucc

SEQ ID NO: 17071 - RNA, 19 nt, artificial
  Oligomer
guaucugggucguaacacu

SEQ ID NO: 17072 - RNA, 19 nt, artificial
  Oligomer
aagugccucaacagguaca

SEQ ID NO: 17073 - RNA, 19 nt, artificial
  Oligomer
ccagaagauaagcaacacc

SEQ ID NO: 17074 - RNA, 19 nt, artificial
  Oligomer
aacgugugaccaucauagc

SEQ ID NO: 17075 - RNA, 19 nt, artificial
  Oligomer
uaacacucagcugaauuaa

SEQ ID NO: 17076 - RNA, 19 nt, artificial
  Oligomer
guuuccacaucguagcgcu

SEQ ID NO: 17077 - RNA, 19 nt, artificial
  Oligomer
uuuguacaaaaacaaugau

SEQ ID NO: 17078 - RNA, 19 nt, artificial
  Oligomer
acacuguugugguggaugc

SEQ ID NO: 17079 - RNA, 19 nt, artificial
  Oligomer
guucaugacguggaggaca

SEQ ID NO: 17080 - RNA, 19 nt, artificial
  Oligomer
cccaaaaugcauguagaug

SEQ ID NO: 17081 - RNA, 19 nt, artificial
  Oligomer
ugguguucauugcugugau

SEQ ID NO: 17082 - RNA, 19 nt, artificial
  Oligomer
gacagguugaagaacuccu

SEQ ID NO: 17083 - RNA, 19 nt, artificial
  Oligomer
gugagcuccucgaagaucu

SEQ ID NO: 17084 - RNA, 19 nt, artificial
  Oligomer
gaagaacuccucuugcuug

SEQ ID NO: 17085 - RNA, 19 nt, artificial
  Oligomer
uccucucuggguaguaaca

SEQ ID NO: 17086 - RNA, 19 nt, artificial
  Oligomer
gguugaagaacuccucuug

SEQ ID NO: 17087 - RNA, 19 nt, artificial
  Oligomer
agaagauaagcaacaccac

SEQ ID NO: 17088 - RNA, 19 nt, artificial
  Oligomer
gucuguucuuuauuuuccu

SEQ ID NO: 17089 - RNA, 19 nt, artificial
  Oligomer
gcauguagauguacucccg

SEQ ID NO: 17090 - RNA, 19 nt, artificial
  Oligomer
uucccgcuuuggacuucuu

SEQ ID NO: 17091 - RNA, 19 nt, artificial
  Oligomer
agugccucaacagguacag

SEQ ID NO: 17092 - RNA, 19 nt, artificial
  Oligomer
cuuuggacuucuuuugaga

SEQ ID NO: 17093 - RNA, 19 nt, artificial
  Oligomer
guucauugcugugaucauu

SEQ ID NO: 17094 - RNA, 19 nt, artificial
  Oligomer
agguauccaagaauaaauc

SEQ ID NO: 17095 - RNA, 19 nt, artificial
  Oligomer
acaugauucccgcuuugga

SEQ ID NO: 17096 - RNA, 19 nt, artificial
  Oligomer
cuacgaaaguccacgucuc

SEQ ID NO: 17097 - RNA, 19 nt, artificial
  Oligomer
ugggaaccacauuuccaga

SEQ ID NO: 17098 - RNA, 19 nt, artificial
  Oligomer
ucuccacacuguuguggug

SEQ ID NO: 17099 - RNA, 19 nt, artificial
  Oligomer
gaccacugauuggucaugg

SEQ ID NO: 17100 - RNA, 19 nt, artificial
  Oligomer
cauaccucuccacacuguu

SEQ ID NO: 17101 - RNA, 19 nt, artificial
  Oligomer
agcugcaucugcaggaagu

SEQ ID NO: 17102 - RNA, 19 nt, artificial
  Oligomer
aucucgcacuucugcagcu

SEQ ID NO: 17103 - RNA, 19 nt, artificial
  Oligomer
uguucgcagucguacuuga

SEQ ID NO: 17104 - RNA, 19 nt, artificial
  Oligomer
uauuugcagugcugucuuu

SEQ ID NO: 17105 - RNA, 19 nt, artificial
  Oligomer
aaaagugccucaacaggua

SEQ ID NO: 17106 - RNA, 19 nt, artificial
  Oligomer
cgaaaguccacgucucugu

SEQ ID NO: 17107 - RNA, 19 nt, artificial
  Oligomer
cacacuguugugguggaug

SEQ ID NO: 17108 - RNA, 19 nt, artificial
  Oligomer
gaaaauuacaggguuacuu

SEQ ID NO: 17109 - RNA, 19 nt, artificial
  Oligomer
cggaagauggguuauuugc

SEQ ID NO: 17110 - RNA, 19 nt, artificial
  Oligomer
gaugucauucgggucaccu

SEQ ID NO: 17111 - RNA, 19 nt, artificial
  Oligomer
cuuuugagaugucauuuua

SEQ ID NO: 17112 - RNA, 19 nt, artificial
  Oligomer
gauacccucaauggacacc

SEQ ID NO: 17113 - RNA, 19 nt, artificial
  Oligomer
cacucagcugaauuaaggc

SEQ ID NO: 17114 - RNA, 19 nt, artificial
  Oligomer
guacuugaccugcagugug

SEQ ID NO: 17115 - RNA, 19 nt, artificial
  Oligomer
guccacgucucuguuucca

SEQ ID NO: 17116 - RNA, 19 nt, artificial
  Oligomer
aacacucagcugaauuaag

SEQ ID NO: 17117 - RNA, 19 nt, artificial
  Oligomer
cccaagaaacaaaagugcc

SEQ ID NO: 17118 - RNA, 19 nt, artificial
  Oligomer
aggccugcuugguaugauc

SEQ ID NO: 17119 - RNA, 19 nt, artificial
  Oligomer
aagaaacaaaagugccuca

SEQ ID NO: 17120 - RNA, 19 nt, artificial
  Oligomer
cuguaucugggucguaaca

SEQ ID NO: 17121 - RNA, 19 nt, artificial
  Oligomer
cucuccacacuguuguggu

SEQ ID NO: 17122 - RNA, 19 nt, artificial
  Oligomer
uacccucaauggacaccac

SEQ ID NO: 17123 - RNA, 19 nt, artificial
  Oligomer
gcugaauuaaggcgguuug

SEQ ID NO: 17124 - RNA, 19 nt, artificial
  Oligomer
guucgcagucguacuugac

SEQ ID NO: 17125 - RNA, 19 nt, artificial
  Oligomer
ucagcugaauuaaggcggu

SEQ ID NO: 17126 - RNA, 19 nt, artificial
  Oligomer
cauccugguacuugaccug

SEQ ID NO: 17127 - RNA, 19 nt, artificial
  Oligomer
ugauucccgcuuuggacuu

SEQ ID NO: 17128 - RNA, 19 nt, artificial
  Oligomer
cuucuauguacaggcccau

SEQ ID NO: 17129 - RNA, 19 nt, artificial
  Oligomer
cauagauacaguugugcag

SEQ ID NO: 17130 - RNA, 19 nt, artificial
  Oligomer
acuuaucaacaaaauaacu

SEQ ID NO: 17131 - RNA, 19 nt, artificial
  Oligomer
gugugaccaucauagccuc

SEQ ID NO: 17132 - RNA, 19 nt, artificial
  Oligomer
ccgcuuuggacuucuuuug

SEQ ID NO: 17133 - RNA, 19 nt, artificial
  Oligomer
ccaagaaacaaaagugccu

SEQ ID NO: 17134 - RNA, 19 nt, artificial
  Oligomer
guuagucuguucuuuauuu

SEQ ID NO: 17135 - RNA, 19 nt, artificial
  Oligomer
acguagaaccgucgcuguu

SEQ ID NO: 17136 - RNA, 19 nt, artificial
  Oligomer
caguucugcuggucaaucu

SEQ ID NO: 17137 - RNA, 19 nt, artificial
  Oligomer
accacugauuggucauggg

SEQ ID NO: 17138 - RNA, 19 nt, artificial
  Oligomer
gcgaauucaaugaggcgcu

SEQ ID NO: 17139 - RNA, 19 nt, artificial
  Oligomer
gguaguaacacucagcuga

SEQ ID NO: 17140 - RNA, 19 nt, artificial
  Oligomer
gguacaguucugcugguca

SEQ ID NO: 17141 - RNA, 19 nt, artificial
  Oligomer
uagccuccaaggacguaga

SEQ ID NO: 17142 - RNA, 19 nt, artificial
  Oligomer
uguaagccuccagguagcu

SEQ ID NO: 17143 - RNA, 19 nt, artificial
  Oligomer
ggucguaacacuccacacu

SEQ ID NO: 17144 - RNA, 19 nt, artificial
  Oligomer
auccaagaauaaaucacau

SEQ ID NO: 17145 - RNA, 19 nt, artificial
  Oligomer
aacacuccacacuguccag

SEQ ID NO: 17146 - RNA, 19 nt, artificial
  Oligomer
guauccaagaauaaaucac

SEQ ID NO: 17147 - RNA, 19 nt, artificial
  Oligomer
aaaguccacgucucuguuu

SEQ ID NO: 17148 - RNA, 19 nt, artificial
  Oligomer
cccagcagcauagauacag

SEQ ID NO: 17149 - RNA, 19 nt, artificial
  Oligomer
guaugauccuccagggugu

SEQ ID NO: 17150 - RNA, 19 nt, artificial
  Oligomer
ccugcuugguaugauccuc

SEQ ID NO: 17151 - RNA, 19 nt, artificial
  Oligomer
cucucuggguaguaacacu

SEQ ID NO: 17152 - RNA, 19 nt, artificial
  Oligomer
cacaugauucccgcuuugg

SEQ ID NO: 17153 - RNA, 19 nt, artificial
  Oligomer
cucuggguaguaacacuca

SEQ ID NO: 17154 - RNA, 19 nt, artificial
  Oligomer
cagugcugucuuuucuuuu

SEQ ID NO: 17155 - RNA, 19 nt, artificial
  Oligomer
uagauacaguugugcagga

SEQ ID NO: 17156 - RNA, 19 nt, artificial
  Oligomer
acgcugucgaucugguaca

SEQ ID NO: 17157 - RNA, 19 nt, artificial
  Oligomer
agaucuugaccagguaguc

SEQ ID NO: 17158 - RNA, 19 nt, artificial
  Oligomer
ccucucuggguaguaacac

SEQ ID NO: 17159 - RNA, 19 nt, artificial
  Oligomer
caaaaacaaugauacuccc

SEQ ID NO: 17160 - RNA, 19 nt, artificial
  Oligomer
aguccacgucucuguuucc

SEQ ID NO: 17161 - RNA, 19 nt, artificial
  Oligomer
guuccagaagauaagcaac

SEQ ID NO: 17162 - RNA, 19 nt, artificial
  Oligomer
ccauuggacuguauuuuug

SEQ ID NO: 17163 - RNA, 19 nt, artificial
  Oligomer
ugcugucuuuucuuuuagu

SEQ ID NO: 17164 - RNA, 19 nt, artificial
  Oligomer
cagguugaagaacuccucu

SEQ ID NO: 17165 - RNA, 19 nt, artificial
  Oligomer
cuugacccaguugaugcag

SEQ ID NO: 17166 - RNA, 19 nt, artificial
  Oligomer
agggugaaagacacuaguu

SEQ ID NO: 17167 - RNA, 19 nt, artificial
  Oligomer
acuguauuuuugcccaaga

SEQ ID NO: 17168 - RNA, 19 nt, artificial
  Oligomer
uaugauccuccagggugua

SEQ ID NO: 17169 - RNA, 19 nt, artificial
  Oligomer
ugaagacagggcuggauga

SEQ ID NO: 17170 - RNA, 19 nt, artificial
  Oligomer
gaagaucuugaccagguag

SEQ ID NO: 17171 - RNA, 19 nt, artificial
  Oligomer
aguugaugcaggcguggaa

SEQ ID NO: 17172 - RNA, 19 nt, artificial
  Oligomer
gaagauggguuauuugcag

SEQ ID NO: 17173 - RNA, 19 nt, artificial
  Oligomer
gaccaucauagccuccaag

SEQ ID NO: 17174 - RNA, 19 nt, artificial
  Oligomer
gucgaucugguacaugaca

SEQ ID NO: 17175 - RNA, 19 nt, artificial
  Oligomer
cuugaagacagggcuggau

SEQ ID NO: 17176 - RNA, 19 nt, artificial
  Oligomer
ccugggaaccacauuucca

SEQ ID NO: 17177 - RNA, 19 nt, artificial
  Oligomer
gcauccugguacuugaccu

SEQ ID NO: 17178 - RNA, 19 nt, artificial
  Oligomer
ugaccaucauagccuccaa

SEQ ID NO: 17179 - RNA, 19 nt, artificial
  Oligomer
aagacacuaguuagucugu

SEQ ID NO: 17180 - RNA, 19 nt, artificial
  Oligomer
gucguacuugacccaguug

SEQ ID NO: 17181 - RNA, 19 nt, artificial
  Oligomer
ggcauaaaggagacgauug

SEQ ID NO: 17182 - RNA, 19 nt, artificial
  Oligomer
ucccggaagauggguuauu

SEQ ID NO: 17183 - RNA, 19 nt, artificial
  Oligomer
ucgcuccaggugucuguau

SEQ ID NO: 17184 - RNA, 19 nt, artificial
  Oligomer
gugaaagacacuaguuagu

SEQ ID NO: 17185 - RNA, 19 nt, artificial
  Oligomer
gagaugucauuuuaacacu

SEQ ID NO: 17186 - RNA, 19 nt, artificial
  Oligomer
agucguacuugacccaguu

SEQ ID NO: 17187 - RNA, 19 nt, artificial
  Oligomer
cauaaaggagacgauugag

SEQ ID NO: 17188 - RNA, 19 nt, artificial
  Oligomer
aaaucacauggugacagcu

SEQ ID NO: 17189 - RNA, 19 nt, artificial
  Oligomer
gaauaaaucacauggugac

SEQ ID NO: 17190 - RNA, 19 nt, artificial
  Oligomer
acaacgcugucgaucuggu

SEQ ID NO: 17191 - RNA, 19 nt, artificial
  Oligomer
gccucaacagguacaguuc

SEQ ID NO: 17192 - RNA, 19 nt, artificial
  Oligomer
ucguuccucucuggguagu

SEQ ID NO: 17193 - RNA, 19 nt, artificial
  Oligomer
gcuucuauguacaggccca

SEQ ID NO: 17194 - RNA, 19 nt, artificial
  Oligomer
acgucucuguuuccacauc

SEQ ID NO: 17195 - RNA, 19 nt, artificial
  Oligomer
gugcugucuuuucuuuuag

SEQ ID NO: 17196 - RNA, 19 nt, artificial
  Oligomer
acuugaccugcagugugac

SEQ ID NO: 17197 - RNA, 19 nt, artificial
  Oligomer
gguuauuugcagugcuguc

SEQ ID NO: 17198 - RNA, 19 nt, artificial
  Oligomer
gcuuuggacuucuuuugag

SEQ ID NO: 17199 - RNA, 19 nt, artificial
  Oligomer
gcuacgaaaguccacgucu

SEQ ID NO: 17200 - RNA, 19 nt, artificial
  Oligomer
ugacagcaccguucaugac

SEQ ID NO: 17201 - RNA, 19 nt, artificial
  Oligomer
ggugaaagacacuaguuag

SEQ ID NO: 17202 - RNA, 19 nt, artificial
  Oligomer
caacagguacaguucugcu

SEQ ID NO: 17203 - RNA, 19 nt, artificial
  Oligomer
gacacuaguuagucuguuc

SEQ ID NO: 17204 - RNA, 19 nt, artificial
  Oligomer
agacacuaguuagucuguu

SEQ ID NO: 17205 - RNA, 19 nt, artificial
  Oligomer
ccgguuuuuguacaaaaac

SEQ ID NO: 17206 - RNA, 19 nt, artificial
  Oligomer
agaaacaaaagugccucaa

SEQ ID NO: 17207 - RNA, 19 nt, artificial
  Oligomer
gcucauaccucuccacacu

SEQ ID NO: 17208 - RNA, 19 nt, artificial
  Oligomer
cuuuauuuuccuuggaaaa

SEQ ID NO: 17209 - RNA, 19 nt, artificial
  Oligomer
cccgcuuuggacuucuuuu

SEQ ID NO: 17210 - RNA, 19 nt, artificial
  Oligomer
gaagccugcucuuuccaca

SEQ ID NO: 17211 - RNA, 19 nt, artificial
  Oligomer
gacuucuuuugagauguca

SEQ ID NO: 17212 - RNA, 19 nt, artificial
  Oligomer
gucucuguuuccacaucgu

SEQ ID NO: 17213 - RNA, 19 nt, artificial
  Oligomer
aaauuacaggguuacuuau

SEQ ID NO: 17214 - RNA, 19 nt, artificial
  Oligomer
acuugacccaguugaugca

SEQ ID NO: 17215 - RNA, 19 nt, artificial
  Oligomer
gcugucgaucugguacaug

SEQ ID NO: 17216 - RNA, 19 nt, artificial
  Oligomer
acagcaccguucaugacgu

SEQ ID NO: 17217 - RNA, 19 nt, artificial
  Oligomer
gcugucuuuucuuuuaguc

SEQ ID NO: 17218 - RNA, 19 nt, artificial
  Oligomer
gauccuucgugucagcauu

SEQ ID NO: 17219 - RNA, 19 nt, artificial
  Oligomer
cacuaguuagucuguucuu

SEQ ID NO: 17220 - RNA, 19 nt, artificial
  Oligomer
cacggcauaaaggagacga

SEQ ID NO: 17221 - RNA, 19 nt, artificial
  Oligomer
cacgucucuguuuccacau

SEQ ID NO: 17222 - RNA, 19 nt, artificial
  Oligomer
ccacgucucuguuuccaca

SEQ ID NO: 17223 - RNA, 19 nt, artificial
  Oligomer
cagggugaaagacacuagu

SEQ ID NO: 17224 - RNA, 19 nt, artificial
  Oligomer
agauacaguugugcaggac

SEQ ID NO: 17225 - RNA, 19 nt, artificial
  Oligomer
cggugaagcccaaugcaaa

SEQ ID NO: 17226 - RNA, 19 nt, artificial
  Oligomer
gggaauuucuggugacaua

SEQ ID NO: 17227 - RNA, 19 nt, artificial
  Oligomer
caaucaucggguuaaaaaa

SEQ ID NO: 17228 - RNA, 19 nt, artificial
  Oligomer
cacugauugugccuuauaa

SEQ ID NO: 17229 - RNA, 19 nt, artificial
  Oligomer
ggagagucauuguuugcaa

SEQ ID NO: 17230 - RNA, 19 nt, artificial
  Oligomer
cucgcaugcugauaacaau

SEQ ID NO: 17231 - RNA, 19 nt, artificial
  Oligomer
auacaaagcuggauaauaa

SEQ ID NO: 17232 - RNA, 19 nt, artificial
  Oligomer
caucaauaucccucuugua

SEQ ID NO: 17233 - RNA, 19 nt, artificial
  Oligomer
gucauuguuugcaauacaa

SEQ ID NO: 17234 - RNA, 19 nt, artificial
  Oligomer
gcguuaucugggucuggaa

SEQ ID NO: 17235 - RNA, 19 nt, artificial
  Oligomer
gcaauacaaagcuggauaa

SEQ ID NO: 17236 - RNA, 19 nt, artificial
  Oligomer
ccucgcaugcugauaacaa

SEQ ID NO: 17237 - RNA, 19 nt, artificial
  Oligomer
gucgguuuucccauuugaa

SEQ ID NO: 17238 - RNA, 19 nt, artificial
  Oligomer
agugggaaaccauucaaaa

SEQ ID NO: 17239 - RNA, 19 nt, artificial
  Oligomer
cuucauauaccaugauaua

SEQ ID NO: 17240 - RNA, 19 nt, artificial
  Oligomer
cacgcuucaaugagaacaa

SEQ ID NO: 17241 - RNA, 19 nt, artificial
  Oligomer
aagucaucuacuuaauaaa

SEQ ID NO: 17242 - RNA, 19 nt, artificial
  Oligomer
guacaaucaucggguuaaa

SEQ ID NO: 17243 - RNA, 19 nt, artificial
  Oligomer
cugggucuggaaacccaaa

SEQ ID NO: 17244 - RNA, 19 nt, artificial
  Oligomer
gguuaaaaaacucaaugaa

SEQ ID NO: 17245 - RNA, 19 nt, artificial
  Oligomer
ggaaaccauucaaaauaca

SEQ ID NO: 17246 - RNA, 19 nt, artificial
  Oligomer
cucacuuguugcaguacaa

SEQ ID NO: 17247 - RNA, 19 nt, artificial
  Oligomer
acggugaagcccaaugcaa

SEQ ID NO: 17248 - RNA, 19 nt, artificial
  Oligomer
cagcaaacugggaauuucu

SEQ ID NO: 17249 - RNA, 19 nt, artificial
  Oligomer
agucauuguuugcaauaca

SEQ ID NO: 17250 - RNA, 19 nt, artificial
  Oligomer
cuucaagguugcagugaau

SEQ ID NO: 17251 - RNA, 19 nt, artificial
  Oligomer
cccucuuguaagucaucua

SEQ ID NO: 17252 - RNA, 19 nt, artificial
  Oligomer
cguuaucugggucuggaaa

SEQ ID NO: 17253 - RNA, 19 nt, artificial
  Oligomer
acuucaagguugcagugaa

SEQ ID NO: 17254 - RNA, 19 nt, artificial
  Oligomer
gaagcccaaugcaaacaga

SEQ ID NO: 17255 - RNA, 19 nt, artificial
  Oligomer
gaaaccauucaaaauacaa

SEQ ID NO: 17256 - RNA, 19 nt, artificial
  Oligomer
caaacagaauugcuuuaga

SEQ ID NO: 17257 - RNA, 19 nt, artificial
  Oligomer
caaugagaacaacaggaga

SEQ ID NO: 17258 - RNA, 19 nt, artificial
  Oligomer
cacugugagugaaaauuuu

SEQ ID NO: 17259 - RNA, 19 nt, artificial
  Oligomer
gugccucgcaugcugauaa

SEQ ID NO: 17260 - RNA, 19 nt, artificial
  Oligomer
gagagucauuguuugcaau

SEQ ID NO: 17261 - RNA, 19 nt, artificial
  Oligomer
gcuucauauaccaugauau

SEQ ID NO: 17262 - RNA, 19 nt, artificial
  Oligomer
gauguugccuuccacuuua

SEQ ID NO: 17263 - RNA, 19 nt, artificial
  Oligomer
ucgguuuucccauuugaaa

SEQ ID NO: 17264 - RNA, 19 nt, artificial
  Oligomer
gaauuucuggugacauaga

SEQ ID NO: 17265 - RNA, 19 nt, artificial
  Oligomer
gugggaaaccauucaaaau

SEQ ID NO: 17266 - RNA, 19 nt, artificial
  Oligomer
ucauuguuugcaauacaaa

SEQ ID NO: 17267 - RNA, 19 nt, artificial
  Oligomer
agugcuucauauaccauga

SEQ ID NO: 17268 - RNA, 19 nt, artificial
  Oligomer
cugugagugaaaauuuuua

SEQ ID NO: 17269 - RNA, 19 nt, artificial
  Oligomer
aagugggaaaccauucaaa

SEQ ID NO: 17270 - RNA, 19 nt, artificial
  Oligomer
cauucaaaauacaaguacu

SEQ ID NO: 17271 - RNA, 19 nt, artificial
  Oligomer
aagcccaaugcaaacagaa

SEQ ID NO: 17272 - RNA, 19 nt, artificial
  Oligomer
cgcuucaaugagaacaaca

SEQ ID NO: 17273 - RNA, 19 nt, artificial
  Oligomer
gagugaaaauuuuuacauu

SEQ ID NO: 17274 - RNA, 19 nt, artificial
  Oligomer
caauucugggcacggugaa

SEQ ID NO: 17275 - RNA, 19 nt, artificial
  Oligomer
agucgguuuucccauuuga

SEQ ID NO: 17276 - RNA, 19 nt, artificial
  Oligomer
acccacgcuucaaugagaa

SEQ ID NO: 17277 - RNA, 19 nt, artificial
  Oligomer
ggaguauuugaggcucgga

SEQ ID NO: 17278 - RNA, 19 nt, artificial
  Oligomer
guuaaaaaacucaaugaaa

SEQ ID NO: 17279 - RNA, 19 nt, artificial
  Oligomer
cauuguuugcaauacaaag

SEQ ID NO: 17280 - RNA, 19 nt, artificial
  Oligomer
caagguugcagugaaugau

SEQ ID NO: 17281 - RNA, 19 nt, artificial
  Oligomer
ucugggucuggaaacccaa

SEQ ID NO: 17282 - RNA, 19 nt, artificial
  Oligomer
ggguuaaaaaacucaauga

SEQ ID NO: 17283 - RNA, 19 nt, artificial
  Oligomer
ccucaccagugcuucauau

SEQ ID NO: 17284 - RNA, 19 nt, artificial
  Oligomer
aacccacgcuucaaugaga

SEQ ID NO: 17285 - RNA, 19 nt, artificial
  Oligomer
accaugauauaaucugaaa

SEQ ID NO: 17286 - RNA, 19 nt, artificial
  Oligomer
ggaagggaagaaagacagu

SEQ ID NO: 17287 - RNA, 19 nt, artificial
  Oligomer
gaaucuaaaccuuacaugu

SEQ ID NO: 17288 - RNA, 19 nt, artificial
  Oligomer
auguugccuuccacuuuaa

SEQ ID NO: 17289 - RNA, 19 nt, artificial
  Oligomer
caauaucccucuuguaagu

SEQ ID NO: 17290 - RNA, 19 nt, artificial
  Oligomer
ggugaagcccaaugcaaac

SEQ ID NO: 17291 - RNA, 19 nt, artificial
  Oligomer
gaaagugggaaaccauuca

SEQ ID NO: 17292 - RNA, 19 nt, artificial
  Oligomer
agaccucaccagugcuuca

SEQ ID NO: 17293 - RNA, 19 nt, artificial
  Oligomer
accagugcuucauauacca

SEQ ID NO: 17294 - RNA, 19 nt, artificial
  Oligomer
cccauuugaaagugggaaa

SEQ ID NO: 17295 - RNA, 19 nt, artificial
  Oligomer
guaagucaucuacuuaaua

SEQ ID NO: 17296 - RNA, 19 nt, artificial
  Oligomer
cugggaauuucuggugaca

SEQ ID NO: 17297 - RNA, 19 nt, artificial
  Oligomer
agcccaaugcaaacagaau

SEQ ID NO: 17298 - RNA, 19 nt, artificial
  Oligomer
ggaaugauguugccuucca

SEQ ID NO: 17299 - RNA, 19 nt, artificial
  Oligomer
aaagugggaaaccauucaa

SEQ ID NO: 17300 - RNA, 19 nt, artificial
  Oligomer
uggagcaccuggagcuuau

SEQ ID NO: 17301 - RNA, 19 nt, artificial
  Oligomer
cagugaauuaccugucuca

SEQ ID NO: 17302 - RNA, 19 nt, artificial
  Oligomer
ugggaaaccauucaaaaua

SEQ ID NO: 17303 - RNA, 19 nt, artificial
  Oligomer
gggaaaccauucaaaauac

SEQ ID NO: 17304 - RNA, 19 nt, artificial
  Oligomer
gucaucuacuuaauaaaua

SEQ ID NO: 17305 - RNA, 19 nt, artificial
  Oligomer
gggaagggaagaaagacag

SEQ ID NO: 17306 - RNA, 19 nt, artificial
  Oligomer
caauacaaagcuggauaau

SEQ ID NO: 17307 - RNA, 19 nt, artificial
  Oligomer
auaccaugauauaaucuga

SEQ ID NO: 17308 - RNA, 19 nt, artificial
  Oligomer
ggugacauagaccucacca

SEQ ID NO: 17309 - RNA, 19 nt, artificial
  Oligomer
gaaugauguugccuuccac

SEQ ID NO: 17310 - RNA, 19 nt, artificial
  Oligomer
cuggaaacccaaacccuca

SEQ ID NO: 17311 - RNA, 19 nt, artificial
  Oligomer
ugcuucauauaccaugaua

SEQ ID NO: 17312 - RNA, 19 nt, artificial
  Oligomer
aauacaaagcuggauaaua

SEQ ID NO: 17313 - RNA, 19 nt, artificial
  Oligomer
gugaaaauuuuuacauuca

SEQ ID NO: 17314 - RNA, 19 nt, artificial
  Oligomer
gcaugcugauaacaauucu

SEQ ID NO: 17315 - RNA, 19 nt, artificial
  Oligomer
accucaccagugcuucaua

SEQ ID NO: 17316 - RNA, 19 nt, artificial
  Oligomer
aaacagaauugcuuuagau

SEQ ID NO: 17317 - RNA, 19 nt, artificial
  Oligomer
cacuuuaacccacgcuuca

SEQ ID NO: 17318 - RNA, 19 nt, artificial
  Oligomer
aaauacaaguacugguuga

SEQ ID NO: 17319 - RNA, 19 nt, artificial
  Oligomer
uaccaugauauaaucugaa

SEQ ID NO: 17320 - RNA, 19 nt, artificial
  Oligomer
uguaagucaucuacuuaau

SEQ ID NO: 17321 - RNA, 19 nt, artificial
  Oligomer
gugagugaaaauuuuuaca

SEQ ID NO: 17322 - RNA, 19 nt, artificial
  Oligomer
uuugcaauacaaagcugga

SEQ ID NO: 17323 - RNA, 19 nt, artificial
  Oligomer
caauuuuucgcuccaugau

SEQ ID NO: 17324 - RNA, 19 nt, artificial
  Oligomer
aacucaaugaaaucagcaa

SEQ ID NO: 17325 - RNA, 19 nt, artificial
  Oligomer
uaagucaucuacuuaauaa

SEQ ID NO: 17326 - RNA, 19 nt, artificial
  Oligomer
aaguacugguugaaccuga

SEQ ID NO: 17327 - RNA, 19 nt, artificial
  Oligomer
uguucacugugagugaaaa

SEQ ID NO: 17328 - RNA, 19 nt, artificial
  Oligomer
ccaaagagggaaugauguu

SEQ ID NO: 17329 - RNA, 19 nt, artificial
  Oligomer
gaagaaagacagucgguuu

SEQ ID NO: 17330 - RNA, 19 nt, artificial
  Oligomer
uggaaacccaaacccucaa

SEQ ID NO: 17331 - RNA, 19 nt, artificial
  Oligomer
ccacugauugugccuuaua

SEQ ID NO: 17332 - RNA, 19 nt, artificial
  Oligomer
agugaauuaccugucucaa

SEQ ID NO: 17333 - RNA, 19 nt, artificial
  Oligomer
aauacaaguacugguugaa

SEQ ID NO: 17334 - RNA, 19 nt, artificial
  Oligomer
gaacaacaggagagucauu

SEQ ID NO: 17335 - RNA, 19 nt, artificial
  Oligomer
gcuccaugaugcguuaucu

SEQ ID NO: 17336 - RNA, 19 nt, artificial
  Oligomer
ucggguuaaaaaacucaau

SEQ ID NO: 17337 - RNA, 19 nt, artificial
  Oligomer
cucaccagugcuucauaua

SEQ ID NO: 17338 - RNA, 19 nt, artificial
  Oligomer
acaaucaucggguuaaaaa

SEQ ID NO: 17339 - RNA, 19 nt, artificial
  Oligomer
uuguaagucaucuacuuaa

SEQ ID NO: 17340 - RNA, 19 nt, artificial
  Oligomer
ucauauaccaugauauaau

SEQ ID NO: 17341 - RNA, 19 nt, artificial
  Oligomer
ugcuuuagauuuccaaaga

SEQ ID NO: 17342 - RNA, 19 nt, artificial
  Oligomer
cagacaauuuuucgcucca

SEQ ID NO: 17343 - RNA, 19 nt, artificial
  Oligomer
acucaaugaaaucagcaaa

SEQ ID NO: 17344 - RNA, 19 nt, artificial
  Oligomer
gccucgcaugcugauaaca

SEQ ID NO: 17345 - RNA, 19 nt, artificial
  Oligomer
agucaucuacuuaauaaau

SEQ ID NO: 17346 - RNA, 19 nt, artificial
  Oligomer
aucggguuaaaaaacucaa

SEQ ID NO: 17347 - RNA, 19 nt, artificial
  Oligomer
ucaagguugcagugaauga

SEQ ID NO: 17348 - RNA, 19 nt, artificial
  Oligomer
gcccaaugcaaacagaauu

SEQ ID NO: 17349 - RNA, 19 nt, artificial
  Oligomer
cgguuuucccauuugaaag

SEQ ID NO: 17350 - RNA, 19 nt, artificial
  Oligomer
caugaugcguuaucugggu

SEQ ID NO: 17351 - RNA, 19 nt, artificial
  Oligomer
gggaagaaagacagucggu

SEQ ID NO: 17352 - RNA, 19 nt, artificial
  Oligomer
ugcaauacaaagcuggaua

SEQ ID NO: 17353 - RNA, 19 nt, artificial
  Oligomer
cauguucacugugagugaa

SEQ ID NO: 17354 - RNA, 19 nt, artificial
  Oligomer
gugcuucauauaccaugau

SEQ ID NO: 17355 - RNA, 19 nt, artificial
  Oligomer
cagugaaugaugcucacuu

SEQ ID NO: 17356 - RNA, 19 nt, artificial
  Oligomer
auugcuuuagauuuccaaa

SEQ ID NO: 17357 - RNA, 19 nt, artificial
  Oligomer
ucaucaauaucccucuugu

SEQ ID NO: 17358 - RNA, 19 nt, artificial
  Oligomer
ugcagugaaugaugcucac

SEQ ID NO: 17359 - RNA, 19 nt, artificial
  Oligomer
caucggguuaaaaaacuca

SEQ ID NO: 17360 - RNA, 19 nt, artificial
  Oligomer
gagggaaugauguugccuu

SEQ ID NO: 17361 - RNA, 19 nt, artificial
  Oligomer
agaacaacaggagagucau

SEQ ID NO: 17362 - RNA, 19 nt, artificial
  Oligomer
aucaauaucccucuuguaa

SEQ ID NO: 17363 - RNA, 19 nt, artificial
  Oligomer
acuuuaacccacgcuucaa

SEQ ID NO: 17364 - RNA, 19 nt, artificial
  Oligomer
cuuguaagucaucuacuua

SEQ ID NO: 17365 - RNA, 19 nt, artificial
  Oligomer
gguugcagugaaugaugcu

SEQ ID NO: 17366 - RNA, 19 nt, artificial
  Oligomer
gaauugcuuuagauuucca

SEQ ID NO: 17367 - RNA, 19 nt, artificial
  Oligomer
ucuuguaagucaucuacuu

SEQ ID NO: 17368 - RNA, 19 nt, artificial
  Oligomer
aauugcuuuagauuuccaa

SEQ ID NO: 17369 - RNA, 19 nt, artificial
  Oligomer
guugaaccugaccacuuca

SEQ ID NO: 17370 - RNA, 19 nt, artificial
  Oligomer
ccaugauauaaucugaaag

SEQ ID NO: 17371 - RNA, 19 nt, artificial
  Oligomer
gguugaaccugaccacuuc

SEQ ID NO: 17372 - RNA, 19 nt, artificial
  Oligomer
gaguauuugaggcucggag

SEQ ID NO: 17373 - RNA, 19 nt, artificial
  Oligomer
ggaauuucuggugacauag

SEQ ID NO: 17374 - RNA, 19 nt, artificial
  Oligomer
aguacugguugaaccugac

SEQ ID NO: 17375 - RNA, 19 nt, artificial
  Oligomer
caaaauacaaguacugguu

SEQ ID NO: 17376 - RNA, 19 nt, artificial
  Oligomer
agagucauuguuugcaaua

SEQ ID NO: 17377 - RNA, 19 nt, artificial
  Oligomer
caaugcaaacagaauugcu

SEQ ID NO: 17378 - RNA, 19 nt, artificial
  Oligomer
aagacagucgguuuuccca

SEQ ID NO: 17379 - RNA, 19 nt, artificial
  Oligomer
gcuuuagauuuccaaagag

SEQ ID NO: 17380 - RNA, 19 nt, artificial
  Oligomer
cuggugacauagaccucac

SEQ ID NO: 17381 - RNA, 19 nt, artificial
  Oligomer
gcuucaaugagaacaacag

SEQ ID NO: 17382 - RNA, 19 nt, artificial
  Oligomer
gaaaucagcaaacugggaa

SEQ ID NO: 17383 - RNA, 19 nt, artificial
  Oligomer
uucauauaccaugauauaa

SEQ ID NO: 17384 - RNA, 19 nt, artificial
  Oligomer
gcucacuuguugcaguaca

SEQ ID NO: 17385 - RNA, 19 nt, artificial
  Oligomer
cauauaccaugauauaauc

SEQ ID NO: 17386 - RNA, 19 nt, artificial
  Oligomer
uucgcuccaugaugcguua

SEQ ID NO: 17387 - RNA, 19 nt, artificial
  Oligomer
aaaucagcaaacugggaau

SEQ ID NO: 17388 - RNA, 19 nt, artificial
  Oligomer
ugaaaucagcaaacuggga

SEQ ID NO: 17389 - RNA, 19 nt, artificial
  Oligomer
ugcguuaucugggucugga

SEQ ID NO: 17390 - RNA, 19 nt, artificial
  Oligomer
cuuuaacccacgcuucaau

SEQ ID NO: 17391 - RNA, 19 nt, artificial
  Oligomer
aaacccaaacccucaagga

SEQ ID NO: 17392 - RNA, 19 nt, artificial
  Oligomer
ugaccacuucaagguugca

SEQ ID NO: 17393 - RNA, 19 nt, artificial
  Oligomer
ggaagaaagacagucgguu

SEQ ID NO: 17394 - RNA, 19 nt, artificial
  Oligomer
gacagucgguuuucccauu

SEQ ID NO: 17395 - RNA, 19 nt, artificial
  Oligomer
uguaaagguuucauguuca

SEQ ID NO: 17396 - RNA, 19 nt, artificial
  Oligomer
gagaacaacaggagaguca

SEQ ID NO: 17397 - RNA, 19 nt, artificial
  Oligomer
cauucaucaauaucccucu

SEQ ID NO: 17398 - RNA, 19 nt, artificial
  Oligomer
uaucccucuuguaagucau

SEQ ID NO: 17399 - RNA, 19 nt, artificial
  Oligomer
auuugaaagugggaaacca

SEQ ID NO: 17400 - RNA, 19 nt, artificial
  Oligomer
aaagcuggauaauaacugg

SEQ ID NO: 17401 - RNA, 19 nt, artificial
  Oligomer
gaaugaugcucacuuguug

SEQ ID NO: 17402 - RNA, 19 nt, artificial
  Oligomer
cuuguugcaguacaaucau

SEQ ID NO: 17403 - RNA, 19 nt, artificial
  Oligomer
aacccaaacccucaaggau

SEQ ID NO: 17404 - RNA, 19 nt, artificial
  Oligomer
uacaaagcuggauaauaac

SEQ ID NO: 17405 - RNA, 19 nt, artificial
  Oligomer
ugccucgcaugcugauaac

SEQ ID NO: 17406 - RNA, 19 nt, artificial
  Oligomer
ugggaauuucuggugacau

SEQ ID NO: 17407 - RNA, 19 nt, artificial
  Oligomer
ucgcaugcugauaacaauu

SEQ ID NO: 17408 - RNA, 19 nt, artificial
  Oligomer
acaaguacugguugaaccu

SEQ ID NO: 17409 - RNA, 19 nt, artificial
  Oligomer
gguuucauguucacuguga

SEQ ID NO: 17410 - RNA, 19 nt, artificial
  Oligomer
uuugaaagugggaaaccau

SEQ ID NO: 17411 - RNA, 19 nt, artificial
  Oligomer
acaauuuuucgcuccauga

SEQ ID NO: 17412 - RNA, 19 nt, artificial
  Oligomer
aucugggucuggaaaccca

SEQ ID NO: 17413 - RNA, 19 nt, artificial
  Oligomer
caacaggagagucauuguu

SEQ ID NO: 17414 - RNA, 19 nt, artificial
  Oligomer
ugacauagaccucaccagu

SEQ ID NO: 17415 - RNA, 19 nt, artificial
  Oligomer
agacaauuuuucgcuccau

SEQ ID NO: 17416 - RNA, 19 nt, artificial
  Oligomer
agggaaugauguugccuuc

SEQ ID NO: 17417 - RNA, 19 nt, artificial
  Oligomer
guucacugugagugaaaau

SEQ ID NO: 17418 - RNA, 19 nt, artificial
  Oligomer
caaacugggaauuucuggu

SEQ ID NO: 17419 - RNA, 19 nt, artificial
  Oligomer
agacagucgguuuucccau

SEQ ID NO: 17420 - RNA, 19 nt, artificial
  Oligomer
gauugugccuuauaaccug

SEQ ID NO: 17421 - RNA, 19 nt, artificial
  Oligomer
agugaaugaugcucacuug

SEQ ID NO: 17422 - RNA, 19 nt, artificial
  Oligomer
ccagugcuucauauaccau

SEQ ID NO: 17423 - RNA, 19 nt, artificial
  Oligomer
gcaguacaaucaucggguu

SEQ ID NO: 17424 - RNA, 19 nt, artificial
  Oligomer
uacaaucaucggguuaaaa

SEQ ID NO: 17425 - RNA, 19 nt, artificial
  Oligomer
ucaaaauacaaguacuggu

SEQ ID NO: 17426 - RNA, 19 nt, artificial
  Oligomer
acuuguugcaguacaauca

SEQ ID NO: 17427 - RNA, 19 nt, artificial
  Oligomer
cauagaccucaccagugcu

SEQ ID NO: 17428 - RNA, 19 nt, artificial
  Oligomer
gugacauagaccucaccag

SEQ ID NO: 17429 - RNA, 19 nt, artificial
  Oligomer
ugcaaacagaauugcuuua

SEQ ID NO: 17430 - RNA, 19 nt, artificial
  Oligomer
aaccauucaaaauacaagu

SEQ ID NO: 17431 - RNA, 19 nt, artificial
  Oligomer
uugaaagugggaaaccauu

SEQ ID NO: 17432 - RNA, 19 nt, artificial
  Oligomer
caaugaaaucagcaaacug

SEQ ID NO: 17433 - RNA, 19 nt, artificial
  Oligomer
acaggagagucauuguuug

SEQ ID NO: 17434 - RNA, 19 nt, artificial
  Oligomer
ugauguugccuuccacuuu

SEQ ID NO: 17435 - RNA, 19 nt, artificial
  Oligomer
aggagagucauuguuugca

SEQ ID NO: 17436 - RNA, 19 nt, artificial
  Oligomer
gagucauuguuugcaauac

SEQ ID NO: 17437 - RNA, 19 nt, artificial
  Oligomer
gaugcucacuuguugcagu

SEQ ID NO: 17438 - RNA, 19 nt, artificial
  Oligomer
cggguuaaaaaacucaaug

SEQ ID NO: 17439 - RNA, 19 nt, artificial
  Oligomer
uuagauuuccaaagaggga

SEQ ID NO: 17440 - RNA, 19 nt, artificial
  Oligomer
aacugggaauuucugguga

SEQ ID NO: 17441 - RNA, 19 nt, artificial
  Oligomer
acaacaggagagucauugu

SEQ ID NO: 17442 - RNA, 19 nt, artificial
  Oligomer
aaugcaaacagaauugcuu

SEQ ID NO: 17443 - RNA, 19 nt, artificial
  Oligomer
ccaugaugcguuaucuggg

SEQ ID NO: 17444 - RNA, 19 nt, artificial
  Oligomer
ucauguucacugugaguga

SEQ ID NO: 17445 - RNA, 19 nt, artificial
  Oligomer
ccacgcuucaaugagaaca

SEQ ID NO: 17446 - RNA, 19 nt, artificial
  Oligomer
ucuggugacauagaccuca

SEQ ID NO: 17447 - RNA, 19 nt, artificial
  Oligomer
gugccuuauaaccugccuu

SEQ ID NO: 17448 - RNA, 19 nt, artificial
  Oligomer
aguacaaucaucggguuaa

SEQ ID NO: 17449 - RNA, 19 nt, artificial
  Oligomer
aaaccauucaaaauacaag

SEQ ID NO: 17450 - RNA, 19 nt, artificial
  Oligomer
gugaaugaugcucacuugu

SEQ ID NO: 17451 - RNA, 19 nt, artificial
  Oligomer
cuacccaucuucuggacag

SEQ ID NO: 17452 - RNA, 19 nt, artificial
  Oligomer
gaaaauuuuuacauucauc

SEQ ID NO: 17453 - RNA, 19 nt, artificial
  Oligomer
agauuuccaaagagggaau

SEQ ID NO: 17454 - RNA, 19 nt, artificial
  Oligomer
aauuucuggugacauagac

SEQ ID NO: 17455 - RNA, 19 nt, artificial
  Oligomer
ugccuuauaaccugccuuu

SEQ ID NO: 17456 - RNA, 19 nt, artificial
  Oligomer
caguacaaucaucggguua

SEQ ID NO: 17457 - RNA, 19 nt, artificial
  Oligomer
aagaaagacagucgguuuu

SEQ ID NO: 17458 - RNA, 19 nt, artificial
  Oligomer
ugccuuccacuuuaaccca

SEQ ID NO: 17459 - RNA, 19 nt, artificial
  Oligomer
uugcaauacaaagcuggau

SEQ ID NO: 17460 - RNA, 19 nt, artificial
  Oligomer
gaaccugaccacuucaagg

SEQ ID NO: 17461 - RNA, 19 nt, artificial
  Oligomer
acugauugugccuuauaac

SEQ ID NO: 17462 - RNA, 19 nt, artificial
  Oligomer
acugguugaaccugaccac

SEQ ID NO: 17463 - RNA, 19 nt, artificial
  Oligomer
cugguugaaccugaccacu

SEQ ID NO: 17464 - RNA, 19 nt, artificial
  Oligomer
gcugggaguauuugaggcu

SEQ ID NO: 17465 - RNA, 19 nt, artificial
  Oligomer
uugaaccugaccacuucaa

SEQ ID NO: 17466 - RNA, 19 nt, artificial
  Oligomer
aagguuucauguucacugu

SEQ ID NO: 17467 - RNA, 19 nt, artificial
  Oligomer
ccacuucaagguugcagug

SEQ ID NO: 17468 - RNA, 19 nt, artificial
  Oligomer
uuuccaaagagggaaugau

SEQ ID NO: 17469 - RNA, 19 nt, artificial
  Oligomer
augcucacuuguugcagua

SEQ ID NO: 17470 - RNA, 19 nt, artificial
  Oligomer
cucuuguaagucaucuacu

SEQ ID NO: 17471 - RNA, 19 nt, artificial
  Oligomer
ugagugaaaauuuuuacau

SEQ ID NO: 17472 - RNA, 19 nt, artificial
  Oligomer
gaccucaccagugcuucau

SEQ ID NO: 17473 - RNA, 19 nt, artificial
  Oligomer
accauucaaaauacaagua

SEQ ID NO: 17474 - RNA, 19 nt, artificial
  Oligomer
gucuggaaacccaaacccu

SEQ ID NO: 17475 - RNA, 19 nt, artificial
  Oligomer
gguuuucccauuugaaagu

SEQ ID NO: 17476 - RNA, 19 nt, artificial
  Oligomer
caugcugauaacaauucug

SEQ ID NO: 17477 - RNA, 19 nt, artificial
  Oligomer
uccaaagagggaaugaugu

SEQ ID NO: 17478 - RNA, 19 nt, artificial
  Oligomer
aaacucaaugaaaucagca

SEQ ID NO: 17479 - RNA, 19 nt, artificial
  Oligomer
auguucacugugagugaaa

SEQ ID NO: 17480 - RNA, 19 nt, artificial
  Oligomer
accacuucaagguugcagu

SEQ ID NO: 17481 - RNA, 19 nt, artificial
  Oligomer
aacagaauugcuuuagauu

SEQ ID NO: 17482 - RNA, 19 nt, artificial
  Oligomer
acugugagugaaaauuuuu

SEQ ID NO: 17483 - RNA, 19 nt, artificial
  Oligomer
ugguugaaccugaccacuu

SEQ ID NO: 17484 - RNA, 19 nt, artificial
  Oligomer
ccucuuguaagucaucuac

SEQ ID NO: 17485 - RNA, 19 nt, artificial
  Oligomer
uucccauuugaaaguggga

SEQ ID NO: 17486 - RNA, 19 nt, artificial
  Oligomer
ccuuauaaccugccuuugc

SEQ ID NO: 17487 - RNA, 19 nt, artificial
  Oligomer
uucaaugagaacaacagga

SEQ ID NO: 17488 - RNA, 19 nt, artificial
  Oligomer
cccacgcuucaaugagaac

SEQ ID NO: 17489 - RNA, 19 nt, artificial
  Oligomer
cuucaaugagaacaacagg

SEQ ID NO: 17490 - RNA, 19 nt, artificial
  Oligomer
auaucccucuuguaaguca

SEQ ID NO: 17491 - RNA, 19 nt, artificial
  Oligomer
ucaauaucccucuuguaag

SEQ ID NO: 17492 - RNA, 19 nt, artificial
  Oligomer
ucagcaaacugggaauuuc

SEQ ID NO: 17493 - RNA, 19 nt, artificial
  Oligomer
caugauauaaucugaaagg

SEQ ID NO: 17494 - RNA, 19 nt, artificial
  Oligomer
ugcugauaacaauucuggg

SEQ ID NO: 17495 - RNA, 19 nt, artificial
  Oligomer
acgcuucaaugagaacaac

SEQ ID NO: 17496 - RNA, 19 nt, artificial
  Oligomer
uacugguugaaccugacca

SEQ ID NO: 17497 - RNA, 19 nt, artificial
  Oligomer
acagaauugcuuuagauuu

SEQ ID NO: 17498 - RNA, 19 nt, artificial
  Oligomer
agcaaacugggaauuucug

SEQ ID NO: 17499 - RNA, 19 nt, artificial
  Oligomer
cuccaugaugcguuaucug

SEQ ID NO: 17500 - RNA, 19 nt, artificial
  Oligomer
augcaaacagaauugcuuu

SEQ ID NO: 17501 - RNA, 19 nt, artificial
  Oligomer
acaauucugggcacgguga

SEQ ID NO: 17502 - RNA, 19 nt, artificial
  Oligomer
ccuacccaucuucuggaca

SEQ ID NO: 17503 - RNA, 19 nt, artificial
  Oligomer
cagugcuucauauaccaug

SEQ ID NO: 17504 - RNA, 19 nt, artificial
  Oligomer
gugaagcccaaugcaaaca

SEQ ID NO: 17505 - RNA, 19 nt, artificial
  Oligomer
caaagcuggauaauaacug

SEQ ID NO: 17506 - RNA, 19 nt, artificial
  Oligomer
ugaaccugaccacuucaag

SEQ ID NO: 17507 - RNA, 19 nt, artificial
  Oligomer
aagagggaaugauguugcc

SEQ ID NO: 17508 - RNA, 19 nt, artificial
  Oligomer
auucaucaauaucccucuu

SEQ ID NO: 17509 - RNA, 19 nt, artificial
  Oligomer
acaaagcuggauaauaacu

SEQ ID NO: 17510 - RNA, 19 nt, artificial
  Oligomer
caccagugcuucauauacc

SEQ ID NO: 17511 - RNA, 19 nt, artificial
  Oligomer
acugggaauuucuggugac

SEQ ID NO: 17512 - RNA, 19 nt, artificial
  Oligomer
guaaagguuucauguucac

SEQ ID NO: 17513 - RNA, 19 nt, artificial
  Oligomer
ggaaacccaaacccucaag

SEQ ID NO: 17514 - RNA, 19 nt, artificial
  Oligomer
aaugauguugccuuccacu

SEQ ID NO: 17515 - RNA, 19 nt, artificial
  Oligomer
aagguugcagugaaugaug

SEQ ID NO: 17516 - RNA, 19 nt, artificial
  Oligomer
uagauuuccaaagagggaa

SEQ ID NO: 17517 - RNA, 19 nt, artificial
  Oligomer
caggagagucauuguuugc

SEQ ID NO: 17518 - RNA, 19 nt, artificial
  Oligomer
agggaagaaagacagucgg

SEQ ID NO: 17519 - RNA, 19 nt, artificial
  Oligomer
cagaauugcuuuagauuuc

SEQ ID NO: 17520 - RNA, 19 nt, artificial
  Oligomer
gacauagaccucaccagug

SEQ ID NO: 17521 - RNA, 19 nt, artificial
  Oligomer
cacuucaagguugcaguga

SEQ ID NO: 17522 - RNA, 19 nt, artificial
  Oligomer
ccauucaaaauacaaguac

SEQ ID NO: 17523 - RNA, 19 nt, artificial
  Oligomer
guuucauguucacugugag

SEQ ID NO: 17524 - RNA, 19 nt, artificial
  Oligomer
cagucgguuuucccauuug

SEQ ID NO: 17525 - RNA, 19 nt, artificial
  Oligomer
ucacugugagugaaaauuu

SEQ ID NO: 17526 - RNA, 19 nt, artificial
  Oligomer
gacaauuuuucgcuccaug

SEQ ID NO: 17527 - RNA, 19 nt, artificial
  Oligomer
ucccauuugaaagugggaa

SEQ ID NO: 17528 - RNA, 19 nt, artificial
  Oligomer
cuuauaaccugccuuugcc

SEQ ID NO: 17529 - RNA, 19 nt, artificial
  Oligomer
ugugccuuauaaccugccu

SEQ ID NO: 17530 - RNA, 19 nt, artificial
  Oligomer
gcagugaaugaugcucacu

SEQ ID NO: 17531 - RNA, 19 nt, artificial
  Oligomer
ucaccagugcuucauauac

SEQ ID NO: 17532 - RNA, 19 nt, artificial
  Oligomer
ugaaugaugcucacuuguu

SEQ ID NO: 17533 - RNA, 19 nt, artificial
  Oligomer
accugaccacuucaagguu

SEQ ID NO: 17534 - RNA, 19 nt, artificial
  Oligomer
aacaggagagucauuguuu

SEQ ID NO: 17535 - RNA, 19 nt, artificial
  Oligomer
gaaagacagucgguuuucc

SEQ ID NO: 17536 - RNA, 19 nt, artificial
  Oligomer
gccuuauaaccugccuuug

SEQ ID NO: 17537 - RNA, 19 nt, artificial
  Oligomer
uugcagugaaugaugcuca

SEQ ID NO: 17538 - RNA, 19 nt, artificial
  Oligomer
auauuacagugaauuaccu

SEQ ID NO: 17539 - RNA, 19 nt, artificial
  Oligomer
ucacuuguugcaguacaau

SEQ ID NO: 17540 - RNA, 19 nt, artificial
  Oligomer
uuccaaagagggaaugaug

SEQ ID NO: 17541 - RNA, 19 nt, artificial
  Oligomer
uggugacauagaccucacc

SEQ ID NO: 17542 - RNA, 19 nt, artificial
  Oligomer
uguugccuuccacuuuaac

SEQ ID NO: 17543 - RNA, 19 nt, artificial
  Oligomer
aaaacucaaugaaaucagc

SEQ ID NO: 17544 - RNA, 19 nt, artificial
  Oligomer
aaucuaaaccuuacaugug

SEQ ID NO: 17545 - RNA, 19 nt, artificial
  Oligomer
uuaacccacgcuucaauga

SEQ ID NO: 17546 - RNA, 19 nt, artificial
  Oligomer
cuuuagauuuccaaagagg

SEQ ID NO: 17547 - RNA, 19 nt, artificial
  Oligomer
cgcuccaugaugcguuauc

SEQ ID NO: 17548 - RNA, 19 nt, artificial
  Oligomer
uuguuugcaauacaaagcu

SEQ ID NO: 17549 - RNA, 19 nt, artificial
  Oligomer
ugugagugaaaauuuuuac

SEQ ID NO: 17550 - RNA, 19 nt, artificial
  Oligomer
cccaaugcaaacagaauug

SEQ ID NO: 17551 - RNA, 19 nt, artificial
  Oligomer
agugaaaauuuuuacauuc

SEQ ID NO: 17552 - RNA, 19 nt, artificial
  Oligomer
cugauaacaauucugggca

SEQ ID NO: 17553 - RNA, 19 nt, artificial
  Oligomer
gcaaacugggaauuucugg

SEQ ID NO: 17554 - RNA, 19 nt, artificial
  Oligomer
uaacaauucugggcacggu

SEQ ID NO: 17555 - RNA, 19 nt, artificial
  Oligomer
agguugcagugaaugaugc

SEQ ID NO: 17556 - RNA, 19 nt, artificial
  Oligomer
caaagagggaaugauguug

SEQ ID NO: 17557 - RNA, 19 nt, artificial
  Oligomer
uguuugcaauacaaagcug

SEQ ID NO: 17558 - RNA, 19 nt, artificial
  Oligomer
ugggaguauuugaggcucg

SEQ ID NO: 17559 - RNA, 19 nt, artificial
  Oligomer
ccacuuuaacccacgcuuc

SEQ ID NO: 17560 - RNA, 19 nt, artificial
  Oligomer
ggcagacaauuuuucgcuc

SEQ ID NO: 17561 - RNA, 19 nt, artificial
  Oligomer
ugauugugccuuauaaccu

SEQ ID NO: 17562 - RNA, 19 nt, artificial
  Oligomer
auuuccaaagagggaauga

SEQ ID NO: 17563 - RNA, 19 nt, artificial
  Oligomer
cugggaguauuugaggcuc

SEQ ID NO: 17564 - RNA, 19 nt, artificial
  Oligomer
auucaaaauacaaguacug

SEQ ID NO: 17565 - RNA, 19 nt, artificial
  Oligomer
ugauaacaauucugggcac

SEQ ID NO: 17566 - RNA, 19 nt, artificial
  Oligomer
uuauaaccugccuuugccu

SEQ ID NO: 17567 - RNA, 19 nt, artificial
  Oligomer
agagggaaugauguugccu

SEQ ID NO: 17568 - RNA, 19 nt, artificial
  Oligomer
augagaacaacaggagagu

SEQ ID NO: 17569 - RNA, 19 nt, artificial
  Oligomer
uuacauucaucaauauccc

SEQ ID NO: 17570 - RNA, 19 nt, artificial
  Oligomer
aagggaagaaagacagucg

SEQ ID NO: 17571 - RNA, 19 nt, artificial
  Oligomer
aguauuugaggcucggagc

SEQ ID NO: 17572 - RNA, 19 nt, artificial
  Oligomer
cucaaugaaaucagcaaac

SEQ ID NO: 17573 - RNA, 19 nt, artificial
  Oligomer
aaaaaacucaaugaaauca

SEQ ID NO: 17574 - RNA, 19 nt, artificial
  Oligomer
uacauucaucaauaucccu

SEQ ID NO: 17575 - RNA, 19 nt, artificial
  Oligomer
guguaaagguuucauguuc

SEQ ID NO: 17576 - RNA, 19 nt, artificial
  Oligomer
ccauuugaaagugggaaac

SEQ ID NO: 17577 - RNA, 19 nt, artificial
  Oligomer
uaacccacgcuucaaugag

SEQ ID NO: 17578 - RNA, 19 nt, artificial
  Oligomer
cugaccacuucaagguugc

SEQ ID NO: 17579 - RNA, 19 nt, artificial
  Oligomer
ucuggaaacccaaacccuc

SEQ ID NO: 17580 - RNA, 19 nt, artificial
  Oligomer
ugaagcccaaugcaaacag

SEQ ID NO: 17581 - RNA, 19 nt, artificial
  Oligomer
uaaaaaacucaaugaaauc

SEQ ID NO: 17582 - RNA, 19 nt, artificial
  Oligomer
aaucaucggguuaaaaaac

SEQ ID NO: 17583 - RNA, 19 nt, artificial
  Oligomer
ucaaugaaaucagcaaacu

SEQ ID NO: 17584 - RNA, 19 nt, artificial
  Oligomer
aauucugggcacggugaag

SEQ ID NO: 17585 - RNA, 19 nt, artificial
  Oligomer
guuugcaauacaaagcugg

SEQ ID NO: 17586 - RNA, 19 nt, artificial
  Oligomer
augaaaucagcaaacuggg

SEQ ID NO: 17587 - RNA, 19 nt, artificial
  Oligomer
acccaaacccucaaggaug

SEQ ID NO: 17588 - RNA, 19 nt, artificial
  Oligomer
gaagggaagaaagacaguc

SEQ ID NO: 17589 - RNA, 19 nt, artificial
  Oligomer
cugauugugccuuauaacc

SEQ ID NO: 17590 - RNA, 19 nt, artificial
  Oligomer
acagucgguuuucccauuu

SEQ ID NO: 17591 - RNA, 19 nt, artificial
  Oligomer
cacuuguugcaguacaauc

SEQ ID NO: 17592 - RNA, 19 nt, artificial
  Oligomer
aagcuggauaauaacuggg

SEQ ID NO: 17593 - RNA, 19 nt, artificial
  Oligomer
ccuuccacuuuaacccacg

SEQ ID NO: 17594 - RNA, 19 nt, artificial
  Oligomer
augauguugccuuccacuu

SEQ ID NO: 17595 - RNA, 19 nt, artificial
  Oligomer
cuuaauaaauauuacagug

SEQ ID NO: 17596 - RNA, 19 nt, artificial
  Oligomer
ccugaccacuucaagguug

SEQ ID NO: 17597 - RNA, 19 nt, artificial
  Oligomer
gccuuccacuuuaacccac

SEQ ID NO: 17598 - RNA, 19 nt, artificial
  Oligomer
uacagugaauuaccugucu

SEQ ID NO: 17599 - RNA, 19 nt, artificial
  Oligomer
aaauauuacagugaauuac

SEQ ID NO: 17600 - RNA, 19 nt, artificial
  Oligomer
cgcaugcugauaacaauuc

SEQ ID NO: 17601 - RNA, 19 nt, artificial
  Oligomer
caaguacugguugaaccug

SEQ ID NO: 17602 - RNA, 19 nt, artificial
  Oligomer
ucaucggguuaaaaaacuc

SEQ ID NO: 17603 - RNA, 19 nt, artificial
  Oligomer
ugaaagugggaaaccauuc

SEQ ID NO: 17604 - RNA, 19 nt, artificial
  Oligomer
aaugaaaucagcaaacugg

SEQ ID NO: 17605 - RNA, 19 nt, artificial
  Oligomer
aaugagaacaacaggagag

SEQ ID NO: 17606 - RNA, 19 nt, artificial
  Oligomer
augaugcucacuuguugca

SEQ ID NO: 17607 - RNA, 19 nt, artificial
  Oligomer
auacaaguacugguugaac

SEQ ID NO: 17608 - RNA, 19 nt, artificial
  Oligomer
guugcaguacaaucaucgg

SEQ ID NO: 17609 - RNA, 19 nt, artificial
  Oligomer
uccacuuuaacccacgcuu

SEQ ID NO: 17610 - RNA, 19 nt, artificial
  Oligomer
ucaaugagaacaacaggag

SEQ ID NO: 17611 - RNA, 19 nt, artificial
  Oligomer
ugggucuggaaacccaaac

SEQ ID NO: 17612 - RNA, 19 nt, artificial
  Oligomer
acauagaccucaccagugc

SEQ ID NO: 17613 - RNA, 19 nt, artificial
  Oligomer
aaccugaccacuucaaggu

SEQ ID NO: 17614 - RNA, 19 nt, artificial
  Oligomer
aucaucggguuaaaaaacu

SEQ ID NO: 17615 - RNA, 19 nt, artificial
  Oligomer
uacaaguacugguugaacc

SEQ ID NO: 17616 - RNA, 19 nt, artificial
  Oligomer
aaaaacucaaugaaaucag

SEQ ID NO: 17617 - RNA, 19 nt, artificial
  Oligomer
uuucuggugacauagaccu

SEQ ID NO: 17618 - RNA, 19 nt, artificial
  Oligomer
gaugcguuaucugggucug

SEQ ID NO: 17619 - RNA, 19 nt, artificial
  Oligomer
ugcaguacaaucaucgggu

SEQ ID NO: 17620 - RNA, 19 nt, artificial
  Oligomer
aucagcaaacugggaauuu

SEQ ID NO: 17621 - RNA, 19 nt, artificial
  Oligomer
ucccucuuguaagucaucu

SEQ ID NO: 17622 - RNA, 19 nt, artificial
  Oligomer
gggaaugauguugccuucc

SEQ ID NO: 17623 - RNA, 19 nt, artificial
  Oligomer
uugcuuuagauuuccaaag

SEQ ID NO: 17624 - RNA, 19 nt, artificial
  Oligomer
gaaacccaaacccucaagg

SEQ ID NO: 17625 - RNA, 19 nt, artificial
  Oligomer
guuaucugggucuggaaac

SEQ ID NO: 17626 - RNA, 19 nt, artificial
  Oligomer
uacccaucuucuggacagc

SEQ ID NO: 17627 - RNA, 19 nt, artificial
  Oligomer
aaucagcaaacugggaauu

SEQ ID NO: 17628 - RNA, 19 nt, artificial
  Oligomer
augauauaaucugaaaggg

SEQ ID NO: 17629 - RNA, 19 nt, artificial
  Oligomer
ugaugcguuaucugggucu

SEQ ID NO: 17630 - RNA, 19 nt, artificial
  Oligomer
aauuuuucgcuccaugaug

SEQ ID NO: 17631 - RNA, 19 nt, artificial
  Oligomer
aaagacagucgguuuuccc

SEQ ID NO: 17632 - RNA, 19 nt, artificial
  Oligomer
guacugguugaaccugacc

SEQ ID NO: 17633 - RNA, 19 nt, artificial
  Oligomer
ucgcuccaugaugcguuau

SEQ ID NO: 17634 - RNA, 19 nt, artificial
  Oligomer
gaccacuucaagguugcag

SEQ ID NO: 17635 - RNA, 19 nt, artificial
  Oligomer
guugccuuccacuuuaacc

SEQ ID NO: 17636 - RNA, 19 nt, artificial
  Oligomer
aacaauucugggcacggug

SEQ ID NO: 17637 - RNA, 19 nt, artificial
  Oligomer
agaaagacagucgguuuuc

SEQ ID NO: 17638 - RNA, 19 nt, artificial
  Oligomer
uucuggugacauagaccuc

SEQ ID NO: 17639 - RNA, 19 nt, artificial
  Oligomer
aucccucuuguaagucauc

SEQ ID NO: 17640 - RNA, 19 nt, artificial
  Oligomer
auagaccucaccagugcuu

SEQ ID NO: 17641 - RNA, 19 nt, artificial
  Oligomer
aaaauacaaguacugguug

SEQ ID NO: 17642 - RNA, 19 nt, artificial
  Oligomer
aaagguuucauguucacug

SEQ ID NO: 17643 - RNA, 19 nt, artificial
  Oligomer
uuuagauuuccaaagaggg

SEQ ID NO: 17644 - RNA, 19 nt, artificial
  Oligomer
auauaccaugauauaaucu

SEQ ID NO: 17645 - RNA, 19 nt, artificial
  Oligomer
cuuccacuuuaacccacgc

SEQ ID NO: 17646 - RNA, 19 nt, artificial
  Oligomer
gcaaacagaauugcuuuag

SEQ ID NO: 17647 - RNA, 19 nt, artificial
  Oligomer
auuguuugcaauacaaagc

SEQ ID NO: 17648 - RNA, 19 nt, artificial
  Oligomer
ugaugcucacuuguugcag

SEQ ID NO: 17649 - RNA, 19 nt, artificial
  Oligomer
auuucuggugacauagacc

SEQ ID NO: 17650 - RNA, 19 nt, artificial
  Oligomer
ugagaacaacaggagaguc

SEQ ID NO: 17651 - RNA, 19 nt, artificial
  Oligomer
aaagagggaaugauguugc

SEQ ID NO: 17652 - RNA, 19 nt, artificial
  Oligomer
agguuucauguucacugug

SEQ ID NO: 17653 - RNA, 19 nt, artificial
  Oligomer
aauauuacagugaauuacc

SEQ ID NO: 17654 - RNA, 19 nt, artificial
  Oligomer
uuucauguucacugugagu

SEQ ID NO: 17655 - RNA, 19 nt, artificial
  Oligomer
gcugauaacaauucugggc

SEQ ID NO: 17656 - RNA, 19 nt, artificial
  Oligomer
aaugaugcucacuuguugc

SEQ ID NO: 17657 - RNA, 19 nt, artificial
  Oligomer
uucacugugagugaaaauu

SEQ ID NO: 17658 - RNA, 19 nt, artificial
  Oligomer
augcugauaacaauucugg

SEQ ID NO: 17659 - RNA, 19 nt, artificial
  Oligomer
auuacagugaauuaccugu

SEQ ID NO: 17660 - RNA, 19 nt, artificial
  Oligomer
uccaugaugcguuaucugg

SEQ ID NO: 17661 - RNA, 19 nt, artificial
  Oligomer
uucaaaauacaaguacugg

SEQ ID NO: 17662 - RNA, 19 nt, artificial
  Oligomer
cauuugaaagugggaaacc

SEQ ID NO: 17663 - RNA, 19 nt, artificial
  Oligomer
augcguuaucugggucugg

SEQ ID NO: 17664 - RNA, 19 nt, artificial
  Oligomer
uuucgcuccaugaugcguu

SEQ ID NO: 17665 - RNA, 19 nt, artificial
  Oligomer
ccaaugcaaacagaauugc

SEQ ID NO: 17666 - RNA, 19 nt, artificial
  Oligomer
gcagacaauuuuucgcucc

SEQ ID NO: 17667 - RNA, 19 nt, artificial
  Oligomer
agaauugcuuuagauuucc

SEQ ID NO: 17668 - RNA, 19 nt, artificial
  Oligomer
acagugaauuaccugucuc

SEQ ID NO: 17669 - RNA, 19 nt, artificial
  Oligomer
uuuaacccacgcuucaaug

SEQ ID NO: 17670 - RNA, 19 nt, artificial
  Oligomer
gauuuccaaagagggaaug

SEQ ID NO: 17671 - RNA, 19 nt, artificial
  Oligomer
aaacugggaauuucuggug

SEQ ID NO: 17672 - RNA, 19 nt, artificial
  Oligomer
uaaagguuucauguucacu

SEQ ID NO: 17673 - RNA, 19 nt, artificial
  Oligomer
uauaccaugauauaaucug

SEQ ID NO: 17674 - RNA, 19 nt, artificial
  Oligomer
uguugcaguacaaucaucg

SEQ ID NO: 17675 - RNA, 19 nt, artificial
  Oligomer
uuguugcaguacaaucauc

SEQ ID NO: 17676 - RNA, 19 nt, artificial
  Oligomer
uuuacauucaucaauaucc

SEQ ID NO: 17677 - RNA, 19 nt, artificial
  Oligomer
uuuuacauucaucaauauc

SEQ ID NO: 17678 - RNA, 19 nt, artificial
  Oligomer
uuaucugggucuggaaacc

SEQ ID NO: 17679 - RNA, 19 nt, artificial
  Oligomer
uuucccauuugaaaguggg

SEQ ID NO: 17680 - RNA, 19 nt, artificial
  Oligomer
uugccuuccacuuuaaccc

SEQ ID NO: 17681 - RNA, 19 nt, artificial
  Oligomer
guugcagugaaugaugcuc

SEQ ID NO: 17682 - RNA, 19 nt, artificial
  Oligomer
auuuuucgcuccaugaugc

SEQ ID NO: 17683 - RNA, 19 nt, artificial
  Oligomer
uauuacagugaauuaccug

SEQ ID NO: 17684 - RNA, 19 nt, artificial
  Oligomer
ugcucacuuguugcaguac

SEQ ID NO: 17685 - RNA, 19 nt, artificial
  Oligomer
gauaacaauucugggcacg

SEQ ID NO: 17686 - RNA, 19 nt, artificial
  Oligomer
uuauccuggacaggcaccu

SEQ ID NO: 17687 - RNA, 19 nt, artificial
  Oligomer
uagaccucaccagugcuuc

SEQ ID NO: 17688 - RNA, 19 nt, artificial
  Oligomer
auugugccuuauaaccugc

SEQ ID NO: 17689 - RNA, 19 nt, artificial
  Oligomer
acauucaucaauaucccuc

SEQ ID NO: 17690 - RNA, 19 nt, artificial
  Oligomer
uucaagguugcagugaaug

SEQ ID NO: 17691 - RNA, 19 nt, artificial
  Oligomer
uuuuucgcuccaugaugcg

SEQ ID NO: 17692 - RNA, 19 nt, artificial
  Oligomer
aacaacaggagagucauug

SEQ ID NO: 17693 - RNA, 19 nt, artificial
  Oligomer
auaaccugccuuugccugg

SEQ ID NO: 17694 - RNA, 19 nt, artificial
  Oligomer
uuccacuuuaacccacgcu

SEQ ID NO: 17695 - RNA, 19 nt, artificial
  Oligomer
guuuucccauuugaaagug

SEQ ID NO: 17696 - RNA, 19 nt, artificial
  Oligomer
uauaaccugccuuugccug

SEQ ID NO: 17697 - RNA, 19 nt, artificial
  Oligomer
augaugcguuaucuggguc

SEQ ID NO: 17698 - RNA, 19 nt, artificial
  Oligomer
uugugccuuauaaccugcc

SEQ ID NO: 17699 - RNA, 19 nt, artificial
  Oligomer
auaacaauucugggcacgg

SEQ ID NO: 17700 - RNA, 19 nt, artificial
  Oligomer
uucaucaauaucccucuug

SEQ ID NO: 17701 - RNA, 19 nt, artificial
  Oligomer
uuuucgcuccaugaugcgu

SEQ ID NO: 17702 - RNA, 19 nt, artificial
  Oligomer
uuacagugaauuaccuguc

SEQ ID NO: 17703 - RNA, 19 nt, artificial
  Oligomer
uuuucccauuugaaagugg

SEQ ID NO: 17704 - RNA, 19 nt, artificial
  Oligomer
uugcaguacaaucaucggg

SEQ ID NO: 17705 - RNA, 19 nt, artificial
  Oligomer
uaucugggucuggaaaccc

SEQ ID NO: 17706 - RNA, 19 nt, artificial
  Oligomer
aauaucccucuuguaaguc

SEQ ID NO: 17707 - RNA, 19 nt, artificial
  Oligomer
uucauguucacugugagug

SEQ ID NO: 17708 - RNA, 19 nt, artificial
  Oligomer
uuugcauugggcuucaccg

SEQ ID NO: 17709 - RNA, 19 nt, artificial
  Oligomer
uaugucaccagaaauuccc

SEQ ID NO: 17710 - RNA, 19 nt, artificial
  Oligomer
uuuuuuaacccgaugauug

SEQ ID NO: 17711 - RNA, 19 nt, artificial
  Oligomer
uuauaaggcacaaucagug

SEQ ID NO: 17712 - RNA, 19 nt, artificial
  Oligomer
uugcaaacaaugacucucc

SEQ ID NO: 17713 - RNA, 19 nt, artificial
  Oligomer
auuguuaucagcaugcgag

SEQ ID NO: 17714 - RNA, 19 nt, artificial
  Oligomer
uuauuauccagcuuuguau

SEQ ID NO: 17715 - RNA, 19 nt, artificial
  Oligomer
uacaagagggauauugaug

SEQ ID NO: 17716 - RNA, 19 nt, artificial
  Oligomer
uuguauugcaaacaaugac

SEQ ID NO: 17717 - RNA, 19 nt, artificial
  Oligomer
uuccagacccagauaacgc

SEQ ID NO: 17718 - RNA, 19 nt, artificial
  Oligomer
uuauccagcuuuguauugc

SEQ ID NO: 17719 - RNA, 19 nt, artificial
  Oligomer
uuguuaucagcaugcgagg

SEQ ID NO: 17720 - RNA, 19 nt, artificial
  Oligomer
uucaaaugggaaaaccgac

SEQ ID NO: 17721 - RNA, 19 nt, artificial
  Oligomer
uuuugaaugguuucccacu

SEQ ID NO: 17722 - RNA, 19 nt, artificial
  Oligomer
uauaucaugguauaugaag

SEQ ID NO: 17723 - RNA, 19 nt, artificial
  Oligomer
uuguucucauugaagcgug

SEQ ID NO: 17724 - RNA, 19 nt, artificial
  Oligomer
uuuauuaaguagaugacuu

SEQ ID NO: 17725 - RNA, 19 nt, artificial
  Oligomer
uuuaacccgaugauuguac

SEQ ID NO: 17726 - RNA, 19 nt, artificial
  Oligomer
uuuggguuuccagacccag

SEQ ID NO: 17727 - RNA, 19 nt, artificial
  Oligomer
uucauugaguuuuuuaacc

SEQ ID NO: 17728 - RNA, 19 nt, artificial
  Oligomer
uguauuuugaaugguuucc

SEQ ID NO: 17729 - RNA, 19 nt, artificial
  Oligomer
uuguacugcaacaagugag

SEQ ID NO: 17730 - RNA, 19 nt, artificial
  Oligomer
uugcauugggcuucaccgu

SEQ ID NO: 17731 - RNA, 19 nt, artificial
  Oligomer
agaaauucccaguuugcug

SEQ ID NO: 17732 - RNA, 19 nt, artificial
  Oligomer
uguauugcaaacaaugacu

SEQ ID NO: 17733 - RNA, 19 nt, artificial
  Oligomer
auucacugcaaccuugaag

SEQ ID NO: 17734 - RNA, 19 nt, artificial
  Oligomer
uagaugacuuacaagaggg

SEQ ID NO: 17735 - RNA, 19 nt, artificial
  Oligomer
uuuccagacccagauaacg

SEQ ID NO: 17736 - RNA, 19 nt, artificial
  Oligomer
uucacugcaaccuugaagu

SEQ ID NO: 17737 - RNA, 19 nt, artificial
  Oligomer
ucuguuugcauugggcuuc

SEQ ID NO: 17738 - RNA, 19 nt, artificial
  Oligomer
uuguauuuugaaugguuuc

SEQ ID NO: 17739 - RNA, 19 nt, artificial
  Oligomer
ucuaaagcaauucuguuug

SEQ ID NO: 17740 - RNA, 19 nt, artificial
  Oligomer
ucuccuguuguucucauug

SEQ ID NO: 17741 - RNA, 19 nt, artificial
  Oligomer
aaaauuuucacucacagug

SEQ ID NO: 17742 - RNA, 19 nt, artificial
  Oligomer
uuaucagcaugcgaggcac

SEQ ID NO: 17743 - RNA, 19 nt, artificial
  Oligomer
auugcaaacaaugacucuc

SEQ ID NO: 17744 - RNA, 19 nt, artificial
  Oligomer
auaucaugguauaugaagc

SEQ ID NO: 17745 - RNA, 19 nt, artificial
  Oligomer
uaaaguggaaggcaacauc

SEQ ID NO: 17746 - RNA, 19 nt, artificial
  Oligomer
uuucaaaugggaaaaccga

SEQ ID NO: 17747 - RNA, 19 nt, artificial
  Oligomer
ucuaugucaccagaaauuc

SEQ ID NO: 17748 - RNA, 19 nt, artificial
  Oligomer
auuuugaaugguuucccac

SEQ ID NO: 17749 - RNA, 19 nt, artificial
  Oligomer
uuuguauugcaaacaauga

SEQ ID NO: 17750 - RNA, 19 nt, artificial
  Oligomer
ucaugguauaugaagcacu

SEQ ID NO: 17751 - RNA, 19 nt, artificial
  Oligomer
uaaaaauuuucacucacag

SEQ ID NO: 17752 - RNA, 19 nt, artificial
  Oligomer
uuugaaugguuucccacuu

SEQ ID NO: 17753 - RNA, 19 nt, artificial
  Oligomer
aguacuuguauuuugaaug

SEQ ID NO: 17754 - RNA, 19 nt, artificial
  Oligomer
uucuguuugcauugggcuu

SEQ ID NO: 17755 - RNA, 19 nt, artificial
  Oligomer
uguuguucucauugaagcg

SEQ ID NO: 17756 - RNA, 19 nt, artificial
  Oligomer
aauguaaaaauuuucacuc

SEQ ID NO: 17757 - RNA, 19 nt, artificial
  Oligomer
uucaccgugcccagaauug

SEQ ID NO: 17758 - RNA, 19 nt, artificial
  Oligomer
ucaaaugggaaaaccgacu

SEQ ID NO: 17759 - RNA, 19 nt, artificial
  Oligomer
uucucauugaagcgugggu

SEQ ID NO: 17760 - RNA, 19 nt, artificial
  Oligomer
uccgagccucaaauacucc

SEQ ID NO: 17761 - RNA, 19 nt, artificial
  Oligomer
uuucauugaguuuuuuaac

SEQ ID NO: 17762 - RNA, 19 nt, artificial
  Oligomer
cuuuguauugcaaacaaug

SEQ ID NO: 17763 - RNA, 19 nt, artificial
  Oligomer
aucauucacugcaaccuug

SEQ ID NO: 17764 - RNA, 19 nt, artificial
  Oligomer
uuggguuuccagacccaga

SEQ ID NO: 17765 - RNA, 19 nt, artificial
  Oligomer
ucauugaguuuuuuaaccc

SEQ ID NO: 17766 - RNA, 19 nt, artificial
  Oligomer
auaugaagcacuggugagg

SEQ ID NO: 17767 - RNA, 19 nt, artificial
  Oligomer
ucucauugaagcguggguu

SEQ ID NO: 17768 - RNA, 19 nt, artificial
  Oligomer
uuucagauuauaucauggu

SEQ ID NO: 17769 - RNA, 19 nt, artificial
  Oligomer
acugucuuucuucccuucc

SEQ ID NO: 17770 - RNA, 19 nt, artificial
  Oligomer
acauguaagguuuagauuc

SEQ ID NO: 17771 - RNA, 19 nt, artificial
  Oligomer
uuaaaguggaaggcaacau

SEQ ID NO: 17772 - RNA, 19 nt, artificial
  Oligomer
acuuacaagagggauauug

SEQ ID NO: 17773 - RNA, 19 nt, artificial
  Oligomer
guuugcauugggcuucacc

SEQ ID NO: 17774 - RNA, 19 nt, artificial
  Oligomer
ugaaugguuucccacuuuc

SEQ ID NO: 17775 - RNA, 19 nt, artificial
  Oligomer
ugaagcacuggugaggucu

SEQ ID NO: 17776 - RNA, 19 nt, artificial
  Oligomer
ugguauaugaagcacuggu

SEQ ID NO: 17777 - RNA, 19 nt, artificial
  Oligomer
uuucccacuuucaaauggg

SEQ ID NO: 17778 - RNA, 19 nt, artificial
  Oligomer
uauuaaguagaugacuuac

SEQ ID NO: 17779 - RNA, 19 nt, artificial
  Oligomer
ugucaccagaaauucccag

SEQ ID NO: 17780 - RNA, 19 nt, artificial
  Oligomer
auucuguuugcauugggcu

SEQ ID NO: 17781 - RNA, 19 nt, artificial
  Oligomer
uggaaggcaacaucauucc

SEQ ID NO: 17782 - RNA, 19 nt, artificial
  Oligomer
uugaaugguuucccacuuu

SEQ ID NO: 17783 - RNA, 19 nt, artificial
  Oligomer
auaagcuccaggugcucca

SEQ ID NO: 17784 - RNA, 19 nt, artificial
  Oligomer
ugagacagguaauucacug

SEQ ID NO: 17785 - RNA, 19 nt, artificial
  Oligomer
uauuuugaaugguuuccca

SEQ ID NO: 17786 - RNA, 19 nt, artificial
  Oligomer
guauuuugaaugguuuccc

SEQ ID NO: 17787 - RNA, 19 nt, artificial
  Oligomer
uauuuauuaaguagaugac

SEQ ID NO: 17788 - RNA, 19 nt, artificial
  Oligomer
cugucuuucuucccuuccc

SEQ ID NO: 17789 - RNA, 19 nt, artificial
  Oligomer
auuauccagcuuuguauug

SEQ ID NO: 17790 - RNA, 19 nt, artificial
  Oligomer
ucagauuauaucaugguau

SEQ ID NO: 17791 - RNA, 19 nt, artificial
  Oligomer
uggugaggucuaugucacc

SEQ ID NO: 17792 - RNA, 19 nt, artificial
  Oligomer
guggaaggcaacaucauuc

SEQ ID NO: 17793 - RNA, 19 nt, artificial
  Oligomer
ugaggguuuggguuuccag

SEQ ID NO: 17794 - RNA, 19 nt, artificial
  Oligomer
uaucaugguauaugaagca

SEQ ID NO: 17795 - RNA, 19 nt, artificial
  Oligomer
uauuauccagcuuuguauu

SEQ ID NO: 17796 - RNA, 19 nt, artificial
  Oligomer
ugaauguaaaaauuuucac

SEQ ID NO: 17797 - RNA, 19 nt, artificial
  Oligomer
agaauuguuaucagcaugc

SEQ ID NO: 17798 - RNA, 19 nt, artificial
  Oligomer
uaugaagcacuggugaggu

SEQ ID NO: 17799 - RNA, 19 nt, artificial
  Oligomer
aucuaaagcaauucuguuu

SEQ ID NO: 17800 - RNA, 19 nt, artificial
  Oligomer
ugaagcguggguuaaagug

SEQ ID NO: 17801 - RNA, 19 nt, artificial
  Oligomer
ucaaccaguacuuguauuu

SEQ ID NO: 17802 - RNA, 19 nt, artificial
  Oligomer
uucagauuauaucauggua

SEQ ID NO: 17803 - RNA, 19 nt, artificial
  Oligomer
auuaaguagaugacuuaca

SEQ ID NO: 17804 - RNA, 19 nt, artificial
  Oligomer
uguaaaaauuuucacucac

SEQ ID NO: 17805 - RNA, 19 nt, artificial
  Oligomer
uccagcuuuguauugcaaa

SEQ ID NO: 17806 - RNA, 19 nt, artificial
  Oligomer
aucauggagcgaaaaauug

SEQ ID NO: 17807 - RNA, 19 nt, artificial
  Oligomer
uugcugauuucauugaguu

SEQ ID NO: 17808 - RNA, 19 nt, artificial
  Oligomer
uuauuaaguagaugacuua

SEQ ID NO: 17809 - RNA, 19 nt, artificial
  Oligomer
ucagguucaaccaguacuu

SEQ ID NO: 17810 - RNA, 19 nt, artificial
  Oligomer
uuuucacucacagugaaca

SEQ ID NO: 17811 - RNA, 19 nt, artificial
  Oligomer
aacaucauucccucuuugg

SEQ ID NO: 17812 - RNA, 19 nt, artificial
  Oligomer
aaaccgacugucuuucuuc

SEQ ID NO: 17813 - RNA, 19 nt, artificial
  Oligomer
uugaggguuuggguuucca

SEQ ID NO: 17814 - RNA, 19 nt, artificial
  Oligomer
uauaaggcacaaucagugg

SEQ ID NO: 17815 - RNA, 19 nt, artificial
  Oligomer
uugagacagguaauucacu

SEQ ID NO: 17816 - RNA, 19 nt, artificial
  Oligomer
uucaaccaguacuuguauu

SEQ ID NO: 17817 - RNA, 19 nt, artificial
  Oligomer
aaugacucuccuguuguuc

SEQ ID NO: 17818 - RNA, 19 nt, artificial
  Oligomer
agauaacgcaucauggagc

SEQ ID NO: 17819 - RNA, 19 nt, artificial
  Oligomer
auugaguuuuuuaacccga

SEQ ID NO: 17820 - RNA, 19 nt, artificial
  Oligomer
uauaugaagcacuggugag

SEQ ID NO: 17821 - RNA, 19 nt, artificial
  Oligomer
uuuuuaacccgaugauugu

SEQ ID NO: 17822 - RNA, 19 nt, artificial
  Oligomer
uuaaguagaugacuuacaa

SEQ ID NO: 17823 - RNA, 19 nt, artificial
  Oligomer
auuauaucaugguauauga

SEQ ID NO: 17824 - RNA, 19 nt, artificial
  Oligomer
ucuuuggaaaucuaaagca

SEQ ID NO: 17825 - RNA, 19 nt, artificial
  Oligomer
uggagcgaaaaauugucug

SEQ ID NO: 17826 - RNA, 19 nt, artificial
  Oligomer
uuugcugauuucauugagu

SEQ ID NO: 17827 - RNA, 19 nt, artificial
  Oligomer
uguuaucagcaugcgaggc

SEQ ID NO: 17828 - RNA, 19 nt, artificial
  Oligomer
auuuauuaaguagaugacu

SEQ ID NO: 17829 - RNA, 19 nt, artificial
  Oligomer
uugaguuuuuuaacccgau

SEQ ID NO: 17830 - RNA, 19 nt, artificial
  Oligomer
ucauucacugcaaccuuga

SEQ ID NO: 17831 - RNA, 19 nt, artificial
  Oligomer
aauucuguuugcauugggc

SEQ ID NO: 17832 - RNA, 19 nt, artificial
  Oligomer
cuuucaaaugggaaaaccg

SEQ ID NO: 17833 - RNA, 19 nt, artificial
  Oligomer
acccagauaacgcaucaug

SEQ ID NO: 17834 - RNA, 19 nt, artificial
  Oligomer
accgacugucuuucuuccc

SEQ ID NO: 17835 - RNA, 19 nt, artificial
  Oligomer
uauccagcuuuguauugca

SEQ ID NO: 17836 - RNA, 19 nt, artificial
  Oligomer
uucacucacagugaacaug

SEQ ID NO: 17837 - RNA, 19 nt, artificial
  Oligomer
aucaugguauaugaagcac

SEQ ID NO: 17838 - RNA, 19 nt, artificial
  Oligomer
aagugagcaucauucacug

SEQ ID NO: 17839 - RNA, 19 nt, artificial
  Oligomer
uuuggaaaucuaaagcaau

SEQ ID NO: 17840 - RNA, 19 nt, artificial
  Oligomer
acaagagggauauugauga

SEQ ID NO: 17841 - RNA, 19 nt, artificial
  Oligomer
gugagcaucauucacugca

SEQ ID NO: 17842 - RNA, 19 nt, artificial
  Oligomer
ugaguuuuuuaacccgaug

SEQ ID NO: 17843 - RNA, 19 nt, artificial
  Oligomer
aaggcaacaucauucccuc

SEQ ID NO: 17844 - RNA, 19 nt, artificial
  Oligomer
augacucuccuguuguucu

SEQ ID NO: 17845 - RNA, 19 nt, artificial
  Oligomer
uuacaagagggauauugau

SEQ ID NO: 17846 - RNA, 19 nt, artificial
  Oligomer
uugaagcguggguuaaagu

SEQ ID NO: 17847 - RNA, 19 nt, artificial
  Oligomer
uaaguagaugacuuacaag

SEQ ID NO: 17848 - RNA, 19 nt, artificial
  Oligomer
agcaucauucacugcaacc

SEQ ID NO: 17849 - RNA, 19 nt, artificial
  Oligomer
uggaaaucuaaagcaauuc

SEQ ID NO: 17850 - RNA, 19 nt, artificial
  Oligomer
aaguagaugacuuacaaga

SEQ ID NO: 17851 - RNA, 19 nt, artificial
  Oligomer
uuggaaaucuaaagcaauu

SEQ ID NO: 17852 - RNA, 19 nt, artificial
  Oligomer
ugaaguggucagguucaac

SEQ ID NO: 17853 - RNA, 19 nt, artificial
  Oligomer
cuuucagauuauaucaugg

SEQ ID NO: 17854 - RNA, 19 nt, artificial
  Oligomer
gaaguggucagguucaacc

SEQ ID NO: 17855 - RNA, 19 nt, artificial
  Oligomer
cuccgagccucaaauacuc

SEQ ID NO: 17856 - RNA, 19 nt, artificial
  Oligomer
cuaugucaccagaaauucc

SEQ ID NO: 17857 - RNA, 19 nt, artificial
  Oligomer
gucagguucaaccaguacu

SEQ ID NO: 17858 - RNA, 19 nt, artificial
  Oligomer
aaccaguacuuguauuuug

SEQ ID NO: 17859 - RNA, 19 nt, artificial
  Oligomer
uauugcaaacaaugacucu

SEQ ID NO: 17860 - RNA, 19 nt, artificial
  Oligomer
agcaauucuguuugcauug

SEQ ID NO: 17861 - RNA, 19 nt, artificial
  Oligomer
ugggaaaaccgacugucuu

SEQ ID NO: 17862 - RNA, 19 nt, artificial
  Oligomer
cucuuuggaaaucuaaagc

SEQ ID NO: 17863 - RNA, 19 nt, artificial
  Oligomer
gugaggucuaugucaccag

SEQ ID NO: 17864 - RNA, 19 nt, artificial
  Oligomer
cuguuguucucauugaagc

SEQ ID NO: 17865 - RNA, 19 nt, artificial
  Oligomer
uucccaguuugcugauuuc

SEQ ID NO: 17866 - RNA, 19 nt, artificial
  Oligomer
uuauaucaugguauaugaa

SEQ ID NO: 17867 - RNA, 19 nt, artificial
  Oligomer
uguacugcaacaagugagc

SEQ ID NO: 17868 - RNA, 19 nt, artificial
  Oligomer
gauuauaucaugguauaug

SEQ ID NO: 17869 - RNA, 19 nt, artificial
  Oligomer
uaacgcaucauggagcgaa

SEQ ID NO: 17870 - RNA, 19 nt, artificial
  Oligomer
auucccaguuugcugauuu

SEQ ID NO: 17871 - RNA, 19 nt, artificial
  Oligomer
ucccaguuugcugauuuca

SEQ ID NO: 17872 - RNA, 19 nt, artificial
  Oligomer
uccagacccagauaacgca

SEQ ID NO: 17873 - RNA, 19 nt, artificial
  Oligomer
auugaagcguggguuaaag

SEQ ID NO: 17874 - RNA, 19 nt, artificial
  Oligomer
uccuugaggguuuggguuu

SEQ ID NO: 17875 - RNA, 19 nt, artificial
  Oligomer
ugcaaccuugaagugguca

SEQ ID NO: 17876 - RNA, 19 nt, artificial
  Oligomer
aaccgacugucuuucuucc

SEQ ID NO: 17877 - RNA, 19 nt, artificial
  Oligomer
aaugggaaaaccgacuguc

SEQ ID NO: 17878 - RNA, 19 nt, artificial
  Oligomer
ugaacaugaaaccuuuaca

SEQ ID NO: 17879 - RNA, 19 nt, artificial
  Oligomer
ugacucuccuguuguucuc

SEQ ID NO: 17880 - RNA, 19 nt, artificial
  Oligomer
agagggauauugaugaaug

SEQ ID NO: 17881 - RNA, 19 nt, artificial
  Oligomer
augacuuacaagagggaua

SEQ ID NO: 17882 - RNA, 19 nt, artificial
  Oligomer
ugguuucccacuuucaaau

SEQ ID NO: 17883 - RNA, 19 nt, artificial
  Oligomer
ccaguuauuauccagcuuu

SEQ ID NO: 17884 - RNA, 19 nt, artificial
  Oligomer
caacaagugagcaucauuc

SEQ ID NO: 17885 - RNA, 19 nt, artificial
  Oligomer
augauuguacugcaacaag

SEQ ID NO: 17886 - RNA, 19 nt, artificial
  Oligomer
auccuugaggguuuggguu

SEQ ID NO: 17887 - RNA, 19 nt, artificial
  Oligomer
guuauuauccagcuuugua

SEQ ID NO: 17888 - RNA, 19 nt, artificial
  Oligomer
guuaucagcaugcgaggca

SEQ ID NO: 17889 - RNA, 19 nt, artificial
  Oligomer
augucaccagaaauuccca

SEQ ID NO: 17890 - RNA, 19 nt, artificial
  Oligomer
aauuguuaucagcaugcga

SEQ ID NO: 17891 - RNA, 19 nt, artificial
  Oligomer
agguucaaccaguacuugu

SEQ ID NO: 17892 - RNA, 19 nt, artificial
  Oligomer
ucacagugaacaugaaacc

SEQ ID NO: 17893 - RNA, 19 nt, artificial
  Oligomer
augguuucccacuuucaaa

SEQ ID NO: 17894 - RNA, 19 nt, artificial
  Oligomer
ucauggagcgaaaaauugu

SEQ ID NO: 17895 - RNA, 19 nt, artificial
  Oligomer
uggguuuccagacccagau

SEQ ID NO: 17896 - RNA, 19 nt, artificial
  Oligomer
aacaaugacucuccuguug

SEQ ID NO: 17897 - RNA, 19 nt, artificial
  Oligomer
acuggugaggucuauguca

SEQ ID NO: 17898 - RNA, 19 nt, artificial
  Oligomer
auggagcgaaaaauugucu

SEQ ID NO: 17899 - RNA, 19 nt, artificial
  Oligomer
gaaggcaacaucauucccu

SEQ ID NO: 17900 - RNA, 19 nt, artificial
  Oligomer
auuuucacucacagugaac

SEQ ID NO: 17901 - RNA, 19 nt, artificial
  Oligomer
accagaaauucccaguuug

SEQ ID NO: 17902 - RNA, 19 nt, artificial
  Oligomer
augggaaaaccgacugucu

SEQ ID NO: 17903 - RNA, 19 nt, artificial
  Oligomer
cagguuauaaggcacaauc

SEQ ID NO: 17904 - RNA, 19 nt, artificial
  Oligomer
caagugagcaucauucacu

SEQ ID NO: 17905 - RNA, 19 nt, artificial
  Oligomer
augguauaugaagcacugg

SEQ ID NO: 17906 - RNA, 19 nt, artificial
  Oligomer
aacccgaugauuguacugc

SEQ ID NO: 17907 - RNA, 19 nt, artificial
  Oligomer
uuuuaacccgaugauugua

SEQ ID NO: 17908 - RNA, 19 nt, artificial
  Oligomer
accaguacuuguauuuuga

SEQ ID NO: 17909 - RNA, 19 nt, artificial
  Oligomer
ugauuguacugcaacaagu

SEQ ID NO: 17910 - RNA, 19 nt, artificial
  Oligomer
agcacuggugaggucuaug

SEQ ID NO: 17911 - RNA, 19 nt, artificial
  Oligomer
cuggugaggucuaugucac

SEQ ID NO: 17912 - RNA, 19 nt, artificial
  Oligomer
uaaagcaauucuguuugca

SEQ ID NO: 17913 - RNA, 19 nt, artificial
  Oligomer
acuuguauuuugaaugguu

SEQ ID NO: 17914 - RNA, 19 nt, artificial
  Oligomer
aaugguuucccacuuucaa

SEQ ID NO: 17915 - RNA, 19 nt, artificial
  Oligomer
caguuugcugauuucauug

SEQ ID NO: 17916 - RNA, 19 nt, artificial
  Oligomer
caaacaaugacucuccugu

SEQ ID NO: 17917 - RNA, 19 nt, artificial
  Oligomer
aaaguggaaggcaacauca

SEQ ID NO: 17918 - RNA, 19 nt, artificial
  Oligomer
ugcaaacaaugacucuccu

SEQ ID NO: 17919 - RNA, 19 nt, artificial
  Oligomer
guauugcaaacaaugacuc

SEQ ID NO: 17920 - RNA, 19 nt, artificial
  Oligomer
acugcaacaagugagcauc

SEQ ID NO: 17921 - RNA, 19 nt, artificial
  Oligomer
cauugaguuuuuuaacccg

SEQ ID NO: 17922 - RNA, 19 nt, artificial
  Oligomer
ucccucuuuggaaaucuaa

SEQ ID NO: 17923 - RNA, 19 nt, artificial
  Oligomer
ucaccagaaauucccaguu

SEQ ID NO: 17924 - RNA, 19 nt, artificial
  Oligomer
acaaugacucuccuguugu

SEQ ID NO: 17925 - RNA, 19 nt, artificial
  Oligomer
aagcaauucuguuugcauu

SEQ ID NO: 17926 - RNA, 19 nt, artificial
  Oligomer
cccagauaacgcaucaugg

SEQ ID NO: 17927 - RNA, 19 nt, artificial
  Oligomer
ucacucacagugaacauga

SEQ ID NO: 17928 - RNA, 19 nt, artificial
  Oligomer
uguucucauugaagcgugg

SEQ ID NO: 17929 - RNA, 19 nt, artificial
  Oligomer
ugaggucuaugucaccaga

SEQ ID NO: 17930 - RNA, 19 nt, artificial
  Oligomer
aaggcagguuauaaggcac

SEQ ID NO: 17931 - RNA, 19 nt, artificial
  Oligomer
uuaacccgaugauuguacu

SEQ ID NO: 17932 - RNA, 19 nt, artificial
  Oligomer
cuuguauuuugaaugguuu

SEQ ID NO: 17933 - RNA, 19 nt, artificial
  Oligomer
acaagugagcaucauucac

SEQ ID NO: 17934 - RNA, 19 nt, artificial
  Oligomer
cuguccagaagauggguag

SEQ ID NO: 17935 - RNA, 19 nt, artificial
  Oligomer
gaugaauguaaaaauuuuc

SEQ ID NO: 17936 - RNA, 19 nt, artificial
  Oligomer
auucccucuuuggaaaucu

SEQ ID NO: 17937 - RNA, 19 nt, artificial
  Oligomer
gucuaugucaccagaaauu

SEQ ID NO: 17938 - RNA, 19 nt, artificial
  Oligomer
aaaggcagguuauaaggca

SEQ ID NO: 17939 - RNA, 19 nt, artificial
  Oligomer
uaacccgaugauuguacug

SEQ ID NO: 17940 - RNA, 19 nt, artificial
  Oligomer
aaaaccgacugucuuucuu

SEQ ID NO: 17941 - RNA, 19 nt, artificial
  Oligomer
uggguuaaaguggaaggca

SEQ ID NO: 17942 - RNA, 19 nt, artificial
  Oligomer
auccagcuuuguauugcaa

SEQ ID NO: 17943 - RNA, 19 nt, artificial
  Oligomer
ccuugaaguggucagguuc

SEQ ID NO: 17944 - RNA, 19 nt, artificial
  Oligomer
guuauaaggcacaaucagu

SEQ ID NO: 17945 - RNA, 19 nt, artificial
  Oligomer
guggucagguucaaccagu

SEQ ID NO: 17946 - RNA, 19 nt, artificial
  Oligomer
aguggucagguucaaccag

SEQ ID NO: 17947 - RNA, 19 nt, artificial
  Oligomer
agccucaaauacucccagc

SEQ ID NO: 17948 - RNA, 19 nt, artificial
  Oligomer
uugaaguggucagguucaa

SEQ ID NO: 17949 - RNA, 19 nt, artificial
  Oligomer
acagugaacaugaaaccuu

SEQ ID NO: 17950 - RNA, 19 nt, artificial
  Oligomer
cacugcaaccuugaagugg

SEQ ID NO: 17951 - RNA, 19 nt, artificial
  Oligomer
aucauucccucuuuggaaa

SEQ ID NO: 17952 - RNA, 19 nt, artificial
  Oligomer
uacugcaacaagugagcau

SEQ ID NO: 17953 - RNA, 19 nt, artificial
  Oligomer
aguagaugacuuacaagag

SEQ ID NO: 17954 - RNA, 19 nt, artificial
  Oligomer
auguaaaaauuuucacuca

SEQ ID NO: 17955 - RNA, 19 nt, artificial
  Oligomer
augaagcacuggugagguc

SEQ ID NO: 17956 - RNA, 19 nt, artificial
  Oligomer
uacuuguauuuugaauggu

SEQ ID NO: 17957 - RNA, 19 nt, artificial
  Oligomer
aggguuuggguuuccagac

SEQ ID NO: 17958 - RNA, 19 nt, artificial
  Oligomer
acuuucaaaugggaaaacc

SEQ ID NO: 17959 - RNA, 19 nt, artificial
  Oligomer
cagaauuguuaucagcaug

SEQ ID NO: 17960 - RNA, 19 nt, artificial
  Oligomer
acaucauucccucuuugga

SEQ ID NO: 17961 - RNA, 19 nt, artificial
  Oligomer
ugcugauuucauugaguuu

SEQ ID NO: 17962 - RNA, 19 nt, artificial
  Oligomer
uuucacucacagugaacau

SEQ ID NO: 17963 - RNA, 19 nt, artificial
  Oligomer
acugcaaccuugaaguggu

SEQ ID NO: 17964 - RNA, 19 nt, artificial
  Oligomer
aaucuaaagcaauucuguu

SEQ ID NO: 17965 - RNA, 19 nt, artificial
  Oligomer
aaaaauuuucacucacagu

SEQ ID NO: 17966 - RNA, 19 nt, artificial
  Oligomer
aaguggucagguucaacca

SEQ ID NO: 17967 - RNA, 19 nt, artificial
  Oligomer
guagaugacuuacaagagg

SEQ ID NO: 17968 - RNA, 19 nt, artificial
  Oligomer
ucccacuuucaaaugggaa

SEQ ID NO: 17969 - RNA, 19 nt, artificial
  Oligomer
gcaaaggcagguuauaagg

SEQ ID NO: 17970 - RNA, 19 nt, artificial
  Oligomer
uccuguuguucucauugaa

SEQ ID NO: 17971 - RNA, 19 nt, artificial
  Oligomer
guucucauugaagcguggg

SEQ ID NO: 17972 - RNA, 19 nt, artificial
  Oligomer
ccuguuguucucauugaag

SEQ ID NO: 17973 - RNA, 19 nt, artificial
  Oligomer
ugacuuacaagagggauau

SEQ ID NO: 17974 - RNA, 19 nt, artificial
  Oligomer
cuuacaagagggauauuga

SEQ ID NO: 17975 - RNA, 19 nt, artificial
  Oligomer
gaaauucccaguuugcuga

SEQ ID NO: 17976 - RNA, 19 nt, artificial
  Oligomer
ccuuucagauuauaucaug

SEQ ID NO: 17977 - RNA, 19 nt, artificial
  Oligomer
cccagaauuguuaucagca

SEQ ID NO: 17978 - RNA, 19 nt, artificial
  Oligomer
guuguucucauugaagcgu

SEQ ID NO: 17979 - RNA, 19 nt, artificial
  Oligomer
uggucagguucaaccagua

SEQ ID NO: 17980 - RNA, 19 nt, artificial
  Oligomer
aaaucuaaagcaauucugu

SEQ ID NO: 17981 - RNA, 19 nt, artificial
  Oligomer
cagaaauucccaguuugcu

SEQ ID NO: 17982 - RNA, 19 nt, artificial
  Oligomer
cagauaacgcaucauggag

SEQ ID NO: 17983 - RNA, 19 nt, artificial
  Oligomer
aaagcaauucuguuugcau

SEQ ID NO: 17984 - RNA, 19 nt, artificial
  Oligomer
ucaccgugcccagaauugu

SEQ ID NO: 17985 - RNA, 19 nt, artificial
  Oligomer
uguccagaagauggguagg

SEQ ID NO: 17986 - RNA, 19 nt, artificial
  Oligomer
caugguauaugaagcacug

SEQ ID NO: 17987 - RNA, 19 nt, artificial
  Oligomer
uguuugcauugggcuucac

SEQ ID NO: 17988 - RNA, 19 nt, artificial
  Oligomer
caguuauuauccagcuuug

SEQ ID NO: 17989 - RNA, 19 nt, artificial
  Oligomer
cuugaaguggucagguuca

SEQ ID NO: 17990 - RNA, 19 nt, artificial
  Oligomer
ggcaacaucauucccucuu

SEQ ID NO: 17991 - RNA, 19 nt, artificial
  Oligomer
aagagggauauugaugaau

SEQ ID NO: 17992 - RNA, 19 nt, artificial
  Oligomer
aguuauuauccagcuuugu

SEQ ID NO: 17993 - RNA, 19 nt, artificial
  Oligomer
gguauaugaagcacuggug

SEQ ID NO: 17994 - RNA, 19 nt, artificial
  Oligomer
gucaccagaaauucccagu

SEQ ID NO: 17995 - RNA, 19 nt, artificial
  Oligomer
gugaacaugaaaccuuuac

SEQ ID NO: 17996 - RNA, 19 nt, artificial
  Oligomer
cuugaggguuuggguuucc

SEQ ID NO: 17997 - RNA, 19 nt, artificial
  Oligomer
aguggaaggcaacaucauu

SEQ ID NO: 17998 - RNA, 19 nt, artificial
  Oligomer
caucauucacugcaaccuu

SEQ ID NO: 17999 - RNA, 19 nt, artificial
  Oligomer
uucccucuuuggaaaucua

SEQ ID NO: 18000 - RNA, 19 nt, artificial
  Oligomer
gcaaacaaugacucuccug

SEQ ID NO: 18001 - RNA, 19 nt, artificial
  Oligomer
ccgacugucuuucuucccu

SEQ ID NO: 18002 - RNA, 19 nt, artificial
  Oligomer
gaaaucuaaagcaauucug

SEQ ID NO: 18003 - RNA, 19 nt, artificial
  Oligomer
cacuggugaggucuauguc

SEQ ID NO: 18004 - RNA, 19 nt, artificial
  Oligomer
ucacugcaaccuugaagug

SEQ ID NO: 18005 - RNA, 19 nt, artificial
  Oligomer
guacuuguauuuugaaugg

SEQ ID NO: 18006 - RNA, 19 nt, artificial
  Oligomer
cucacagugaacaugaaac

SEQ ID NO: 18007 - RNA, 19 nt, artificial
  Oligomer
caaaugggaaaaccgacug

SEQ ID NO: 18008 - RNA, 19 nt, artificial
  Oligomer
aaauuuucacucacaguga

SEQ ID NO: 18009 - RNA, 19 nt, artificial
  Oligomer
cauggagcgaaaaauuguc

SEQ ID NO: 18010 - RNA, 19 nt, artificial
  Oligomer
uucccacuuucaaauggga

SEQ ID NO: 18011 - RNA, 19 nt, artificial
  Oligomer
ggcaaaggcagguuauaag

SEQ ID NO: 18012 - RNA, 19 nt, artificial
  Oligomer
aggcagguuauaaggcaca

SEQ ID NO: 18013 - RNA, 19 nt, artificial
  Oligomer
agugagcaucauucacugc

SEQ ID NO: 18014 - RNA, 19 nt, artificial
  Oligomer
guauaugaagcacugguga

SEQ ID NO: 18015 - RNA, 19 nt, artificial
  Oligomer
aacaagugagcaucauuca

SEQ ID NO: 18016 - RNA, 19 nt, artificial
  Oligomer
aaccuugaaguggucaggu

SEQ ID NO: 18017 - RNA, 19 nt, artificial
  Oligomer
aaacaaugacucuccuguu

SEQ ID NO: 18018 - RNA, 19 nt, artificial
  Oligomer
ggaaaaccgacugucuuuc

SEQ ID NO: 18019 - RNA, 19 nt, artificial
  Oligomer
caaaggcagguuauaaggc

SEQ ID NO: 18020 - RNA, 19 nt, artificial
  Oligomer
ugagcaucauucacugcaa

SEQ ID NO: 18021 - RNA, 19 nt, artificial
  Oligomer
agguaauucacuguaauau

SEQ ID NO: 18022 - RNA, 19 nt, artificial
  Oligomer
auuguacugcaacaaguga

SEQ ID NO: 18023 - RNA, 19 nt, artificial
  Oligomer
caucauucccucuuuggaa

SEQ ID NO: 18024 - RNA, 19 nt, artificial
  Oligomer
ggugaggucuaugucacca

SEQ ID NO: 18025 - RNA, 19 nt, artificial
  Oligomer
guuaaaguggaaggcaaca

SEQ ID NO: 18026 - RNA, 19 nt, artificial
  Oligomer
gcugauuucauugaguuuu

SEQ ID NO: 18027 - RNA, 19 nt, artificial
  Oligomer
cacauguaagguuuagauu

SEQ ID NO: 18028 - RNA, 19 nt, artificial
  Oligomer
ucauugaagcguggguuaa

SEQ ID NO: 18029 - RNA, 19 nt, artificial
  Oligomer
ccucuuuggaaaucuaaag

SEQ ID NO: 18030 - RNA, 19 nt, artificial
  Oligomer
gauaacgcaucauggagcg

SEQ ID NO: 18031 - RNA, 19 nt, artificial
  Oligomer
agcuuuguauugcaaacaa

SEQ ID NO: 18032 - RNA, 19 nt, artificial
  Oligomer
guaaaaauuuucacucaca

SEQ ID NO: 18033 - RNA, 19 nt, artificial
  Oligomer
caauucuguuugcauuggg

SEQ ID NO: 18034 - RNA, 19 nt, artificial
  Oligomer
gaauguaaaaauuuucacu

SEQ ID NO: 18035 - RNA, 19 nt, artificial
  Oligomer
ugcccagaauuguuaucag

SEQ ID NO: 18036 - RNA, 19 nt, artificial
  Oligomer
ccagaaauucccaguuugc

SEQ ID NO: 18037 - RNA, 19 nt, artificial
  Oligomer
accgugcccagaauuguua

SEQ ID NO: 18038 - RNA, 19 nt, artificial
  Oligomer
gcaucauucacugcaaccu

SEQ ID NO: 18039 - RNA, 19 nt, artificial
  Oligomer
caacaucauucccucuuug

SEQ ID NO: 18040 - RNA, 19 nt, artificial
  Oligomer
cagcuuuguauugcaaaca

SEQ ID NO: 18041 - RNA, 19 nt, artificial
  Oligomer
cgagccucaaauacuccca

SEQ ID NO: 18042 - RNA, 19 nt, artificial
  Oligomer
gaagcguggguuaaagugg

SEQ ID NO: 18043 - RNA, 19 nt, artificial
  Oligomer
gagcgaaaaauugucugcc

SEQ ID NO: 18044 - RNA, 19 nt, artificial
  Oligomer
agguuauaaggcacaauca

SEQ ID NO: 18045 - RNA, 19 nt, artificial
  Oligomer
ucauucccucuuuggaaau

SEQ ID NO: 18046 - RNA, 19 nt, artificial
  Oligomer
gagccucaaauacucccag

SEQ ID NO: 18047 - RNA, 19 nt, artificial
  Oligomer
caguacuuguauuuugaau

SEQ ID NO: 18048 - RNA, 19 nt, artificial
  Oligomer
gugcccagaauuguuauca

SEQ ID NO: 18049 - RNA, 19 nt, artificial
  Oligomer
aggcaaaggcagguuauaa

SEQ ID NO: 18050 - RNA, 19 nt, artificial
  Oligomer
aggcaacaucauucccucu

SEQ ID NO: 18051 - RNA, 19 nt, artificial
  Oligomer
acucuccuguuguucucau

SEQ ID NO: 18052 - RNA, 19 nt, artificial
  Oligomer
gggauauugaugaauguaa

SEQ ID NO: 18053 - RNA, 19 nt, artificial
  Oligomer
cgacugucuuucuucccuu

SEQ ID NO: 18054 - RNA, 19 nt, artificial
  Oligomer
gcuccgagccucaaauacu

SEQ ID NO: 18055 - RNA, 19 nt, artificial
  Oligomer
guuugcugauuucauugag

SEQ ID NO: 18056 - RNA, 19 nt, artificial
  Oligomer
ugauuucauugaguuuuuu

SEQ ID NO: 18057 - RNA, 19 nt, artificial
  Oligomer
agggauauugaugaaugua

SEQ ID NO: 18058 - RNA, 19 nt, artificial
  Oligomer
gaacaugaaaccuuuacac

SEQ ID NO: 18059 - RNA, 19 nt, artificial
  Oligomer
guuucccacuuucaaaugg

SEQ ID NO: 18060 - RNA, 19 nt, artificial
  Oligomer
cucauugaagcguggguua

SEQ ID NO: 18061 - RNA, 19 nt, artificial
  Oligomer
gcaaccuugaaguggucag

SEQ ID NO: 18062 - RNA, 19 nt, artificial
  Oligomer
gaggguuuggguuuccaga

SEQ ID NO: 18063 - RNA, 19 nt, artificial
  Oligomer
cuguuugcauugggcuuca

SEQ ID NO: 18064 - RNA, 19 nt, artificial
  Oligomer
gauuucauugaguuuuuua

SEQ ID NO: 18065 - RNA, 19 nt, artificial
  Oligomer
guuuuuuaacccgaugauu

SEQ ID NO: 18066 - RNA, 19 nt, artificial
  Oligomer
aguuugcugauuucauuga

SEQ ID NO: 18067 - RNA, 19 nt, artificial
  Oligomer
cuucaccgugcccagaauu

SEQ ID NO: 18068 - RNA, 19 nt, artificial
  Oligomer
ccagcuuuguauugcaaac

SEQ ID NO: 18069 - RNA, 19 nt, artificial
  Oligomer
cccaguuugcugauuucau

SEQ ID NO: 18070 - RNA, 19 nt, artificial
  Oligomer
cauccuugaggguuugggu

SEQ ID NO: 18071 - RNA, 19 nt, artificial
  Oligomer
gacugucuuucuucccuuc

SEQ ID NO: 18072 - RNA, 19 nt, artificial
  Oligomer
gguuauaaggcacaaucag

SEQ ID NO: 18073 - RNA, 19 nt, artificial
  Oligomer
aaaugggaaaaccgacugu

SEQ ID NO: 18074 - RNA, 19 nt, artificial
  Oligomer
gauuguacugcaacaagug

SEQ ID NO: 18075 - RNA, 19 nt, artificial
  Oligomer
cccaguuauuauccagcuu

SEQ ID NO: 18076 - RNA, 19 nt, artificial
  Oligomer
cguggguuaaaguggaagg

SEQ ID NO: 18077 - RNA, 19 nt, artificial
  Oligomer
aaguggaaggcaacaucau

SEQ ID NO: 18078 - RNA, 19 nt, artificial
  Oligomer
cacuguaauauuuauuaag

SEQ ID NO: 18079 - RNA, 19 nt, artificial
  Oligomer
caaccuugaaguggucagg

SEQ ID NO: 18080 - RNA, 19 nt, artificial
  Oligomer
guggguuaaaguggaaggc

SEQ ID NO: 18081 - RNA, 19 nt, artificial
  Oligomer
agacagguaauucacugua

SEQ ID NO: 18082 - RNA, 19 nt, artificial
  Oligomer
guaauucacuguaauauuu

SEQ ID NO: 18083 - RNA, 19 nt, artificial
  Oligomer
gaauuguuaucagcaugcg

SEQ ID NO: 18084 - RNA, 19 nt, artificial
  Oligomer
cagguucaaccaguacuug

SEQ ID NO: 18085 - RNA, 19 nt, artificial
  Oligomer
gaguuuuuuaacccgauga

SEQ ID NO: 18086 - RNA, 19 nt, artificial
  Oligomer
gaaugguuucccacuuuca

SEQ ID NO: 18087 - RNA, 19 nt, artificial
  Oligomer
ccaguuugcugauuucauu

SEQ ID NO: 18088 - RNA, 19 nt, artificial
  Oligomer
cucuccuguuguucucauu

SEQ ID NO: 18089 - RNA, 19 nt, artificial
  Oligomer
ugcaacaagugagcaucau

SEQ ID NO: 18090 - RNA, 19 nt, artificial
  Oligomer
guucaaccaguacuuguau

SEQ ID NO: 18091 - RNA, 19 nt, artificial
  Oligomer
ccgaugauuguacugcaac

SEQ ID NO: 18092 - RNA, 19 nt, artificial
  Oligomer
aagcguggguuaaagugga

SEQ ID NO: 18093 - RNA, 19 nt, artificial
  Oligomer
cuccuguuguucucauuga

SEQ ID NO: 18094 - RNA, 19 nt, artificial
  Oligomer
guuuggguuuccagaccca

SEQ ID NO: 18095 - RNA, 19 nt, artificial
  Oligomer
gcacuggugaggucuaugu

SEQ ID NO: 18096 - RNA, 19 nt, artificial
  Oligomer
accuugaaguggucagguu

SEQ ID NO: 18097 - RNA, 19 nt, artificial
  Oligomer
aguuuuuuaacccgaugau

SEQ ID NO: 18098 - RNA, 19 nt, artificial
  Oligomer
gguucaaccaguacuugua

SEQ ID NO: 18099 - RNA, 19 nt, artificial
  Oligomer
cugauuucauugaguuuuu

SEQ ID NO: 18100 - RNA, 19 nt, artificial
  Oligomer
aggucuaugucaccagaaa

SEQ ID NO: 18101 - RNA, 19 nt, artificial
  Oligomer
cagacccagauaacgcauc

SEQ ID NO: 18102 - RNA, 19 nt, artificial
  Oligomer
acccgaugauuguacugca

SEQ ID NO: 18103 - RNA, 19 nt, artificial
  Oligomer
aaauucccaguuugcugau

SEQ ID NO: 18104 - RNA, 19 nt, artificial
  Oligomer
agaugacuuacaagaggga

SEQ ID NO: 18105 - RNA, 19 nt, artificial
  Oligomer
ggaaggcaacaucauuccc

SEQ ID NO: 18106 - RNA, 19 nt, artificial
  Oligomer
cuuuggaaaucuaaagcaa

SEQ ID NO: 18107 - RNA, 19 nt, artificial
  Oligomer
ccuugaggguuuggguuuc

SEQ ID NO: 18108 - RNA, 19 nt, artificial
  Oligomer
guuuccagacccagauaac

SEQ ID NO: 18109 - RNA, 19 nt, artificial
  Oligomer
gcuguccagaagaugggua

SEQ ID NO: 18110 - RNA, 19 nt, artificial
  Oligomer
aauucccaguuugcugauu

SEQ ID NO: 18111 - RNA, 19 nt, artificial
  Oligomer
cccuuucagauuauaucau

SEQ ID NO: 18112 - RNA, 19 nt, artificial
  Oligomer
agacccagauaacgcauca

SEQ ID NO: 18113 - RNA, 19 nt, artificial
  Oligomer
caucauggagcgaaaaauu

SEQ ID NO: 18114 - RNA, 19 nt, artificial
  Oligomer
gggaaaaccgacugucuuu

SEQ ID NO: 18115 - RNA, 19 nt, artificial
  Oligomer
ggucagguucaaccaguac

SEQ ID NO: 18116 - RNA, 19 nt, artificial
  Oligomer
auaacgcaucauggagcga

SEQ ID NO: 18117 - RNA, 19 nt, artificial
  Oligomer
cugcaaccuugaagugguc

SEQ ID NO: 18118 - RNA, 19 nt, artificial
  Oligomer
gguuaaaguggaaggcaac

SEQ ID NO: 18119 - RNA, 19 nt, artificial
  Oligomer
caccgugcccagaauuguu

SEQ ID NO: 18120 - RNA, 19 nt, artificial
  Oligomer
gaaaaccgacugucuuucu

SEQ ID NO: 18121 - RNA, 19 nt, artificial
  Oligomer
gaggucuaugucaccagaa

SEQ ID NO: 18122 - RNA, 19 nt, artificial
  Oligomer
gaugacuuacaagagggau

SEQ ID NO: 18123 - RNA, 19 nt, artificial
  Oligomer
aagcacuggugaggucuau

SEQ ID NO: 18124 - RNA, 19 nt, artificial
  Oligomer
caaccaguacuuguauuuu

SEQ ID NO: 18125 - RNA, 19 nt, artificial
  Oligomer
cagugaacaugaaaccuuu

SEQ ID NO: 18126 - RNA, 19 nt, artificial
  Oligomer
cccucuuuggaaaucuaaa

SEQ ID NO: 18127 - RNA, 19 nt, artificial
  Oligomer
agauuauaucaugguauau

SEQ ID NO: 18128 - RNA, 19 nt, artificial
  Oligomer
gcguggguuaaaguggaag

SEQ ID NO: 18129 - RNA, 19 nt, artificial
  Oligomer
cuaaagcaauucuguuugc

SEQ ID NO: 18130 - RNA, 19 nt, artificial
  Oligomer
gcuuuguauugcaaacaau

SEQ ID NO: 18131 - RNA, 19 nt, artificial
  Oligomer
cugcaacaagugagcauca

SEQ ID NO: 18132 - RNA, 19 nt, artificial
  Oligomer
ggucuaugucaccagaaau

SEQ ID NO: 18133 - RNA, 19 nt, artificial
  Oligomer
gacucuccuguuguucuca

SEQ ID NO: 18134 - RNA, 19 nt, artificial
  Oligomer
gcaacaucauucccucuuu

SEQ ID NO: 18135 - RNA, 19 nt, artificial
  Oligomer
cacagugaacaugaaaccu

SEQ ID NO: 18136 - RNA, 19 nt, artificial
  Oligomer
gguaauucacuguaauauu

SEQ ID NO: 18137 - RNA, 19 nt, artificial
  Oligomer
acucacagugaacaugaaa

SEQ ID NO: 18138 - RNA, 19 nt, artificial
  Oligomer
gcccagaauuguuaucagc

SEQ ID NO: 18139 - RNA, 19 nt, artificial
  Oligomer
gcaacaagugagcaucauu

SEQ ID NO: 18140 - RNA, 19 nt, artificial
  Oligomer
aauuuucacucacagugaa

SEQ ID NO: 18141 - RNA, 19 nt, artificial
  Oligomer
ccagaauuguuaucagcau

SEQ ID NO: 18142 - RNA, 19 nt, artificial
  Oligomer
acagguaauucacuguaau

SEQ ID NO: 18143 - RNA, 19 nt, artificial
  Oligomer
ccagauaacgcaucaugga

SEQ ID NO: 18144 - RNA, 19 nt, artificial
  Oligomer
ccaguacuuguauuuugaa

SEQ ID NO: 18145 - RNA, 19 nt, artificial
  Oligomer
gguuucccacuuucaaaug

SEQ ID NO: 18146 - RNA, 19 nt, artificial
  Oligomer
ccagacccagauaacgcau

SEQ ID NO: 18147 - RNA, 19 nt, artificial
  Oligomer
aacgcaucauggagcgaaa

SEQ ID NO: 18148 - RNA, 19 nt, artificial
  Oligomer
gcaauucuguuugcauugg

SEQ ID NO: 18149 - RNA, 19 nt, artificial
  Oligomer
ggagcgaaaaauugucugc

SEQ ID NO: 18150 - RNA, 19 nt, artificial
  Oligomer
ggaaaucuaaagcaauucu

SEQ ID NO: 18151 - RNA, 19 nt, artificial
  Oligomer
gagacagguaauucacugu

SEQ ID NO: 18152 - RNA, 19 nt, artificial
  Oligomer
cauugaagcguggguuaaa

SEQ ID NO: 18153 - RNA, 19 nt, artificial
  Oligomer
cauucccucuuuggaaauc

SEQ ID NO: 18154 - RNA, 19 nt, artificial
  Oligomer
caccagaaauucccaguuu

SEQ ID NO: 18155 - RNA, 19 nt, artificial
  Oligomer
agugaacaugaaaccuuua

SEQ ID NO: 18156 - RNA, 19 nt, artificial
  Oligomer
cagauuauaucaugguaua

SEQ ID NO: 18157 - RNA, 19 nt, artificial
  Oligomer
cgaugauuguacugcaaca

SEQ ID NO: 18158 - RNA, 19 nt, artificial
  Oligomer
gaugauuguacugcaacaa

SEQ ID NO: 18159 - RNA, 19 nt, artificial
  Oligomer
ggauauugaugaauguaaa

SEQ ID NO: 18160 - RNA, 19 nt, artificial
  Oligomer
gauauugaugaauguaaaa

SEQ ID NO: 18161 - RNA, 19 nt, artificial
  Oligomer
gguuuccagacccagauaa

SEQ ID NO: 18162 - RNA, 19 nt, artificial
  Oligomer
cccacuuucaaaugggaaa

SEQ ID NO: 18163 - RNA, 19 nt, artificial
  Oligomer
ggguuaaaguggaaggcaa

SEQ ID NO: 18164 - RNA, 19 nt, artificial
  Oligomer
gagcaucauucacugcaac

SEQ ID NO: 18165 - RNA, 19 nt, artificial
  Oligomer
gcaucauggagcgaaaaau

SEQ ID NO: 18166 - RNA, 19 nt, artificial
  Oligomer
cagguaauucacuguaaua

SEQ ID NO: 18167 - RNA, 19 nt, artificial
  Oligomer
guacugcaacaagugagca

SEQ ID NO: 18168 - RNA, 19 nt, artificial
  Oligomer
cgugcccagaauuguuauc

SEQ ID NO: 18169 - RNA, 19 nt, artificial
  Oligomer
aggugccuguccaggauaa

SEQ ID NO: 18170 - RNA, 19 nt, artificial
  Oligomer
gaagcacuggugaggucua

SEQ ID NO: 18171 - RNA, 19 nt, artificial
  Oligomer
gcagguuauaaggcacaau

SEQ ID NO: 18172 - RNA, 19 nt, artificial
  Oligomer
gagggauauugaugaaugu

SEQ ID NO: 18173 - RNA, 19 nt, artificial
  Oligomer
cauucacugcaaccuugaa

SEQ ID NO: 18174 - RNA, 19 nt, artificial
  Oligomer
cgcaucauggagcgaaaaa

SEQ ID NO: 18175 - RNA, 19 nt, artificial
  Oligomer
caaugacucuccuguuguu

SEQ ID NO: 18176 - RNA, 19 nt, artificial
  Oligomer
ccaggcaaaggcagguuau

SEQ ID NO: 18177 - RNA, 19 nt, artificial
  Oligomer
agcguggguuaaaguggaa

SEQ ID NO: 18178 - RNA, 19 nt, artificial
  Oligomer
cacuuucaaaugggaaaac

SEQ ID NO: 18179 - RNA, 19 nt, artificial
  Oligomer
caggcaaaggcagguuaua

SEQ ID NO: 18180 - RNA, 19 nt, artificial
  Oligomer
gacccagauaacgcaucau

SEQ ID NO: 18181 - RNA, 19 nt, artificial
  Oligomer
ggcagguuauaaggcacaa

SEQ ID NO: 18182 - RNA, 19 nt, artificial
  Oligomer
ccgugcccagaauuguuau

SEQ ID NO: 18183 - RNA, 19 nt, artificial
  Oligomer
caagagggauauugaugaa

SEQ ID NO: 18184 - RNA, 19 nt, artificial
  Oligomer
acgcaucauggagcgaaaa

SEQ ID NO: 18185 - RNA, 19 nt, artificial
  Oligomer
gacagguaauucacuguaa

SEQ ID NO: 18186 - RNA, 19 nt, artificial
  Oligomer
ccacuuucaaaugggaaaa

SEQ ID NO: 18187 - RNA, 19 nt, artificial
  Oligomer
cccgaugauuguacugcaa

SEQ ID NO: 18188 - RNA, 19 nt, artificial
  Oligomer
ggguuuccagacccagaua

SEQ ID NO: 18189 - RNA, 19 nt, artificial
  Oligomer
gacuuacaagagggauauu

SEQ ID NO: 18190 - RNA, 19 nt, Artificial
  Oligomer
cacucacagugaacaugaa

SEQ ID NO: 18191 - RNA, 19 nt, artificial
  Oligomer
cgcucuugcugucucacaa

SEQ ID NO: 18192 - RNA, 19 nt, artificial
  Oligomer
gacuguuccugaccucaga

SEQ ID NO: 18193 - RNA, 19 nt, artificial
  Oligomer
cgcaccugaagaaugugaa

SEQ ID NO: 18194 - RNA, 19 nt, artificial
  Oligomer
ggucccugugagcaacaaa

SEQ ID NO: 18195 - RNA, 19 nt, artificial
  Oligomer
agaccuaccuggaggaaga

SEQ ID NO: 18196 - RNA, 19 nt, artificial
  Oligomer
ucaggacccggaaugacaa

SEQ ID NO: 18197 - RNA, 19 nt, artificial
  Oligomer
gucccugugagcaacaaaa

SEQ ID NO: 18198 - RNA, 19 nt, artificial
  Oligomer
gccucgaucucucucagaa

SEQ ID NO: 18199 - RNA, 19 nt, artificial
  Oligomer
gaaucugcuuugucuucua

SEQ ID NO: 18200 - RNA, 19 nt, artificial
  Oligomer
ucugguacaccaccaagaa

SEQ ID NO: 18201 - RNA, 19 nt, artificial
  Oligomer
ucuucuacucgcaccugaa

SEQ ID NO: 18202 - RNA, 19 nt, artificial
  Oligomer
aggagaugcuucagaggau

SEQ ID NO: 18203 - RNA, 19 nt, artificial
  Oligomer
ccucgaucucucucagaau

SEQ ID NO: 18204 - RNA, 19 nt, artificial
  Oligomer
gagguauacgugaccacca

SEQ ID NO: 18205 - RNA, 19 nt, artificial
  Oligomer
caccugggaugacaucaca

SEQ ID NO: 18206 - RNA, 19 nt, artificial
  Oligomer
gggaugacaucacagcuca

SEQ ID NO: 18207 - RNA, 19 nt, artificial
  Oligomer
gcuuucugacgcagagcaa

SEQ ID NO: 18208 - RNA, 19 nt, artificial
  Oligomer
accuggaccugagcuucaa

SEQ ID NO: 18209 - RNA, 19 nt, artificial
  Oligomer
guggaauucuugcgucuga

SEQ ID NO: 18210 - RNA, 19 nt, artificial
  Oligomer
cugacacgguggagauguu

SEQ ID NO: 18211 - RNA, 19 nt, artificial
  Oligomer
ccaccuucaagucucucca

SEQ ID NO: 18212 - RNA, 19 nt, artificial
  Oligomer
ggagaugcuucagaggauu

SEQ ID NO: 18213 - RNA, 19 nt, artificial
  Oligomer
ggaugaucuggaugagcag

SEQ ID NO: 18214 - RNA, 19 nt, artificial
  Oligomer
gggaugaucuggaugagca

SEQ ID NO: 18215 - RNA, 19 nt, artificial
  Oligomer
gaagaaugugaaggaggua

SEQ ID NO: 18216 - RNA, 19 nt, artificial
  Oligomer
cucugguacaccaccaaga

SEQ ID NO: 18217 - RNA, 19 nt, artificial
  Oligomer
uccuuguccugcacagcaa

SEQ ID NO: 18218 - RNA, 19 nt, artificial
  Oligomer
gcaccugaagaaugugaag

SEQ ID NO: 18219 - RNA, 19 nt, artificial
  Oligomer
caggagaugcuucagagga

SEQ ID NO: 18220 - RNA, 19 nt, artificial
  Oligomer
ccagaaaugcccagacugu

SEQ ID NO: 18221 - RNA, 19 nt, artificial
  Oligomer
agaaugugaaggagguaua

SEQ ID NO: 18222 - RNA, 19 nt, artificial
  Oligomer
accugaagaaugugaagga

SEQ ID NO: 18223 - RNA, 19 nt, artificial
  Oligomer
ggaugacaucacagcucag

SEQ ID NO: 18224 - RNA, 19 nt, artificial
  Oligomer
gcuuugucuucuacucgca

SEQ ID NO: 18225 - RNA, 19 nt, artificial
  Oligomer
ggcagaaucugcuuugucu

SEQ ID NO: 18226 - RNA, 19 nt, artificial
  Oligomer
gcaaguaccaggacagcau

SEQ ID NO: 18227 - RNA, 19 nt, artificial
  Oligomer
uccugaccucagauuugga

SEQ ID NO: 18228 - RNA, 19 nt, artificial
  Oligomer
cacgcuaccuccugagauu

SEQ ID NO: 18229 - RNA, 19 nt, artificial
  Oligomer
caccuuccucacagugaca

SEQ ID NO: 18230 - RNA, 19 nt, artificial
  Oligomer
ucuacucgcaccugaagaa

SEQ ID NO: 18231 - RNA, 19 nt, artificial
  Oligomer
ccucagauuuggacagcuu

SEQ ID NO: 18232 - RNA, 19 nt, artificial
  Oligomer
guuccgggaugaucuggau

SEQ ID NO: 18233 - RNA, 19 nt, artificial
  Oligomer
gugugaaccucaucgcucu

SEQ ID NO: 18234 - RNA, 19 nt, artificial
  Oligomer
cagaaaugcccagacuguu

SEQ ID NO: 18235 - RNA, 19 nt, artificial
  Oligomer
gucuucuacucgcaccuga

SEQ ID NO: 18236 - RNA, 19 nt, artificial
  Oligomer
acacgguggagauguucga

SEQ ID NO: 18237 - RNA, 19 nt, artificial
  Oligomer
agagcaaccugcugagugu

SEQ ID NO: 18238 - RNA, 19 nt, artificial
  Oligomer
aguucuuugcggccuucga

SEQ ID NO: 18239 - RNA, 19 nt, artificial
  Oligomer
gugaaggagguauacguga

SEQ ID NO: 18240 - RNA, 19 nt, artificial
  Oligomer
ugaagaaugugaaggaggu

SEQ ID NO: 18241 - RNA, 19 nt, artificial
  Oligomer
acucgcaccugaagaaugu

SEQ ID NO: 18242 - RNA, 19 nt, artificial
  Oligomer
gaaucugcuggacacgcua

SEQ ID NO: 18243 - RNA, 19 nt, artificial
  Oligomer
cagcccucauuccagaaau

SEQ ID NO: 18244 - RNA, 19 nt, artificial
  Oligomer
gaaugugaaggagguauac

SEQ ID NO: 18245 - RNA, 19 nt, artificial
  Oligomer
cucacaacugccucucuga

SEQ ID NO: 18246 - RNA, 19 nt, artificial
  Oligomer
cuggaccugagcuucaaca

SEQ ID NO: 18247 - RNA, 19 nt, artificial
  Oligomer
gcuaccuccugagauugga

SEQ ID NO: 18248 - RNA, 19 nt, artificial
  Oligomer
cacccuugaaucugggaga

SEQ ID NO: 18249 - RNA, 19 nt, artificial
  Oligomer
ugcugcagguggaauucuu

SEQ ID NO: 18250 - RNA, 19 nt, artificial
  Oligomer
ugaaccucaucgcucugca

SEQ ID NO: 18251 - RNA, 19 nt, artificial
  Oligomer
gcagaaucugcuuugucuu

SEQ ID NO: 18252 - RNA, 19 nt, artificial
  Oligomer
cugggaugacaucacagcu

SEQ ID NO: 18253 - RNA, 19 nt, artificial
  Oligomer
ugagcuucaacagccugga

SEQ ID NO: 18254 - RNA, 19 nt, artificial
  Oligomer
gggucaaagucaucuuccc

SEQ ID NO: 18255 - RNA, 19 nt, artificial
  Oligomer
agguauacgugaccaccac

SEQ ID NO: 18256 - RNA, 19 nt, artificial
  Oligomer
ucaaagggucgaucuggga

SEQ ID NO: 18257 - RNA, 19 nt, artificial
  Oligomer
cucagauuuggacagcuuu

SEQ ID NO: 18258 - RNA, 19 nt, artificial
  Oligomer
cagacuguuccugaccuca

SEQ ID NO: 18259 - RNA, 19 nt, artificial
  Oligomer
cgaucucucucagaaucug

SEQ ID NO: 18260 - RNA, 19 nt, artificial
  Oligomer
gguacaccaccaagaacug

SEQ ID NO: 18261 - RNA, 19 nt, artificial
  Oligomer
augugaaggagguauacgu

SEQ ID NO: 18262 - RNA, 19 nt, artificial
  Oligomer
ccugaagaaugugaaggag

SEQ ID NO: 18263 - RNA, 19 nt, artificial
  Oligomer
ugcaccgugugaaccucau

SEQ ID NO: 18264 - RNA, 19 nt, artificial
  Oligomer
agauguucgagggcgaaga

SEQ ID NO: 18265 - RNA, 19 nt, artificial
  Oligomer
accugagcuucaacagccu

SEQ ID NO: 18266 - RNA, 19 nt, artificial
  Oligomer
cgagggcgaagaguucuuu

SEQ ID NO: 18267 - RNA, 19 nt, artificial
  Oligomer
caucaagcugccgagacuu

SEQ ID NO: 18268 - RNA, 19 nt, artificial
  Oligomer
gaugagcagauccgucaca

SEQ ID NO: 18269 - RNA, 19 nt, artificial
  Oligomer
ucaacagccuggagacacu

SEQ ID NO: 18270 - RNA, 19 nt, artificial
  Oligomer
gaauucuugcgucugagca

SEQ ID NO: 18271 - RNA, 19 nt, artificial
  Oligomer
gguauacgugaccaccacu

SEQ ID NO: 18272 - RNA, 19 nt, artificial
  Oligomer
agcagauccgucacaugcu

SEQ ID NO: 18273 - RNA, 19 nt, artificial
  Oligomer
acuguuccugaccucagau

SEQ ID NO: 18274 - RNA, 19 nt, artificial
  Oligomer
ccugguuccuugugguuuc

SEQ ID NO: 18275 - RNA, 19 nt, artificial
  Oligomer
ugagcagauccgucacaug

SEQ ID NO: 18276 - RNA, 19 nt, artificial
  Oligomer
agauuuggacagcuuuccu

SEQ ID NO: 18277 - RNA, 19 nt, artificial
  Oligomer
cugaccucagauuuggaca

SEQ ID NO: 18278 - RNA, 19 nt, artificial
  Oligomer
aaggagguauacgugacca

SEQ ID NO: 18279 - RNA, 19 nt, artificial
  Oligomer
cuacucgcaccugaagaau

SEQ ID NO: 18280 - RNA, 19 nt, artificial
  Oligomer
cuucaagucucuccagugu

SEQ ID NO: 18281 - RNA, 19 nt, artificial
  Oligomer
uggaugagcagauccguca

SEQ ID NO: 18282 - RNA, 19 nt, artificial
  Oligomer
agggcagaaucugcuuugu

SEQ ID NO: 18283 - RNA, 19 nt, artificial
  Oligomer
augcccagacuguuccuga

SEQ ID NO: 18284 - RNA, 19 nt, artificial
  Oligomer
ucgcaccugaagaauguga

SEQ ID NO: 18285 - RNA, 19 nt, artificial
  Oligomer
cgucacaugcucuucuccu

SEQ ID NO: 18286 - RNA, 19 nt, artificial
  Oligomer
gcugcagguggaauucuug

SEQ ID NO: 18287 - RNA, 19 nt, artificial
  Oligomer
augcuucagaggauucgga

SEQ ID NO: 18288 - RNA, 19 nt, artificial
  Oligomer
acgaguuccgggaugaucu

SEQ ID NO: 18289 - RNA, 19 nt, artificial
  Oligomer
cuucuacucgcaccugaag

SEQ ID NO: 18290 - RNA, 19 nt, artificial
  Oligomer
cugguacaccaccaagaac

SEQ ID NO: 18291 - RNA, 19 nt, artificial
  Oligomer
gcagcccucauuccagaaa

SEQ ID NO: 18292 - RNA, 19 nt, artificial
  Oligomer
agcugcugcagguggaauu

SEQ ID NO: 18293 - RNA, 19 nt, artificial
  Oligomer
augagcagauccgucacau

SEQ ID NO: 18294 - RNA, 19 nt, artificial
  Oligomer
ccuucaagucucuccagug

SEQ ID NO: 18295 - RNA, 19 nt, artificial
  Oligomer
ucaccuuccucacagugac

SEQ ID NO: 18296 - RNA, 19 nt, artificial
  Oligomer
aagaguucuuugcggccuu

SEQ ID NO: 18297 - RNA, 19 nt, artificial
  Oligomer
gaugaucuggaugagcaga

SEQ ID NO: 18298 - RNA, 19 nt, artificial
  Oligomer
guuccugaccucagauuug

SEQ ID NO: 18299 - RNA, 19 nt, artificial
  Oligomer
agauccgucacaugcucuu

SEQ ID NO: 18300 - RNA, 19 nt, artificial
  Oligomer
agguggaauucuugcgucu

SEQ ID NO: 18301 - RNA, 19 nt, artificial
  Oligomer
uggacagcuuuccugugac

SEQ ID NO: 18302 - RNA, 19 nt, artificial
  Oligomer
aggagguauacgugaccac

SEQ ID NO: 18303 - RNA, 19 nt, artificial
  Oligomer
agacuguuccugaccucag

SEQ ID NO: 18304 - RNA, 19 nt, artificial
  Oligomer
ugugaaggagguauacgug

SEQ ID NO: 18305 - RNA, 19 nt, artificial
  Oligomer
cuucaacagccuggagaca

SEQ ID NO: 18306 - RNA, 19 nt, artificial
  Oligomer
gagggcgaagaguucuuug

SEQ ID NO: 18307 - RNA, 19 nt, artificial
  Oligomer
uggaccugagcuucaacag

SEQ ID NO: 18308 - RNA, 19 nt, artificial
  Oligomer
ucuugcgucugagcacuca

SEQ ID NO: 18309 - RNA, 19 nt, artificial
  Oligomer
aguuccgggaugaucugga

SEQ ID NO: 18310 - RNA, 19 nt, artificial
  Oligomer
agcuucaacagccuggaga

SEQ ID NO: 18311 - RNA, 19 nt, artificial
  Oligomer
cucauuccagaaaugccca

SEQ ID NO: 18312 - RNA, 19 nt, artificial
  Oligomer
uguuccugaccucagauuu

SEQ ID NO: 18313 - RNA, 19 nt, artificial
  Oligomer
uguucgagggcgaagaguu

SEQ ID NO: 18314 - RNA, 19 nt, artificial
  Oligomer
ugaaggagguauacgugac

SEQ ID NO: 18315 - RNA, 19 nt, artificial
  Oligomer
gcucuugcugucucacaac

SEQ ID NO: 18316 - RNA, 19 nt, artificial
  Oligomer
uggagggcagaaucugcuu

SEQ ID NO: 18317 - RNA, 19 nt, artificial
  Oligomer
cucaccuuccucacaguga

SEQ ID NO: 18318 - RNA, 19 nt, artificial
  Oligomer
acccggaaugacaacagcu

SEQ ID NO: 18319 - RNA, 19 nt, artificial
  Oligomer
acccuugaaucugggagau

SEQ ID NO: 18320 - RNA, 19 nt, artificial
  Oligomer
cauuccagaaaugcccaga

SEQ ID NO: 18321 - RNA, 19 nt, artificial
  Oligomer
ucuccugguuccuuguggu

SEQ ID NO: 18322 - RNA, 19 nt, artificial
  Oligomer
aggacccggaaugacaaca

SEQ ID NO: 18323 - RNA, 19 nt, artificial
  Oligomer
caaguaccaggacagcauc

SEQ ID NO: 18324 - RNA, 19 nt, artificial
  Oligomer
uucuacucgcaccugaaga

SEQ ID NO: 18325 - RNA, 19 nt, artificial
  Oligomer
ggagggcagaaucugcuuu

SEQ ID NO: 18326 - RNA, 19 nt, artificial
  Oligomer
cucuugcugucucacaacu

SEQ ID NO: 18327 - RNA, 19 nt, artificial
  Oligomer
gggcagaaucugcuuuguc

SEQ ID NO: 18328 - RNA, 19 nt, artificial
  Oligomer
ugguacaccaccaagaacu

SEQ ID NO: 18329 - RNA, 19 nt, artificial
  Oligomer
caccuucaagucucuccag

SEQ ID NO: 18330 - RNA, 19 nt, artificial
  Oligomer
uuggacagcuuuccuguga

SEQ ID NO: 18331 - RNA, 19 nt, artificial
  Oligomer
ucuggaugagcagauccgu

SEQ ID NO: 18332 - RNA, 19 nt, artificial
  Oligomer
acaacugccucucugagcu

SEQ ID NO: 18333 - RNA, 19 nt, artificial
  Oligomer
accucagauuuggacagcu

SEQ ID NO: 18334 - RNA, 19 nt, artificial
  Oligomer
cucagaaucugcuggacac

SEQ ID NO: 18335 - RNA, 19 nt, artificial
  Oligomer
uccgggaugaucuggauga

SEQ ID NO: 18336 - RNA, 19 nt, artificial
  Oligomer
uggaauucuugcgucugag

SEQ ID NO: 18337 - RNA, 19 nt, artificial
  Oligomer
aaaugcccagacuguuccu

SEQ ID NO: 18338 - RNA, 19 nt, artificial
  Oligomer
cuguuccugaccucagauu

SEQ ID NO: 18339 - RNA, 19 nt, artificial
  Oligomer
gaaggagguauacgugacc

SEQ ID NO: 18340 - RNA, 19 nt, artificial
  Oligomer
cucgcaccugaagaaugug

SEQ ID NO: 18341 - RNA, 19 nt, artificial
  Oligomer
auacgugaccaccacucug

SEQ ID NO: 18342 - RNA, 19 nt, artificial
  Oligomer
ugguccucaaagggucgau

SEQ ID NO: 18343 - RNA, 19 nt, artificial
  Oligomer
gcagguggaauucuugcgu

SEQ ID NO: 18344 - RNA, 19 nt, artificial
  Oligomer
ucgagggcgaagaguucuu

SEQ ID NO: 18345 - RNA, 19 nt, artificial
  Oligomer
ccacuucuccugguuccuu

SEQ ID NO: 18346 - RNA, 19 nt, artificial
  Oligomer
agcccucauuccagaaaug

SEQ ID NO: 18347 - RNA, 19 nt, artificial
  Oligomer
cucgaucucucucagaauc

SEQ ID NO: 18348 - RNA, 19 nt, artificial
  Oligomer
acacgcuaccuccugagau

SEQ ID NO: 18349 - RNA, 19 nt, artificial
  Oligomer
cccucauuccagaaaugcc

SEQ ID NO: 18350 - RNA, 19 nt, artificial
  Oligomer
gaugcuucagaggauucgg

SEQ ID NO: 18351 - RNA, 19 nt, artificial
  Oligomer
aauucuugcgucugagcac

SEQ ID NO: 18352 - RNA, 19 nt, artificial
  Oligomer
cuugcugucucacaacugc

SEQ ID NO: 18353 - RNA, 19 nt, artificial
  Oligomer
ucacaacugccucucugag

SEQ ID NO: 18354 - RNA, 19 nt, artificial
  Oligomer
uccucaaagggucgaucug

SEQ ID NO: 18355 - RNA, 19 nt, artificial
  Oligomer
acuucuccugguuccuugu

SEQ ID NO: 18356 - RNA, 19 nt, artificial
  Oligomer
cuaccuccugagauuggag

SEQ ID NO: 18357 - RNA, 19 nt, artificial
  Oligomer
ugaaucugggagaugccga

SEQ ID NO: 18358 - RNA, 19 nt, artificial
  Oligomer
uauacgugaccaccacucu

SEQ ID NO: 18359 - RNA, 19 nt, artificial
  Oligomer
uucagaggauucggacgca

SEQ ID NO: 18360 - RNA, 19 nt, artificial
  Oligomer
accugggaugacaucacag

SEQ ID NO: 18361 - RNA, 19 nt, artificial
  Oligomer
cugucucacaacugccucu

SEQ ID NO: 18362 - RNA, 19 nt, artificial
  Oligomer
guccucaaagggucgaucu

SEQ ID NO: 18363 - RNA, 19 nt, artificial
  Oligomer
ccugaccucagauuuggac

SEQ ID NO: 18364 - RNA, 19 nt, artificial
  Oligomer
guacaccaccaagaacugu

SEQ ID NO: 18365 - RNA, 19 nt, artificial
  Oligomer
ggaauucuugcgucugagc

SEQ ID NO: 18366 - RNA, 19 nt, artificial
  Oligomer
aagaaugugaaggagguau

SEQ ID NO: 18367 - RNA, 19 nt, artificial
  Oligomer
ccuugaaucugggagaugc

SEQ ID NO: 18368 - RNA, 19 nt, artificial
  Oligomer
uuccagaaaugcccagacu

SEQ ID NO: 18369 - RNA, 19 nt, artificial
  Oligomer
cacuucuccugguuccuug

SEQ ID NO: 18370 - RNA, 19 nt, artificial
  Oligomer
cuugaaucugggagaugcc

SEQ ID NO: 18371 - RNA, 19 nt, artificial
  Oligomer
augacaucacagcucaggu

SEQ ID NO: 18372 - RNA, 19 nt, artificial
  Oligomer
gucacaugcucuucuccug

SEQ ID NO: 18373 - RNA, 19 nt, artificial
  Oligomer
cuccugguuccuugugguu

SEQ ID NO: 18374 - RNA, 19 nt, artificial
  Oligomer
ugaccucagauuuggacag

SEQ ID NO: 18375 - RNA, 19 nt, artificial
  Oligomer
ugaucuggaugagcagauc

SEQ ID NO: 18376 - RNA, 19 nt, artificial
  Oligomer
auuuggacagcuuuccugu

SEQ ID NO: 18377 - RNA, 19 nt, artificial
  Oligomer
acaucacagcucagguggu

SEQ ID NO: 18378 - RNA, 19 nt, artificial
  Oligomer
ugcugucucacaacugccu

SEQ ID NO: 18379 - RNA, 19 nt, artificial
  Oligomer
gucucacaacugccucucu

SEQ ID NO: 18380 - RNA, 19 nt, artificial
  Oligomer
cuuugucuucuacucgcac

SEQ ID NO: 18381 - RNA, 19 nt, artificial
  Oligomer
cagauccgucacaugcucu

SEQ ID NO: 18382 - RNA, 19 nt, artificial
  Oligomer
gauuuggacagcuuuccug

SEQ ID NO: 18383 - RNA, 19 nt, artificial
  Oligomer
ucgaucucucucagaaucu

SEQ ID NO: 18384 - RNA, 19 nt, artificial
  Oligomer
cuuucugacgcagagcaac

SEQ ID NO: 18385 - RNA, 19 nt, artificial
  Oligomer
agaaaugcccagacuguuc

SEQ ID NO: 18386 - RNA, 19 nt, artificial
  Oligomer
cugcugcagguggaauucu

SEQ ID NO: 18387 - RNA, 19 nt, artificial
  Oligomer
ucagauuuggacagcuuuc

SEQ ID NO: 18388 - RNA, 19 nt, artificial
  Oligomer
accuucaagucucuccagu

SEQ ID NO: 18389 - RNA, 19 nt, artificial
  Oligomer
gguggaauucuugcgucug

SEQ ID NO: 18390 - RNA, 19 nt, artificial
  Oligomer
ccucauuccagaaaugccc

SEQ ID NO: 18391 - RNA, 19 nt, artificial
  Oligomer
ucugcuuugucuucuacuc

SEQ ID NO: 18392 - RNA, 19 nt, artificial
  Oligomer
uugucuucuacucgcaccu

SEQ ID NO: 18393 - RNA, 19 nt, artificial
  Oligomer
ucucucagaaucugcugga

SEQ ID NO: 18394 - RNA, 19 nt, artificial
  Oligomer
agggcgaagaguucuuugc

SEQ ID NO: 18395 - RNA, 19 nt, artificial
  Oligomer
gagggcagaaucugcuuug

SEQ ID NO: 18396 - RNA, 19 nt, artificial
  Oligomer
aaucugggagaugccgaga

SEQ ID NO: 18397 - RNA, 19 nt, artificial
  Oligomer
ucucagaaucugcuggaca

SEQ ID NO: 18398 - RNA, 19 nt, artificial
  Oligomer
cugaagaaugugaaggagg

SEQ ID NO: 18399 - RNA, 19 nt, artificial
  Oligomer
aucugcuuugucuucuacu

SEQ ID NO: 18400 - RNA, 19 nt, artificial
  Oligomer
uacucgcaccugaagaaug

SEQ ID NO: 18401 - RNA, 19 nt, artificial
  Oligomer
augaucuggaugagcagau

SEQ ID NO: 18402 - RNA, 19 nt, artificial
  Oligomer
aucucucucagaaucugcu

SEQ ID NO: 18403 - RNA, 19 nt, artificial
  Oligomer
cugguuccuugugguuucc

SEQ ID NO: 18404 - RNA, 19 nt, artificial
  Oligomer
cagguggaauucuugcguc

SEQ ID NO: 18405 - RNA, 19 nt, artificial
  Oligomer
cagauuuggacagcuuucc

SEQ ID NO: 18406 - RNA, 19 nt, artificial
  Oligomer
uccagaaaugcccagacug

SEQ ID NO: 18407 - RNA, 19 nt, artificial
  Oligomer
ugcuuugucuucuacucgc

SEQ ID NO: 18408 - RNA, 19 nt, artificial
  Oligomer
gagaugcuucagaggauuc

SEQ ID NO: 18409 - RNA, 19 nt, artificial
  Oligomer
cugcuuugucuucuacucg

SEQ ID NO: 18410 - RNA, 19 nt, artificial
  Oligomer
uccgucacaugcucuucuc

SEQ ID NO: 18411 - RNA, 19 nt, artificial
  Oligomer
ugcuucagaggauucggac

SEQ ID NO: 18412 - RNA, 19 nt, artificial
  Oligomer
agaaucugcuggacacgcu

SEQ ID NO: 18413 - RNA, 19 nt, artificial
  Oligomer
auccgucacaugcucuucu

SEQ ID NO: 18414 - RNA, 19 nt, artificial
  Oligomer
ugugaaccucaucgcucug

SEQ ID NO: 18415 - RNA, 19 nt, artificial
  Oligomer
uucugacgcagagcaaccu

SEQ ID NO: 18416 - RNA, 19 nt, artificial
  Oligomer
cucucagaaucugcuggac

SEQ ID NO: 18417 - RNA, 19 nt, artificial
  Oligomer
gaagaguucuuugcggccu

SEQ ID NO: 18418 - RNA, 19 nt, artificial
  Oligomer
cugcagguggaauucuugc

SEQ ID NO: 18419 - RNA, 19 nt, artificial
  Oligomer
agaugcuucagaggauucg

SEQ ID NO: 18420 - RNA, 19 nt, artificial
  Oligomer
gaucucucucagaaucugc

SEQ ID NO: 18421 - RNA, 19 nt, artificial
  Oligomer
cagaaucugcuuugucuuc

SEQ ID NO: 18422 - RNA, 19 nt, artificial
  Oligomer
aaucugcuuugucuucuac

SEQ ID NO: 18423 - RNA, 19 nt, artificial
  Oligomer
ccacagacuuuuaggcugg

SEQ ID NO: 18424 - RNA, 19 nt, artificial
  Oligomer
ugggaugacaucacagcuc

SEQ ID NO: 18425 - RNA, 19 nt, artificial
  Oligomer
cccacagacuuuuaggcug

SEQ ID NO: 18426 - RNA, 19 nt, artificial
  Oligomer
agaaucugcuuugucuucu

SEQ ID NO: 18427 - RNA, 19 nt, artificial
  Oligomer
uuuggacagcuuuccugug

SEQ ID NO: 18428 - RNA, 19 nt, artificial
  Oligomer
ucuugcugucucacaacug

SEQ ID NO: 18429 - RNA, 19 nt, artificial
  Oligomer
ugacaucacagcucaggug

SEQ ID NO: 18430 - RNA, 19 nt, artificial
  Oligomer
gaucuggaugagcagaucc

SEQ ID NO: 18431 - RNA, 19 nt, artificial
  Oligomer
auuccagaaaugcccagac

SEQ ID NO: 18432 - RNA, 19 nt, artificial
  Oligomer
gauccgucacaugcucuuc

SEQ ID NO: 18433 - RNA, 19 nt, artificial
  Oligomer
gaaaugcccagacuguucc

SEQ ID NO: 18434 - RNA, 19 nt, artificial
  Oligomer
auucuugcgucugagcacu

SEQ ID NO: 18435 - RNA, 19 nt, artificial
  Oligomer
guauacgugaccaccacuc

SEQ ID NO: 18436 - RNA, 19 nt, artificial
  Oligomer
cccuugaaucugggagaug

SEQ ID NO: 18437 - RNA, 19 nt, artificial
  Oligomer
aaugugaaggagguauacg

SEQ ID NO: 18438 - RNA, 19 nt, artificial
  Oligomer
ucucacaacugccucucug

SEQ ID NO: 18439 - RNA, 19 nt, artificial
  Oligomer
agaguucuuugcggccuuc

SEQ ID NO: 18440 - RNA, 19 nt, artificial
  Oligomer
uccugguuccuugugguuu

SEQ ID NO: 18441 - RNA, 19 nt, artificial
  Oligomer
ucugacacgguggagaugu

SEQ ID NO: 18442 - RNA, 19 nt, artificial
  Oligomer
ugacacgguggagauguuc

SEQ ID NO: 18443 - RNA, 19 nt, artificial
  Oligomer
uacaccaccaagaacugug

SEQ ID NO: 18444 - RNA, 19 nt, artificial
  Oligomer
auguucgagggcgaagagu

SEQ ID NO: 18445 - RNA, 19 nt, artificial
  Oligomer
uuccugaccucagauuugg

SEQ ID NO: 18446 - RNA, 19 nt, artificial
  Oligomer
gaccucagauuuggacagc

SEQ ID NO: 18447 - RNA, 19 nt, artificial
  Oligomer
caccugaagaaugugaagg

SEQ ID NO: 18448 - RNA, 19 nt, artificial
  Oligomer
aucuggaugagcagauccg

SEQ ID NO: 18449 - RNA, 19 nt, artificial
  Oligomer
gaugacaucacagcucagg

SEQ ID NO: 18450 - RNA, 19 nt, artificial
  Oligomer
ugucuucuacucgcaccug

SEQ ID NO: 18451 - RNA, 19 nt, artificial
  Oligomer
uucgagggcgaagaguucu

SEQ ID NO: 18452 - RNA, 19 nt, artificial
  Oligomer
uuguccugcacagcaaccu

SEQ ID NO: 18453 - RNA, 19 nt, artificial
  Oligomer
gcccucauuccagaaaugc

SEQ ID NO: 18454 - RNA, 19 nt, artificial
  Oligomer
ugcagguggaauucuugcg

SEQ ID NO: 18455 - RNA, 19 nt, artificial
  Oligomer
ucucucucagaaucugcug

SEQ ID NO: 18456 - RNA, 19 nt, artificial
  Oligomer
uuucugacgcagagcaacc

SEQ ID NO: 18457 - RNA, 19 nt, artificial
  Oligomer
ucauuccagaaaugcccag

SEQ ID NO: 18458 - RNA, 19 nt, artificial
  Oligomer
acgcuaccuccugagauug

SEQ ID NO: 18459 - RNA, 19 nt, artificial
  Oligomer
uugcugucucacaacugcc

SEQ ID NO: 18460 - RNA, 19 nt, artificial
  Oligomer
aucaagcugccgagacuuc

SEQ ID NO: 18461 - RNA, 19 nt, artificial
  Oligomer
uucaagucucuccagugug

SEQ ID NO: 18462 - RNA, 19 nt, artificial
  Oligomer
aaguaccaggacagcaucc

SEQ ID NO: 18463 - RNA, 19 nt, artificial
  Oligomer
ucagaaucugcuggacacg

SEQ ID NO: 18464 - RNA, 19 nt, artificial
  Oligomer
ucacaugcucuucuccugg

SEQ ID NO: 18465 - RNA, 19 nt, artificial
  Oligomer
cuucuccugguuccuugug

SEQ ID NO: 18466 - RNA, 19 nt, artificial
  Oligomer
cucucucagaaucugcugg

SEQ ID NO: 18467 - RNA, 19 nt, artificial
  Oligomer
uuugucuucuacucgcacc

SEQ ID NO: 18468 - RNA, 19 nt, artificial
  Oligomer
uuccgggaugaucuggaug

SEQ ID NO: 18469 - RNA, 19 nt, artificial
  Oligomer
ugguuccuugugguuuccc

SEQ ID NO: 18470 - RNA, 19 nt, artificial
  Oligomer
uucuccugguuccuugugg

SEQ ID NO: 18471 - RNA, 19 nt, artificial
  Oligomer
uucuugcgucugagcacuc

SEQ ID NO: 18472 - RNA, 19 nt, artificial
  Oligomer
aaucugcuggacacgcuac

SEQ ID NO: 18473 - RNA, 19 nt, artificial
  Oligomer
accuuccucacagugacac

SEQ ID NO: 18474 - RNA, 19 nt, artificial
  Oligomer
aaugcccagacuguuccug

SEQ ID NO: 18475 - RNA, 19 nt, artificial
  Oligomer
uugaaucugggagaugccg

SEQ ID NO: 18476 - RNA, 19 nt, artificial
  Oligomer
uucaacagccuggagacac

SEQ ID NO: 18477 - RNA, 19 nt, artificial
  Oligomer
ugucucacaacugccucuc

SEQ ID NO: 18478 - RNA, 19 nt, artificial
  Oligomer
uaccuccugagauuggagg

SEQ ID NO: 18479 - RNA, 19 nt, artificial
  Oligomer
uugugagacagcaagagcg

SEQ ID NO: 18480 - RNA, 19 nt, artificial
  Oligomer
ucugaggucaggaacaguc

SEQ ID NO: 18481 - RNA, 19 nt, artificial
  Oligomer
uucacauucuucaggugcg

SEQ ID NO: 18482 - RNA, 19 nt, artificial
  Oligomer
uuuguugcucacagggacc

SEQ ID NO: 18483 - RNA, 19 nt, artificial
  Oligomer
ucuuccuccagguaggucu

SEQ ID NO: 18484 - RNA, 19 nt, artificial
  Oligomer
uugucauuccggguccuga

SEQ ID NO: 18485 - RNA, 19 nt, artificial
  Oligomer
uuuuguugcucacagggac

SEQ ID NO: 18486 - RNA, 19 nt, artificial
  Oligomer
uucugagagagaucgaggc

SEQ ID NO: 18487 - RNA, 19 nt, artificial
  Oligomer
uagaagacaaagcagauuc

SEQ ID NO: 18488 - RNA, 19 nt, artificial
  Oligomer
uucuuggugguguaccaga

SEQ ID NO: 18489 - RNA, 19 nt, artificial
  Oligomer
uucaggugcgaguagaaga

SEQ ID NO: 18490 - RNA, 19 nt, artificial
  Oligomer
auccucugaagcaucuccu

SEQ ID NO: 18491 - RNA, 19 nt, artificial
  Oligomer
auucugagagagaucgagg

SEQ ID NO: 18492 - RNA, 19 nt, artificial
  Oligomer
ugguggucacguauaccuc

SEQ ID NO: 18493 - RNA, 19 nt, artificial
  Oligomer
ugugaugucaucccaggug

SEQ ID NO: 18494 - RNA, 19 nt, artificial
  Oligomer
ugagcugugaugucauccc

SEQ ID NO: 18495 - RNA, 19 nt, artificial
  Oligomer
uugcucugcgucagaaagc

SEQ ID NO: 18496 - RNA, 19 nt, artificial
  Oligomer
uugaagcucagguccaggu

SEQ ID NO: 18497 - RNA, 19 nt, artificial
  Oligomer
ucagacgcaagaauuccac

SEQ ID NO: 18498 - RNA, 19 nt, artificial
  Oligomer
aacaucuccaccgugucag

SEQ ID NO: 18499 - RNA, 19 nt, artificial
  Oligomer
uggagagacuugaaggugg

SEQ ID NO: 18500 - RNA, 19 nt, artificial
  Oligomer
aauccucugaagcaucucc

SEQ ID NO: 18501 - RNA, 19 nt, artificial
  Oligomer
cugcucauccagaucaucc

SEQ ID NO: 18502 - RNA, 19 nt, artificial
  Oligomer
ugcucauccagaucauccc

SEQ ID NO: 18503 - RNA, 19 nt, artificial
  Oligomer
uaccuccuucacauucuuc

SEQ ID NO: 18504 - RNA, 19 nt, artificial
  Oligomer
ucuuggugguguaccagag

SEQ ID NO: 18505 - RNA, 19 nt, artificial
  Oligomer
uugcugugcaggacaagga

SEQ ID NO: 18506 - RNA, 19 nt, artificial
  Oligomer
cuucacauucuucaggugc

SEQ ID NO: 18507 - RNA, 19 nt, artificial
  Oligomer
uccucugaagcaucuccug

SEQ ID NO: 18508 - RNA, 19 nt, artificial
  Oligomer
acagucugggcauuucugg

SEQ ID NO: 18509 - RNA, 19 nt, artificial
  Oligomer
uauaccuccuucacauucu

SEQ ID NO: 18510 - RNA, 19 nt, artificial
  Oligomer
uccuucacauucuucaggu

SEQ ID NO: 18511 - RNA, 19 nt, artificial
  Oligomer
cugagcugugaugucaucc

SEQ ID NO: 18512 - RNA, 19 nt, artificial
  Oligomer
ugcgaguagaagacaaagc

SEQ ID NO: 18513 - RNA, 19 nt, artificial
  Oligomer
agacaaagcagauucugcc

SEQ ID NO: 18514 - RNA, 19 nt, artificial
  Oligomer
augcuguccugguacuugc

SEQ ID NO: 18515 - RNA, 19 nt, artificial
  Oligomer
uccaaaucugaggucagga

SEQ ID NO: 18516 - RNA, 19 nt, artificial
  Oligomer
aaucucaggagguagcgug

SEQ ID NO: 18517 - RNA, 19 nt, artificial
  Oligomer
ugucacugugaggaaggug

SEQ ID NO: 18518 - RNA, 19 nt, artificial
  Oligomer
uucuucaggugcgaguaga

SEQ ID NO: 18519 - RNA, 19 nt, artificial
  Oligomer
aagcuguccaaaucugagg

SEQ ID NO: 18520 - RNA, 19 nt, artificial
  Oligomer
auccagaucaucccggaac

SEQ ID NO: 18521 - RNA, 19 nt, artificial
  Oligomer
agagcgaugagguucacac

SEQ ID NO: 18522 - RNA, 19 nt, artificial
  Oligomer
aacagucugggcauuucug

SEQ ID NO: 18523 - RNA, 19 nt, artificial
  Oligomer
ucaggugcgaguagaagac

SEQ ID NO: 18524 - RNA, 19 nt, artificial
  Oligomer
ucgaacaucuccaccgugu

SEQ ID NO: 18525 - RNA, 19 nt, artificial
  Oligomer
acacucagcagguugcucu

SEQ ID NO: 18526 - RNA, 19 nt, artificial
  Oligomer
ucgaaggccgcaaagaacu

SEQ ID NO: 18527 - RNA, 19 nt, artificial
  Oligomer
ucacguauaccuccuucac

SEQ ID NO: 18528 - RNA, 19 nt, artificial
  Oligomer
accuccuucacauucuuca

SEQ ID NO: 18529 - RNA, 19 nt, artificial
  Oligomer
acauucuucaggugcgagu

SEQ ID NO: 18530 - RNA, 19 nt, artificial
  Oligomer
uagcguguccagcagauuc

SEQ ID NO: 18531 - RNA, 19 nt, artificial
  Oligomer
auuucuggaaugagggcug

SEQ ID NO: 18532 - RNA, 19 nt, artificial
  Oligomer
guauaccuccuucacauuc

SEQ ID NO: 18533 - RNA, 19 nt, artificial
  Oligomer
ucagagaggcaguugugag

SEQ ID NO: 18534 - RNA, 19 nt, artificial
  Oligomer
uguugaagcucagguccag

SEQ ID NO: 18535 - RNA, 19 nt, artificial
  Oligomer
uccaaucucaggagguagc

SEQ ID NO: 18536 - RNA, 19 nt, artificial
  Oligomer
ucucccagauucaagggug

SEQ ID NO: 18537 - RNA, 19 nt, artificial
  Oligomer
aagaauuccaccugcagca

SEQ ID NO: 18538 - RNA, 19 nt, artificial
  Oligomer
ugcagagcgaugagguuca

SEQ ID NO: 18539 - RNA, 19 nt, artificial
  Oligomer
aagacaaagcagauucugc

SEQ ID NO: 18540 - RNA, 19 nt, artificial
  Oligomer
agcugugaugucaucccag

SEQ ID NO: 18541 - RNA, 19 nt, artificial
  Oligomer
uccaggcuguugaagcuca

SEQ ID NO: 18542 - RNA, 19 nt, artificial
  Oligomer
gggaagaugacuuugaccc

SEQ ID NO: 18543 - RNA, 19 nt, artificial
  Oligomer
gugguggucacguauaccu

SEQ ID NO: 18544 - RNA, 19 nt, artificial
  Oligomer
ucccagaucgacccuuuga

SEQ ID NO: 18545 - RNA, 19 nt, artificial
  Oligomer
aaagcuguccaaaucugag

SEQ ID NO: 18546 - RNA, 19 nt, artificial
  Oligomer
ugaggucaggaacagucug

SEQ ID NO: 18547 - RNA, 19 nt, artificial
  Oligomer
cagauucugagagagaucg

SEQ ID NO: 18548 - RNA, 19 nt, artificial
  Oligomer
caguucuuggugguguacc

SEQ ID NO: 18549 - RNA, 19 nt, artificial
  Oligomer
acguauaccuccuucacau

SEQ ID NO: 18550 - RNA, 19 nt, artificial
  Oligomer
cuccuucacauucuucagg

SEQ ID NO: 18551 - RNA, 19 nt, artificial
  Oligomer
augagguucacacggugca

SEQ ID NO: 18552 - RNA, 19 nt, artificial
  Oligomer
ucuucgcccucgaacaucu

SEQ ID NO: 18553 - RNA, 19 nt, artificial
  Oligomer
aggcuguugaagcucaggu

SEQ ID NO: 18554 - RNA, 19 nt, artificial
  Oligomer
aaagaacucuucgcccucg

SEQ ID NO: 18555 - RNA, 19 nt, artificial
  Oligomer
aagucucggcagcuugaug

SEQ ID NO: 18556 - RNA, 19 nt, artificial
  Oligomer
ugugacggaucugcucauc

SEQ ID NO: 18557 - RNA, 19 nt, artificial
  Oligomer
agugucuccaggcuguuga

SEQ ID NO: 18558 - RNA, 19 nt, artificial
  Oligomer
ugcucagacgcaagaauuc

SEQ ID NO: 18559 - RNA, 19 nt, artificial
  Oligomer
agugguggucacguauacc

SEQ ID NO: 18560 - RNA, 19 nt, artificial
  Oligomer
agcaugugacggaucugcu

SEQ ID NO: 18561 - RNA, 19 nt, artificial
  Oligomer
aucugaggucaggaacagu

SEQ ID NO: 18562 - RNA, 19 nt, artificial
  Oligomer
gaaaccacaaggaaccagg

SEQ ID NO: 18563 - RNA, 19 nt, artificial
  Oligomer
caugugacggaucugcuca

SEQ ID NO: 18564 - RNA, 19 nt, artificial
  Oligomer
aggaaagcuguccaaaucu

SEQ ID NO: 18565 - RNA, 19 nt, artificial
  Oligomer
uguccaaaucugaggucag

SEQ ID NO: 18566 - RNA, 19 nt, artificial
  Oligomer
uggucacguauaccuccuu

SEQ ID NO: 18567 - RNA, 19 nt, artificial
  Oligomer
auucuucaggugcgaguag

SEQ ID NO: 18568 - RNA, 19 nt, artificial
  Oligomer
acacuggagagacuugaag

SEQ ID NO: 18569 - RNA, 19 nt, artificial
  Oligomer
ugacggaucugcucaucca

SEQ ID NO: 18570 - RNA, 19 nt, artificial
  Oligomer
acaaagcagauucugcccu

SEQ ID NO: 18571 - RNA, 19 nt, artificial
  Oligomer
ucaggaacagucugggcau

SEQ ID NO: 18572 - RNA, 19 nt, artificial
  Oligomer
ucacauucuucaggugcga

SEQ ID NO: 18573 - RNA, 19 nt, artificial
  Oligomer
aggagaagagcaugugacg

SEQ ID NO: 18574 - RNA, 19 nt, artificial
  Oligomer
caagaauuccaccugcagc

SEQ ID NO: 18575 - RNA, 19 nt, artificial
  Oligomer
uccgaauccucugaagcau

SEQ ID NO: 18576 - RNA, 19 nt, artificial
  Oligomer
agaucaucccggaacucgu

SEQ ID NO: 18577 - RNA, 19 nt, artificial
  Oligomer
cuucaggugcgaguagaag

SEQ ID NO: 18578 - RNA, 19 nt, artificial
  Oligomer
guucuuggugguguaccag

SEQ ID NO: 18579 - RNA, 19 nt, artificial
  Oligomer
uuucuggaaugagggcugc

SEQ ID NO: 18580 - RNA, 19 nt, artificial
  Oligomer
aauuccaccugcagcagcu

SEQ ID NO: 18581 - RNA, 19 nt, artificial
  Oligomer
augugacggaucugcucau

SEQ ID NO: 18582 - RNA, 19 nt, artificial
  Oligomer
cacuggagagacuugaagg

SEQ ID NO: 18583 - RNA, 19 nt, artificial
  Oligomer
gucacugugaggaagguga

SEQ ID NO: 18584 - RNA, 19 nt, artificial
  Oligomer
aaggccgcaaagaacucuu

SEQ ID NO: 18585 - RNA, 19 nt, artificial
  Oligomer
ucugcucauccagaucauc

SEQ ID NO: 18586 - RNA, 19 nt, artificial
  Oligomer
caaaucugaggucaggaac

SEQ ID NO: 18587 - RNA, 19 nt, artificial
  Oligomer
aagagcaugugacggaucu

SEQ ID NO: 18588 - RNA, 19 nt, artificial
  Oligomer
agacgcaagaauuccaccu

SEQ ID NO: 18589 - RNA, 19 nt, artificial
  Oligomer
gucacaggaaagcugucca

SEQ ID NO: 18590 - RNA, 19 nt, artificial
  Oligomer
guggucacguauaccuccu

SEQ ID NO: 18591 - RNA, 19 nt, artificial
  Oligomer
cugaggucaggaacagucu

SEQ ID NO: 18592 - RNA, 19 nt, artificial
  Oligomer
cacguauaccuccuucaca

SEQ ID NO: 18593 - RNA, 19 nt, artificial
  Oligomer
ugucuccaggcuguugaag

SEQ ID NO: 18594 - RNA, 19 nt, artificial
  Oligomer
caaagaacucuucgcccuc

SEQ ID NO: 18595 - RNA, 19 nt, artificial
  Oligomer
cuguugaagcucaggucca

SEQ ID NO: 18596 - RNA, 19 nt, artificial
  Oligomer
ugagugcucagacgcaaga

SEQ ID NO: 18597 - RNA, 19 nt, artificial
  Oligomer
uccagaucaucccggaacu

SEQ ID NO: 18598 - RNA, 19 nt, artificial
  Oligomer
ucuccaggcuguugaagcu

SEQ ID NO: 18599 - RNA, 19 nt, artificial
  Oligomer
ugggcauuucuggaaugag

SEQ ID NO: 18600 - RNA, 19 nt, artificial
  Oligomer
aaaucugaggucaggaaca

SEQ ID NO: 18601 - RNA, 19 nt, artificial
  Oligomer
aacucuucgcccucgaaca

SEQ ID NO: 18602 - RNA, 19 nt, artificial
  Oligomer
gucacguauaccuccuuca

SEQ ID NO: 18603 - RNA, 19 nt, artificial
  Oligomer
guugugagacagcaagagc

SEQ ID NO: 18604 - RNA, 19 nt, artificial
  Oligomer
aagcagauucugcccucca

SEQ ID NO: 18605 - RNA, 19 nt, artificial
  Oligomer
ucacugugaggaaggugag

SEQ ID NO: 18606 - RNA, 19 nt, artificial
  Oligomer
agcuguugucauuccgggu

SEQ ID NO: 18607 - RNA, 19 nt, artificial
  Oligomer
aucucccagauucaagggu

SEQ ID NO: 18608 - RNA, 19 nt, artificial
  Oligomer
ucugggcauuucuggaaug

SEQ ID NO: 18609 - RNA, 19 nt, artificial
  Oligomer
accacaaggaaccaggaga

SEQ ID NO: 18610 - RNA, 19 nt, artificial
  Oligomer
uguugucauuccggguccu

SEQ ID NO: 18611 - RNA, 19 nt, artificial
  Oligomer
gaugcuguccugguacuug

SEQ ID NO: 18612 - RNA, 19 nt, artificial
  Oligomer
ucuucaggugcgaguagaa

SEQ ID NO: 18613 - RNA, 19 nt, artificial
  Oligomer
aaagcagauucugcccucc

SEQ ID NO: 18614 - RNA, 19 nt, artificial
  Oligomer
aguugugagacagcaagag

SEQ ID NO: 18615 - RNA, 19 nt, artificial
  Oligomer
gacaaagcagauucugccc

SEQ ID NO: 18616 - RNA, 19 nt, artificial
  Oligomer
aguucuuggugguguacca

SEQ ID NO: 18617 - RNA, 19 nt, artificial
  Oligomer
cuggagagacuugaaggug

SEQ ID NO: 18618 - RNA, 19 nt, artificial
  Oligomer
ucacaggaaagcuguccaa

SEQ ID NO: 18619 - RNA, 19 nt, artificial
  Oligomer
acggaucugcucauccaga

SEQ ID NO: 18620 - RNA, 19 nt, artificial
  Oligomer
agcucagagaggcaguugu

SEQ ID NO: 18621 - RNA, 19 nt, artificial
  Oligomer
agcuguccaaaucugaggu

SEQ ID NO: 18622 - RNA, 19 nt, artificial
  Oligomer
guguccagcagauucugag

SEQ ID NO: 18623 - RNA, 19 nt, artificial
  Oligomer
ucauccagaucaucccgga

SEQ ID NO: 18624 - RNA, 19 nt, artificial
  Oligomer
cucagacgcaagaauucca

SEQ ID NO: 18625 - RNA, 19 nt, artificial
  Oligomer
aggaacagucugggcauuu

SEQ ID NO: 18626 - RNA, 19 nt, artificial
  Oligomer
aaucugaggucaggaacag

SEQ ID NO: 18627 - RNA, 19 nt, artificial
  Oligomer
ggucacguauaccuccuuc

SEQ ID NO: 18628 - RNA, 19 nt, artificial
  Oligomer
cacauucuucaggugcgag

SEQ ID NO: 18629 - RNA, 19 nt, artificial
  Oligomer
cagagugguggucacguau

SEQ ID NO: 18630 - RNA, 19 nt, artificial
  Oligomer
aucgacccuuugaggacca

SEQ ID NO: 18631 - RNA, 19 nt, artificial
  Oligomer
acgcaagaauuccaccugc

SEQ ID NO: 18632 - RNA, 19 nt, artificial
  Oligomer
aagaacucuucgcccucga

SEQ ID NO: 18633 - RNA, 19 nt, artificial
  Oligomer
aaggaaccaggagaagugg

SEQ ID NO: 18634 - RNA, 19 nt, artificial
  Oligomer
cauuucuggaaugagggcu

SEQ ID NO: 18635 - RNA, 19 nt, artificial
  Oligomer
gauucugagagagaucgag

SEQ ID NO: 18636 - RNA, 19 nt, artificial
  Oligomer
aucucaggagguagcgugu

SEQ ID NO: 18637 - RNA, 19 nt, artificial
  Oligomer
ggcauuucuggaaugaggg

SEQ ID NO: 18638 - RNA, 19 nt, artificial
  Oligomer
ccgaauccucugaagcauc

SEQ ID NO: 18639 - RNA, 19 nt, artificial
  Oligomer
gugcucagacgcaagaauu

SEQ ID NO: 18640 - RNA, 19 nt, artificial
  Oligomer
gcaguugugagacagcaag

SEQ ID NO: 18641 - RNA, 19 nt, artificial
  Oligomer
cucagagaggcaguuguga

SEQ ID NO: 18642 - RNA, 19 nt, artificial
  Oligomer
cagaucgacccuuugagga

SEQ ID NO: 18643 - RNA, 19 nt, artificial
  Oligomer
acaaggaaccaggagaagu

SEQ ID NO: 18644 - RNA, 19 nt, artificial
  Oligomer
cuccaaucucaggagguag

SEQ ID NO: 18645 - RNA, 19 nt, artificial
  Oligomer
ucggcaucucccagauuca

SEQ ID NO: 18646 - RNA, 19 nt, artificial
  Oligomer
agagugguggucacguaua

SEQ ID NO: 18647 - RNA, 19 nt, artificial
  Oligomer
ugcguccgaauccucugaa

SEQ ID NO: 18648 - RNA, 19 nt, artificial
  Oligomer
cugugaugucaucccaggu

SEQ ID NO: 18649 - RNA, 19 nt, artificial
  Oligomer
agaggcaguugugagacag

SEQ ID NO: 18650 - RNA, 19 nt, artificial
  Oligomer
agaucgacccuuugaggac

SEQ ID NO: 18651 - RNA, 19 nt, artificial
  Oligomer
guccaaaucugaggucagg

SEQ ID NO: 18652 - RNA, 19 nt, artificial
  Oligomer
acaguucuuggugguguac

SEQ ID NO: 18653 - RNA, 19 nt, artificial
  Oligomer
gcucagacgcaagaauucc

SEQ ID NO: 18654 - RNA, 19 nt, artificial
  Oligomer
auaccuccuucacauucuu

SEQ ID NO: 18655 - RNA, 19 nt, artificial
  Oligomer
gcaucucccagauucaagg

SEQ ID NO: 18656 - RNA, 19 nt, artificial
  Oligomer
agucugggcauuucuggaa

SEQ ID NO: 18657 - RNA, 19 nt, artificial
  Oligomer
caaggaaccaggagaagug

SEQ ID NO: 18658 - RNA, 19 nt, artificial
  Oligomer
ggcaucucccagauucaag

SEQ ID NO: 18659 - RNA, 19 nt, artificial
  Oligomer
accugagcugugaugucau

SEQ ID NO: 18660 - RNA, 19 nt, artificial
  Oligomer
caggagaagagcaugugac

SEQ ID NO: 18661 - RNA, 19 nt, artificial
  Oligomer
aaccacaaggaaccaggag

SEQ ID NO: 18662 - RNA, 19 nt, artificial
  Oligomer
cuguccaaaucugagguca

SEQ ID NO: 18663 - RNA, 19 nt, artificial
  Oligomer
gaucugcucauccagauca

SEQ ID NO: 18664 - RNA, 19 nt, artificial
  Oligomer
acaggaaagcuguccaaau

SEQ ID NO: 18665 - RNA, 19 nt, artificial
  Oligomer
accaccugagcugugaugu

SEQ ID NO: 18666 - RNA, 19 nt, artificial
  Oligomer
aggcaguugugagacagca

SEQ ID NO: 18667 - RNA, 19 nt, artificial
  Oligomer
agagaggcaguugugagac

SEQ ID NO: 18668 - RNA, 19 nt, artificial
  Oligomer
gugcgaguagaagacaaag

SEQ ID NO: 18669 - RNA, 19 nt, artificial
  Oligomer
agagcaugugacggaucug

SEQ ID NO: 18670 - RNA, 19 nt, artificial
  Oligomer
caggaaagcuguccaaauc

SEQ ID NO: 18671 - RNA, 19 nt, artificial
  Oligomer
agauucugagagagaucga

SEQ ID NO: 18672 - RNA, 19 nt, artificial
  Oligomer
guugcucugcgucagaaag

SEQ ID NO: 18673 - RNA, 19 nt, artificial
  Oligomer
gaacagucugggcauuucu

SEQ ID NO: 18674 - RNA, 19 nt, artificial
  Oligomer
agaauuccaccugcagcag

SEQ ID NO: 18675 - RNA, 19 nt, artificial
  Oligomer
gaaagcuguccaaaucuga

SEQ ID NO: 18676 - RNA, 19 nt, artificial
  Oligomer
acuggagagacuugaaggu

SEQ ID NO: 18677 - RNA, 19 nt, artificial
  Oligomer
cagacgcaagaauuccacc

SEQ ID NO: 18678 - RNA, 19 nt, artificial
  Oligomer
gggcauuucuggaaugagg

SEQ ID NO: 18679 - RNA, 19 nt, artificial
  Oligomer
gaguagaagacaaagcaga

SEQ ID NO: 18680 - RNA, 19 nt, artificial
  Oligomer
aggugcgaguagaagacaa

SEQ ID NO: 18681 - RNA, 19 nt, artificial
  Oligomer
uccagcagauucugagaga

SEQ ID NO: 18682 - RNA, 19 nt, artificial
  Oligomer
gcaaagaacucuucgcccu

SEQ ID NO: 18683 - RNA, 19 nt, artificial
  Oligomer
caaagcagauucugcccuc

SEQ ID NO: 18684 - RNA, 19 nt, artificial
  Oligomer
ucucggcaucucccagauu

SEQ ID NO: 18685 - RNA, 19 nt, artificial
  Oligomer
uguccagcagauucugaga

SEQ ID NO: 18686 - RNA, 19 nt, artificial
  Oligomer
ccuccuucacauucuucag

SEQ ID NO: 18687 - RNA, 19 nt, artificial
  Oligomer
aguagaagacaaagcagau

SEQ ID NO: 18688 - RNA, 19 nt, artificial
  Oligomer
cauucuucaggugcgagua

SEQ ID NO: 18689 - RNA, 19 nt, artificial
  Oligomer
aucugcucauccagaucau

SEQ ID NO: 18690 - RNA, 19 nt, artificial
  Oligomer
agcagauucugagagagau

SEQ ID NO: 18691 - RNA, 19 nt, artificial
  Oligomer
ggaaaccacaaggaaccag

SEQ ID NO: 18692 - RNA, 19 nt, artificial
  Oligomer
gacgcaagaauuccaccug

SEQ ID NO: 18693 - RNA, 19 nt, artificial
  Oligomer
ggaaagcuguccaaaucug

SEQ ID NO: 18694 - RNA, 19 nt, artificial
  Oligomer
cagucugggcauuucugga

SEQ ID NO: 18695 - RNA, 19 nt, artificial
  Oligomer
gcgaguagaagacaaagca

SEQ ID NO: 18696 - RNA, 19 nt, artificial
  Oligomer
gaauccucugaagcaucuc

SEQ ID NO: 18697 - RNA, 19 nt, artificial
  Oligomer
cgaguagaagacaaagcag

SEQ ID NO: 18698 - RNA, 19 nt, artificial
  Oligomer
gagaagagcaugugacgga

SEQ ID NO: 18699 - RNA, 19 nt, artificial
  Oligomer
guccgaauccucugaagca

SEQ ID NO: 18700 - RNA, 19 nt, artificial
  Oligomer
agcguguccagcagauucu

SEQ ID NO: 18701 - RNA, 19 nt, artificial
  Oligomer
agaagagcaugugacggau

SEQ ID NO: 18702 - RNA, 19 nt, artificial
  Oligomer
cagagcgaugagguucaca

SEQ ID NO: 18703 - RNA, 19 nt, artificial
  Oligomer
agguugcucugcgucagaa

SEQ ID NO: 18704 - RNA, 19 nt, artificial
  Oligomer
guccagcagauucugagag

SEQ ID NO: 18705 - RNA, 19 nt, artificial
  Oligomer
aggccgcaaagaacucuuc

SEQ ID NO: 18706 - RNA, 19 nt, artificial
  Oligomer
gcaagaauuccaccugcag

SEQ ID NO: 18707 - RNA, 19 nt, artificial
  Oligomer
cgaauccucugaagcaucu

SEQ ID NO: 18708 - RNA, 19 nt, artificial
  Oligomer
gcagauucugagagagauc

SEQ ID NO: 18709 - RNA, 19 nt, artificial
  Oligomer
gaagacaaagcagauucug

SEQ ID NO: 18710 - RNA, 19 nt, artificial
  Oligomer
guagaagacaaagcagauu

SEQ ID NO: 18711 - RNA, 19 nt, artificial
  Oligomer
ccagccuaaaagucugugg

SEQ ID NO: 18712 - RNA, 19 nt, artificial
  Oligomer
gagcugugaugucauccca

SEQ ID NO: 18713 - RNA, 19 nt, artificial
  Oligomer
cagccuaaaagucuguggg

SEQ ID NO: 18714 - RNA, 19 nt, artificial
  Oligomer
agaagacaaagcagauucu

SEQ ID NO: 18715 - RNA, 19 nt, artificial
  Oligomer
cacaggaaagcuguccaaa

SEQ ID NO: 18716 - RNA, 19 nt, artificial
  Oligomer
caguugugagacagcaaga

SEQ ID NO: 18717 - RNA, 19 nt, artificial
  Oligomer
caccugagcugugauguca

SEQ ID NO: 18718 - RNA, 19 nt, artificial
  Oligomer
ggaucugcucauccagauc

SEQ ID NO: 18719 - RNA, 19 nt, artificial
  Oligomer
gucugggcauuucuggaau

SEQ ID NO: 18720 - RNA, 19 nt, artificial
  Oligomer
gaagagcaugugacggauc

SEQ ID NO: 18721 - RNA, 19 nt, artificial
  Oligomer
ggaacagucugggcauuuc

SEQ ID NO: 18722 - RNA, 19 nt, artificial
  Oligomer
agugcucagacgcaagaau

SEQ ID NO: 18723 - RNA, 19 nt, artificial
  Oligomer
gagugguggucacguauac

SEQ ID NO: 18724 - RNA, 19 nt, artificial
  Oligomer
caucucccagauucaaggg

SEQ ID NO: 18725 - RNA, 19 nt, artificial
  Oligomer
cguauaccuccuucacauu

SEQ ID NO: 18726 - RNA, 19 nt, artificial
  Oligomer
cagagaggcaguugugaga

SEQ ID NO: 18727 - RNA, 19 nt, artificial
  Oligomer
gaaggccgcaaagaacucu

SEQ ID NO: 18728 - RNA, 19 nt, artificial
  Oligomer
aaaccacaaggaaccagga

SEQ ID NO: 18729 - RNA, 19 nt, artificial
  Oligomer
acaucuccaccgugucaga

SEQ ID NO: 18730 - RNA, 19 nt, artificial
  Oligomer
gaacaucuccaccguguca

SEQ ID NO: 18731 - RNA, 19 nt, artificial
  Oligomer
cacaguucuugguggugua

SEQ ID NO: 18732 - RNA, 19 nt, artificial
  Oligomer
acucuucgcccucgaacau

SEQ ID NO: 18733 - RNA, 19 nt, artificial
  Oligomer
ccaaaucugaggucaggaa

SEQ ID NO: 18734 - RNA, 19 nt, artificial
  Oligomer
gcuguccaaaucugagguc

SEQ ID NO: 18735 - RNA, 19 nt, artificial
  Oligomer
ccuucacauucuucaggug

SEQ ID NO: 18736 - RNA, 19 nt, artificial
  Oligomer
cggaucugcucauccagau

SEQ ID NO: 18737 - RNA, 19 nt, artificial
  Oligomer
ccugagcugugaugucauc

SEQ ID NO: 18738 - RNA, 19 nt, artificial
  Oligomer
caggugcgaguagaagaca

SEQ ID NO: 18739 - RNA, 19 nt, artificial
  Oligomer
agaacucuucgcccucgaa

SEQ ID NO: 18740 - RNA, 19 nt, artificial
  Oligomer
agguugcugugcaggacaa

SEQ ID NO: 18741 - RNA, 19 nt, artificial
  Oligomer
gcauuucuggaaugagggc

SEQ ID NO: 18742 - RNA, 19 nt, artificial
  Oligomer
cgcaagaauuccaccugca

SEQ ID NO: 18743 - RNA, 19 nt, artificial
  Oligomer
cagcagauucugagagaga

SEQ ID NO: 18744 - RNA, 19 nt, artificial
  Oligomer
gguugcucugcgucagaaa

SEQ ID NO: 18745 - RNA, 19 nt, artificial
  Oligomer
cugggcauuucuggaauga

SEQ ID NO: 18746 - RNA, 19 nt, artificial
  Oligomer
caaucucaggagguagcgu

SEQ ID NO: 18747 - RNA, 19 nt, artificial
  Oligomer
ggcaguugugagacagcaa

SEQ ID NO: 18748 - RNA, 19 nt, artificial
  Oligomer
gaagucucggcagcuugau

SEQ ID NO: 18749 - RNA, 19 nt, artificial
  Oligomer
cacacuggagagacuugaa

SEQ ID NO: 18750 - RNA, 19 nt, artificial
  Oligomer
ggaugcuguccugguacuu

SEQ ID NO: 18751 - RNA, 19 nt, artificial
  Oligomer
cguguccagcagauucuga

SEQ ID NO: 18752 - RNA, 19 nt, artificial
  Oligomer
ccaggagaagagcauguga

SEQ ID NO: 18753 - RNA, 19 nt, artificial
  Oligomer
cacaaggaaccaggagaag

SEQ ID NO: 18754 - RNA, 19 nt, artificial
  Oligomer
ccagcagauucugagagag

SEQ ID NO: 18755 - RNA, 19 nt, artificial
  Oligomer
ggugcgaguagaagacaaa

SEQ ID NO: 18756 - RNA, 19 nt, artificial
  Oligomer
cauccagaucaucccggaa

SEQ ID NO: 18757 - RNA, 19 nt, artificial
  Oligomer
gggaaaccacaaggaacca

SEQ ID NO: 18758 - RNA, 19 nt, artificial
  Oligomer
ccacaaggaaccaggagaa

SEQ ID NO: 18759 - RNA, 19 nt, artificial
  Oligomer
gagugcucagacgcaagaa

SEQ ID NO: 18760 - RNA, 19 nt, artificial
  Oligomer
guagcguguccagcagauu

SEQ ID NO: 18761 - RNA, 19 nt, artificial
  Oligomer
gugucacugugaggaaggu

SEQ ID NO: 18762 - RNA, 19 nt, artificial
  Oligomer
caggaacagucugggcauu

SEQ ID NO: 18763 - RNA, 19 nt, artificial
  Oligomer
cggcaucucccagauucaa

SEQ ID NO: 18764 - RNA, 19 nt, artificial
  Oligomer
gugucuccaggcuguugaa

SEQ ID NO: 18765 - RNA, 19 nt, artificial
  Oligomer
gagaggcaguugugagaca

SEQ ID NO: 18766 - RNA, 19 nt, artificial
  Oligomer
ccuccaaucucaggaggua

SEQ ID NO: 18767 - RNA, 19 nt, artificial
  Oligomer
ccaagaagaugaacuuaga

SEQ ID NO: 18768 - RNA, 19 nt, artificial
  Oligomer
ggagggacauuaagaaaua

SEQ ID NO: 18769 - RNA, 19 nt, artificial
  Oligomer
cgguguaauuccucccuaa

SEQ ID NO: 18770 - RNA, 19 nt, artificial
  Oligomer
gcggcaauuugauauccaa

SEQ ID NO: 18771 - RNA, 19 nt, artificial
  Oligomer
ccacagauauaaagaacaa

SEQ ID NO: 18772 - RNA, 19 nt, artificial
  Oligomer
agaugaugucaacauugaa

SEQ ID NO: 18773 - RNA, 19 nt, artificial
  Oligomer
gagggacauuaagaaauaa

SEQ ID NO: 18774 - RNA, 19 nt, artificial
  Oligomer
cauugaagagagcaaaaaa

SEQ ID NO: 18775 - RNA, 19 nt, artificial
  Oligomer
cgaaccuaaagaauaugaa

SEQ ID NO: 18776 - RNA, 19 nt, artificial
  Oligomer
gggagaggauccugaagau

SEQ ID NO: 18777 - RNA, 19 nt, artificial
  Oligomer
gaacguacgaagugaccaa

SEQ ID NO: 18778 - RNA, 19 nt, artificial
  Oligomer
ggagacuguuaaagugaaa

SEQ ID NO: 18779 - RNA, 19 nt, artificial
  Oligomer
gggacauuaagaaauaaau

SEQ ID NO: 18780 - RNA, 19 nt, artificial
  Oligomer
gaauaugaauggauuaaau

SEQ ID NO: 18781 - RNA, 19 nt, artificial
  Oligomer
cgaugcaaugcuuuucuaa

SEQ ID NO: 18782 - RNA, 19 nt, artificial
  Oligomer
agaggagugggaaauugau

SEQ ID NO: 18783 - RNA, 19 nt, artificial
  Oligomer
ggcugugcuuugauggaaa

SEQ ID NO: 18784 - RNA, 19 nt, artificial
  Oligomer
gggcugucucccaaugaaa

SEQ ID NO: 18785 - RNA, 19 nt, artificial
  Oligomer
ccggcugcaaguuuuguaa

SEQ ID NO: 18786 - RNA, 19 nt, artificial
  Oligomer
cgcgaagaaagcaaccaga

SEQ ID NO: 18787 - RNA, 19 nt, artificial
  Oligomer
gauaaaggagggacauuaa

SEQ ID NO: 18788 - RNA, 19 nt, artificial
  Oligomer
ggcucaugaugccucagau

SEQ ID NO: 18789 - RNA, 19 nt, artificial
  Oligomer
gaauggauuaaauguuaaa

SEQ ID NO: 18790 - RNA, 19 nt, artificial
  Oligomer
ggcuggaagaggugaacaa

SEQ ID NO: 18791 - RNA, 19 nt, artificial
  Oligomer
gaaacaauaucaaguaaca

SEQ ID NO: 18792 - RNA, 19 nt, artificial
  Oligomer
gagaggagugggaaauuga

SEQ ID NO: 18793 - RNA, 19 nt, artificial
  Oligomer
ggagugggaaauugauuaa

SEQ ID NO: 18794 - RNA, 19 nt, artificial
  Oligomer
caaugaagauacccagaga

SEQ ID NO: 18795 - RNA, 19 nt, artificial
  Oligomer
cccagaaagagacaagaaa

SEQ ID NO: 18796 - RNA, 19 nt, artificial
  Oligomer
caaagaguuuauugaucaa

SEQ ID NO: 18797 - RNA, 19 nt, artificial
  Oligomer
cacgcuuccucaaggucaa

SEQ ID NO: 18798 - RNA, 19 nt, artificial
  Oligomer
cgagauggagaaggaccaa

SEQ ID NO: 18799 - RNA, 19 nt, artificial
  Oligomer
gguuggacgucacugcuaa

SEQ ID NO: 18800 - RNA, 19 nt, artificial
  Oligomer
ugauguccauggaagaaua

SEQ ID NO: 18801 - RNA, 19 nt, artificial
  Oligomer
aggugauguccauggaaga

SEQ ID NO: 18802 - RNA, 19 nt, artificial
  Oligomer
ccagauggugaaaguggaa

SEQ ID NO: 18803 - RNA, 19 nt, artificial
  Oligomer
gugucuugcuauacagaaa

SEQ ID NO: 18804 - RNA, 19 nt, artificial
  Oligomer
ccaugaggauauuuuugga

SEQ ID NO: 18805 - RNA, 19 nt, artificial
  Oligomer
cgggaugcacugaguacau

SEQ ID NO: 18806 - RNA, 19 nt, artificial
  Oligomer
ggaugacaaccgauaccau

SEQ ID NO: 18807 - RNA, 19 nt, artificial
  Oligomer
aagggaagcccauucuaaa

SEQ ID NO: 18808 - RNA, 19 nt, artificial
  Oligomer
caggcaaaucgcaagcuua

SEQ ID NO: 18809 - RNA, 19 nt, artificial
  Oligomer
caaggugauguccauggaa

SEQ ID NO: 18810 - RNA, 19 nt, artificial
  Oligomer
uauccaauguccacaaaaa

SEQ ID NO: 18811 - RNA, 19 nt, artificial
  Oligomer
gaucgcagcuggaagagaa

SEQ ID NO: 18812 - RNA, 19 nt, artificial
  Oligomer
gcuggaagaggugaacaaa

SEQ ID NO: 18813 - RNA, 19 nt, artificial
  Oligomer
cccucaacucagaucaaaa

SEQ ID NO: 18814 - RNA, 19 nt, artificial
  Oligomer
aggagacuguuaaagugaa

SEQ ID NO: 18815 - RNA, 19 nt, artificial
  Oligomer
ggacauuaagaaauaaauu

SEQ ID NO: 18816 - RNA, 19 nt, artificial
  Oligomer
cauguucgguguucagcaa

SEQ ID NO: 18817 - RNA, 19 nt, artificial
  Oligomer
gaucaauacuauucaucaa

SEQ ID NO: 18818 - RNA, 19 nt, artificial
  Oligomer
cgcccauguaccugaaaca

SEQ ID NO: 18819 - RNA, 19 nt, artificial
  Oligomer
ccaucuuccaggccuucaa

SEQ ID NO: 18820 - RNA, 19 nt, artificial
  Oligomer
cacucuuccacagauauaa

SEQ ID NO: 18821 - RNA, 19 nt, artificial
  Oligomer
agagaauaguucacaucua

SEQ ID NO: 18822 - RNA, 19 nt, artificial
  Oligomer
ccauguaccugaaacauuu

SEQ ID NO: 18823 - RNA, 19 nt, artificial
  Oligomer
ggaguacgaggaauggaaa

SEQ ID NO: 18824 - RNA, 19 nt, artificial
  Oligomer
cauaauuguucuaguuaga

SEQ ID NO: 18825 - RNA, 19 nt, artificial
  Oligomer
gcuacaagguccgauucaa

SEQ ID NO: 18826 - RNA, 19 nt, artificial
  Oligomer
cagacaaaccaaagaagua

SEQ ID NO: 18827 - RNA, 19 nt, artificial
  Oligomer
gggagaugaugucaacauu

SEQ ID NO: 18828 - RNA, 19 nt, artificial
  Oligomer
aaaggagggacauuaagaa

SEQ ID NO: 18829 - RNA, 19 nt, artificial
  Oligomer
ggcugcugauguccucaaa

SEQ ID NO: 18830 - RNA, 19 nt, artificial
  Oligomer
cagauauaaagaacaaaca

SEQ ID NO: 18831 - RNA, 19 nt, artificial
  Oligomer
ugugcaccuggaacaugaa

SEQ ID NO: 18832 - RNA, 19 nt, artificial
  Oligomer
cacagauauaaagaacaaa

SEQ ID NO: 18833 - RNA, 19 nt, artificial
  Oligomer
cccagagaauaguucacau

SEQ ID NO: 18834 - RNA, 19 nt, artificial
  Oligomer
gagugggaaauugauuaaa

SEQ ID NO: 18835 - RNA, 19 nt, artificial
  Oligomer
cuaccagcgagaaggagaa

SEQ ID NO: 18836 - RNA, 19 nt, artificial
  Oligomer
gagaauaguucacaucuau

SEQ ID NO: 18837 - RNA, 19 nt, artificial
  Oligomer
ccuggagaccaccuuuaca

SEQ ID NO: 18838 - RNA, 19 nt, artificial
  Oligomer
gggaagggaucccuuugua

SEQ ID NO: 18839 - RNA, 19 nt, artificial
  Oligomer
cugacacccuccaccuuaa

SEQ ID NO: 18840 - RNA, 19 nt, artificial
  Oligomer
gaggcaaccuguugaauuu

SEQ ID NO: 18841 - RNA, 19 nt, artificial
  Oligomer
gaagggaagcccauucuaa

SEQ ID NO: 18842 - RNA, 19 nt, artificial
  Oligomer
ggcggaugcaggaaaucau

SEQ ID NO: 18843 - RNA, 19 nt, artificial
  Oligomer
ccagaaagagacaagaaau

SEQ ID NO: 18844 - RNA, 19 nt, artificial
  Oligomer
uggaaacaauaucaaguaa

SEQ ID NO: 18845 - RNA, 19 nt, artificial
  Oligomer
ggaugagguuggaaagagu

SEQ ID NO: 18846 - RNA, 19 nt, artificial
  Oligomer
acgggauguucaacuacau

SEQ ID NO: 18847 - RNA, 19 nt, artificial
  Oligomer
cuccaaagcccacauggaa

SEQ ID NO: 18848 - RNA, 19 nt, artificial
  Oligomer
gaugaugucaacauugaaa

SEQ ID NO: 18849 - RNA, 19 nt, artificial
  Oligomer
ccuuaagagcacauuggaa

SEQ ID NO: 18850 - RNA, 19 nt, artificial
  Oligomer
gaacacgcaugucuggaaa

SEQ ID NO: 18851 - RNA, 19 nt, artificial
  Oligomer
ggaacacgcaugucuggaa

SEQ ID NO: 18852 - RNA, 19 nt, artificial
  Oligomer
cucugcaguugaucuccaa

SEQ ID NO: 18853 - RNA, 19 nt, artificial
  Oligomer
ccgaguccuucauuaagca

SEQ ID NO: 18854 - RNA, 19 nt, artificial
  Oligomer
ccucaacucagaucaaaaa

SEQ ID NO: 18855 - RNA, 19 nt, artificial
  Oligomer
cuuccacagauauaaagaa

SEQ ID NO: 18856 - RNA, 19 nt, artificial
  Oligomer
aggcaaaucgcaagcuuau

SEQ ID NO: 18857 - RNA, 19 nt, artificial
  Oligomer
gccugggauuucuggugaa

SEQ ID NO: 18858 - RNA, 19 nt, artificial
  Oligomer
acucuuccacagauauaaa

SEQ ID NO: 18859 - RNA, 19 nt, artificial
  Oligomer
gcucacucuuccacagaua

SEQ ID NO: 18860 - RNA, 19 nt, artificial
  Oligomer
gcagcuggaagagaaacaa

SEQ ID NO: 18861 - RNA, 19 nt, artificial
  Oligomer
gcgaugcaaugcuuuucua

SEQ ID NO: 18862 - RNA, 19 nt, artificial
  Oligomer
ugaagacguccgcacaaaa

SEQ ID NO: 18863 - RNA, 19 nt, artificial
  Oligomer
ugacauugugcaccuggaa

SEQ ID NO: 18864 - RNA, 19 nt, artificial
  Oligomer
acgcugagcugacgucaaa

SEQ ID NO: 18865 - RNA, 19 nt, artificial
  Oligomer
cgguguucagcaaauccag

SEQ ID NO: 18866 - RNA, 19 nt, artificial
  Oligomer
cacucgagauggagaagga

SEQ ID NO: 18867 - RNA, 19 nt, artificial
  Oligomer
aagcuuuggugccuggaaa

SEQ ID NO: 18868 - RNA, 19 nt, artificial
  Oligomer
agggacauuaagaaauaaa

SEQ ID NO: 18869 - RNA, 19 nt, artificial
  Oligomer
cggcugugcuuugauggaa

SEQ ID NO: 18870 - RNA, 19 nt, artificial
  Oligomer
caauguccacaaaaagcga

SEQ ID NO: 18871 - RNA, 19 nt, artificial
  Oligomer
gggucuucagagagcugua

SEQ ID NO: 18872 - RNA, 19 nt, artificial
  Oligomer
gaaccuaaagaauaugaau

SEQ ID NO: 18873 - RNA, 19 nt, artificial
  Oligomer
ccaucacuuccuuagagaa

SEQ ID NO: 18874 - RNA, 19 nt, artificial
  Oligomer
caggcaguucccagaaaga

SEQ ID NO: 18875 - RNA, 19 nt, artificial
  Oligomer
ggaagcuaguuaccaugga

SEQ ID NO: 18876 - RNA, 19 nt, artificial
  Oligomer
ccaacaugcuccuagagau

SEQ ID NO: 18877 - RNA, 19 nt, artificial
  Oligomer
cgcugguggagaucaauau

SEQ ID NO: 18878 - RNA, 19 nt, artificial
  Oligomer
cuucaagaagcuagcagaa

SEQ ID NO: 18879 - RNA, 19 nt, artificial
  Oligomer
gcaaggguuugcaggagua

SEQ ID NO: 18880 - RNA, 19 nt, artificial
  Oligomer
cagagauaugcauacagca

SEQ ID NO: 18881 - RNA, 19 nt, artificial
  Oligomer
aggcagagaugaaagauau

SEQ ID NO: 18882 - RNA, 19 nt, artificial
  Oligomer
agaauuugcugcauuuaga

SEQ ID NO: 18883 - RNA, 19 nt, artificial
  Oligomer
ccaacucugugcaggaaga

SEQ ID NO: 18884 - RNA, 19 nt, artificial
  Oligomer
uggaagaggugaacaaaga

SEQ ID NO: 18885 - RNA, 19 nt, artificial
  Oligomer
ccaccgaguccuucauuaa

SEQ ID NO: 18886 - RNA, 19 nt, artificial
  Oligomer
cugucaaccagauggugaa

SEQ ID NO: 18887 - RNA, 19 nt, artificial
  Oligomer
ccaaggcagagaugaaaga

SEQ ID NO: 18888 - RNA, 19 nt, artificial
  Oligomer
gucuugcuauacagaaaaa

SEQ ID NO: 18889 - RNA, 19 nt, artificial
  Oligomer
cuuuaggugucaucaguaa

SEQ ID NO: 18890 - RNA, 19 nt, artificial
  Oligomer
cacgggauguucaacuaca

SEQ ID NO: 18891 - RNA, 19 nt, artificial
  Oligomer
ccaaguuugagugguucaa

SEQ ID NO: 18892 - RNA, 19 nt, artificial
  Oligomer
cccuuuguauacuuuuuua

SEQ ID NO: 18893 - RNA, 19 nt, artificial
  Oligomer
gggcauaucuuguuguuca

SEQ ID NO: 18894 - RNA, 19 nt, artificial
  Oligomer
gcaacagcggcaauuugau

SEQ ID NO: 18895 - RNA, 19 nt, artificial
  Oligomer
gcaugaaaccacuggaaca

SEQ ID NO: 18896 - RNA, 19 nt, artificial
  Oligomer
ccacaaaaagcgagucuca

SEQ ID NO: 18897 - RNA, 19 nt, artificial
  Oligomer
agaucugauccgcaucuaa

SEQ ID NO: 18898 - RNA, 19 nt, artificial
  Oligomer
ccaaggugauguccaugga

SEQ ID NO: 18899 - RNA, 19 nt, artificial
  Oligomer
aaguuuuaaaccuguuaaa

SEQ ID NO: 18900 - RNA, 19 nt, artificial
  Oligomer
gccggcaauccaagauaga

SEQ ID NO: 18901 - RNA, 19 nt, artificial
  Oligomer
ggaagcugguuaaagugga

SEQ ID NO: 18902 - RNA, 19 nt, artificial
  Oligomer
gugacaugaacccauccaa

SEQ ID NO: 18903 - RNA, 19 nt, artificial
  Oligomer
ccauuaaagacaaauugau

SEQ ID NO: 18904 - RNA, 19 nt, artificial
  Oligomer
cucggaagcuaguuaccau

SEQ ID NO: 18905 - RNA, 19 nt, artificial
  Oligomer
gagaugaugucaacauuga

SEQ ID NO: 18906 - RNA, 19 nt, artificial
  Oligomer
gaagcugguuaaaguggau

SEQ ID NO: 18907 - RNA, 19 nt, artificial
  Oligomer
gcugcauuuagauuuugau

SEQ ID NO: 18908 - RNA, 19 nt, artificial
  Oligomer
guaccugaaacauuuggaa

SEQ ID NO: 18909 - RNA, 19 nt, artificial
  Oligomer
cucugacucccaaaaauca

SEQ ID NO: 18910 - RNA, 19 nt, artificial
  Oligomer
agacauguacccugaugaa

SEQ ID NO: 18911 - RNA, 19 nt, artificial
  Oligomer
cuggaaacaauaucaagua

SEQ ID NO: 18912 - RNA, 19 nt, artificial
  Oligomer
cauccuucucagcaugcaa

SEQ ID NO: 18913 - RNA, 19 nt, artificial
  Oligomer
ggcaguucccagaaagaga

SEQ ID NO: 18914 - RNA, 19 nt, artificial
  Oligomer
caauacuauucaucaauua

SEQ ID NO: 18915 - RNA, 19 nt, artificial
  Oligomer
gucauacgaaccuaaagaa

SEQ ID NO: 18916 - RNA, 19 nt, artificial
  Oligomer
ccuucauugaagagagcaa

SEQ ID NO: 18917 - RNA, 19 nt, artificial
  Oligomer
ugaauggauuaaauguuaa

SEQ ID NO: 18918 - RNA, 19 nt, artificial
  Oligomer
ugaaggagcgggucaguaa

SEQ ID NO: 18919 - RNA, 19 nt, artificial
  Oligomer
gaauccagguggacagaga

SEQ ID NO: 18920 - RNA, 19 nt, artificial
  Oligomer
ggugauguccauggaagaa

SEQ ID NO: 18921 - RNA, 19 nt, artificial
  Oligomer
cgaagaaagcaaccagagu

SEQ ID NO: 18922 - RNA, 19 nt, artificial
  Oligomer
aaggagggacauuaagaaa

SEQ ID NO: 18923 - RNA, 19 nt, artificial
  Oligomer
accagauggugaaagugga

SEQ ID NO: 18924 - RNA, 19 nt, artificial
  Oligomer
gaggagugggaaauugauu

SEQ ID NO: 18925 - RNA, 19 nt, artificial
  Oligomer
ccgagucuucaaugaccua

SEQ ID NO: 18926 - RNA, 19 nt, artificial
  Oligomer
guccauugccuucauugaa

SEQ ID NO: 18927 - RNA, 19 nt, artificial
  Oligomer
gguccaagcugcagguauu

SEQ ID NO: 18928 - RNA, 19 nt, artificial
  Oligomer
ugggauuucuggugaagga

SEQ ID NO: 18929 - RNA, 19 nt, artificial
  Oligomer
uaagaggcaaccuguugaa

SEQ ID NO: 18930 - RNA, 19 nt, artificial
  Oligomer
gcgcugguggagaucaaua

SEQ ID NO: 18931 - RNA, 19 nt, artificial
  Oligomer
cuccuuuccugcaaaccca

SEQ ID NO: 18932 - RNA, 19 nt, artificial
  Oligomer
ggugucugcuaaagaggaa

SEQ ID NO: 18933 - RNA, 19 nt, artificial
  Oligomer
ccuguuaaauuaauuuuga

SEQ ID NO: 18934 - RNA, 19 nt, artificial
  Oligomer
gccggcugcaaguuuugua

SEQ ID NO: 18935 - RNA, 19 nt, artificial
  Oligomer
agaggauccugaagaugag

SEQ ID NO: 18936 - RNA, 19 nt, artificial
  Oligomer
aggaguacgaggaauggaa

SEQ ID NO: 18937 - RNA, 19 nt, artificial
  Oligomer
caauaucaaguaacaauau

SEQ ID NO: 18938 - RNA, 19 nt, artificial
  Oligomer
cuaguagcuuuccucccaa

SEQ ID NO: 18939 - RNA, 19 nt, artificial
  Oligomer
ggcaacagcggcaauuuga

SEQ ID NO: 18940 - RNA, 19 nt, artificial
  Oligomer
aagaguuuauugaucaaua

SEQ ID NO: 18941 - RNA, 19 nt, artificial
  Oligomer
ugaucuccaaaguuuuaaa

SEQ ID NO: 18942 - RNA, 19 nt, artificial
  Oligomer
agaacgaccgagucuucaa

SEQ ID NO: 18943 - RNA, 19 nt, artificial
  Oligomer
auacgaaccuaaagaauau

SEQ ID NO: 18944 - RNA, 19 nt, artificial
  Oligomer
cauacgaaccuaaagaaua

SEQ ID NO: 18945 - RNA, 19 nt, artificial
  Oligomer
agaauaugaauggauuaaa

SEQ ID NO: 18946 - RNA, 19 nt, artificial
  Oligomer
caguuugggugucugcuaa

SEQ ID NO: 18947 - RNA, 19 nt, artificial
  Oligomer
cuucaaacacgccuuugau

SEQ ID NO: 18948 - RNA, 19 nt, artificial
  Oligomer
uguccaacaugcuccuaga

SEQ ID NO: 18949 - RNA, 19 nt, artificial
  Oligomer
cauacagcagggcuggaaa

SEQ ID NO: 18950 - RNA, 19 nt, artificial
  Oligomer
ugagguuuucagcuccuaa

SEQ ID NO: 18951 - RNA, 19 nt, artificial
  Oligomer
ccuaaauccagucggucaa

SEQ ID NO: 18952 - RNA, 19 nt, artificial
  Oligomer
cccauuaaagacaaauuga

SEQ ID NO: 18953 - RNA, 19 nt, artificial
  Oligomer
cugcauuuagauuuugaua

SEQ ID NO: 18954 - RNA, 19 nt, artificial
  Oligomer
caggaagaggcuuucagga

SEQ ID NO: 18955 - RNA, 19 nt, artificial
  Oligomer
aaacaauaucaaguaacaa

SEQ ID NO: 18956 - RNA, 19 nt, artificial
  Oligomer
ugccugucguccucaacaa

SEQ ID NO: 18957 - RNA, 19 nt, artificial
  Oligomer
cugcgaacguacgaaguga

SEQ ID NO: 18958 - RNA, 19 nt, artificial
  Oligomer
cgaagcuccagaacucaca

SEQ ID NO: 18959 - RNA, 19 nt, artificial
  Oligomer
aagugaaaaggcaaucuau

SEQ ID NO: 18960 - RNA, 19 nt, artificial
  Oligomer
agaacaaugaacugcucaa

SEQ ID NO: 18961 - RNA, 19 nt, artificial
  Oligomer
ccaagauagaucauaucua

SEQ ID NO: 18962 - RNA, 19 nt, artificial
  Oligomer
gaauguucugcugguucua

SEQ ID NO: 18963 - RNA, 19 nt, artificial
  Oligomer
aggugaacaaagagaucga

SEQ ID NO: 18964 - RNA, 19 nt, artificial
  Oligomer
aggagugggaaauugauua

SEQ ID NO: 18965 - RNA, 19 nt, artificial
  Oligomer
cccuaagaggcaaccuguu

SEQ ID NO: 18966 - RNA, 19 nt, artificial
  Oligomer
cggcucagucccuacauau

SEQ ID NO: 18967 - RNA, 19 nt, artificial
  Oligomer
acaucauucuugcggucaa

SEQ ID NO: 18968 - RNA, 19 nt, artificial
  Oligomer
ggcaaugaagauacccaga

SEQ ID NO: 18969 - RNA, 19 nt, artificial
  Oligomer
ccuuuguauacuuuuuuaa

SEQ ID NO: 18970 - RNA, 19 nt, artificial
  Oligomer
cagagacaggcaaaucgca

SEQ ID NO: 18971 - RNA, 19 nt, artificial
  Oligomer
aucgcagcuggaagagaaa

SEQ ID NO: 18972 - RNA, 19 nt, artificial
  Oligomer
gcuucaagaagcuagcaga

SEQ ID NO: 18973 - RNA, 19 nt, artificial
  Oligomer
caaguaacaauaugauuau

SEQ ID NO: 18974 - RNA, 19 nt, artificial
  Oligomer
cugugcaggaagaaaggaa

SEQ ID NO: 18975 - RNA, 19 nt, artificial
  Oligomer
ccauugccuucauugaaga

SEQ ID NO: 18976 - RNA, 19 nt, artificial
  Oligomer
agagaugaaagauauggga

SEQ ID NO: 18977 - RNA, 19 nt, artificial
  Oligomer
caaccaucacuuccuuaga

SEQ ID NO: 18978 - RNA, 19 nt, artificial
  Oligomer
cuguuaaagugaaaaggca

SEQ ID NO: 18979 - RNA, 19 nt, artificial
  Oligomer
ggauaaaggagggacauua

SEQ ID NO: 18980 - RNA, 19 nt, artificial
  Oligomer
gagcaaaaaagacaccgau

SEQ ID NO: 18981 - RNA, 19 nt, artificial
  Oligomer
cuauccaauguccacaaaa

SEQ ID NO: 18982 - RNA, 19 nt, artificial
  Oligomer
ggaagaauaugacauugug

SEQ ID NO: 18983 - RNA, 19 nt, artificial
  Oligomer
gaagaaaggaagagcuaca

SEQ ID NO: 18984 - RNA, 19 nt, artificial
  Oligomer
cuagcacuuaccagcucaa

SEQ ID NO: 18985 - RNA, 19 nt, artificial
  Oligomer
agucauaaugucauacgaa

SEQ ID NO: 18986 - RNA, 19 nt, artificial
  Oligomer
gcuggaagagaaacaaguu

SEQ ID NO: 18987 - RNA, 19 nt, artificial
  Oligomer
ggugcaugaaaccacugga

SEQ ID NO: 18988 - RNA, 19 nt, artificial
  Oligomer
aaugucauacgaaccuaaa

SEQ ID NO: 18989 - RNA, 19 nt, artificial
  Oligomer
cauccaauggauugugcaa

SEQ ID NO: 18990 - RNA, 19 nt, artificial
  Oligomer
uggaaguuauguuguucaa

SEQ ID NO: 18991 - RNA, 19 nt, artificial
  Oligomer
caacuuugagagugcugga

SEQ ID NO: 18992 - RNA, 19 nt, artificial
  Oligomer
gagaaggaccaauucacca

SEQ ID NO: 18993 - RNA, 19 nt, artificial
  Oligomer
gugaaaaggcaaucuauga

SEQ ID NO: 18994 - RNA, 19 nt, artificial
  Oligomer
guuuauugaucaauacuau

SEQ ID NO: 18995 - RNA, 19 nt, artificial
  Oligomer
ugaagauacccagagaaua

SEQ ID NO: 18996 - RNA, 19 nt, artificial
  Oligomer
ugccuggaaacaauaucaa

SEQ ID NO: 18997 - RNA, 19 nt, artificial
  Oligomer
gacaacucccgcuacaaua

SEQ ID NO: 18998 - RNA, 19 nt, artificial
  Oligomer
gaugcaaugcuuuucuaau

SEQ ID NO: 18999 - RNA, 19 nt, artificial
  Oligomer
cccaaggauggaaagggaa

SEQ ID NO: 19000 - RNA, 19 nt, artificial
  Oligomer
uggaggaguucccaucuau

SEQ ID NO: 19001 - RNA, 19 nt, artificial
  Oligomer
gccuggaaacaauaucaag

SEQ ID NO: 19002 - RNA, 19 nt, artificial
  Oligomer
gugcaugaaaccacuggaa

SEQ ID NO: 19003 - RNA, 19 nt, artificial
  Oligomer
ggaagaggugaacaaagag

SEQ ID NO: 19004 - RNA, 19 nt, artificial
  Oligomer
cguccucaacaacccauau

SEQ ID NO: 19005 - RNA, 19 nt, artificial
  Oligomer
cacgcccauguaccugaaa

SEQ ID NO: 19006 - RNA, 19 nt, artificial
  Oligomer
gaauaguucacaucuauca

SEQ ID NO: 19007 - RNA, 19 nt, artificial
  Oligomer
gaugagggaugacaaccga

SEQ ID NO: 19008 - RNA, 19 nt, artificial
  Oligomer
ccggcaauccaagauagau

SEQ ID NO: 19009 - RNA, 19 nt, artificial
  Oligomer
gcuuccucaaggucaagaa

SEQ ID NO: 19010 - RNA, 19 nt, artificial
  Oligomer
gaagggaucccuuuguaua

SEQ ID NO: 19011 - RNA, 19 nt, artificial
  Oligomer
caacagcggcaauuugaua

SEQ ID NO: 19012 - RNA, 19 nt, artificial
  Oligomer
ggaauuggagccgguguaa

SEQ ID NO: 19013 - RNA, 19 nt, artificial
  Oligomer
cauggaagaauaugacauu

SEQ ID NO: 19014 - RNA, 19 nt, artificial
  Oligomer
ggcuccuuagccgucaaaa

SEQ ID NO: 19015 - RNA, 19 nt, artificial
  Oligomer
uagcuuccagagugacaaa

SEQ ID NO: 19016 - RNA, 19 nt, artificial
  Oligomer
gugugggagaugaugucaa

SEQ ID NO: 19017 - RNA, 19 nt, artificial
  Oligomer
gagcacauuggaaacggga

SEQ ID NO: 19018 - RNA, 19 nt, artificial
  Oligomer
ccaaaggcuuucuuuccaa

SEQ ID NO: 19019 - RNA, 19 nt, artificial
  Oligomer
gagaugaaagauaugggaa

SEQ ID NO: 19020 - RNA, 19 nt, artificial
  Oligomer
caugaugccucagaucuga

SEQ ID NO: 19021 - RNA, 19 nt, artificial
  Oligomer
ugaacuuagacaugaggaa

SEQ ID NO: 19022 - RNA, 19 nt, artificial
  Oligomer
gaauuugcugcauuuagau

SEQ ID NO: 19023 - RNA, 19 nt, artificial
  Oligomer
aaaccacauuucuuuuaua

SEQ ID NO: 19024 - RNA, 19 nt, artificial
  Oligomer
cuggaggaguucccaucua

SEQ ID NO: 19025 - RNA, 19 nt, artificial
  Oligomer
gaacgaccgagucuucaau

SEQ ID NO: 19026 - RNA, 19 nt, artificial
  Oligomer
acgacuuccgagucuggaa

SEQ ID NO: 19027 - RNA, 19 nt, artificial
  Oligomer
caguuugccucccuagcua

SEQ ID NO: 19028 - RNA, 19 nt, artificial
  Oligomer
ugguggaccugagcuauga

SEQ ID NO: 19029 - RNA, 19 nt, artificial
  Oligomer
caguuuuuccuagucauaa

SEQ ID NO: 19030 - RNA, 19 nt, artificial
  Oligomer
guuggacgucacugcuaau

SEQ ID NO: 19031 - RNA, 19 nt, artificial
  Oligomer
gggagaggagugggaaauu

SEQ ID NO: 19032 - RNA, 19 nt, artificial
  Oligomer
agaaguacgugcaggacau

SEQ ID NO: 19033 - RNA, 19 nt, artificial
  Oligomer
cuaucaugcgucacuucua

SEQ ID NO: 19034 - RNA, 19 nt, artificial
  Oligomer
ucacuuccuuagagaauaa

SEQ ID NO: 19035 - RNA, 19 nt, artificial
  Oligomer
cuccagcaauagcauccaa

SEQ ID NO: 19036 - RNA, 19 nt, artificial
  Oligomer
gggaagaacuugucccuca

SEQ ID NO: 19037 - RNA, 19 nt, artificial
  Oligomer
cccacgggauguucaacua

SEQ ID NO: 19038 - RNA, 19 nt, artificial
  Oligomer
aaugaagauacccagagaa

SEQ ID NO: 19039 - RNA, 19 nt, artificial
  Oligomer
ggcaauccaagauagauca

SEQ ID NO: 19040 - RNA, 19 nt, artificial
  Oligomer
cuaagaggcaaccuguuga

SEQ ID NO: 19041 - RNA, 19 nt, artificial
  Oligomer
uguucaacuacaucuguaa

SEQ ID NO: 19042 - RNA, 19 nt, artificial
  Oligomer
acaauaucaaguaacaaua

SEQ ID NO: 19043 - RNA, 19 nt, artificial
  Oligomer
gggugucugcuaaagagga

SEQ ID NO: 19044 - RNA, 19 nt, artificial
  Oligomer
gaagaggugaacaaagaga

SEQ ID NO: 19045 - RNA, 19 nt, artificial
  Oligomer
aaagaauaugaauggauua

SEQ ID NO: 19046 - RNA, 19 nt, artificial
  Oligomer
uaguagcuuuccucccaaa

SEQ ID NO: 19047 - RNA, 19 nt, artificial
  Oligomer
cuccuacucugacucccaa

SEQ ID NO: 19048 - RNA, 19 nt, artificial
  Oligomer
cugaagacguccgcacaaa

SEQ ID NO: 19049 - RNA, 19 nt, artificial
  Oligomer
aaggcagagaugaaagaua

SEQ ID NO: 19050 - RNA, 19 nt, artificial
  Oligomer
cgccuuagaucugagucca

SEQ ID NO: 19051 - RNA, 19 nt, artificial
  Oligomer
gugcaggaagaaaggaaga

SEQ ID NO: 19052 - RNA, 19 nt, artificial
  Oligomer
ggaagggaucccuuuguau

SEQ ID NO: 19053 - RNA, 19 nt, artificial
  Oligomer
gcugugcuuugauggaaau

SEQ ID NO: 19054 - RNA, 19 nt, artificial
  Oligomer
gcuacaauauccuggagga

SEQ ID NO: 19055 - RNA, 19 nt, artificial
  Oligomer
caagcugcagguauucgau

SEQ ID NO: 19056 - RNA, 19 nt, artificial
  Oligomer
agcccucaugugacaugaa

SEQ ID NO: 19057 - RNA, 19 nt, artificial
  Oligomer
agacguccgcacaaaagga

SEQ ID NO: 19058 - RNA, 19 nt, artificial
  Oligomer
caaccgauaccaugaggau

SEQ ID NO: 19059 - RNA, 19 nt, artificial
  Oligomer
gugcaccuggaacaugaaa

SEQ ID NO: 19060 - RNA, 19 nt, artificial
  Oligomer
ccuuuuuuaugaugacauu

SEQ ID NO: 19061 - RNA, 19 nt, artificial
  Oligomer
gagaggauccugaagauga

SEQ ID NO: 19062 - RNA, 19 nt, artificial
  Oligomer
uaaugucauacgaaccuaa

SEQ ID NO: 19063 - RNA, 19 nt, artificial
  Oligomer
agugaccaaccgccuuaga

SEQ ID NO: 19064 - RNA, 19 nt, artificial
  Oligomer
aguuuuuccuagucauaau

SEQ ID NO: 19065 - RNA, 19 nt, artificial
  Oligomer
gaaagauaugggaauccag

SEQ ID NO: 19066 - RNA, 19 nt, artificial
  Oligomer
caaagaaguacgugcagga

SEQ ID NO: 19067 - RNA, 19 nt, artificial
  Oligomer
caacucugugcaggaagaa

SEQ ID NO: 19068 - RNA, 19 nt, artificial
  Oligomer
agaugaaagauaugggaau

SEQ ID NO: 19069 - RNA, 19 nt, artificial
  Oligomer
ccaagucuucgguaggaau

SEQ ID NO: 19070 - RNA, 19 nt, artificial
  Oligomer
cuuuggugccuggaaacaa

SEQ ID NO: 19071 - RNA, 19 nt, artificial
  Oligomer
ggcucagucccuacauauu

SEQ ID NO: 19072 - RNA, 19 nt, artificial
  Oligomer
cuguaaccaugucaaguau

SEQ ID NO: 19073 - RNA, 19 nt, artificial
  Oligomer
gguacaugggcacagagau

SEQ ID NO: 19074 - RNA, 19 nt, artificial
  Oligomer
gcauugugaggucuucaga

SEQ ID NO: 19075 - RNA, 19 nt, artificial
  Oligomer
cucagucccuacauauuua

SEQ ID NO: 19076 - RNA, 19 nt, artificial
  Oligomer
acggcucagucccuacaua

SEQ ID NO: 19077 - RNA, 19 nt, artificial
  Oligomer
ugucuugcuauacagaaaa

SEQ ID NO: 19078 - RNA, 19 nt, artificial
  Oligomer
gugcuuugauggaaaugag

SEQ ID NO: 19079 - RNA, 19 nt, artificial
  Oligomer
ccuccuccagcaauagcau

SEQ ID NO: 19080 - RNA, 19 nt, artificial
  Oligomer
ccuucauuaagcacaugga

SEQ ID NO: 19081 - RNA, 19 nt, artificial
  Oligomer
cgagcauacccucacuuuu

SEQ ID NO: 19082 - RNA, 19 nt, artificial
  Oligomer
cugaguccauugccuucau

SEQ ID NO: 19083 - RNA, 19 nt, artificial
  Oligomer
cgcagcuggaagagaaaca

SEQ ID NO: 19084 - RNA, 19 nt, artificial
  Oligomer
cgaacguacgaagugacca

SEQ ID NO: 19085 - RNA, 19 nt, artificial
  Oligomer
ggcuuuaggugucaucagu

SEQ ID NO: 19086 - RNA, 19 nt, artificial
  Oligomer
acaaauaaguuacccucaa

SEQ ID NO: 19087 - RNA, 19 nt, artificial
  Oligomer
caugcauccuucucagcau

SEQ ID NO: 19088 - RNA, 19 nt, artificial
  Oligomer
ccuaaagaauaugaaugga

SEQ ID NO: 19089 - RNA, 19 nt, artificial
  Oligomer
uagucauaaugucauacga

SEQ ID NO: 19090 - RNA, 19 nt, artificial
  Oligomer
gcuuuaggugucaucagua

SEQ ID NO: 19091 - RNA, 19 nt, artificial
  Oligomer
gugccuggaaacaauauca

SEQ ID NO: 19092 - RNA, 19 nt, artificial
  Oligomer
gacagacacugcugaaccu

SEQ ID NO: 19093 - RNA, 19 nt, artificial
  Oligomer
uguccauggaagaauauga

SEQ ID NO: 19094 - RNA, 19 nt, artificial
  Oligomer
aguccauugccuucauuga

SEQ ID NO: 19095 - RNA, 19 nt, artificial
  Oligomer
agcccauucuaaacuccuu

SEQ ID NO: 19096 - RNA, 19 nt, artificial
  Oligomer
uggugaaaguggaacugcu

SEQ ID NO: 19097 - RNA, 19 nt, artificial
  Oligomer
gugacaaagugaccauugu

SEQ ID NO: 19098 - RNA, 19 nt, artificial
  Oligomer
aaagcuuuggugccuggaa

SEQ ID NO: 19099 - RNA, 19 nt, artificial
  Oligomer
acgggugcaugaaaccacu

SEQ ID NO: 19100 - RNA, 19 nt, artificial
  Oligomer
aggaguucccaucuaucca

SEQ ID NO: 19101 - RNA, 19 nt, artificial
  Oligomer
uguugaauuuacucucuca

SEQ ID NO: 19102 - RNA, 19 nt, artificial
  Oligomer
cggcuuuaggugucaucag

SEQ ID NO: 19103 - RNA, 19 nt, artificial
  Oligomer
gauguccauggaagaauau

SEQ ID NO: 19104 - RNA, 19 nt, artificial
  Oligomer
gugacaacucccgcuacaa

SEQ ID NO: 19105 - RNA, 19 nt, artificial
  Oligomer
gaaacgggaugcacugagu

SEQ ID NO: 19106 - RNA, 19 nt, artificial
  Oligomer
gagacuguuaaagugaaaa

SEQ ID NO: 19107 - RNA, 19 nt, artificial
  Oligomer
aggguuugcaggaguacga

SEQ ID NO: 19108 - RNA, 19 nt, artificial
  Oligomer
uguuaaagugaaaaggcaa

SEQ ID NO: 19109 - RNA, 19 nt, artificial
  Oligomer
ugaccauuguugaccauca

SEQ ID NO: 19110 - RNA, 19 nt, artificial
  Oligomer
aaguuauguuguucaaaga

SEQ ID NO: 19111 - RNA, 19 nt, artificial
  Oligomer
aauaauggaagcugguuaa

SEQ ID NO: 19112 - RNA, 19 nt, artificial
  Oligomer
gaccauuguugaccaucac

SEQ ID NO: 19113 - RNA, 19 nt, artificial
  Oligomer
guguaauuccucccuaaga

SEQ ID NO: 19114 - RNA, 19 nt, artificial
  Oligomer
caaagagaucgacaccacu

SEQ ID NO: 19115 - RNA, 19 nt, artificial
  Oligomer
agcacauggagaaugagua

SEQ ID NO: 19116 - RNA, 19 nt, artificial
  Oligomer
gaagagagcaaaaaagaca

SEQ ID NO: 19117 - RNA, 19 nt, artificial
  Oligomer
uacucugacucccaaaaau

SEQ ID NO: 19118 - RNA, 19 nt, artificial
  Oligomer
cacccauaccagcuagaau

SEQ ID NO: 19119 - RNA, 19 nt, artificial
  Oligomer
augacauugugcaccugga

SEQ ID NO: 19120 - RNA, 19 nt, artificial
  Oligomer
accaggagaugcucaacua

SEQ ID NO: 19121 - RNA, 19 nt, artificial
  Oligomer
gcaaccuguugaauuuacu

SEQ ID NO: 19122 - RNA, 19 nt, artificial
  Oligomer
agaucauaucuacagggaa

SEQ ID NO: 19123 - RNA, 19 nt, artificial
  Oligomer
gcaccuggaacaugaaacu

SEQ ID NO: 19124 - RNA, 19 nt, artificial
  Oligomer
gcugucucccaaugaaaga

SEQ ID NO: 19125 - RNA, 19 nt, artificial
  Oligomer
ggaaguuauguuguucaaa

SEQ ID NO: 19126 - RNA, 19 nt, artificial
  Oligomer
uuuggugccuggaaacaau

SEQ ID NO: 19127 - RNA, 19 nt, artificial
  Oligomer
accaauucaccacggcgua

SEQ ID NO: 19128 - RNA, 19 nt, artificial
  Oligomer
gaguucccaucuauccaga

SEQ ID NO: 19129 - RNA, 19 nt, artificial
  Oligomer
gaaagaggcauucccagaa

SEQ ID NO: 19130 - RNA, 19 nt, artificial
  Oligomer
aauccaagauagaucauau

SEQ ID NO: 19131 - RNA, 19 nt, artificial
  Oligomer
agcugacgucaaagacaga

SEQ ID NO: 19132 - RNA, 19 nt, artificial
  Oligomer
gcaaaaaagacaccgauga

SEQ ID NO: 19133 - RNA, 19 nt, artificial
  Oligomer
gguuaaaguggaugagguu

SEQ ID NO: 19134 - RNA, 19 nt, artificial
  Oligomer
ccauaauuguucuaguuag

SEQ ID NO: 19135 - RNA, 19 nt, artificial
  Oligomer
gugaccaaccgccuuagau

SEQ ID NO: 19136 - RNA, 19 nt, artificial
  Oligomer
acauggaaaggcuggaaga

SEQ ID NO: 19137 - RNA, 19 nt, artificial
  Oligomer
gugggaaauugauuaaagg

SEQ ID NO: 19138 - RNA, 19 nt, artificial
  Oligomer
agugggaaauugauuaaag

SEQ ID NO: 19139 - RNA, 19 nt, artificial
  Oligomer
acaauucccucaucagcaa

SEQ ID NO: 19140 - RNA, 19 nt, artificial
  Oligomer
acagagauuuggacggcaa

SEQ ID NO: 19141 - RNA, 19 nt, artificial
  Oligomer
ccacugcuuucauugaaga

SEQ ID NO: 19142 - RNA, 19 nt, artificial
  Oligomer
agguggacagagauuugga

SEQ ID NO: 19143 - RNA, 19 nt, artificial
  Oligomer
ccgauaccaugaggauauu

SEQ ID NO: 19144 - RNA, 19 nt, artificial
  Oligomer
ccuggaaacaauaucaagu

SEQ ID NO: 19145 - RNA, 19 nt, artificial
  Oligomer
aggaagaaaggaagagcua

SEQ ID NO: 19146 - RNA, 19 nt, artificial
  Oligomer
ggaagaacuugucccucag

SEQ ID NO: 19147 - RNA, 19 nt, artificial
  Oligomer
cagugaugauaggauaaag

SEQ ID NO: 19148 - RNA, 19 nt, artificial
  Oligomer
aaguggaacugcuggagga

SEQ ID NO: 19149 - RNA, 19 nt, artificial
  Oligomer
ugacaugaacccauccaau

SEQ ID NO: 19150 - RNA, 19 nt, artificial
  Oligomer
ccugaugaagugcaccuca

SEQ ID NO: 19151 - RNA, 19 nt, artificial
  Oligomer
uaauuguucuaguuagaaa

SEQ ID NO: 19152 - RNA, 19 nt, artificial
  Oligomer
cuucauugaagagagcaaa

SEQ ID NO: 19153 - RNA, 19 nt, artificial
  Oligomer
aaagagacaagaaauccua

SEQ ID NO: 19154 - RNA, 19 nt, artificial
  Oligomer
augaauggauuaaauguua

SEQ ID NO: 19155 - RNA, 19 nt, artificial
  Oligomer
gcacaaaaggacagcucuu

SEQ ID NO: 19156 - RNA, 19 nt, artificial
  Oligomer
gaagugaccaaccgccuua

SEQ ID NO: 19157 - RNA, 19 nt, artificial
  Oligomer
aauccuuuauagcuuugga

SEQ ID NO: 19158 - RNA, 19 nt, artificial
  Oligomer
cuucuaauccugaagggaa

SEQ ID NO: 19159 - RNA, 19 nt, artificial
  Oligomer
cccagaauuugcugcauuu

SEQ ID NO: 19160 - RNA, 19 nt, artificial
  Oligomer
cccagggaaggaaacuguu

SEQ ID NO: 19161 - RNA, 19 nt, artificial
  Oligomer
guugaucuccaaaguuuua

SEQ ID NO: 19162 - RNA, 19 nt, artificial
  Oligomer
ucccagaaagagacaagaa

SEQ ID NO: 19163 - RNA, 19 nt, artificial
  Oligomer
cuacucugacucccaaaaa

SEQ ID NO: 19164 - RNA, 19 nt, artificial
  Oligomer
ccucaacaacccauauuca

SEQ ID NO: 19165 - RNA, 19 nt, artificial
  Oligomer
caaugucauuucuguucgu

SEQ ID NO: 19166 - RNA, 19 nt, artificial
  Oligomer
ggaggaguucccaucuauc

SEQ ID NO: 19167 - RNA, 19 nt, artificial
  Oligomer
aguccuucauuaagcacau

SEQ ID NO: 19168 - RNA, 19 nt, artificial
  Oligomer
gccuuagaucugaguccau

SEQ ID NO: 19169 - RNA, 19 nt, artificial
  Oligomer
ggcauaucuuguuguucag

SEQ ID NO: 19170 - RNA, 19 nt, artificial
  Oligomer
caaaguuuuaaaccuguua

SEQ ID NO: 19171 - RNA, 19 nt, artificial
  Oligomer
cugccuuccuuuaauccca

SEQ ID NO: 19172 - RNA, 19 nt, artificial
  Oligomer
cgaccucagagacaacuuu

SEQ ID NO: 19173 - RNA, 19 nt, artificial
  Oligomer
cugaggugguucucacuga

SEQ ID NO: 19174 - RNA, 19 nt, artificial
  Oligomer
cccgcuacaauauccugga

SEQ ID NO: 19175 - RNA, 19 nt, artificial
  Oligomer
ggcaauuugauauccaaca

SEQ ID NO: 19176 - RNA, 19 nt, artificial
  Oligomer
cccaccucaggaaaacagu

SEQ ID NO: 19177 - RNA, 19 nt, artificial
  Oligomer
ccaagcugcagguauucga

SEQ ID NO: 19178 - RNA, 19 nt, artificial
  Oligomer
ugcucacucuuccacagau

SEQ ID NO: 19179 - RNA, 19 nt, artificial
  Oligomer
ccuggaacaugaaacucug

SEQ ID NO: 19180 - RNA, 19 nt, artificial
  Oligomer
uccaaagcccacauggaaa

SEQ ID NO: 19181 - RNA, 19 nt, artificial
  Oligomer
gcccaaugucauuucuguu

SEQ ID NO: 19182 - RNA, 19 nt, artificial
  Oligomer
acauguucgguguucagca

SEQ ID NO: 19183 - RNA, 19 nt, artificial
  Oligomer
gcuaauucguuucagugau

SEQ ID NO: 19184 - RNA, 19 nt, artificial
  Oligomer
cagacacugcugaaccuuu

SEQ ID NO: 19185 - RNA, 19 nt, artificial
  Oligomer
ugagggaugacaaccgaua

SEQ ID NO: 19186 - RNA, 19 nt, artificial
  Oligomer
aaguuacccucaacucaga

SEQ ID NO: 19187 - RNA, 19 nt, artificial
  Oligomer
ucauuaagcacauggagaa

SEQ ID NO: 19188 - RNA, 19 nt, artificial
  Oligomer
acaaugaacugcucaagga

SEQ ID NO: 19189 - RNA, 19 nt, artificial
  Oligomer
gaagauacccagagaauag

SEQ ID NO: 19190 - RNA, 19 nt, artificial
  Oligomer
agaugaacuuagacaugag

SEQ ID NO: 19191 - RNA, 19 nt, artificial
  Oligomer
cugggugaggagcuacuua

SEQ ID NO: 19192 - RNA, 19 nt, artificial
  Oligomer
cgcacaaaaggacagcucu

SEQ ID NO: 19193 - RNA, 19 nt, artificial
  Oligomer
ccacccauaccagcuagaa

SEQ ID NO: 19194 - RNA, 19 nt, artificial
  Oligomer
aacucugugcaggaagaaa

SEQ ID NO: 19195 - RNA, 19 nt, artificial
  Oligomer
acaucuguaaccaugucaa

SEQ ID NO: 19196 - RNA, 19 nt, artificial
  Oligomer
ucacucuuccacagauaua

SEQ ID NO: 19197 - RNA, 19 nt, artificial
  Oligomer
acgcaugucuggaaaggca

SEQ ID NO: 19198 - RNA, 19 nt, artificial
  Oligomer
agagacaggcaaaucgcaa

SEQ ID NO: 19199 - RNA, 19 nt, artificial
  Oligomer
aguuugggugucugcuaaa

SEQ ID NO: 19200 - RNA, 19 nt, artificial
  Oligomer
ugugcaguucacagagaua

SEQ ID NO: 19201 - RNA, 19 nt, artificial
  Oligomer
caauaucgcgguucucuau

SEQ ID NO: 19202 - RNA, 19 nt, artificial
  Oligomer
ggauccugaagaugaggga

SEQ ID NO: 19203 - RNA, 19 nt, artificial
  Oligomer
cuacaauauccuggaggaa

SEQ ID NO: 19204 - RNA, 19 nt, artificial
  Oligomer
agauuuggacggcaaguca

SEQ ID NO: 19205 - RNA, 19 nt, artificial
  Oligomer
cggcuucaagaagcuagca

SEQ ID NO: 19206 - RNA, 19 nt, artificial
  Oligomer
gccuggaaguuauguuguu

SEQ ID NO: 19207 - RNA, 19 nt, artificial
  Oligomer
aaaccuccagagcccuaaa

SEQ ID NO: 19208 - RNA, 19 nt, artificial
  Oligomer
ccagaauuugcugcauuua

SEQ ID NO: 19209 - RNA, 19 nt, artificial
  Oligomer
ugccuuccuuuaaucccaa

SEQ ID NO: 19210 - RNA, 19 nt, artificial
  Oligomer
ccuaguagcuuuccuccca

SEQ ID NO: 19211 - RNA, 19 nt, artificial
  Oligomer
ccaucggcuucaagaagcu

SEQ ID NO: 19212 - RNA, 19 nt, artificial
  Oligomer
ugcugcauuuagauuuuga

SEQ ID NO: 19213 - RNA, 19 nt, artificial
  Oligomer
ggcugucucccaaugaaag

SEQ ID NO: 19214 - RNA, 19 nt, artificial
  Oligomer
aaauccagucggucaacua

SEQ ID NO: 19215 - RNA, 19 nt, artificial
  Oligomer
aacucacgggugcaugaaa

SEQ ID NO: 19216 - RNA, 19 nt, artificial
  Oligomer
caggagacuguuaaaguga

SEQ ID NO: 19217 - RNA, 19 nt, artificial
  Oligomer
cgcuacuauuccaucagcu

SEQ ID NO: 19218 - RNA, 19 nt, artificial
  Oligomer
ucaagaacugggagacuga

SEQ ID NO: 19219 - RNA, 19 nt, artificial
  Oligomer
ugucauacgaaccuaaaga

SEQ ID NO: 19220 - RNA, 19 nt, artificial
  Oligomer
ggcagagaugaaagauaug

SEQ ID NO: 19221 - RNA, 19 nt, artificial
  Oligomer
ggauuaaauguuaaagcuu

SEQ ID NO: 19222 - RNA, 19 nt, artificial
  Oligomer
cucaguuuuuccuagucau

SEQ ID NO: 19223 - RNA, 19 nt, artificial
  Oligomer
ccgguguaauuccucccua

SEQ ID NO: 19224 - RNA, 19 nt, artificial
  Oligomer
agauggagaaggaccaauu

SEQ ID NO: 19225 - RNA, 19 nt, artificial
  Oligomer
agcccaaugucauuucugu

SEQ ID NO: 19226 - RNA, 19 nt, artificial
  Oligomer
gcugagcugacgucaaaga

SEQ ID NO: 19227 - RNA, 19 nt, artificial
  Oligomer
caauaaggaucuucccacu

SEQ ID NO: 19228 - RNA, 19 nt, artificial
  Oligomer
aguugaucuccaaaguuuu

SEQ ID NO: 19229 - RNA, 19 nt, artificial
  Oligomer
ccuucaaguacuaccugga

SEQ ID NO: 19230 - RNA, 19 nt, artificial
  Oligomer
aguuauguuguucaaagaa

SEQ ID NO: 19231 - RNA, 19 nt, artificial
  Oligomer
uccuagucauaaugucaua

SEQ ID NO: 19232 - RNA, 19 nt, artificial
  Oligomer
uagcuaccagcgagaagga

SEQ ID NO: 19233 - RNA, 19 nt, artificial
  Oligomer
agcuaguuaccauggagga

SEQ ID NO: 19234 - RNA, 19 nt, artificial
  Oligomer
ccucagaucugauccgcau

SEQ ID NO: 19235 - RNA, 19 nt, artificial
  Oligomer
gcacuuaccagcucaagga

SEQ ID NO: 19236 - RNA, 19 nt, artificial
  Oligomer
gugaugauaggauaaagga

SEQ ID NO: 19237 - RNA, 19 nt, artificial
  Oligomer
ucgagauggagaaggacca

SEQ ID NO: 19238 - RNA, 19 nt, artificial
  Oligomer
aggcaaccuguugaauuua

SEQ ID NO: 19239 - RNA, 19 nt, artificial
  Oligomer
augaugucaacauugaaaa

SEQ ID NO: 19240 - RNA, 19 nt, artificial
  Oligomer
cuuaagagcacauuggaaa

SEQ ID NO: 19241 - RNA, 19 nt, artificial
  Oligomer
agaagaugaacuuagacau

SEQ ID NO: 19242 - RNA, 19 nt, artificial
  Oligomer
cuuugauggaaaugaggca

SEQ ID NO: 19243 - RNA, 19 nt, artificial
  Oligomer
gugggcauaucuuguuguu

SEQ ID NO: 19244 - RNA, 19 nt, artificial
  Oligomer
uaaacuccuuuccugcaaa

SEQ ID NO: 19245 - RNA, 19 nt, artificial
  Oligomer
ccacauggaaaggcuggaa

SEQ ID NO: 19246 - RNA, 19 nt, artificial
  Oligomer
ggaauguucugcugguucu

SEQ ID NO: 19247 - RNA, 19 nt, artificial
  Oligomer
ccauggaagaauaugacau

SEQ ID NO: 19248 - RNA, 19 nt, artificial
  Oligomer
ucgugaaugcccugaucga

SEQ ID NO: 19249 - RNA, 19 nt, artificial
  Oligomer
cauugugcaccuggaacau

SEQ ID NO: 19250 - RNA, 19 nt, artificial
  Oligomer
ggucaaccaucacuuccuu

SEQ ID NO: 19251 - RNA, 19 nt, artificial
  Oligomer
ccaaagaguuuauugauca

SEQ ID NO: 19252 - RNA, 19 nt, artificial
  Oligomer
cgaccgagucuucaaugac

SEQ ID NO: 19253 - RNA, 19 nt, artificial
  Oligomer
aagugaccauuguugacca

SEQ ID NO: 19254 - RNA, 19 nt, artificial
  Oligomer
caagaaggucuucaaggca

SEQ ID NO: 19255 - RNA, 19 nt, artificial
  Oligomer
accuuaagagcacauugga

SEQ ID NO: 19256 - RNA, 19 nt, artificial
  Oligomer
aaaggcuggaagaggugaa

SEQ ID NO: 19257 - RNA, 19 nt, artificial
  Oligomer
gauuaaauguuaaagcuuu

SEQ ID NO: 19258 - RNA, 19 nt, artificial
  Oligomer
gucuauccaauguccacaa

SEQ ID NO: 19259 - RNA, 19 nt, artificial
  Oligomer
gauggaaagggaauguucu

SEQ ID NO: 19260 - RNA, 19 nt, artificial
  Oligomer
uugugcaccuggaacauga

SEQ ID NO: 19261 - RNA, 19 nt, artificial
  Oligomer
ggagaaggaccaauucacc

SEQ ID NO: 19262 - RNA, 19 nt, artificial
  Oligomer
aaguggaugagguuggaaa

SEQ ID NO: 19263 - RNA, 19 nt, artificial
  Oligomer
uauaaagaacaaacacuua

SEQ ID NO: 19264 - RNA, 19 nt, artificial
  Oligomer
cucacucuuccacagauau

SEQ ID NO: 19265 - RNA, 19 nt, artificial
  Oligomer
gcguauucaucagccggau

SEQ ID NO: 19266 - RNA, 19 nt, artificial
  Oligomer
ggacgucacugcuaauucg

SEQ ID NO: 19267 - RNA, 19 nt, artificial
  Oligomer
ucuaaguucaucuucuugg

SEQ ID NO: 19268 - RNA, 19 nt, artificial
  Oligomer
uauuucuuaaugucccucc

SEQ ID NO: 19269 - RNA, 19 nt, artificial
  Oligomer
uuagggaggaauuacaccg

SEQ ID NO: 19270 - RNA, 19 nt, artificial
  Oligomer
uuggauaucaaauugccgc

SEQ ID NO: 19271 - RNA, 19 nt, artificial
  Oligomer
uuguucuuuauaucugugg

SEQ ID NO: 19272 - RNA, 19 nt, artificial
  Oligomer
uucaauguugacaucaucu

SEQ ID NO: 19273 - RNA, 19 nt, artificial
  Oligomer
uuauuucuuaaugucccuc

SEQ ID NO: 19274 - RNA, 19 nt, artificial
  Oligomer
uuuuuugcucucuucaaug

SEQ ID NO: 19275 - RNA, 19 nt, artificial
  Oligomer
uucauauucuuuagguucg

SEQ ID NO: 19276 - RNA, 19 nt, artificial
  Oligomer
aucuucaggauccucuccc

SEQ ID NO: 19277 - RNA, 19 nt, artificial
  Oligomer
uuggucacuucguacguuc

SEQ ID NO: 19278 - RNA, 19 nt, artificial
  Oligomer
uuucacuuuaacagucucc

SEQ ID NO: 19279 - RNA, 19 nt, artificial
  Oligomer
auuuauuucuuaauguccc

SEQ ID NO: 19280 - RNA, 19 nt, artificial
  Oligomer
auuuaauccauucauauuc

SEQ ID NO: 19281 - RNA, 19 nt, artificial
  Oligomer
uuagaaaagcauugcaucg

SEQ ID NO: 19282 - RNA, 19 nt, artificial
  Oligomer
aucaauuucccacuccucu

SEQ ID NO: 19283 - RNA, 19 nt, artificial
  Oligomer
uuuccaucaaagcacagcc

SEQ ID NO: 19284 - RNA, 19 nt, artificial
  Oligomer
uuucauugggagacagccc

SEQ ID NO: 19285 - RNA, 19 nt, artificial
  Oligomer
uuacaaaacuugcagccgg

SEQ ID NO: 19286 - RNA, 19 nt, artificial
  Oligomer
ucugguugcuuucuucgcg

SEQ ID NO: 19287 - RNA, 19 nt, artificial
  Oligomer
uuaaugucccuccuuuauc

SEQ ID NO: 19288 - RNA, 19 nt, artificial
  Oligomer
aucugaggcaucaugagcc

SEQ ID NO: 19289 - RNA, 19 nt, artificial
  Oligomer
uuuaacauuuaauccauuc

SEQ ID NO: 19290 - RNA, 19 nt, artificial
  Oligomer
uuguucaccucuuccagcc

SEQ ID NO: 19291 - RNA, 19 nt, artificial
  Oligomer
uguuacuugauauuguuuc

SEQ ID NO: 19292 - RNA, 19 nt, artificial
  Oligomer
ucaauuucccacuccucuc

SEQ ID NO: 19293 - RNA, 19 nt, artificial
  Oligomer
uuaaucaauuucccacucc

SEQ ID NO: 19294 - RNA, 19 nt, artificial
  Oligomer
ucucuggguaucuucauug

SEQ ID NO: 19295 - RNA, 19 nt, artificial
  Oligomer
uuucuugucucuuucuggg

SEQ ID NO: 19296 - RNA, 19 nt, artificial
  Oligomer
uugaucaauaaacucuuug

SEQ ID NO: 19297 - RNA, 19 nt, artificial
  Oligomer
uugaccuugaggaagcgug

SEQ ID NO: 19298 - RNA, 19 nt, artificial
  Oligomer
uugguccuucuccaucucg

SEQ ID NO: 19299 - RNA, 19 nt, artificial
  Oligomer
uuagcagugacguccaacc

SEQ ID NO: 19300 - RNA, 19 nt, artificial
  Oligomer
uauucuuccauggacauca

SEQ ID NO: 19301 - RNA, 19 nt, artificial
  Oligomer
ucuuccauggacaucaccu

SEQ ID NO: 19302 - RNA, 19 nt, artificial
  Oligomer
uuccacuuucaccaucugg

SEQ ID NO: 19303 - RNA, 19 nt, artificial
  Oligomer
uuucuguauagcaagacac

SEQ ID NO: 19304 - RNA, 19 nt, artificial
  Oligomer
uccaaaaauauccucaugg

SEQ ID NO: 19305 - RNA, 19 nt, artificial
  Oligomer
auguacucagugcaucccg

SEQ ID NO: 19306 - RNA, 19 nt, artificial
  Oligomer
augguaucgguugucaucc

SEQ ID NO: 19307 - RNA, 19 nt, artificial
  Oligomer
uuuagaaugggcuucccuu

SEQ ID NO: 19308 - RNA, 19 nt, artificial
  Oligomer
uaagcuugcgauuugccug

SEQ ID NO: 19309 - RNA, 19 nt, artificial
  Oligomer
uuccauggacaucaccuug

SEQ ID NO: 19310 - RNA, 19 nt, artificial
  Oligomer
uuuuuguggacauuggaua

SEQ ID NO: 19311 - RNA, 19 nt, artificial
  Oligomer
uucucuuccagcugcgauc

SEQ ID NO: 19312 - RNA, 19 nt, artificial
  Oligomer
uuuguucaccucuuccagc

SEQ ID NO: 19313 - RNA, 19 nt, artificial
  Oligomer
uuuugaucugaguugaggg

SEQ ID NO: 19314 - RNA, 19 nt, artificial
  Oligomer
uucacuuuaacagucuccu

SEQ ID NO: 19315 - RNA, 19 nt, artificial
  Oligomer
aauuuauuucuuaaugucc

SEQ ID NO: 19316 - RNA, 19 nt, artificial
  Oligomer
uugcugaacaccgaacaug

SEQ ID NO: 19317 - RNA, 19 nt, artificial
  Oligomer
uugaugaauaguauugauc

SEQ ID NO: 19318 - RNA, 19 nt, artificial
  Oligomer
uguuucagguacaugggcg

SEQ ID NO: 19319 - RNA, 19 nt, artificial
  Oligomer
uugaaggccuggaagaugg

SEQ ID NO: 19320 - RNA, 19 nt, artificial
  Oligomer
uuauaucuguggaagagug

SEQ ID NO: 19321 - RNA, 19 nt, artificial
  Oligomer
uagaugugaacuauucucu

SEQ ID NO: 19322 - RNA, 19 nt, artificial
  Oligomer
aaauguuucagguacaugg

SEQ ID NO: 19323 - RNA, 19 nt, artificial
  Oligomer
uuuccauuccucguacucc

SEQ ID NO: 19324 - RNA, 19 nt, artificial
  Oligomer
ucuaacuagaacaauuaug

SEQ ID NO: 19325 - RNA, 19 nt, artificial
  Oligomer
uugaaucggaccuuguagc

SEQ ID NO: 19326 - RNA, 19 nt, artificial
  Oligomer
uacuucuuugguuugucug

SEQ ID NO: 19327 - RNA, 19 nt, artificial
  Oligomer
aauguugacaucaucuccc

SEQ ID NO: 19328 - RNA, 19 nt, artificial
  Oligomer
uucuuaaugucccuccuuu

SEQ ID NO: 19329 - RNA, 19 nt, artificial
  Oligomer
uuugaggacaucagcagcc

SEQ ID NO: 19330 - RNA, 19 nt, artificial
  Oligomer
uguuuguucuuuauaucug

SEQ ID NO: 19331 - RNA, 19 nt, artificial
  Oligomer
uucauguuccaggugcaca

SEQ ID NO: 19332 - RNA, 19 nt, artificial
  Oligomer
uuuguucuuuauaucugug

SEQ ID NO: 19333 - RNA, 19 nt, artificial
  Oligomer
augugaacuauucucuggg

SEQ ID NO: 19334 - RNA, 19 nt, artificial
  Oligomer
uuuaaucaauuucccacuc

SEQ ID NO: 19335 - RNA, 19 nt, artificial
  Oligomer
uucuccuucucgcugguag

SEQ ID NO: 19336 - RNA, 19 nt, artificial
  Oligomer
auagaugugaacuauucuc

SEQ ID NO: 19337 - RNA, 19 nt, artificial
  Oligomer
uguaaagguggucuccagg

SEQ ID NO: 19338 - RNA, 19 nt, artificial
  Oligomer
uacaaagggaucccuuccc

SEQ ID NO: 19339 - RNA, 19 nt, artificial
  Oligomer
uuaagguggagggugucag

SEQ ID NO: 19340 - RNA, 19 nt, artificial
  Oligomer
aaauucaacagguugccuc

SEQ ID NO: 19341 - RNA, 19 nt, artificial
  Oligomer
uuagaaugggcuucccuuc

SEQ ID NO: 19342 - RNA, 19 nt, artificial
  Oligomer
augauuuccugcauccgcc

SEQ ID NO: 19343 - RNA, 19 nt, artificial
  Oligomer
auuucuugucucuuucugg

SEQ ID NO: 19344 - RNA, 19 nt, artificial
  Oligomer
uuacuugauauuguuucca

SEQ ID NO: 19345 - RNA, 19 nt, artificial
  Oligomer
acucuuuccaaccucaucc

SEQ ID NO: 19346 - RNA, 19 nt, artificial
  Oligomer
auguaguugaacaucccgu

SEQ ID NO: 19347 - RNA, 19 nt, artificial
  Oligomer
uuccaugugggcuuuggag

SEQ ID NO: 19348 - RNA, 19 nt, artificial
  Oligomer
uuucaauguugacaucauc

SEQ ID NO: 19349 - RNA, 19 nt, artificial
  Oligomer
uuccaaugugcucuuaagg

SEQ ID NO: 19350 - RNA, 19 nt, artificial
  Oligomer
uuuccagacaugcguguuc

SEQ ID NO: 19351 - RNA, 19 nt, artificial
  Oligomer
uuccagacaugcguguucc

SEQ ID NO: 19352 - RNA, 19 nt, artificial
  Oligomer
uuggagaucaacugcagag

SEQ ID NO: 19353 - RNA, 19 nt, artificial
  Oligomer
ugcuuaaugaaggacucgg

SEQ ID NO: 19354 - RNA, 19 nt, artificial
  Oligomer
uuuuugaucugaguugagg

SEQ ID NO: 19355 - RNA, 19 nt, artificial
  Oligomer
uucuuuauaucuguggaag

SEQ ID NO: 19356 - RNA, 19 nt, artificial
  Oligomer
auaagcuugcgauuugccu

SEQ ID NO: 19357 - RNA, 19 nt, artificial
  Oligomer
uucaccagaaaucccaggc

SEQ ID NO: 19358 - RNA, 19 nt, artificial
  Oligomer
uuuauaucuguggaagagu

SEQ ID NO: 19359 - RNA, 19 nt, artificial
  Oligomer
uaucuguggaagagugagc

SEQ ID NO: 19360 - RNA, 19 nt, artificial
  Oligomer
uuguuucucuuccagcugc

SEQ ID NO: 19361 - RNA, 19 nt, artificial
  Oligomer
uagaaaagcauugcaucgc

SEQ ID NO: 19362 - RNA, 19 nt, artificial
  Oligomer
uuuugugcggacgucuuca

SEQ ID NO: 19363 - RNA, 19 nt, artificial
  Oligomer
uuccaggugcacaauguca

SEQ ID NO: 19364 - RNA, 19 nt, artificial
  Oligomer
uuugacgucagcucagcgu

SEQ ID NO: 19365 - RNA, 19 nt, artificial
  Oligomer
cuggauuugcugaacaccg

SEQ ID NO: 19366 - RNA, 19 nt, artificial
  Oligomer
uccuucuccaucucgagug

SEQ ID NO: 19367 - RNA, 19 nt, artificial
  Oligomer
uuuccaggcaccaaagcuu

SEQ ID NO: 19368 - RNA, 19 nt, artificial
  Oligomer
uuuauuucuuaaugucccu

SEQ ID NO: 19369 - RNA, 19 nt, artificial
  Oligomer
uuccaucaaagcacagccg

SEQ ID NO: 19370 - RNA, 19 nt, artificial
  Oligomer
ucgcuuuuuguggacauug

SEQ ID NO: 19371 - RNA, 19 nt, artificial
  Oligomer
uacagcucucugaagaccc

SEQ ID NO: 19372 - RNA, 19 nt, artificial
  Oligomer
auucauauucuuuagguuc

SEQ ID NO: 19373 - RNA, 19 nt, artificial
  Oligomer
uucucuaaggaagugaugg

SEQ ID NO: 19374 - RNA, 19 nt, artificial
  Oligomer
ucuuucugggaacugccug

SEQ ID NO: 19375 - RNA, 19 nt, artificial
  Oligomer
uccaugguaacuagcuucc

SEQ ID NO: 19376 - RNA, 19 nt, artificial
  Oligomer
aucucuaggagcauguugg

SEQ ID NO: 19377 - RNA, 19 nt, artificial
  Oligomer
auauugaucuccaccagcg

SEQ ID NO: 19378 - RNA, 19 nt, artificial
  Oligomer
uucugcuagcuucuugaag

SEQ ID NO: 19379 - RNA, 19 nt, artificial
  Oligomer
uacuccugcaaacccuugc

SEQ ID NO: 19380 - RNA, 19 nt, artificial
  Oligomer
ugcuguaugcauaucucug

SEQ ID NO: 19381 - RNA, 19 nt, artificial
  Oligomer
auaucuuucaucucugccu

SEQ ID NO: 19382 - RNA, 19 nt, artificial
  Oligomer
ucuaaaugcagcaaauucu

SEQ ID NO: 19383 - RNA, 19 nt, artificial
  Oligomer
ucuuccugcacagaguugg

SEQ ID NO: 19384 - RNA, 19 nt, artificial
  Oligomer
ucuuuguucaccucuucca

SEQ ID NO: 19385 - RNA, 19 nt, artificial
  Oligomer
uuaaugaaggacucggugg

SEQ ID NO: 19386 - RNA, 19 nt, artificial
  Oligomer
uucaccaucugguugacag

SEQ ID NO: 19387 - RNA, 19 nt, artificial
  Oligomer
ucuuucaucucugccuugg

SEQ ID NO: 19388 - RNA, 19 nt, artificial
  Oligomer
uuuuucuguauagcaagac

SEQ ID NO: 19389 - RNA, 19 nt, artificial
  Oligomer
uuacugaugacaccuaaag

SEQ ID NO: 19390 - RNA, 19 nt, artificial
  Oligomer
uguaguugaacaucccgug

SEQ ID NO: 19391 - RNA, 19 nt, artificial
  Oligomer
uugaaccacucaaacuugg

SEQ ID NO: 19392 - RNA, 19 nt, artificial
  Oligomer
uaaaaaaguauacaaaggg

SEQ ID NO: 19393 - RNA, 19 nt, artificial
  Oligomer
ugaacaacaagauaugccc

SEQ ID NO: 19394 - RNA, 19 nt, artificial
  Oligomer
aucaaauugccgcuguugc

SEQ ID NO: 19395 - RNA, 19 nt, artificial
  Oligomer
uguuccagugguuucaugc

SEQ ID NO: 19396 - RNA, 19 nt, artificial
  Oligomer
ugagacucgcuuuuugugg

SEQ ID NO: 19397 - RNA, 19 nt, artificial
  Oligomer
uuagaugcggaucagaucu

SEQ ID NO: 19398 - RNA, 19 nt, artificial
  Oligomer
uccauggacaucaccuugg

SEQ ID NO: 19399 - RNA, 19 nt, artificial
  Oligomer
uuuaacagguuuaaaacuu

SEQ ID NO: 19400 - RNA, 19 nt, artificial
  Oligomer
ucuaucuuggauugccggc

SEQ ID NO: 19401 - RNA, 19 nt, artificial
  Oligomer
uccacuuuaaccagcuucc

SEQ ID NO: 19402 - RNA, 19 nt, artificial
  Oligomer
uuggauggguucaugucac

SEQ ID NO: 19403 - RNA, 19 nt, artificial
  Oligomer
aucaauuugucuuuaaugg

SEQ ID NO: 19404 - RNA, 19 nt, artificial
  Oligomer
augguaacuagcuuccgag

SEQ ID NO: 19405 - RNA, 19 nt, artificial
  Oligomer
ucaauguugacaucaucuc

SEQ ID NO: 19406 - RNA, 19 nt, artificial
  Oligomer
auccacuuuaaccagcuuc

SEQ ID NO: 19407 - RNA, 19 nt, artificial
  Oligomer
aucaaaaucuaaaugcagc

SEQ ID NO: 19408 - RNA, 19 nt, artificial
  Oligomer
uuccaaauguuucagguac

SEQ ID NO: 19409 - RNA, 19 nt, artificial
  Oligomer
ugauuuuugggagucagag

SEQ ID NO: 19410 - RNA, 19 nt, artificial
  Oligomer
uucaucaggguacaugucu

SEQ ID NO: 19411 - RNA, 19 nt, artificial
  Oligomer
uacuugauauuguuuccag

SEQ ID NO: 19412 - RNA, 19 nt, artificial
  Oligomer
uugcaugcugagaaggaug

SEQ ID NO: 19413 - RNA, 19 nt, artificial
  Oligomer
ucucuuucugggaacugcc

SEQ ID NO: 19414 - RNA, 19 nt, artificial
  Oligomer
uaauugaugaauaguauug

SEQ ID NO: 19415 - RNA, 19 nt, artificial
  Oligomer
uucuuuagguucguaugac

SEQ ID NO: 19416 - RNA, 19 nt, artificial
  Oligomer
uugcucucuucaaugaagg

SEQ ID NO: 19417 - RNA, 19 nt, artificial
  Oligomer
uuaacauuuaauccauuca

SEQ ID NO: 19418 - RNA, 19 nt, artificial
  Oligomer
uuacugacccgcuccuuca

SEQ ID NO: 19419 - RNA, 19 nt, artificial
  Oligomer
ucucuguccaccuggauuc

SEQ ID NO: 19420 - RNA, 19 nt, artificial
  Oligomer
uucuuccauggacaucacc

SEQ ID NO: 19421 - RNA, 19 nt, artificial
  Oligomer
acucugguugcuuucuucg

SEQ ID NO: 19422 - RNA, 19 nt, artificial
  Oligomer
uuucuuaaugucccuccuu

SEQ ID NO: 19423 - RNA, 19 nt, artificial
  Oligomer
uccacuuucaccaucuggu

SEQ ID NO: 19424 - RNA, 19 nt, artificial
  Oligomer
aaucaauuucccacuccuc

SEQ ID NO: 19425 - RNA, 19 nt, artificial
  Oligomer
uaggucauugaagacucgg

SEQ ID NO: 19426 - RNA, 19 nt, artificial
  Oligomer
uucaaugaaggcaauggac

SEQ ID NO: 19427 - RNA, 19 nt, artificial
  Oligomer
aauaccugcagcuuggacc

SEQ ID NO: 19428 - RNA, 19 nt, artificial
  Oligomer
uccuucaccagaaauccca

SEQ ID NO: 19429 - RNA, 19 nt, artificial
  Oligomer
uucaacagguugccucuua

SEQ ID NO: 19430 - RNA, 19 nt, artificial
  Oligomer
uauugaucuccaccagcgc

SEQ ID NO: 19431 - RNA, 19 nt, artificial
  Oligomer
uggguuugcaggaaaggag

SEQ ID NO: 19432 - RNA, 19 nt, artificial
  Oligomer
uuccucuuuagcagacacc

SEQ ID NO: 19433 - RNA, 19 nt, artificial
  Oligomer
ucaaaauuaauuuaacagg

SEQ ID NO: 19434 - RNA, 19 nt, artificial
  Oligomer
uacaaaacuugcagccggc

SEQ ID NO: 19435 - RNA, 19 nt, artificial
  Oligomer
cucaucuucaggauccucu

SEQ ID NO: 19436 - RNA, 19 nt, artificial
  Oligomer
uuccauuccucguacuccu

SEQ ID NO: 19437 - RNA, 19 nt, artificial
  Oligomer
auauuguuacuugauauug

SEQ ID NO: 19438 - RNA, 19 nt, artificial
  Oligomer
uugggaggaaagcuacuag

SEQ ID NO: 19439 - RNA, 19 nt, artificial
  Oligomer
ucaaauugccgcuguugcc

SEQ ID NO: 19440 - RNA, 19 nt, artificial
  Oligomer
uauugaucaauaaacucuu

SEQ ID NO: 19441 - RNA, 19 nt, artificial
  Oligomer
uuuaaaacuuuggagauca

SEQ ID NO: 19442 - RNA, 19 nt, artificial
  Oligomer
uugaagacucggucguucu

SEQ ID NO: 19443 - RNA, 19 nt, artificial
  Oligomer
auauucuuuagguucguau

SEQ ID NO: 19444 - RNA, 19 nt, artificial
  Oligomer
uauucuuuagguucguaug

SEQ ID NO: 19445 - RNA, 19 nt, artificial
  Oligomer
uuuaauccauucauauucu

SEQ ID NO: 19446 - RNA, 19 nt, artificial
  Oligomer
uuagcagacacccaaacug

SEQ ID NO: 19447 - RNA, 19 nt, artificial
  Oligomer
aucaaaggcguguuugaag

SEQ ID NO: 19448 - RNA, 19 nt, artificial
  Oligomer
ucuaggagcauguuggaca

SEQ ID NO: 19449 - RNA, 19 nt, artificial
  Oligomer
uuuccagcccugcuguaug

SEQ ID NO: 19450 - RNA, 19 nt, artificial
  Oligomer
uuaggagcugaaaaccuca

SEQ ID NO: 19451 - RNA, 19 nt, artificial
  Oligomer
uugaccgacuggauuuagg

SEQ ID NO: 19452 - RNA, 19 nt, artificial
  Oligomer
ucaauuugucuuuaauggg

SEQ ID NO: 19453 - RNA, 19 nt, artificial
  Oligomer
uaucaaaaucuaaaugcag

SEQ ID NO: 19454 - RNA, 19 nt, artificial
  Oligomer
uccugaaagccucuuccug

SEQ ID NO: 19455 - RNA, 19 nt, artificial
  Oligomer
uuguuacuugauauuguuu

SEQ ID NO: 19456 - RNA, 19 nt, artificial
  Oligomer
uuguugaggacgacaggca

SEQ ID NO: 19457 - RNA, 19 nt, artificial
  Oligomer
ucacuucguacguucgcag

SEQ ID NO: 19458 - RNA, 19 nt, artificial
  Oligomer
ugugaguucuggagcuucg

SEQ ID NO: 19459 - RNA, 19 nt, artificial
  Oligomer
auagauugccuuuucacuu

SEQ ID NO: 19460 - RNA, 19 nt, artificial
  Oligomer
uugagcaguucauuguucu

SEQ ID NO: 19461 - RNA, 19 nt, artificial
  Oligomer
uagauaugaucuaucuugg

SEQ ID NO: 19462 - RNA, 19 nt, artificial
  Oligomer
uagaaccagcagaacauuc

SEQ ID NO: 19463 - RNA, 19 nt, artificial
  Oligomer
ucgaucucuuuguucaccu

SEQ ID NO: 19464 - RNA, 19 nt, artificial
  Oligomer
uaaucaauuucccacuccu

SEQ ID NO: 19465 - RNA, 19 nt, artificial
  Oligomer
aacagguugccucuuaggg

SEQ ID NO: 19466 - RNA, 19 nt, artificial
  Oligomer
auauguagggacugagccg

SEQ ID NO: 19467 - RNA, 19 nt, artificial
  Oligomer
uugaccgcaagaaugaugu

SEQ ID NO: 19468 - RNA, 19 nt, artificial
  Oligomer
ucuggguaucuucauugcc

SEQ ID NO: 19469 - RNA, 19 nt, artificial
  Oligomer
uuaaaaaaguauacaaagg

SEQ ID NO: 19470 - RNA, 19 nt, artificial
  Oligomer
ugcgauuugccugucucug

SEQ ID NO: 19471 - RNA, 19 nt, artificial
  Oligomer
uuucucuuccagcugcgau

SEQ ID NO: 19472 - RNA, 19 nt, artificial
  Oligomer
ucugcuagcuucuugaagc

SEQ ID NO: 19473 - RNA, 19 nt, artificial
  Oligomer
auaaucauauuguuacuug

SEQ ID NO: 19474 - RNA, 19 nt, artificial
  Oligomer
uuccuuucuuccugcacag

SEQ ID NO: 19475 - RNA, 19 nt, artificial
  Oligomer
ucuucaaugaaggcaaugg

SEQ ID NO: 19476 - RNA, 19 nt, artificial
  Oligomer
ucccauaucuuucaucucu

SEQ ID NO: 19477 - RNA, 19 nt, artificial
  Oligomer
ucuaaggaagugaugguug

SEQ ID NO: 19478 - RNA, 19 nt, artificial
  Oligomer
ugccuuuucacuuuaacag

SEQ ID NO: 19479 - RNA, 19 nt, artificial
  Oligomer
uaaugucccuccuuuaucc

SEQ ID NO: 19480 - RNA, 19 nt, artificial
  Oligomer
aucggugucuuuuuugcuc

SEQ ID NO: 19481 - RNA, 19 nt, artificial
  Oligomer
uuuuguggacauuggauag

SEQ ID NO: 19482 - RNA, 19 nt, artificial
  Oligomer
cacaaugucauauucuucc

SEQ ID NO: 19483 - RNA, 19 nt, artificial
  Oligomer
uguagcucuuccuuucuuc

SEQ ID NO: 19484 - RNA, 19 nt, artificial
  Oligomer
uugagcugguaagugcuag

SEQ ID NO: 19485 - RNA, 19 nt, artificial
  Oligomer
uucguaugacauuaugacu

SEQ ID NO: 19486 - RNA, 19 nt, artificial
  Oligomer
aacuuguuucucuuccagc

SEQ ID NO: 19487 - RNA, 19 nt, artificial
  Oligomer
uccagugguuucaugcacc

SEQ ID NO: 19488 - RNA, 19 nt, artificial
  Oligomer
uuuagguucguaugacauu

SEQ ID NO: 19489 - RNA, 19 nt, artificial
  Oligomer
uugcacaauccauuggaug

SEQ ID NO: 19490 - RNA, 19 nt, artificial
  Oligomer
uugaacaacauaacuucca

SEQ ID NO: 19491 - RNA, 19 nt, artificial
  Oligomer
uccagcacucucaaaguug

SEQ ID NO: 19492 - RNA, 19 nt, artificial
  Oligomer
uggugaauugguccuucuc

SEQ ID NO: 19493 - RNA, 19 nt, artificial
  Oligomer
ucauagauugccuuuucac

SEQ ID NO: 19494 - RNA, 19 nt, artificial
  Oligomer
auaguauugaucaauaaac

SEQ ID NO: 19495 - RNA, 19 nt, artificial
  Oligomer
uauucucuggguaucuuca

SEQ ID NO: 19496 - RNA, 19 nt, artificial
  Oligomer
uugauauuguuuccaggca

SEQ ID NO: 19497 - RNA, 19 nt, artificial
  Oligomer
uauuguagcgggaguuguc

SEQ ID NO: 19498 - RNA, 19 nt, artificial
  Oligomer
auuagaaaagcauugcauc

SEQ ID NO: 19499 - RNA, 19 nt, artificial
  Oligomer
uucccuuuccauccuuggg

SEQ ID NO: 19500 - RNA, 19 nt, artificial
  Oligomer
auagaugggaacuccucca

SEQ ID NO: 19501 - RNA, 19 nt, artificial
  Oligomer
cuugauauuguuuccaggc

SEQ ID NO: 19502 - RNA, 19 nt, artificial
  Oligomer
uuccagugguuucaugcac

SEQ ID NO: 19503 - RNA, 19 nt, artificial
  Oligomer
cucuuuguucaccucuucc

SEQ ID NO: 19504 - RNA, 19 nt, artificial
  Oligomer
auauggguuguugaggacg

SEQ ID NO: 19505 - RNA, 19 nt, artificial
  Oligomer
uuucagguacaugggcgug

SEQ ID NO: 19506 - RNA, 19 nt, artificial
  Oligomer
ugauagaugugaacuauuc

SEQ ID NO: 19507 - RNA, 19 nt, artificial
  Oligomer
ucgguugucaucccucauc

SEQ ID NO: 19508 - RNA, 19 nt, artificial
  Oligomer
aucuaucuuggauugccgg

SEQ ID NO: 19509 - RNA, 19 nt, artificial
  Oligomer
uucuugaccuugaggaagc

SEQ ID NO: 19510 - RNA, 19 nt, artificial
  Oligomer
uauacaaagggaucccuuc

SEQ ID NO: 19511 - RNA, 19 nt, artificial
  Oligomer
uaucaaauugccgcuguug

SEQ ID NO: 19512 - RNA, 19 nt, artificial
  Oligomer
uuacaccggcuccaauucc

SEQ ID NO: 19513 - RNA, 19 nt, artificial
  Oligomer
aaugucauauucuuccaug

SEQ ID NO: 19514 - RNA, 19 nt, artificial
  Oligomer
uuuugacggcuaaggagcc

SEQ ID NO: 19515 - RNA, 19 nt, artificial
  Oligomer
uuugucacucuggaagcua

SEQ ID NO: 19516 - RNA, 19 nt, artificial
  Oligomer
uugacaucaucucccacac

SEQ ID NO: 19517 - RNA, 19 nt, artificial
  Oligomer
ucccguuuccaaugugcuc

SEQ ID NO: 19518 - RNA, 19 nt, artificial
  Oligomer
uuggaaagaaagccuuugg

SEQ ID NO: 19519 - RNA, 19 nt, artificial
  Oligomer
uucccauaucuuucaucuc

SEQ ID NO: 19520 - RNA, 19 nt, artificial
  Oligomer
ucagaucugaggcaucaug

SEQ ID NO: 19521 - RNA, 19 nt, artificial
  Oligomer
uuccucaugucuaaguuca

SEQ ID NO: 19522 - RNA, 19 nt, artificial
  Oligomer
aucuaaaugcagcaaauuc

SEQ ID NO: 19523 - RNA, 19 nt, artificial
  Oligomer
uauaaaagaaaugugguuu

SEQ ID NO: 19524 - RNA, 19 nt, artificial
  Oligomer
uagaugggaacuccuccag

SEQ ID NO: 19525 - RNA, 19 nt, artificial
  Oligomer
auugaagacucggucguuc

SEQ ID NO: 19526 - RNA, 19 nt, artificial
  Oligomer
uuccagacucggaagucgu

SEQ ID NO: 19527 - RNA, 19 nt, artificial
  Oligomer
uagcuagggaggcaaacug

SEQ ID NO: 19528 - RNA, 19 nt, artificial
  Oligomer
ucauagcucagguccacca

SEQ ID NO: 19529 - RNA, 19 nt, artificial
  Oligomer
uuaugacuaggaaaaacug

SEQ ID NO: 19530 - RNA, 19 nt, artificial
  Oligomer
auuagcagugacguccaac

SEQ ID NO: 19531 - RNA, 19 nt, artificial
  Oligomer
aauuucccacuccucuccc

SEQ ID NO: 19532 - RNA, 19 nt, artificial
  Oligomer
auguccugcacguacuucu

SEQ ID NO: 19533 - RNA, 19 nt, artificial
  Oligomer
uagaagugacgcaugauag

SEQ ID NO: 19534 - RNA, 19 nt, artificial
  Oligomer
uuauucucuaaggaaguga

SEQ ID NO: 19535 - RNA, 19 nt, artificial
  Oligomer
uuggaugcuauugcuggag

SEQ ID NO: 19536 - RNA, 19 nt, artificial
  Oligomer
ugagggacaaguucuuccc

SEQ ID NO: 19537 - RNA, 19 nt, artificial
  Oligomer
uaguugaacaucccguggg

SEQ ID NO: 19538 - RNA, 19 nt, artificial
  Oligomer
uucucuggguaucuucauu

SEQ ID NO: 19539 - RNA, 19 nt, artificial
  Oligomer
ugaucuaucuuggauugcc

SEQ ID NO: 19540 - RNA, 19 nt, artificial
  Oligomer
ucaacagguugccucuuag

SEQ ID NO: 19541 - RNA, 19 nt, artificial
  Oligomer
uuacagauguaguugaaca

SEQ ID NO: 19542 - RNA, 19 nt, artificial
  Oligomer
uauuguuacuugauauugu

SEQ ID NO: 19543 - RNA, 19 nt, artificial
  Oligomer
uccucuuuagcagacaccc

SEQ ID NO: 19544 - RNA, 19 nt, artificial
  Oligomer
ucucuuuguucaccucuuc

SEQ ID NO: 19545 - RNA, 19 nt, artificial
  Oligomer
uaauccauucauauucuuu

SEQ ID NO: 19546 - RNA, 19 nt, artificial
  Oligomer
uuugggaggaaagcuacua

SEQ ID NO: 19547 - RNA, 19 nt, artificial
  Oligomer
uugggagucagaguaggag

SEQ ID NO: 19548 - RNA, 19 nt, artificial
  Oligomer
uuugugcggacgucuucag

SEQ ID NO: 19549 - RNA, 19 nt, artificial
  Oligomer
uaucuuucaucucugccuu

SEQ ID NO: 19550 - RNA, 19 nt, artificial
  Oligomer
uggacucagaucuaaggcg

SEQ ID NO: 19551 - RNA, 19 nt, artificial
  Oligomer
ucuuccuuucuuccugcac

SEQ ID NO: 19552 - RNA, 19 nt, artificial
  Oligomer
auacaaagggaucccuucc

SEQ ID NO: 19553 - RNA, 19 nt, artificial
  Oligomer
auuuccaucaaagcacagc

SEQ ID NO: 19554 - RNA, 19 nt, artificial
  Oligomer
uccuccaggauauuguagc

SEQ ID NO: 19555 - RNA, 19 nt, artificial
  Oligomer
aucgaauaccugcagcuug

SEQ ID NO: 19556 - RNA, 19 nt, artificial
  Oligomer
uucaugucacaugagggcu

SEQ ID NO: 19557 - RNA, 19 nt, artificial
  Oligomer
uccuuuugugcggacgucu

SEQ ID NO: 19558 - RNA, 19 nt, artificial
  Oligomer
auccucaugguaucgguug

SEQ ID NO: 19559 - RNA, 19 nt, artificial
  Oligomer
uuucauguuccaggugcac

SEQ ID NO: 19560 - RNA, 19 nt, artificial
  Oligomer
aaugucaucauaaaaaagg

SEQ ID NO: 19561 - RNA, 19 nt, artificial
  Oligomer
ucaucuucaggauccucuc

SEQ ID NO: 19562 - RNA, 19 nt, artificial
  Oligomer
uuagguucguaugacauua

SEQ ID NO: 19563 - RNA, 19 nt, artificial
  Oligomer
ucuaaggcgguuggucacu

SEQ ID NO: 19564 - RNA, 19 nt, artificial
  Oligomer
auuaugacuaggaaaaacu

SEQ ID NO: 19565 - RNA, 19 nt, artificial
  Oligomer
cuggauucccauaucuuuc

SEQ ID NO: 19566 - RNA, 19 nt, artificial
  Oligomer
uccugcacguacuucuuug

SEQ ID NO: 19567 - RNA, 19 nt, artificial
  Oligomer
uucuuccugcacagaguug

SEQ ID NO: 19568 - RNA, 19 nt, artificial
  Oligomer
auucccauaucuuucaucu

SEQ ID NO: 19569 - RNA, 19 nt, artificial
  Oligomer
auuccuaccgaagacuugg

SEQ ID NO: 19570 - RNA, 19 nt, artificial
  Oligomer
uuguuuccaggcaccaaag

SEQ ID NO: 19571 - RNA, 19 nt, artificial
  Oligomer
aauauguagggacugagcc

SEQ ID NO: 19572 - RNA, 19 nt, artificial
  Oligomer
auacuugacaugguuacag

SEQ ID NO: 19573 - RNA, 19 nt, artificial
  Oligomer
aucucugugcccauguacc

SEQ ID NO: 19574 - RNA, 19 nt, artificial
  Oligomer
ucugaagaccucacaaugc

SEQ ID NO: 19575 - RNA, 19 nt, artificial
  Oligomer
uaaauauguagggacugag

SEQ ID NO: 19576 - RNA, 19 nt, artificial
  Oligomer
uauguagggacugagccgu

SEQ ID NO: 19577 - RNA, 19 nt, artificial
  Oligomer
uuuucuguauagcaagaca

SEQ ID NO: 19578 - RNA, 19 nt, artificial
  Oligomer
cucauuuccaucaaagcac

SEQ ID NO: 19579 - RNA, 19 nt, artificial
  Oligomer
augcuauugcuggaggagg

SEQ ID NO: 19580 - RNA, 19 nt, artificial
  Oligomer
uccaugugcuuaaugaagg

SEQ ID NO: 19581 - RNA, 19 nt, artificial
  Oligomer
aaaagugaggguaugcucg

SEQ ID NO: 19582 - RNA, 19 nt, artificial
  Oligomer
augaaggcaauggacucag

SEQ ID NO: 19583 - RNA, 19 nt, artificial
  Oligomer
uguuucucuuccagcugcg

SEQ ID NO: 19584 - RNA, 19 nt, artificial
  Oligomer
uggucacuucguacguucg

SEQ ID NO: 19585 - RNA, 19 nt, artificial
  Oligomer
acugaugacaccuaaagcc

SEQ ID NO: 19586 - RNA, 19 nt, artificial
  Oligomer
uugaggguaacuuauuugu

SEQ ID NO: 19587 - RNA, 19 nt, artificial
  Oligomer
augcugagaaggaugcaug

SEQ ID NO: 19588 - RNA, 19 nt, artificial
  Oligomer
uccauucauauucuuuagg

SEQ ID NO: 19589 - RNA, 19 nt, artificial
  Oligomer
ucguaugacauuaugacua

SEQ ID NO: 19590 - RNA, 19 nt, artificial
  Oligomer
uacugaugacaccuaaagc

SEQ ID NO: 19591 - RNA, 19 nt, artificial
  Oligomer
ugauauuguuuccaggcac

SEQ ID NO: 19592 - RNA, 19 nt, artificial
  Oligomer
agguucagcagugucuguc

SEQ ID NO: 19593 - RNA, 19 nt, artificial
  Oligomer
ucauauucuuccauggaca

SEQ ID NO: 19594 - RNA, 19 nt, artificial
  Oligomer
ucaaugaaggcaauggacu

SEQ ID NO: 19595 - RNA, 19 nt, artificial
  Oligomer
aaggaguuuagaaugggcu

SEQ ID NO: 19596 - RNA, 19 nt, artificial
  Oligomer
agcaguuccacuuucacca

SEQ ID NO: 19597 - RNA, 19 nt, artificial
  Oligomer
acaauggucacuuugucac

SEQ ID NO: 19598 - RNA, 19 nt, artificial
  Oligomer
uuccaggcaccaaagcuuu

SEQ ID NO: 19599 - RNA, 19 nt, artificial
  Oligomer
agugguuucaugcacccgu

SEQ ID NO: 19600 - RNA, 19 nt, artificial
  Oligomer
uggauagaugggaacuccu

SEQ ID NO: 19601 - RNA, 19 nt, artificial
  Oligomer
ugagagaguaaauucaaca

SEQ ID NO: 19602 - RNA, 19 nt, artificial
  Oligomer
cugaugacaccuaaagccg

SEQ ID NO: 19603 - RNA, 19 nt, artificial
  Oligomer
auauucuuccauggacauc

SEQ ID NO: 19604 - RNA, 19 nt, artificial
  Oligomer
uuguagcgggaguugucac

SEQ ID NO: 19605 - RNA, 19 nt, artificial
  Oligomer
acucagugcaucccguuuc

SEQ ID NO: 19606 - RNA, 19 nt, artificial
  Oligomer
uuuucacuuuaacagucuc

SEQ ID NO: 19607 - RNA, 19 nt, artificial
  Oligomer
ucguacuccugcaaacccu

SEQ ID NO: 19608 - RNA, 19 nt, artificial
  Oligomer
uugccuuuucacuuuaaca

SEQ ID NO: 19609 - RNA, 19 nt, artificial
  Oligomer
ugauggucaacaaugguca

SEQ ID NO: 19610 - RNA, 19 nt, artificial
  Oligomer
ucuuugaacaacauaacuu

SEQ ID NO: 19611 - RNA, 19 nt, artificial
  Oligomer
uuaaccagcuuccauuauu

SEQ ID NO: 19612 - RNA, 19 nt, artificial
  Oligomer
gugauggucaacaaugguc

SEQ ID NO: 19613 - RNA, 19 nt, artificial
  Oligomer
ucuuagggaggaauuacac

SEQ ID NO: 19614 - RNA, 19 nt, artificial
  Oligomer
aguggugucgaucucuuug

SEQ ID NO: 19615 - RNA, 19 nt, artificial
  Oligomer
uacucauucuccaugugcu

SEQ ID NO: 19616 - RNA, 19 nt, artificial
  Oligomer
ugucuuuuuugcucucuuc

SEQ ID NO: 19617 - RNA, 19 nt, artificial
  Oligomer
auuuuugggagucagagua

SEQ ID NO: 19618 - RNA, 19 nt, artificial
  Oligomer
auucuagcugguaugggug

SEQ ID NO: 19619 - RNA, 19 nt, artificial
  Oligomer
uccaggugcacaaugucau

SEQ ID NO: 19620 - RNA, 19 nt, artificial
  Oligomer
uaguugagcaucuccuggu

SEQ ID NO: 19621 - RNA, 19 nt, artificial
  Oligomer
aguaaauucaacagguugc

SEQ ID NO: 19622 - RNA, 19 nt, artificial
  Oligomer
uucccuguagauaugaucu

SEQ ID NO: 19623 - RNA, 19 nt, artificial
  Oligomer
aguuucauguuccaggugc

SEQ ID NO: 19624 - RNA, 19 nt, artificial
  Oligomer
ucuuucauugggagacagc

SEQ ID NO: 19625 - RNA, 19 nt, artificial
  Oligomer
uuugaacaacauaacuucc

SEQ ID NO: 19626 - RNA, 19 nt, artificial
  Oligomer
auuguuuccaggcaccaaa

SEQ ID NO: 19627 - RNA, 19 nt, artificial
  Oligomer
uacgccguggugaauuggu

SEQ ID NO: 19628 - RNA, 19 nt, artificial
  Oligomer
ucuggauagaugggaacuc

SEQ ID NO: 19629 - RNA, 19 nt, artificial
  Oligomer
uucugggaaugccucuuuc

SEQ ID NO: 19630 - RNA, 19 nt, artificial
  Oligomer
auaugaucuaucuuggauu

SEQ ID NO: 19631 - RNA, 19 nt, artificial
  Oligomer
ucugucuuugacgucagcu

SEQ ID NO: 19632 - RNA, 19 nt, artificial
  Oligomer
ucaucggugucuuuuuugc

SEQ ID NO: 19633 - RNA, 19 nt, artificial
  Oligomer
aaccucauccacuuuaacc

SEQ ID NO: 19634 - RNA, 19 nt, artificial
  Oligomer
cuaacuagaacaauuaugg

SEQ ID NO: 19635 - RNA, 19 nt, artificial
  Oligomer
aucuaaggcgguuggucac

SEQ ID NO: 19636 - RNA, 19 nt, artificial
  Oligomer
ucuuccagccuuuccaugu

SEQ ID NO: 19637 - RNA, 19 nt, artificial
  Oligomer
ccuuuaaucaauuucccac

SEQ ID NO: 19638 - RNA, 19 nt, artificial
  Oligomer
cuuuaaucaauuucccacu

SEQ ID NO: 19639 - RNA, 19 nt, artificial
  Oligomer
uugcugaugagggaauugu

SEQ ID NO: 19640 - RNA, 19 nt, artificial
  Oligomer
uugccguccaaaucucugu

SEQ ID NO: 19641 - RNA, 19 nt, artificial
  Oligomer
ucuucaaugaaagcagugg

SEQ ID NO: 19642 - RNA, 19 nt, artificial
  Oligomer
uccaaaucucuguccaccu

SEQ ID NO: 19643 - RNA, 19 nt, artificial
  Oligomer
aauauccucaugguaucgg

SEQ ID NO: 19644 - RNA, 19 nt, artificial
  Oligomer
acuugauauuguuuccagg

SEQ ID NO: 19645 - RNA, 19 nt, artificial
  Oligomer
uagcucuuccuuucuuccu

SEQ ID NO: 19646 - RNA, 19 nt, artificial
  Oligomer
cugagggacaaguucuucc

SEQ ID NO: 19647 - RNA, 19 nt, artificial
  Oligomer
cuuuauccuaucaucacug

SEQ ID NO: 19648 - RNA, 19 nt, artificial
  Oligomer
uccuccagcaguuccacuu

SEQ ID NO: 19649 - RNA, 19 nt, artificial
  Oligomer
auuggauggguucauguca

SEQ ID NO: 19650 - RNA, 19 nt, artificial
  Oligomer
ugaggugcacuucaucagg

SEQ ID NO: 19651 - RNA, 19 nt, artificial
  Oligomer
uuucuaacuagaacaauua

SEQ ID NO: 19652 - RNA, 19 nt, artificial
  Oligomer
uuugcucucuucaaugaag

SEQ ID NO: 19653 - RNA, 19 nt, artificial
  Oligomer
uaggauuucuugucucuuu

SEQ ID NO: 19654 - RNA, 19 nt, artificial
  Oligomer
uaacauuuaauccauucau

SEQ ID NO: 19655 - RNA, 19 nt, artificial
  Oligomer
aagagcuguccuuuugugc

SEQ ID NO: 19656 - RNA, 19 nt, artificial
  Oligomer
uaaggcgguuggucacuuc

SEQ ID NO: 19657 - RNA, 19 nt, artificial
  Oligomer
uccaaagcuauaaaggauu

SEQ ID NO: 19658 - RNA, 19 nt, artificial
  Oligomer
uucccuucaggauuagaag

SEQ ID NO: 19659 - RNA, 19 nt, artificial
  Oligomer
aaaugcagcaaauucuggg

SEQ ID NO: 19660 - RNA, 19 nt, artificial
  Oligomer
aacaguuuccuucccuggg

SEQ ID NO: 19661 - RNA, 19 nt, artificial
  Oligomer
uaaaacuuuggagaucaac

SEQ ID NO: 19662 - RNA, 19 nt, artificial
  Oligomer
uucuugucucuuucuggga

SEQ ID NO: 19663 - RNA, 19 nt, artificial
  Oligomer
uuuuugggagucagaguag

SEQ ID NO: 19664 - RNA, 19 nt, artificial
  Oligomer
ugaauauggguuguugagg

SEQ ID NO: 19665 - RNA, 19 nt, artificial
  Oligomer
acgaacagaaaugacauug

SEQ ID NO: 19666 - RNA, 19 nt, artificial
  Oligomer
gauagaugggaacuccucc

SEQ ID NO: 19667 - RNA, 19 nt, artificial
  Oligomer
augugcuuaaugaaggacu

SEQ ID NO: 19668 - RNA, 19 nt, artificial
  Oligomer
auggacucagaucuaaggc

SEQ ID NO: 19669 - RNA, 19 nt, artificial
  Oligomer
cugaacaacaagauaugcc

SEQ ID NO: 19670 - RNA, 19 nt, artificial
  Oligomer
uaacagguuuaaaacuuug

SEQ ID NO: 19671 - RNA, 19 nt, artificial
  Oligomer
ugggauuaaaggaaggcag

SEQ ID NO: 19672 - RNA, 19 nt, artificial
  Oligomer
aaaguugucucugaggucg

SEQ ID NO: 19673 - RNA, 19 nt, artificial
  Oligomer
ucagugagaaccaccucag

SEQ ID NO: 19674 - RNA, 19 nt, artificial
  Oligomer
uccaggauauuguagcggg

SEQ ID NO: 19675 - RNA, 19 nt, artificial
  Oligomer
uguuggauaucaaauugcc

SEQ ID NO: 19676 - RNA, 19 nt, artificial
  Oligomer
acuguuuuccugagguggg

SEQ ID NO: 19677 - RNA, 19 nt, artificial
  Oligomer
ucgaauaccugcagcuugg

SEQ ID NO: 19678 - RNA, 19 nt, artificial
  Oligomer
aucuguggaagagugagca

SEQ ID NO: 19679 - RNA, 19 nt, artificial
  Oligomer
cagaguuucauguuccagg

SEQ ID NO: 19680 - RNA, 19 nt, artificial
  Oligomer
uuuccaugugggcuuugga

SEQ ID NO: 19681 - RNA, 19 nt, artificial
  Oligomer
aacagaaaugacauugggc

SEQ ID NO: 19682 - RNA, 19 nt, artificial
  Oligomer
ugcugaacaccgaacaugu

SEQ ID NO: 19683 - RNA, 19 nt, artificial
  Oligomer
aucacugaaacgaauuagc

SEQ ID NO: 19684 - RNA, 19 nt, artificial
  Oligomer
aaagguucagcagugucug

SEQ ID NO: 19685 - RNA, 19 nt, artificial
  Oligomer
uaucgguugucaucccuca

SEQ ID NO: 19686 - RNA, 19 nt, artificial
  Oligomer
ucugaguugaggguaacuu

SEQ ID NO: 19687 - RNA, 19 nt, artificial
  Oligomer
uucuccaugugcuuaauga

SEQ ID NO: 19688 - RNA, 19 nt, artificial
  Oligomer
uccuugagcaguucauugu

SEQ ID NO: 19689 - RNA, 19 nt, artificial
  Oligomer
cuauucucuggguaucuuc

SEQ ID NO: 19690 - RNA, 19 nt, artificial
  Oligomer
cucaugucuaaguucaucu

SEQ ID NO: 19691 - RNA, 19 nt, artificial
  Oligomer
uaaguagcuccucacccag

SEQ ID NO: 19692 - RNA, 19 nt, artificial
  Oligomer
agagcuguccuuuugugcg

SEQ ID NO: 19693 - RNA, 19 nt, artificial
  Oligomer
uucuagcugguaugggugg

SEQ ID NO: 19694 - RNA, 19 nt, artificial
  Oligomer
uuucuuccugcacagaguu

SEQ ID NO: 19695 - RNA, 19 nt, artificial
  Oligomer
uugacaugguuacagaugu

SEQ ID NO: 19696 - RNA, 19 nt, artificial
  Oligomer
uauaucuguggaagaguga

SEQ ID NO: 19697 - RNA, 19 nt, artificial
  Oligomer
ugccuuuccagacaugcgu

SEQ ID NO: 19698 - RNA, 19 nt, artificial
  Oligomer
uugcgauuugccugucucu

SEQ ID NO: 19699 - RNA, 19 nt, artificial
  Oligomer
uuuagcagacacccaaacu

SEQ ID NO: 19700 - RNA, 19 nt, artificial
  Oligomer
uaucucugugaacugcaca

SEQ ID NO: 19701 - RNA, 19 nt, artificial
  Oligomer
auagagaaccgcgauauug

SEQ ID NO: 19702 - RNA, 19 nt, artificial
  Oligomer
ucccucaucuucaggaucc

SEQ ID NO: 19703 - RNA, 19 nt, artificial
  Oligomer
uuccuccaggauauuguag

SEQ ID NO: 19704 - RNA, 19 nt, artificial
  Oligomer
ugacuugccguccaaaucu

SEQ ID NO: 19705 - RNA, 19 nt, artificial
  Oligomer
ugcuagcuucuugaagccg

SEQ ID NO: 19706 - RNA, 19 nt, artificial
  Oligomer
aacaacauaacuuccaggc

SEQ ID NO: 19707 - RNA, 19 nt, artificial
  Oligomer
uuuagggcucuggagguuu

SEQ ID NO: 19708 - RNA, 19 nt, artificial
  Oligomer
uaaaugcagcaaauucugg

SEQ ID NO: 19709 - RNA, 19 nt, artificial
  Oligomer
uugggauuaaaggaaggca

SEQ ID NO: 19710 - RNA, 19 nt, artificial
  Oligomer
ugggaggaaagcuacuagg

SEQ ID NO: 19711 - RNA, 19 nt, artificial
  Oligomer
agcuucuugaagccgaugg

SEQ ID NO: 19712 - RNA, 19 nt, artificial
  Oligomer
ucaaaaucuaaaugcagca

SEQ ID NO: 19713 - RNA, 19 nt, artificial
  Oligomer
cuuucauugggagacagcc

SEQ ID NO: 19714 - RNA, 19 nt, artificial
  Oligomer
uaguugaccgacuggauuu

SEQ ID NO: 19715 - RNA, 19 nt, artificial
  Oligomer
uuucaugcacccgugaguu

SEQ ID NO: 19716 - RNA, 19 nt, artificial
  Oligomer
ucacuuuaacagucuccug

SEQ ID NO: 19717 - RNA, 19 nt, artificial
  Oligomer
agcugauggaauaguagcg

SEQ ID NO: 19718 - RNA, 19 nt, artificial
  Oligomer
ucagucucccaguucuuga

SEQ ID NO: 19719 - RNA, 19 nt, artificial
  Oligomer
ucuuuagguucguaugaca

SEQ ID NO: 19720 - RNA, 19 nt, artificial
  Oligomer
cauaucuuucaucucugcc

SEQ ID NO: 19721 - RNA, 19 nt, artificial
  Oligomer
aagcuuuaacauuuaaucc

SEQ ID NO: 19722 - RNA, 19 nt, artificial
  Oligomer
augacuaggaaaaacugag

SEQ ID NO: 19723 - RNA, 19 nt, artificial
  Oligomer
uagggaggaauuacaccgg

SEQ ID NO: 19724 - RNA, 19 nt, artificial
  Oligomer
aauugguccuucuccaucu

SEQ ID NO: 19725 - RNA, 19 nt, artificial
  Oligomer
acagaaaugacauugggcu

SEQ ID NO: 19726 - RNA, 19 nt, artificial
  Oligomer
ucuuugacgucagcucagc

SEQ ID NO: 19727 - RNA, 19 nt, artificial
  Oligomer
agugggaagauccuuauug

SEQ ID NO: 19728 - RNA, 19 nt, artificial
  Oligomer
aaaacuuuggagaucaacu

SEQ ID NO: 19729 - RNA, 19 nt, artificial
  Oligomer
uccagguaguacuugaagg

SEQ ID NO: 19730 - RNA, 19 nt, artificial
  Oligomer
uucuuugaacaacauaacu

SEQ ID NO: 19731 - RNA, 19 nt, artificial
  Oligomer
uaugacauuaugacuagga

SEQ ID NO: 19732 - RNA, 19 nt, artificial
  Oligomer
uccuucucgcugguagcua

SEQ ID NO: 19733 - RNA, 19 nt, artificial
  Oligomer
uccuccaugguaacuagcu

SEQ ID NO: 19734 - RNA, 19 nt, artificial
  Oligomer
augcggaucagaucugagg

SEQ ID NO: 19735 - RNA, 19 nt, artificial
  Oligomer
uccuugagcugguaagugc

SEQ ID NO: 19736 - RNA, 19 nt, artificial
  Oligomer
uccuuuauccuaucaucac

SEQ ID NO: 19737 - RNA, 19 nt, artificial
  Oligomer
ugguccuucuccaucucga

SEQ ID NO: 19738 - RNA, 19 nt, artificial
  Oligomer
uaaauucaacagguugccu

SEQ ID NO: 19739 - RNA, 19 nt, artificial
  Oligomer
uuuucaauguugacaucau

SEQ ID NO: 19740 - RNA, 19 nt, artificial
  Oligomer
uuuccaaugugcucuuaag

SEQ ID NO: 19741 - RNA, 19 nt, artificial
  Oligomer
augucuaaguucaucuucu

SEQ ID NO: 19742 - RNA, 19 nt, artificial
  Oligomer
ugccucauuuccaucaaag

SEQ ID NO: 19743 - RNA, 19 nt, artificial
  Oligomer
aacaacaagauaugcccac

SEQ ID NO: 19744 - RNA, 19 nt, artificial
  Oligomer
uuugcaggaaaggaguuua

SEQ ID NO: 19745 - RNA, 19 nt, artificial
  Oligomer
uuccagccuuuccaugugg

SEQ ID NO: 19746 - RNA, 19 nt, artificial
  Oligomer
agaaccagcagaacauucc

SEQ ID NO: 19747 - RNA, 19 nt, artificial
  Oligomer
augucauauucuuccaugg

SEQ ID NO: 19748 - RNA, 19 nt, artificial
  Oligomer
ucgaucagggcauucacga

SEQ ID NO: 19749 - RNA, 19 nt, artificial
  Oligomer
auguuccaggugcacaaug

SEQ ID NO: 19750 - RNA, 19 nt, artificial
  Oligomer
aaggaagugaugguugacc

SEQ ID NO: 19751 - RNA, 19 nt, artificial
  Oligomer
ugaucaauaaacucuuugg

SEQ ID NO: 19752 - RNA, 19 nt, artificial
  Oligomer
gucauugaagacucggucg

SEQ ID NO: 19753 - RNA, 19 nt, artificial
  Oligomer
uggucaacaauggucacuu

SEQ ID NO: 19754 - RNA, 19 nt, artificial
  Oligomer
ugccuugaagaccuucuug

SEQ ID NO: 19755 - RNA, 19 nt, artificial
  Oligomer
uccaaugugcucuuaaggu

SEQ ID NO: 19756 - RNA, 19 nt, artificial
  Oligomer
uucaccucuuccagccuuu

SEQ ID NO: 19757 - RNA, 19 nt, artificial
  Oligomer
aaagcuuuaacauuuaauc

SEQ ID NO: 19758 - RNA, 19 nt, artificial
  Oligomer
uuguggacauuggauagac

SEQ ID NO: 19759 - RNA, 19 nt, artificial
  Oligomer
agaacauucccuuuccauc

SEQ ID NO: 19760 - RNA, 19 nt, artificial
  Oligomer
ucauguuccaggugcacaa

SEQ ID NO: 19761 - RNA, 19 nt, artificial
  Oligomer
ggugaauugguccuucucc

SEQ ID NO: 19762 - RNA, 19 nt, artificial
  Oligomer
uuuccaaccucauccacuu

SEQ ID NO: 19763 - RNA, 19 nt, artificial
  Oligomer
uaaguguuuguucuuuaua

SEQ ID NO: 19764 - RNA, 19 nt, artificial
  Oligomer
auaucuguggaagagugag

SEQ ID NO: 19765 - RNA, 19 nt, artificial
  Oligomer
auccggcugaugaauacgc

SEQ ID NO: 19766 - RNA, 19 nt, artificial
  Oligomer
cgaauuagcagugacgucc

SEQ ID NO: 19767 - RNA, 19 nt, artificial
  Oligomer
cggcaugugaggaucaaaa

SEQ ID NO: 19768 - RNA, 19 nt, artificial
  Oligomer
ccucauuccugcuuuaaaa

SEQ ID NO: 19769 - RNA, 19 nt, artificial
  Oligomer
ggguggaagcgguaacaaa

SEQ ID NO: 19770 - RNA, 19 nt, artificial
  Oligomer
cgguaacaaaggagauaga

SEQ ID NO: 19771 - RNA, 19 nt, artificial
  Oligomer
cgcucuucaugcugaaaga

SEQ ID NO: 19772 - RNA, 19 nt, artificial
  Oligomer
cuucaaagaggcaaaaaua

SEQ ID NO: 19773 - RNA, 19 nt, artificial
  Oligomer
gaagagagauuccauugaa

SEQ ID NO: 19774 - RNA, 19 nt, artificial
  Oligomer
guaacaaaggagauagaaa

SEQ ID NO: 19775 - RNA, 19 nt, artificial
  Oligomer
gaaagagcucaacaacaaa

SEQ ID NO: 19776 - RNA, 19 nt, artificial
  Oligomer
ggcaugugaggaucaaaaa

SEQ ID NO: 19777 - RNA, 19 nt, artificial
  Oligomer
gggaaagaagucuccagaa

SEQ ID NO: 19778 - RNA, 19 nt, artificial
  Oligomer
aagagagauuccauugaaa

SEQ ID NO: 19779 - RNA, 19 nt, artificial
  Oligomer
ccaccaguaugcaaugaau

SEQ ID NO: 19780 - RNA, 19 nt, artificial
  Oligomer
gguccauuaugacucccaa

SEQ ID NO: 19781 - RNA, 19 nt, artificial
  Oligomer
gggaaaaagacaucaacaa

SEQ ID NO: 19782 - RNA, 19 nt, artificial
  Oligomer
ccuucaaagaggcaaaaau

SEQ ID NO: 19783 - RNA, 19 nt, artificial
  Oligomer
gagauagaaacaacaggaa

SEQ ID NO: 19784 - RNA, 19 nt, artificial
  Oligomer
gccucauuccugcuuuaaa

SEQ ID NO: 19785 - RNA, 19 nt, artificial
  Oligomer
gccuuuggaccucagcaaa

SEQ ID NO: 19786 - RNA, 19 nt, artificial
  Oligomer
agaugagcuucuaccucaa

SEQ ID NO: 19787 - RNA, 19 nt, artificial
  Oligomer
cuuuguagcgagucgaaaa

SEQ ID NO: 19788 - RNA, 19 nt, artificial
  Oligomer
caacaacaauguggagaaa

SEQ ID NO: 19789 - RNA, 19 nt, artificial
  Oligomer
gugcguuacuccaccaaca

SEQ ID NO: 19790 - RNA, 19 nt, artificial
  Oligomer
cgccuuugcucaugacauu

SEQ ID NO: 19791 - RNA, 19 nt, artificial
  Oligomer
cauugaaagucuuggucaa

SEQ ID NO: 19792 - RNA, 19 nt, artificial
  Oligomer
ggagauagaaacaacagga

SEQ ID NO: 19793 - RNA, 19 nt, artificial
  Oligomer
ccuguaugcugaugcgcaa

SEQ ID NO: 19794 - RNA, 19 nt, artificial
  Oligomer
cuuggagacaaaaucuuaa

SEQ ID NO: 19795 - RNA, 19 nt, artificial
  Oligomer
cagguagaggccuggaaaa

SEQ ID NO: 19796 - RNA, 19 nt, artificial
  Oligomer
gcuccuucaaagaggcaaa

SEQ ID NO: 19797 - RNA, 19 nt, artificial
  Oligomer
ccagaagcgcuaucacgaa

SEQ ID NO: 19798 - RNA, 19 nt, artificial
  Oligomer
gcgggaugacuuuccaaga

SEQ ID NO: 19799 - RNA, 19 nt, artificial
  Oligomer
gguaacaaaggagauagaa

SEQ ID NO: 19800 - RNA, 19 nt, artificial
  Oligomer
cucuguauuuaaaaaacua

SEQ ID NO: 19801 - RNA, 19 nt, artificial
  Oligomer
cuuggaaauuucuguucaa

SEQ ID NO: 19802 - RNA, 19 nt, artificial
  Oligomer
cagaguacagcaaguggaa

SEQ ID NO: 19803 - RNA, 19 nt, artificial
  Oligomer
gcaauggagagaaacugaa

SEQ ID NO: 19804 - RNA, 19 nt, artificial
  Oligomer
gaagaacaucugagcucaa

SEQ ID NO: 19805 - RNA, 19 nt, artificial
  Oligomer
cagaauccuucaugaagua

SEQ ID NO: 19806 - RNA, 19 nt, artificial
  Oligomer
agaccaaauuccaccagua

SEQ ID NO: 19807 - RNA, 19 nt, artificial
  Oligomer
aaaggagauagaaacaaca

SEQ ID NO: 19808 - RNA, 19 nt, artificial
  Oligomer
ggagagaaacugaagaaau

SEQ ID NO: 19809 - RNA, 19 nt, artificial
  Oligomer
cgggaaagaagucuccaga

SEQ ID NO: 19810 - RNA, 19 nt, artificial
  Oligomer
cacggcaugugaggaucaa

SEQ ID NO: 19811 - RNA, 19 nt, artificial
  Oligomer
cagcgggaugacuuuccaa

SEQ ID NO: 19812 - RNA, 19 nt, artificial
  Oligomer
ccuuggagacaaaaucuua

SEQ ID NO: 19813 - RNA, 19 nt, artificial
  Oligomer
ccagauaagugacauaagu

SEQ ID NO: 19814 - RNA, 19 nt, artificial
  Oligomer
gcugagugcaccacuucaa

SEQ ID NO: 19815 - RNA, 19 nt, artificial
  Oligomer
gcugcagaauccuucauga

SEQ ID NO: 19816 - RNA, 19 nt, artificial
  Oligomer
ggcaauggagagaaacuga

SEQ ID NO: 19817 - RNA, 19 nt, artificial
  Oligomer
gacccugagcucuucgaaa

SEQ ID NO: 19818 - RNA, 19 nt, artificial
  Oligomer
cagccucauuccugcuuua

SEQ ID NO: 19819 - RNA, 19 nt, artificial
  Oligomer
ccaagaacguguucaccau

SEQ ID NO: 19820 - RNA, 19 nt, artificial
  Oligomer
aagcggagacccaagagaa

SEQ ID NO: 19821 - RNA, 19 nt, artificial
  Oligomer
guuugauguccgaggcaaa

SEQ ID NO: 19822 - RNA, 19 nt, artificial
  Oligomer
caauauuacggcuccuuca

SEQ ID NO: 19823 - RNA, 19 nt, artificial
  Oligomer
ggagauggaggaaagugau

SEQ ID NO: 19824 - RNA, 19 nt, artificial
  Oligomer
cacagaagagccugagaga

SEQ ID NO: 19825 - RNA, 19 nt, artificial
  Oligomer
ugcguuacuccaccaacaa

SEQ ID NO: 19826 - RNA, 19 nt, artificial
  Oligomer
caagcuaucgaauuuguca

SEQ ID NO: 19827 - RNA, 19 nt, artificial
  Oligomer
ugaaagagcucaacaacaa

SEQ ID NO: 19828 - RNA, 19 nt, artificial
  Oligomer
uguucaagaccaaauucca

SEQ ID NO: 19829 - RNA, 19 nt, artificial
  Oligomer
acggcaugugaggaucaaa

SEQ ID NO: 19830 - RNA, 19 nt, artificial
  Oligomer
aaaaagacaucaacaacaa

SEQ ID NO: 19831 - RNA, 19 nt, artificial
  Oligomer
agccuuuggaccucagcaa

SEQ ID NO: 19832 - RNA, 19 nt, artificial
  Oligomer
gaggcaaacagcacauuca

SEQ ID NO: 19833 - RNA, 19 nt, artificial
  Oligomer
gcaaguggaaguucaccaa

SEQ ID NO: 19834 - RNA, 19 nt, artificial
  Oligomer
ugcugaaagagcucaacaa

SEQ ID NO: 19835 - RNA, 19 nt, artificial
  Oligomer
aaucgcucuucaugcugaa

SEQ ID NO: 19836 - RNA, 19 nt, artificial
  Oligomer
cuuugcucaugacauugau

SEQ ID NO: 19837 - RNA, 19 nt, artificial
  Oligomer
guagcgagucgaaaacuga

SEQ ID NO: 19838 - RNA, 19 nt, artificial
  Oligomer
gggagauggaggaaaguga

SEQ ID NO: 19839 - RNA, 19 nt, artificial
  Oligomer
cagagacaggaaaaucaga

SEQ ID NO: 19840 - RNA, 19 nt, artificial
  Oligomer
aagugaccugcuuuguaaa

SEQ ID NO: 19841 - RNA, 19 nt, artificial
  Oligomer
ggcaaacagcacauucaga

SEQ ID NO: 19842 - RNA, 19 nt, artificial
  Oligomer
cgaauuugucaaccaauau

SEQ ID NO: 19843 - RNA, 19 nt, artificial
  Oligomer
acaggaaccuaccaacuga

SEQ ID NO: 19844 - RNA, 19 nt, artificial
  Oligomer
cugccggcacagaacuuaa

SEQ ID NO: 19845 - RNA, 19 nt, artificial
  Oligomer
cuacaaaguccgacaucca

SEQ ID NO: 19846 - RNA, 19 nt, artificial
  Oligomer
aauccuucaugaaguacau

SEQ ID NO: 19847 - RNA, 19 nt, artificial
  Oligomer
aggcugucguugagaucaa

SEQ ID NO: 19848 - RNA, 19 nt, artificial
  Oligomer
cugcagaauccuucaugaa

SEQ ID NO: 19849 - RNA, 19 nt, artificial
  Oligomer
uguucaccaugaggcucaa

SEQ ID NO: 19850 - RNA, 19 nt, artificial
  Oligomer
gcuacugggucagugacaa

SEQ ID NO: 19851 - RNA, 19 nt, artificial
  Oligomer
uggagauauuuacaugaau

SEQ ID NO: 19852 - RNA, 19 nt, artificial
  Oligomer
gcgccuuugcucaugacau

SEQ ID NO: 19853 - RNA, 19 nt, artificial
  Oligomer
agcugaaauugaaugagga

SEQ ID NO: 19854 - RNA, 19 nt, artificial
  Oligomer
gcguuacuccaccaacaau

SEQ ID NO: 19855 - RNA, 19 nt, artificial
  Oligomer
ugaaguacaugcagaauga

SEQ ID NO: 19856 - RNA, 19 nt, artificial
  Oligomer
gagucagagucaccauccu

SEQ ID NO: 19857 - RNA, 19 nt, artificial
  Oligomer
gaaguacaugcagaaugaa

SEQ ID NO: 19858 - RNA, 19 nt, artificial
  Oligomer
ggagauauuuacaugaauu

SEQ ID NO: 19859 - RNA, 19 nt, artificial
  Oligomer
aggcaaaaauagaggaaca

SEQ ID NO: 19860 - RNA, 19 nt, artificial
  Oligomer
ggcucaaaucucggcagaa

SEQ ID NO: 19861 - RNA, 19 nt, artificial
  Oligomer
ugcugaugcgcaagacaau

SEQ ID NO: 19862 - RNA, 19 nt, artificial
  Oligomer
ggaaagaagucuccagaau

SEQ ID NO: 19863 - RNA, 19 nt, artificial
  Oligomer
cagccugugagacguuuga

SEQ ID NO: 19864 - RNA, 19 nt, artificial
  Oligomer
accucagcaagcagcagaa

SEQ ID NO: 19865 - RNA, 19 nt, artificial
  Oligomer
aacuuuguagcgagucgaa

SEQ ID NO: 19866 - RNA, 19 nt, artificial
  Oligomer
ucaugaaguacaugcagaa

SEQ ID NO: 19867 - RNA, 19 nt, artificial
  Oligomer
gguacaugggcacagagau

SEQ ID NO: 19868 - RNA, 19 nt, artificial
  Oligomer
agcagaaugugaccaucau

SEQ ID NO: 19869 - RNA, 19 nt, artificial
  Oligomer
gaccaaauuccaccaguau

SEQ ID NO: 19870 - RNA, 19 nt, artificial
  Oligomer
augccucuguauuuaaaaa

SEQ ID NO: 19871 - RNA, 19 nt, artificial
  Oligomer
uaucgaauuugucaaccaa

SEQ ID NO: 19872 - RNA, 19 nt, artificial
  Oligomer
ugagcucaaauccagauaa

SEQ ID NO: 19873 - RNA, 19 nt, artificial
  Oligomer
uggagagaaacugaagaaa

SEQ ID NO: 19874 - RNA, 19 nt, artificial
  Oligomer
ggucgaggacuauuucuuu

SEQ ID NO: 19875 - RNA, 19 nt, artificial
  Oligomer
gacagagacaggaaaauca

SEQ ID NO: 19876 - RNA, 19 nt, artificial
  Oligomer
gcuacaacauccuggagga

SEQ ID NO: 19877 - RNA, 19 nt, artificial
  Oligomer
uucgggaacuggagcuaaa

SEQ ID NO: 19878 - RNA, 19 nt, artificial
  Oligomer
caaaggagauagaaacaac

SEQ ID NO: 19879 - RNA, 19 nt, artificial
  Oligomer
cguugagaucaacauugcu

SEQ ID NO: 19880 - RNA, 19 nt, artificial
  Oligomer
gagagauuccauugaaagu

SEQ ID NO: 19881 - RNA, 19 nt, artificial
  Oligomer
agguugucugcauggauaa

SEQ ID NO: 19882 - RNA, 19 nt, artificial
  Oligomer
cuccuucaaagaggcaaaa

SEQ ID NO: 19883 - RNA, 19 nt, artificial
  Oligomer
accaggagaugcugaacua

SEQ ID NO: 19884 - RNA, 19 nt, artificial
  Oligomer
ucgaauuugucaaccaaua

SEQ ID NO: 19885 - RNA, 19 nt, artificial
  Oligomer
ucaaagaggcaaaaauaga

SEQ ID NO: 19886 - RNA, 19 nt, artificial
  Oligomer
aagagaagagagauuccau

SEQ ID NO: 19887 - RNA, 19 nt, artificial
  Oligomer
ugaagaaaucgcucuucau

SEQ ID NO: 19888 - RNA, 19 nt, artificial
  Oligomer
cuggucccuuggagacaaa

SEQ ID NO: 19889 - RNA, 19 nt, artificial
  Oligomer
cccgggaaauguuugaaca

SEQ ID NO: 19890 - RNA, 19 nt, artificial
  Oligomer
aggaggagaugcuggagau

SEQ ID NO: 19891 - RNA, 19 nt, artificial
  Oligomer
uaagugaccugcuuuguaa

SEQ ID NO: 19892 - RNA, 19 nt, artificial
  Oligomer
cacagugaagaacaucuga

SEQ ID NO: 19893 - RNA, 19 nt, artificial
  Oligomer
gaagagccugagagacaga

SEQ ID NO: 19894 - RNA, 19 nt, artificial
  Oligomer
guccauuaugacucccaaa

SEQ ID NO: 19895 - RNA, 19 nt, artificial
  Oligomer
ccaagcucuacaccuccaa

SEQ ID NO: 19896 - RNA, 19 nt, artificial
  Oligomer
cucaaauccagauaaguga

SEQ ID NO: 19897 - RNA, 19 nt, artificial
  Oligomer
gaagcgguaacaaaggaga

SEQ ID NO: 19898 - RNA, 19 nt, artificial
  Oligomer
ucguggagacgggaaagaa

SEQ ID NO: 19899 - RNA, 19 nt, artificial
  Oligomer
gagcuucuaccucaagcua

SEQ ID NO: 19900 - RNA, 19 nt, artificial
  Oligomer
caagagaagagagauucca

SEQ ID NO: 19901 - RNA, 19 nt, artificial
  Oligomer
cgugcaaaccuucaaggca

SEQ ID NO: 19902 - RNA, 19 nt, artificial
  Oligomer
agaggcaaaaauagaggaa

SEQ ID NO: 19903 - RNA, 19 nt, artificial
  Oligomer
caagguugucugcauggau

SEQ ID NO: 19904 - RNA, 19 nt, artificial
  Oligomer
agugguuucgggaacugga

SEQ ID NO: 19905 - RNA, 19 nt, artificial
  Oligomer
gaagcgcuaucacgaagau

SEQ ID NO: 19906 - RNA, 19 nt, artificial
  Oligomer
cauaguuuccagaagcaga

SEQ ID NO: 19907 - RNA, 19 nt, artificial
  Oligomer
ccuucaugaaguacaugca

SEQ ID NO: 19908 - RNA, 19 nt, artificial
  Oligomer
aagcgguaacaaaggagau

SEQ ID NO: 19909 - RNA, 19 nt, artificial
  Oligomer
gagcucaaauccagauaag

SEQ ID NO: 19910 - RNA, 19 nt, artificial
  Oligomer
ucagguagaggccuggaaa

SEQ ID NO: 19911 - RNA, 19 nt, artificial
  Oligomer
uuaugccucuguauuuaaa

SEQ ID NO: 19912 - RNA, 19 nt, artificial
  Oligomer
aacaaaggagauagaaaca

SEQ ID NO: 19913 - RNA, 19 nt, artificial
  Oligomer
aguuauuuaugccucugua

SEQ ID NO: 19914 - RNA, 19 nt, artificial
  Oligomer
cucaugacauugaucagaa

SEQ ID NO: 19915 - RNA, 19 nt, artificial
  Oligomer
agagaagagagauuccauu

SEQ ID NO: 19916 - RNA, 19 nt, artificial
  Oligomer
cugaaagagcucaacaaca

SEQ ID NO: 19917 - RNA, 19 nt, artificial
  Oligomer
caaagaggcaaaaauagag

SEQ ID NO: 19918 - RNA, 19 nt, artificial
  Oligomer
aggagaugcugaacuacgu

SEQ ID NO: 19919 - RNA, 19 nt, artificial
  Oligomer
agcccaaggucuauguuca

SEQ ID NO: 19920 - RNA, 19 nt, artificial
  Oligomer
gcagaauccuucaugaagu

SEQ ID NO: 19921 - RNA, 19 nt, artificial
  Oligomer
gggucuucccuguaugauu

SEQ ID NO: 19922 - RNA, 19 nt, artificial
  Oligomer
ggucccuuggagacaaaau

SEQ ID NO: 19923 - RNA, 19 nt, artificial
  Oligomer
agauaagugacauaaguga

SEQ ID NO: 19924 - RNA, 19 nt, artificial
  Oligomer
cgaggacuauuucuuucag

SEQ ID NO: 19925 - RNA, 19 nt, artificial
  Oligomer
gaaaaagacaucaacaaca

SEQ ID NO: 19926 - RNA, 19 nt, artificial
  Oligomer
cuccagaaucucuggucaa

SEQ ID NO: 19927 - RNA, 19 nt, artificial
  Oligomer
gaaucuacaaaguccgaca

SEQ ID NO: 19928 - RNA, 19 nt, artificial
  Oligomer
ccucuuugcgacagagaca

SEQ ID NO: 19929 - RNA, 19 nt, artificial
  Oligomer
cagaagagccugagagaca

SEQ ID NO: 19930 - RNA, 19 nt, artificial
  Oligomer
cuuacgaggcgaagaagga

SEQ ID NO: 19931 - RNA, 19 nt, artificial
  Oligomer
caucaagcccuuuacuuga

SEQ ID NO: 19932 - RNA, 19 nt, artificial
  Oligomer
cuaccucaagcuaucgaau

SEQ ID NO: 19933 - RNA, 19 nt, artificial
  Oligomer
uaugccucuguauuuaaaa

SEQ ID NO: 19934 - RNA, 19 nt, artificial
  Oligomer
acuauuucuuucagcucaa

SEQ ID NO: 19935 - RNA, 19 nt, artificial
  Oligomer
aauccagauaagugacaua

SEQ ID NO: 19936 - RNA, 19 nt, artificial
  Oligomer
gcagagaacucagccucau

SEQ ID NO: 19937 - RNA, 19 nt, artificial
  Oligomer
uuggagacaaaaucuuaaa

SEQ ID NO: 19938 - RNA, 19 nt, artificial
  Oligomer
cacagaacuuaaggaugga

SEQ ID NO: 19939 - RNA, 19 nt, artificial
  Oligomer
aagcuaucgaauuugucaa

SEQ ID NO: 19940 - RNA, 19 nt, artificial
  Oligomer
aguacaugcagaaugaaua

SEQ ID NO: 19941 - RNA, 19 nt, artificial
  Oligomer
aauuucuguucaagaccaa

SEQ ID NO: 19942 - RNA, 19 nt, artificial
  Oligomer
auggagagaaacugaagaa

SEQ ID NO: 19943 - RNA, 19 nt, artificial
  Oligomer
gggaugacuuuccaagaca

SEQ ID NO: 19944 - RNA, 19 nt, artificial
  Oligomer
caagcucuacaccuccaau

SEQ ID NO: 19945 - RNA, 19 nt, artificial
  Oligomer
cagagaacucagccucauu

SEQ ID NO: 19946 - RNA, 19 nt, artificial
  Oligomer
aaguggaaguucaccaaca

SEQ ID NO: 19947 - RNA, 19 nt, artificial
  Oligomer
agauaucuuuggugcugua

SEQ ID NO: 19948 - RNA, 19 nt, artificial
  Oligomer
ucagcaagcagcagaauga

SEQ ID NO: 19949 - RNA, 19 nt, artificial
  Oligomer
cugaagaaaucgcucuuca

SEQ ID NO: 19950 - RNA, 19 nt, artificial
  Oligomer
gguggaagcgguaacaaag

SEQ ID NO: 19951 - RNA, 19 nt, artificial
  Oligomer
aaagggauuuuaacuugca

SEQ ID NO: 19952 - RNA, 19 nt, artificial
  Oligomer
cccuuuacuugaccuccua

SEQ ID NO: 19953 - RNA, 19 nt, artificial
  Oligomer
caccugaccuugugcuuga

SEQ ID NO: 19954 - RNA, 19 nt, artificial
  Oligomer
agcgguaacaaaggagaua

SEQ ID NO: 19955 - RNA, 19 nt, artificial
  Oligomer
cguuugauguccgaggcaa

SEQ ID NO: 19956 - RNA, 19 nt, artificial
  Oligomer
agaacaucugagcucaaau

SEQ ID NO: 19957 - RNA, 19 nt, artificial
  Oligomer
ugaccaucauggaccacca

SEQ ID NO: 19958 - RNA, 19 nt, artificial
  Oligomer
ucaacaacaauguggagaa

SEQ ID NO: 19959 - RNA, 19 nt, artificial
  Oligomer
cgggaacuggagcuaaagu

SEQ ID NO: 19960 - RNA, 19 nt, artificial
  Oligomer
gagagaaacugaagaaauc

SEQ ID NO: 19961 - RNA, 19 nt, artificial
  Oligomer
aguucuagacagucccgaa

SEQ ID NO: 19962 - RNA, 19 nt, artificial
  Oligomer
agacccaagagaagagaga

SEQ ID NO: 19963 - RNA, 19 nt, artificial
  Oligomer
gacccaagagaagagagau

SEQ ID NO: 19964 - RNA, 19 nt, artificial
  Oligomer
cauuaugacucccaaaagu

SEQ ID NO: 19965 - RNA, 19 nt, artificial
  Oligomer
auggagauauuuacaugaa

SEQ ID NO: 19966 - RNA, 19 nt, artificial
  Oligomer
uggaagcgguaacaaagga

SEQ ID NO: 19967 - RNA, 19 nt, artificial
  Oligomer
ccggcacagaacuuaagga

SEQ ID NO: 19968 - RNA, 19 nt, artificial
  Oligomer
ccucuguauuuaaaaaacu

SEQ ID NO: 19969 - RNA, 19 nt, artificial
  Oligomer
cccuccagaugagcuucua

SEQ ID NO: 19970 - RNA, 19 nt, artificial
  Oligomer
gagauggaggaaagugaua

SEQ ID NO: 19971 - RNA, 19 nt, artificial
  Oligomer
ccauccucuuugcgacaga

SEQ ID NO: 19972 - RNA, 19 nt, artificial
  Oligomer
aaucucuggucaagcugga

SEQ ID NO: 19973 - RNA, 19 nt, artificial
  Oligomer
aggagaaugggccuggaaa

SEQ ID NO: 19974 - RNA, 19 nt, artificial
  Oligomer
acaggaugaccuucaguau

SEQ ID NO: 19975 - RNA, 19 nt, artificial
  Oligomer
auaguuuccagaagcagaa

SEQ ID NO: 19976 - RNA, 19 nt, artificial
  Oligomer
gauggagauauuuacauga

SEQ ID NO: 19977 - RNA, 19 nt, artificial
  Oligomer
ugcgacagagacaggaaaa

SEQ ID NO: 19978 - RNA, 19 nt, artificial
  Oligomer
ugacccugagcucuucgaa

SEQ ID NO: 19979 - RNA, 19 nt, artificial
  Oligomer
aauauuacggcuccuucaa

SEQ ID NO: 19980 - RNA, 19 nt, artificial
  Oligomer
acaucugagcucaaaucca

SEQ ID NO: 19981 - RNA, 19 nt, artificial
  Oligomer
acuuuguagcgagucgaaa

SEQ ID NO: 19982 - RNA, 19 nt, artificial
  Oligomer
cagaaucuacaaaguccga

SEQ ID NO: 19983 - RNA, 19 nt, artificial
  Oligomer
ccuacuuccuggacaucac

SEQ ID NO: 19984 - RNA, 19 nt, artificial
  Oligomer
aggguggaagcgguaacaa

SEQ ID NO: 19985 - RNA, 19 nt, artificial
  Oligomer
ccauggaacaucccaaaua

SEQ ID NO: 19986 - RNA, 19 nt, artificial
  Oligomer
uggaaauuucuguucaaga

SEQ ID NO: 19987 - RNA, 19 nt, artificial
  Oligomer
ucggcagaaucuacaaagu

SEQ ID NO: 19988 - RNA, 19 nt, artificial
  Oligomer
uugucugcauggauaagua

SEQ ID NO: 19989 - RNA, 19 nt, artificial
  Oligomer
cacaggaugaccuucagua

SEQ ID NO: 19990 - RNA, 19 nt, artificial
  Oligomer
ucaccuacuuccuggacau

SEQ ID NO: 19991 - RNA, 19 nt, artificial
  Oligomer
ggaacucuccugugaggau

SEQ ID NO: 19992 - RNA, 19 nt, artificial
  Oligomer
ccguguuucaccaggagau

SEQ ID NO: 19993 - RNA, 19 nt, artificial
  Oligomer
aagguugucugcauggaua

SEQ ID NO: 19994 - RNA, 19 nt, artificial
  Oligomer
ugcugagugcaccacuuca

SEQ ID NO: 19995 - RNA, 19 nt, artificial
  Oligomer
cagaugaggaccacaucua

SEQ ID NO: 19996 - RNA, 19 nt, artificial
  Oligomer
ggcuccuucaaagaggcaa

SEQ ID NO: 19997 - RNA, 19 nt, artificial
  Oligomer
cuugauggagauauuuaca

SEQ ID NO: 19998 - RNA, 19 nt, artificial
  Oligomer
ugccucuguauuuaaaaaa

SEQ ID NO: 19999 - RNA, 19 nt, artificial
  Oligomer
ccagcucugcauuaucuga

SEQ ID NO: 20000 - RNA, 19 nt, artificial
  Oligomer
augcugaugcgcaagacaa

SEQ ID NO: 20001 - RNA, 19 nt, artificial
  Oligomer
ggaugaccuucaguaucac

SEQ ID NO: 20002 - RNA, 19 nt, artificial
  Oligomer
cucuacaccuccaauguga

SEQ ID NO: 20003 - RNA, 19 nt, artificial
  Oligomer
auauuacggcuccuucaaa

SEQ ID NO: 20004 - RNA, 19 nt, artificial
  Oligomer
gcucaaaucucggcagaau

SEQ ID NO: 20005 - RNA, 19 nt, artificial
  Oligomer
cagaugagcuucuaccuca

SEQ ID NO: 20006 - RNA, 19 nt, artificial
  Oligomer
cauuccuggaggugcuaga

SEQ ID NO: 20007 - RNA, 19 nt, artificial
  Oligomer
cggcacagaacuuaaggau

SEQ ID NO: 20008 - RNA, 19 nt, artificial
  Oligomer
gauauuuacaugaauugca

SEQ ID NO: 20009 - RNA, 19 nt, artificial
  Oligomer
ccuugauggagauauuuac

SEQ ID NO: 20010 - RNA, 19 nt, artificial
  Oligomer
ucuaccucaagcuaucgaa

SEQ ID NO: 20011 - RNA, 19 nt, artificial
  Oligomer
acaaaggagauagaaacaa

SEQ ID NO: 20012 - RNA, 19 nt, artificial
  Oligomer
aagaacaucugagcucaaa

SEQ ID NO: 20013 - RNA, 19 nt, artificial
  Oligomer
ccaugaggcucaaaucucg

SEQ ID NO: 20014 - RNA, 19 nt, artificial
  Oligomer
ggcaaaaauagaggaacau

SEQ ID NO: 20015 - RNA, 19 nt, artificial
  Oligomer
gauggaacuugcugcugag

SEQ ID NO: 20016 - RNA, 19 nt, artificial
  Oligomer
caaauuccaccaguaugca

SEQ ID NO: 20017 - RNA, 19 nt, artificial
  Oligomer
ccuuuacuugaccuccuaa

SEQ ID NO: 20018 - RNA, 19 nt, artificial
  Oligomer
auauuuacaugaauugcau

SEQ ID NO: 20019 - RNA, 19 nt, artificial
  Oligomer
aggcaaacagcacauucag

SEQ ID NO: 20020 - RNA, 19 nt, artificial
  Oligomer
cgggagaugagcucaucuu

SEQ ID NO: 20021 - RNA, 19 nt, artificial
  Oligomer
cugagcucaaauccagaua

SEQ ID NO: 20022 - RNA, 19 nt, artificial
  Oligomer
ggagacccaagagaagaga

SEQ ID NO: 20023 - RNA, 19 nt, artificial
  Oligomer
gguggugaccaguacguuu

SEQ ID NO: 20024 - RNA, 19 nt, artificial
  Oligomer
acaucaacaacaaugugga

SEQ ID NO: 20025 - RNA, 19 nt, artificial
  Oligomer
aguggaaguucaccaacag

SEQ ID NO: 20026 - RNA, 19 nt, artificial
  Oligomer
aaauuccaccaguaugcaa

SEQ ID NO: 20027 - RNA, 19 nt, artificial
  Oligomer
ccaagguugucugcaugga

SEQ ID NO: 20028 - RNA, 19 nt, artificial
  Oligomer
agcgcuacaacauccugga

SEQ ID NO: 20029 - RNA, 19 nt, artificial
  Oligomer
caacauugcugugcuccau

SEQ ID NO: 20030 - RNA, 19 nt, artificial
  Oligomer
aucucggcagaaucuacaa

SEQ ID NO: 20031 - RNA, 19 nt, artificial
  Oligomer
cagcaagcagcagaaugag

SEQ ID NO: 20032 - RNA, 19 nt, artificial
  Oligomer
cuaucgaauuugucaacca

SEQ ID NO: 20033 - RNA, 19 nt, artificial
  Oligomer
cagaaucucuggucaagcu

SEQ ID NO: 20034 - RNA, 19 nt, artificial
  Oligomer
ccuuggaaauuucuguuca

SEQ ID NO: 20035 - RNA, 19 nt, artificial
  Oligomer
aacuggagcuaaaguggua

SEQ ID NO: 20036 - RNA, 19 nt, artificial
  Oligomer
aggaugaccuucaguauca

SEQ ID NO: 20037 - RNA, 19 nt, artificial
  Oligomer
uaacaaguagcacccugga

SEQ ID NO: 20038 - RNA, 19 nt, artificial
  Oligomer
uguggaaugcucagcucau

SEQ ID NO: 20039 - RNA, 19 nt, artificial
  Oligomer
gccucuguauuuaaaaaac

SEQ ID NO: 20040 - RNA, 19 nt, artificial
  Oligomer
gcuucuaccucaagcuauc

SEQ ID NO: 20041 - RNA, 19 nt, artificial
  Oligomer
gaugaccuucaguaucaca

SEQ ID NO: 20042 - RNA, 19 nt, artificial
  Oligomer
aucugagcucaaauccaga

SEQ ID NO: 20043 - RNA, 19 nt, artificial
  Oligomer
accucaagcuaucgaauuu

SEQ ID NO: 20044 - RNA, 19 nt, artificial
  Oligomer
uugcgacagagacaggaaa

SEQ ID NO: 20045 - RNA, 19 nt, artificial
  Oligomer
ccaacaugcugcuugaggu

SEQ ID NO: 20046 - RNA, 19 nt, artificial
  Oligomer
cauggaacaucccaaauac

SEQ ID NO: 20047 - RNA, 19 nt, artificial
  Oligomer
cucauuccugcuuuaaaau

SEQ ID NO: 20048 - RNA, 19 nt, artificial
  Oligomer
cggcugcagaauccuucau

SEQ ID NO: 20049 - RNA, 19 nt, artificial
  Oligomer
caguaucacaaccucagca

SEQ ID NO: 20050 - RNA, 19 nt, artificial
  Oligomer
agcucaaauccagauaagu

SEQ ID NO: 20051 - RNA, 19 nt, artificial
  Oligomer
gcgacagagacaggaaaau

SEQ ID NO: 20052 - RNA, 19 nt, artificial
  Oligomer
aaacaacaggaaccuacca

SEQ ID NO: 20053 - RNA, 19 nt, artificial
  Oligomer
uauucagcugugccuucaa

SEQ ID NO: 20054 - RNA, 19 nt, artificial
  Oligomer
ggaugacuuuccaagacac

SEQ ID NO: 20055 - RNA, 19 nt, artificial
  Oligomer
agaagagagauuccauuga

SEQ ID NO: 20056 - RNA, 19 nt, artificial
  Oligomer
ggaaauuucuguucaagac

SEQ ID NO: 20057 - RNA, 19 nt, artificial
  Oligomer
uuccuuacgaggcgaagaa

SEQ ID NO: 20058 - RNA, 19 nt, artificial
  Oligomer
ccacuucaagugaccacca

SEQ ID NO: 20059 - RNA, 19 nt, artificial
  Oligomer
acaacauccuggaggaagu

SEQ ID NO: 20060 - RNA, 19 nt, artificial
  Oligomer
ucggcugcagaauccuuca

SEQ ID NO: 20061 - RNA, 19 nt, artificial
  Oligomer
ccgaaguucucaaggcaca

SEQ ID NO: 20062 - RNA, 19 nt, artificial
  Oligomer
uaaagcugccggcacagaa

SEQ ID NO: 20063 - RNA, 19 nt, artificial
  Oligomer
caauggagagaaacugaag

SEQ ID NO: 20064 - RNA, 19 nt, artificial
  Oligomer
aauggagagaaacugaaga

SEQ ID NO: 20065 - RNA, 19 nt, artificial
  Oligomer
ugguggaacucuccuguga

SEQ ID NO: 20066 - RNA, 19 nt, artificial
  Oligomer
cuucaguaucacaaccuca

SEQ ID NO: 20067 - RNA, 19 nt, artificial
  Oligomer
cccuguaugauuccuugau

SEQ ID NO: 20068 - RNA, 19 nt, artificial
  Oligomer
aggucuauguucaggacau

SEQ ID NO: 20069 - RNA, 19 nt, artificial
  Oligomer
caucugagcucaaauccag

SEQ ID NO: 20070 - RNA, 19 nt, artificial
  Oligomer
cucuuugccuguaugcuga

SEQ ID NO: 20071 - RNA, 19 nt, artificial
  Oligomer
gaauccuucaugaaguaca

SEQ ID NO: 20072 - RNA, 19 nt, artificial
  Oligomer
ccugguuugacuguccuua

SEQ ID NO: 20073 - RNA, 19 nt, artificial
  Oligomer
cucaagcuaucgaauuugu

SEQ ID NO: 20074 - RNA, 19 nt, artificial
  Oligomer
cuacaacauccuggaggaa

SEQ ID NO: 20075 - RNA, 19 nt, artificial
  Oligomer
cuucaagugaccaccagga

SEQ ID NO: 20076 - RNA, 19 nt, artificial
  Oligomer
cccuuggagacaaaaucuu

SEQ ID NO: 20077 - RNA, 19 nt, artificial
  Oligomer
aaagaagucuccagaaucu

SEQ ID NO: 20078 - RNA, 19 nt, artificial
  Oligomer
gcaaacagcacauucagau

SEQ ID NO: 20079 - RNA, 19 nt, artificial
  Oligomer
gacugggcaguucuagaca

SEQ ID NO: 20080 - RNA, 19 nt, artificial
  Oligomer
aaaagacaucaacaacaau

SEQ ID NO: 20081 - RNA, 19 nt, artificial
  Oligomer
cugagugcaccacuucaag

SEQ ID NO: 20082 - RNA, 19 nt, artificial
  Oligomer
caaaucucggcagaaucua

SEQ ID NO: 20083 - RNA, 19 nt, artificial
  Oligomer
ucaugcugaaagagcucaa

SEQ ID NO: 20084 - RNA, 19 nt, artificial
  Oligomer
uggucccuuggagacaaaa

SEQ ID NO: 20085 - RNA, 19 nt, artificial
  Oligomer
ccaagcugaaauugaauga

SEQ ID NO: 20086 - RNA, 19 nt, artificial
  Oligomer
ccaaggucuauguucagga

SEQ ID NO: 20087 - RNA, 19 nt, artificial
  Oligomer
cagagauccaccugacugu

SEQ ID NO: 20088 - RNA, 19 nt, artificial
  Oligomer
cuuccuggacaucaccaca

SEQ ID NO: 20089 - RNA, 19 nt, artificial
  Oligomer
gcgcuaucacgaagauauc

SEQ ID NO: 20090 - RNA, 19 nt, artificial
  Oligomer
uggagacaaaaucuuaaau

SEQ ID NO: 20091 - RNA, 19 nt, artificial
  Oligomer
cacagagauccaccugacu

SEQ ID NO: 20092 - RNA, 19 nt, artificial
  Oligomer
cgggaugacuuuccaagac

SEQ ID NO: 20093 - RNA, 19 nt, artificial
  Oligomer
gucucuuccugguuugacu

SEQ ID NO: 20094 - RNA, 19 nt, artificial
  Oligomer
cuaucacgaagauaucuuu

SEQ ID NO: 20095 - RNA, 19 nt, artificial
  Oligomer
cugucguugagaucaacau

SEQ ID NO: 20096 - RNA, 19 nt, artificial
  Oligomer
aggacucacagccuuugga

SEQ ID NO: 20097 - RNA, 19 nt, artificial
  Oligomer
uccuucaaagaggcaaaaa

SEQ ID NO: 20098 - RNA, 19 nt, artificial
  Oligomer
aguaucacaaccucagcaa

SEQ ID NO: 20099 - RNA, 19 nt, artificial
  Oligomer
ugagcucuucgaaauccca

SEQ ID NO: 20100 - RNA, 19 nt, artificial
  Oligomer
caagugggugaaagaugga

SEQ ID NO: 20101 - RNA, 19 nt, artificial
  Oligomer
caaccugcaggucuucgau

SEQ ID NO: 20102 - RNA, 19 nt, artificial
  Oligomer
agcgcuaucacgaagauau

SEQ ID NO: 20103 - RNA, 19 nt, artificial
  Oligomer
gaaagaccaggcugucguu

SEQ ID NO: 20104 - RNA, 19 nt, artificial
  Oligomer
cugggcaguucuagacagu

SEQ ID NO: 20105 - RNA, 19 nt, artificial
  Oligomer
caaaaauagaggaacaucu

SEQ ID NO: 20106 - RNA, 19 nt, artificial
  Oligomer
cagagucaccauccucuuu

SEQ ID NO: 20107 - RNA, 19 nt, artificial
  Oligomer
acuugcagguccaaaucuu

SEQ ID NO: 20108 - RNA, 19 nt, artificial
  Oligomer
aauuugucaaccaauauua

SEQ ID NO: 20109 - RNA, 19 nt, artificial
  Oligomer
caggaaccuaccaacugac

SEQ ID NO: 20110 - RNA, 19 nt, artificial
  Oligomer
gcaccacuucaagugacca

SEQ ID NO: 20111 - RNA, 19 nt, artificial
  Oligomer
ugagacguuugauguccga

SEQ ID NO: 20112 - RNA, 19 nt, artificial
  Oligomer
gcccaaggucuauguucag

SEQ ID NO: 20113 - RNA, 19 nt, artificial
  Oligomer
aggaccacaucuaccagga

SEQ ID NO: 20114 - RNA, 19 nt, artificial
  Oligomer
ugguacaugggcacagaga

SEQ ID NO: 20115 - RNA, 19 nt, artificial
  Oligomer
gugcuguauuuccuuacga

SEQ ID NO: 20116 - RNA, 19 nt, artificial
  Oligomer
uaacaaaggagauagaaac

SEQ ID NO: 20117 - RNA, 19 nt, artificial
  Oligomer
ccuuugcucaugacauuga

SEQ ID NO: 20118 - RNA, 19 nt, artificial
  Oligomer
cuguauuuaaaaaacuaac

SEQ ID NO: 20119 - RNA, 19 nt, artificial
  Oligomer
ggaaaaagacaucaacaac

SEQ ID NO: 20120 - RNA, 19 nt, artificial
  Oligomer
agaaugugaccaucaugga

SEQ ID NO: 20121 - RNA, 19 nt, artificial
  Oligomer
guggagacgggaaagaagu

SEQ ID NO: 20122 - RNA, 19 nt, artificial
  Oligomer
uuaacuugcagguccaaau

SEQ ID NO: 20123 - RNA, 19 nt, artificial
  Oligomer
uuacuugaccuccuaacaa

SEQ ID NO: 20124 - RNA, 19 nt, artificial
  Oligomer
acguguucaccaugaggcu

SEQ ID NO: 20125 - RNA, 19 nt, artificial
  Oligomer
cccagguucuacuccauca

SEQ ID NO: 20126 - RNA, 19 nt, artificial
  Oligomer
cugcccgggaaauguuuga

SEQ ID NO: 20127 - RNA, 19 nt, artificial
  Oligomer
cccucagaguacagcaagu

SEQ ID NO: 20128 - RNA, 19 nt, artificial
  Oligomer
guucaccaugaggcucaaa

SEQ ID NO: 20129 - RNA, 19 nt, artificial
  Oligomer
gaauuugucaaccaauauu

SEQ ID NO: 20130 - RNA, 19 nt, artificial
  Oligomer
aagaggcaaaaauagagga

SEQ ID NO: 20131 - RNA, 19 nt, artificial
  Oligomer
uugggucuucccuguauga

SEQ ID NO: 20132 - RNA, 19 nt, artificial
  Oligomer
ccauuaugacucccaaaag

SEQ ID NO: 20133 - RNA, 19 nt, artificial
  Oligomer
ggaacaucccaaauacgag

SEQ ID NO: 20134 - RNA, 19 nt, artificial
  Oligomer
agagagauuccauugaaag

SEQ ID NO: 20135 - RNA, 19 nt, artificial
  Oligomer
ucaugacauugaucagaag

SEQ ID NO: 20136 - RNA, 19 nt, artificial
  Oligomer
agaacguguucaccaugag

SEQ ID NO: 20137 - RNA, 19 nt, artificial
  Oligomer
uaugcugaugcgcaagaca

SEQ ID NO: 20138 - RNA, 19 nt, artificial
  Oligomer
acgugcguuacuccaccaa

SEQ ID NO: 20139 - RNA, 19 nt, artificial
  Oligomer
uggucaagcuggaugcaac

SEQ ID NO: 20140 - RNA, 19 nt, artificial
  Oligomer
gagcucaacaacaaauuca

SEQ ID NO: 20141 - RNA, 19 nt, artificial
  Oligomer
agcugcugcuccaaaagcu

SEQ ID NO: 20142 - RNA, 19 nt, artificial
  Oligomer
caccaugaggcucaaaucu

SEQ ID NO: 20143 - RNA, 19 nt, artificial
  Oligomer
ccuggaaaacccaugucug

SEQ ID NO: 20144 - RNA, 19 nt, artificial
  Oligomer
ugacgggagaugagcucau

SEQ ID NO: 20145 - RNA, 19 nt, artificial
  Oligomer
gcucaaauccagauaagug

SEQ ID NO: 20146 - RNA, 19 nt, artificial
  Oligomer
cguuacuccaccaacaaug

SEQ ID NO: 20147 - RNA, 19 nt, artificial
  Oligomer
cuugaccuccuaacaagua

SEQ ID NO: 20148 - RNA, 19 nt, artificial
  Oligomer
gcaggucgaggacuauuuc

SEQ ID NO: 20149 - RNA, 19 nt, artificial
  Oligomer
cuggucaagcuggaugcaa

SEQ ID NO: 20150 - RNA, 19 nt, artificial
  Oligomer
augaccuucaguaucacaa

SEQ ID NO: 20151 - RNA, 19 nt, artificial
  Oligomer
ugaccuucaguaucacaac

SEQ ID NO: 20152 - RNA, 19 nt, artificial
  Oligomer
agugcaccacuucaaguga

SEQ ID NO: 20153 - RNA, 19 nt, artificial
  Oligomer
caacaggaaccuaccaacu

SEQ ID NO: 20154 - RNA, 19 nt, artificial
  Oligomer
gacuauuucuuucagcuca

SEQ ID NO: 20155 - RNA, 19 nt, artificial
  Oligomer
ugaagaacaucugagcuca

SEQ ID NO: 20156 - RNA, 19 nt, artificial
  Oligomer
auuacggcuccuucaaaga

SEQ ID NO: 20157 - RNA, 19 nt, artificial
  Oligomer
gcaugugaggaucaaaaac

SEQ ID NO: 20158 - RNA, 19 nt, artificial
  Oligomer
auaagugaccugcuuugua

SEQ ID NO: 20159 - RNA, 19 nt, artificial
  Oligomer
ccagccucaagucuuauuu

SEQ ID NO: 20160 - RNA, 19 nt, artificial
  Oligomer
caucaacaacaauguggag

SEQ ID NO: 20161 - RNA, 19 nt, artificial
  Oligomer
agcccagguucuacuccau

SEQ ID NO: 20162 - RNA, 19 nt, artificial
  Oligomer
caccauccucuuugcgaca

SEQ ID NO: 20163 - RNA, 19 nt, artificial
  Oligomer
uagcgagucgaaaacugag

SEQ ID NO: 20164 - RNA, 19 nt, artificial
  Oligomer
cauugcugugcuccauagu

SEQ ID NO: 20165 - RNA, 19 nt, artificial
  Oligomer
uccaugacucccagcacaa

SEQ ID NO: 20166 - RNA, 19 nt, artificial
  Oligomer
auuuuaacuugcaggucca

SEQ ID NO: 20167 - RNA, 19 nt, artificial
  Oligomer
uccaccaguaugcaaugaa

SEQ ID NO: 20168 - RNA, 19 nt, artificial
  Oligomer
acaucuaccaggaggagau

SEQ ID NO: 20169 - RNA, 19 nt, artificial
  Oligomer
aagcgcuaucacgaagaua

SEQ ID NO: 20170 - RNA, 19 nt, artificial
  Oligomer
agauggaacuugcugcuga

SEQ ID NO: 20171 - RNA, 19 nt, artificial
  Oligomer
gagccuccucucucaaacu

SEQ ID NO: 20172 - RNA, 19 nt, artificial
  Oligomer
acaaccucagcaagcagca

SEQ ID NO: 20173 - RNA, 19 nt, artificial
  Oligomer
cgaaaucccaccugaccuu

SEQ ID NO: 20174 - RNA, 19 nt, artificial
  Oligomer
agaugaggaccacaucuac

SEQ ID NO: 20175 - RNA, 19 nt, artificial
  Oligomer
caugaaguacaugcagaau

SEQ ID NO: 20176 - RNA, 19 nt, artificial
  Oligomer
ugcgccuuugcucaugaca

SEQ ID NO: 20177 - RNA, 19 nt, artificial
  Oligomer
acccugagcucuucgaaau

SEQ ID NO: 20178 - RNA, 19 nt, artificial
  Oligomer
gacgggaaagaagucucca

SEQ ID NO: 20179 - RNA, 19 nt, artificial
  Oligomer
cugugcucuuugccuguau

SEQ ID NO: 20180 - RNA, 19 nt, artificial
  Oligomer
auuucuguucaagaccaaa

SEQ ID NO: 20181 - RNA, 19 nt, artificial
  Oligomer
gagauuccauugaaagucu

SEQ ID NO: 20182 - RNA, 19 nt, artificial
  Oligomer
cuaccaacugacgggagau

SEQ ID NO: 20183 - RNA, 19 nt, artificial
  Oligomer
ccgggaaauguuugaacac

SEQ ID NO: 20184 - RNA, 19 nt, artificial
  Oligomer
ccucagcaagcagcagaau

SEQ ID NO: 20185 - RNA, 19 nt, artificial
  Oligomer
gcuccauaguuuccagaag

SEQ ID NO: 20186 - RNA, 19 nt, artificial
  Oligomer
ucucggcagaaucuacaaa

SEQ ID NO: 20187 - RNA, 19 nt, artificial
  Oligomer
uuuaugccucuguauuuaa

SEQ ID NO: 20188 - RNA, 19 nt, artificial
  Oligomer
gcaugaccuugguguuugg

SEQ ID NO: 20189 - RNA, 19 nt, artificial
  Oligomer
agcucuacaccuccaaugu

SEQ ID NO: 20190 - RNA, 19 nt, artificial
  Oligomer
cuguugguggugaccagua

SEQ ID NO: 20191 - RNA, 19 nt, artificial
  Oligomer
cggcagaaucuacaaaguc

SEQ ID NO: 20192 - RNA, 19 nt, artificial
  Oligomer
caaauccagauaagugaca

SEQ ID NO: 20193 - RNA, 19 nt, artificial
  Oligomer
acuugaccuccuaacaagu

SEQ ID NO: 20194 - RNA, 19 nt, artificial
  Oligomer
cgaagauaucuuuggugcu

SEQ ID NO: 20195 - RNA, 19 nt, artificial
  Oligomer
agcuacugggucagugaca

SEQ ID NO: 20196 - RNA, 19 nt, artificial
  Oligomer
aggcucaaaucucggcaga

SEQ ID NO: 20197 - RNA, 19 nt, artificial
  Oligomer
agaagagccugagagacag

SEQ ID NO: 20198 - RNA, 19 nt, artificial
  Oligomer
ccaagagaagagagauucc

SEQ ID NO: 20199 - RNA, 19 nt, artificial
  Oligomer
auuccuugauggagauauu

SEQ ID NO: 20200 - RNA, 19 nt, artificial
  Oligomer
uccagauaagugacauaag

SEQ ID NO: 20201 - RNA, 19 nt, artificial
  Oligomer
uccauaguuuccagaagca

SEQ ID NO: 20202 - RNA, 19 nt, artificial
  Oligomer
agcccucagaguacagcaa

SEQ ID NO: 20203 - RNA, 19 nt, artificial
  Oligomer
ugacauaagugaccugcuu

SEQ ID NO: 20204 - RNA, 19 nt, artificial
  Oligomer
caggucgaggacuauuucu

SEQ ID NO: 20205 - RNA, 19 nt, artificial
  Oligomer
ugucguugagaucaacauu

SEQ ID NO: 20206 - RNA, 19 nt, artificial
  Oligomer
gaaacaacaggaaccuacc

SEQ ID NO: 20207 - RNA, 19 nt, artificial
  Oligomer
gcugaaauugaaugaggag

SEQ ID NO: 20208 - RNA, 19 nt, artificial
  Oligomer
guguggaaugcucagcuca

SEQ ID NO: 20209 - RNA, 19 nt, artificial
  Oligomer
aggucgaggacuauuucuu

SEQ ID NO: 20210 - RNA, 19 nt, artificial
  Oligomer
aagaacguguucaccauga

SEQ ID NO: 20211 - RNA, 19 nt, artificial
  Oligomer
cccagccucaagucuuauu

SEQ ID NO: 20212 - RNA, 19 nt, artificial
  Oligomer
agacacgugcguuacucca

SEQ ID NO: 20213 - RNA, 19 nt, artificial
  Oligomer
ggucaaagcugugcucuuu

SEQ ID NO: 20214 - RNA, 19 nt, artificial
  Oligomer
aaggagauagaaacaacag

SEQ ID NO: 20215 - RNA, 19 nt, artificial
  Oligomer
ugcucagcucauccgcuau

SEQ ID NO: 20216 - RNA, 19 nt, artificial
  Oligomer
gcucaugacauugaucaga

SEQ ID NO: 20217 - RNA, 19 nt, artificial
  Oligomer
cauuccugcuuuaaaaucu

SEQ ID NO: 20218 - RNA, 19 nt, artificial
  Oligomer
agcaggucgaggacuauuu

SEQ ID NO: 20219 - RNA, 19 nt, artificial
  Oligomer
guuauuuaugccucuguau

SEQ ID NO: 20220 - RNA, 19 nt, artificial
  Oligomer
gcugaaagagcucaacaac

SEQ ID NO: 20221 - RNA, 19 nt, artificial
  Oligomer
augugaccaucauggacca

SEQ ID NO: 20222 - RNA, 19 nt, artificial
  Oligomer
ucacgaagauaucuuuggu

SEQ ID NO: 20223 - RNA, 19 nt, artificial
  Oligomer
ucugcagacacgugcguua

SEQ ID NO: 20224 - RNA, 19 nt, artificial
  Oligomer
agcuucuaccucaagcuau

SEQ ID NO: 20225 - RNA, 19 nt, artificial
  Oligomer
ggcugucguugagaucaac

SEQ ID NO: 20226 - RNA, 19 nt, artificial
  Oligomer
agcucaacaacaaauucag

SEQ ID NO: 20227 - RNA, 19 nt, artificial
  Oligomer
ggaagcgguaacaaaggag

SEQ ID NO: 20228 - RNA, 19 nt, artificial
  Oligomer
ccagaugaggaccacaucu

SEQ ID NO: 20229 - RNA, 19 nt, artificial
  Oligomer
auacgagugguuucgggaa

SEQ ID NO: 20230 - RNA, 19 nt, artificial
  Oligomer
ucagagucaccauccucuu

SEQ ID NO: 20231 - RNA, 19 nt, artificial
  Oligomer
caagcccaaggucuauguu

SEQ ID NO: 20232 - RNA, 19 nt, artificial
  Oligomer
augcucagcucauccgcua

SEQ ID NO: 20233 - RNA, 19 nt, artificial
  Oligomer
ccuucaguaucacaaccuc

SEQ ID NO: 20234 - RNA, 19 nt, artificial
  Oligomer
cugguuugacuguccuuac

SEQ ID NO: 20235 - RNA, 19 nt, artificial
  Oligomer
uagaaacaacaggaaccua

SEQ ID NO: 20236 - RNA, 19 nt, artificial
  Oligomer
cacuugggucuucccugua

SEQ ID NO: 20237 - RNA, 19 nt, artificial
  Oligomer
gagucaccauccucuuugc

SEQ ID NO: 20238 - RNA, 19 nt, artificial
  Oligomer
cuauguucaggacauccug

SEQ ID NO: 20239 - RNA, 19 nt, artificial
  Oligomer
guucaagaccaaauuccac

SEQ ID NO: 20240 - RNA, 19 nt, artificial
  Oligomer
agccucauuccugcuuuaa

SEQ ID NO: 20241 - RNA, 19 nt, artificial
  Oligomer
augugaggaucaaaaacug

SEQ ID NO: 20242 - RNA, 19 nt, artificial
  Oligomer
aagguauccuggagcgagu

SEQ ID NO: 20243 - RNA, 19 nt, artificial
  Oligomer
ucuucgaaaucccaccuga

SEQ ID NO: 20244 - RNA, 19 nt, artificial
  Oligomer
aagcagaaugugaccauca

SEQ ID NO: 20245 - RNA, 19 nt, artificial
  Oligomer
gcgguaacaaaggagauag

SEQ ID NO: 20246 - RNA, 19 nt, artificial
  Oligomer
guagcacccuggauugauc

SEQ ID NO: 20247 - RNA, 19 nt, artificial
  Oligomer
gagcaggucgaggacuauu

SEQ ID NO: 20248 - RNA, 19 nt, artificial
  Oligomer
aacaacaggaaccuaccaa

SEQ ID NO: 20249 - RNA, 19 nt, artificial
  Oligomer
gccucaagucuuauuuccu

SEQ ID NO: 20250 - RNA, 19 nt, artificial
  Oligomer
ugguccaagguauccugga

SEQ ID NO: 20251 - RNA, 19 nt, artificial
  Oligomer
aucgaauuugucaaccaau

SEQ ID NO: 20252 - RNA, 19 nt, artificial
  Oligomer
ugagcuucuaccucaagcu

SEQ ID NO: 20253 - RNA, 19 nt, artificial
  Oligomer
aagggauuuuaacuugcag

SEQ ID NO: 20254 - RNA, 19 nt, artificial
  Oligomer
acguccagcgcuacaacau

SEQ ID NO: 20255 - RNA, 19 nt, artificial
  Oligomer
uucuguucaagaccaaauu

SEQ ID NO: 20256 - RNA, 19 nt, artificial
  Oligomer
aaauuucuguucaagacca

SEQ ID NO: 20257 - RNA, 19 nt, artificial
  Oligomer
ggugaaagauggaacuugc

SEQ ID NO: 20258 - RNA, 19 nt, artificial
  Oligomer
uucaaagaggcaaaaauag

SEQ ID NO: 20259 - RNA, 19 nt, artificial
  Oligomer
caaaaguuugaccagagga

SEQ ID NO: 20260 - RNA, 19 nt, artificial
  Oligomer
cuuuggugcuguauuuccu

SEQ ID NO: 20261 - RNA, 19 nt, artificial
  Oligomer
cgcuaucacgaagauaucu

SEQ ID NO: 20262 - RNA, 19 nt, artificial
  Oligomer
gcagaaugugaccaucaug

SEQ ID NO: 20263 - RNA, 19 nt, artificial
  Oligomer
ccaggagaugcugaacuac

SEQ ID NO: 20264 - RNA, 19 nt, artificial
  Oligomer
ccaacguggaauucacuca

SEQ ID NO: 20265 - RNA, 19 nt, artificial
  Oligomer
acagagacaggaaaaucag

SEQ ID NO: 20266 - RNA, 19 nt, artificial
  Oligomer
ccagguucuacuccaucag

SEQ ID NO: 20267 - RNA, 19 nt, artificial
  Oligomer
uuuugauccucacaugccg

SEQ ID NO: 20268 - RNA, 19 nt, artificial
  Oligomer
uuuuaaagcaggaaugagg

SEQ ID NO: 20269 - RNA, 19 nt, artificial
  Oligomer
uuuguuaccgcuuccaccc

SEQ ID NO: 20270 - RNA, 19 nt, artificial
  Oligomer
ucuaucuccuuuguuaccg

SEQ ID NO: 20271 - RNA, 19 nt, artificial
  Oligomer
ucuuucagcaugaagagcg

SEQ ID NO: 20272 - RNA, 19 nt, artificial
  Oligomer
uauuuuugccucuuugaag

SEQ ID NO: 20273 - RNA, 19 nt, artificial
  Oligomer
uucaauggaaucucucuuc

SEQ ID NO: 20274 - RNA, 19 nt, artificial
  Oligomer
uuucuaucuccuuuguuac

SEQ ID NO: 20275 - RNA, 19 nt, artificial
  Oligomer
uuuguuguugagcucuuuc

SEQ ID NO: 20276 - RNA, 19 nt, artificial
  Oligomer
uuuuugauccucacaugcc

SEQ ID NO: 20277 - RNA, 19 nt, artificial
  Oligomer
uucuggagacuucuuuccc

SEQ ID NO: 20278 - RNA, 19 nt, artificial
  Oligomer
uuucaauggaaucucucuu

SEQ ID NO: 20279 - RNA, 19 nt, artificial
  Oligomer
auucauugcauacuggugg

SEQ ID NO: 20280 - RNA, 19 nt, artificial
  Oligomer
uugggagucauaauggacc

SEQ ID NO: 20281 - RNA, 19 nt, artificial
  Oligomer
uuguugaugucuuuuuccc

SEQ ID NO: 20282 - RNA, 19 nt, artificial
  Oligomer
auuuuugccucuuugaagg

SEQ ID NO: 20283 - RNA, 19 nt, artificial
  Oligomer
uuccuguuguuucuaucuc

SEQ ID NO: 20284 - RNA, 19 nt, artificial
  Oligomer
uuuaaagcaggaaugaggc

SEQ ID NO: 20285 - RNA, 19 nt, artificial
  Oligomer
uuugcugagguccaaaggc

SEQ ID NO: 20286 - RNA, 19 nt, artificial
  Oligomer
uugagguagaagcucaucu

SEQ ID NO: 20287 - RNA, 19 nt, artificial
  Oligomer
uuuucgacucgcuacaaag

SEQ ID NO: 20288 - RNA, 19 nt, artificial
  Oligomer
uuucuccacauuguuguug

SEQ ID NO: 20289 - RNA, 19 nt, artificial
  Oligomer
uguugguggaguaacgcac

SEQ ID NO: 20290 - RNA, 19 nt, artificial
  Oligomer
aaugucaugagcaaaggcg

SEQ ID NO: 20291 - RNA, 19 nt, artificial
  Oligomer
uugaccaagacuuucaaug

SEQ ID NO: 20292 - RNA, 19 nt, artificial
  Oligomer
uccuguuguuucuaucucc

SEQ ID NO: 20293 - RNA, 19 nt, artificial
  Oligomer
uugcgcaucagcauacagg

SEQ ID NO: 20294 - RNA, 19 nt, artificial
  Oligomer
uuaagauuuugucuccaag

SEQ ID NO: 20295 - RNA, 19 nt, artificial
  Oligomer
uuuuccaggccucuaccug

SEQ ID NO: 20296 - RNA, 19 nt, artificial
  Oligomer
uuugccucuuugaaggagc

SEQ ID NO: 20297 - RNA, 19 nt, artificial
  Oligomer
uucgugauagcgcuucugg

SEQ ID NO: 20298 - RNA, 19 nt, artificial
  Oligomer
ucuuggaaagucaucccgc

SEQ ID NO: 20299 - RNA, 19 nt, artificial
  Oligomer
uucuaucuccuuuguuacc

SEQ ID NO: 20300 - RNA, 19 nt, artificial
  Oligomer
uaguuuuuuaaauacagag

SEQ ID NO: 20301 - RNA, 19 nt, artificial
  Oligomer
uugaacagaaauuuccaag

SEQ ID NO: 20302 - RNA, 19 nt, artificial
  Oligomer
uuccacuugcuguacucug

SEQ ID NO: 20303 - RNA, 19 nt, artificial
  Oligomer
uucaguuucucuccauugc

SEQ ID NO: 20304 - RNA, 19 nt, artificial
  Oligomer
uugagcucagauguucuuc

SEQ ID NO: 20305 - RNA, 19 nt, artificial
  Oligomer
uacuucaugaaggauucug

SEQ ID NO: 20306 - RNA, 19 nt, artificial
  Oligomer
uacugguggaauuuggucu

SEQ ID NO: 20307 - RNA, 19 nt, artificial
  Oligomer
uguuguuucuaucuccuuu

SEQ ID NO: 20308 - RNA, 19 nt, artificial
  Oligomer
auuucuucaguuucucucc

SEQ ID NO: 20309 - RNA, 19 nt, artificial
  Oligomer
ucuggagacuucuuucccg

SEQ ID NO: 20310 - RNA, 19 nt, artificial
  Oligomer
uugauccucacaugccgug

SEQ ID NO: 20311 - RNA, 19 nt, artificial
  Oligomer
uuggaaagucaucccgcug

SEQ ID NO: 20312 - RNA, 19 nt, artificial
  Oligomer
uaagauuuugucuccaagg

SEQ ID NO: 20313 - RNA, 19 nt, artificial
  Oligomer
acuuaugucacuuaucugg

SEQ ID NO: 20314 - RNA, 19 nt, artificial
  Oligomer
uugaaguggugcacucagc

SEQ ID NO: 20315 - RNA, 19 nt, artificial
  Oligomer
ucaugaaggauucugcagc

SEQ ID NO: 20316 - RNA, 19 nt, artificial
  Oligomer
ucaguuucucuccauugcc

SEQ ID NO: 20317 - RNA, 19 nt, artificial
  Oligomer
uuucgaagagcucaggguc

SEQ ID NO: 20318 - RNA, 19 nt, artificial
  Oligomer
uaaagcaggaaugaggcug

SEQ ID NO: 20319 - RNA, 19 nt, artificial
  Oligomer
auggugaacacguucuugg

SEQ ID NO: 20320 - RNA, 19 nt, artificial
  Oligomer
uucucuugggucuccgcuu

SEQ ID NO: 20321 - RNA, 19 nt, artificial
  Oligomer
uuugccucggacaucaaac

SEQ ID NO: 20322 - RNA, 19 nt, artificial
  Oligomer
ugaaggagccguaauauug

SEQ ID NO: 20323 - RNA, 19 nt, artificial
  Oligomer
aucacuuuccuccaucucc

SEQ ID NO: 20324 - RNA, 19 nt, artificial
  Oligomer
ucucucaggcucuucugug

SEQ ID NO: 20325 - RNA, 19 nt, artificial
  Oligomer
uuguugguggaguaacgca

SEQ ID NO: 20326 - RNA, 19 nt, artificial
  Oligomer
ugacaaauucgauagcuug

SEQ ID NO: 20327 - RNA, 19 nt, artificial
  Oligomer
uuguuguugagcucuuuca

SEQ ID NO: 20328 - RNA, 19 nt, artificial
  Oligomer
uggaauuuggucuugaaca

SEQ ID NO: 20329 - RNA, 19 nt, artificial
  Oligomer
uuugauccucacaugccgu

SEQ ID NO: 20330 - RNA, 19 nt, artificial
  Oligomer
uuguuguugaugucuuuuu

SEQ ID NO: 20331 - RNA, 19 nt, artificial
  Oligomer
uugcugagguccaaaggcu

SEQ ID NO: 20332 - RNA, 19 nt, artificial
  Oligomer
ugaaugugcuguuugccuc

SEQ ID NO: 20333 - RNA, 19 nt, artificial
  Oligomer
uuggugaacuuccacuugc

SEQ ID NO: 20334 - RNA, 19 nt, artificial
  Oligomer
uuguugagcucuuucagca

SEQ ID NO: 20335 - RNA, 19 nt, artificial
  Oligomer
uucagcaugaagagcgauu

SEQ ID NO: 20336 - RNA, 19 nt, artificial
  Oligomer
aucaaugucaugagcaaag

SEQ ID NO: 20337 - RNA, 19 nt, artificial
  Oligomer
ucaguuuucgacucgcuac

SEQ ID NO: 20338 - RNA, 19 nt, artificial
  Oligomer
ucacuuuccuccaucuccc

SEQ ID NO: 20339 - RNA, 19 nt, artificial
  Oligomer
ucugauuuuccugucucug

SEQ ID NO: 20340 - RNA, 19 nt, artificial
  Oligomer
uuuacaaagcaggucacuu

SEQ ID NO: 20341 - RNA, 19 nt, artificial
  Oligomer
ucugaaugugcuguuugcc

SEQ ID NO: 20342 - RNA, 19 nt, artificial
  Oligomer
auauugguugacaaauucg

SEQ ID NO: 20343 - RNA, 19 nt, artificial
  Oligomer
ucaguugguagguuccugu

SEQ ID NO: 20344 - RNA, 19 nt, artificial
  Oligomer
uuaaguucugugccggcag

SEQ ID NO: 20345 - RNA, 19 nt, artificial
  Oligomer
uggaugucggacuuuguag

SEQ ID NO: 20346 - RNA, 19 nt, artificial
  Oligomer
auguacuucaugaaggauu

SEQ ID NO: 20347 - RNA, 19 nt, artificial
  Oligomer
uugaucucaacgacagccu

SEQ ID NO: 20348 - RNA, 19 nt, artificial
  Oligomer
uucaugaaggauucugcag

SEQ ID NO: 20349 - RNA, 19 nt, artificial
  Oligomer
uugagccucauggugaaca

SEQ ID NO: 20350 - RNA, 19 nt, artificial
  Oligomer
uugucacugacccaguagc

SEQ ID NO: 20351 - RNA, 19 nt, artificial
  Oligomer
auucauguaaauaucucca

SEQ ID NO: 20352 - RNA, 19 nt, artificial
  Oligomer
augucaugagcaaaggcgc

SEQ ID NO: 20353 - RNA, 19 nt, artificial
  Oligomer
uccucauucaauuucagcu

SEQ ID NO: 20354 - RNA, 19 nt, artificial
  Oligomer
auuguugguggaguaacgc

SEQ ID NO: 20355 - RNA, 19 nt, artificial
  Oligomer
ucauucugcauguacuuca

SEQ ID NO: 20356 - RNA, 19 nt, artificial
  Oligomer
aggauggugacucugacuc

SEQ ID NO: 20357 - RNA, 19 nt, artificial
  Oligomer
uucauucugcauguacuuc

SEQ ID NO: 20358 - RNA, 19 nt, artificial
  Oligomer
aauucauguaaauaucucc

SEQ ID NO: 20359 - RNA, 19 nt, artificial
  Oligomer
uguuccucuauuuuugccu

SEQ ID NO: 20360 - RNA, 19 nt, artificial
  Oligomer
uucugccgagauuugagcc

SEQ ID NO: 20361 - RNA, 19 nt, artificial
  Oligomer
auugucuugcgcaucagca

SEQ ID NO: 20362 - RNA, 19 nt, artificial
  Oligomer
auucuggagacuucuuucc

SEQ ID NO: 20363 - RNA, 19 nt, artificial
  Oligomer
ucaaacgucucacaggcug

SEQ ID NO: 20364 - RNA, 19 nt, artificial
  Oligomer
uucugcugcuugcugaggu

SEQ ID NO: 20365 - RNA, 19 nt, artificial
  Oligomer
uucgacucgcuacaaaguu

SEQ ID NO: 20366 - RNA, 19 nt, artificial
  Oligomer
uucugcauguacuucauga

SEQ ID NO: 20367 - RNA, 19 nt, artificial
  Oligomer
aucucugugcccauguacc

SEQ ID NO: 20368 - RNA, 19 nt, artificial
  Oligomer
augauggucacauucugcu

SEQ ID NO: 20369 - RNA, 19 nt, artificial
  Oligomer
auacugguggaauuugguc

SEQ ID NO: 20370 - RNA, 19 nt, artificial
  Oligomer
uuuuuaaauacagaggcau

SEQ ID NO: 20371 - RNA, 19 nt, artificial
  Oligomer
uugguugacaaauucgaua

SEQ ID NO: 20372 - RNA, 19 nt, artificial
  Oligomer
uuaucuggauuugagcuca

SEQ ID NO: 20373 - RNA, 19 nt, artificial
  Oligomer
uuucuucaguuucucucca

SEQ ID NO: 20374 - RNA, 19 nt, artificial
  Oligomer
aaagaaauaguccucgacc

SEQ ID NO: 20375 - RNA, 19 nt, artificial
  Oligomer
ugauuuuccugucucuguc

SEQ ID NO: 20376 - RNA, 19 nt, artificial
  Oligomer
uccuccaggauguuguagc

SEQ ID NO: 20377 - RNA, 19 nt, artificial
  Oligomer
uuuagcuccaguucccgaa

SEQ ID NO: 20378 - RNA, 19 nt, artificial
  Oligomer
guuguuucuaucuccuuug

SEQ ID NO: 20379 - RNA, 19 nt, artificial
  Oligomer
agcaauguugaucucaacg

SEQ ID NO: 20380 - RNA, 19 nt, artificial
  Oligomer
acuuucaauggaaucucuc

SEQ ID NO: 20381 - RNA, 19 nt, artificial
  Oligomer
uuauccaugcagacaaccu

SEQ ID NO: 20382 - RNA, 19 nt, artificial
  Oligomer
uuuugccucuuugaaggag

SEQ ID NO: 20383 - RNA, 19 nt, artificial
  Oligomer
uaguucagcaucuccuggu

SEQ ID NO: 20384 - RNA, 19 nt, artificial
  Oligomer
uauugguugacaaauucga

SEQ ID NO: 20385 - RNA, 19 nt, artificial
  Oligomer
ucuauuuuugccucuuuga

SEQ ID NO: 20386 - RNA, 19 nt, artificial
  Oligomer
auggaaucucucuucucuu

SEQ ID NO: 20387 - RNA, 19 nt, artificial
  Oligomer
augaagagcgauuucuuca

SEQ ID NO: 20388 - RNA, 19 nt, artificial
  Oligomer
uuugucuccaagggaccag

SEQ ID NO: 20389 - RNA, 19 nt, artificial
  Oligomer
uguucaaacauuucccggg

SEQ ID NO: 20390 - RNA, 19 nt, artificial
  Oligomer
aucuccagcaucuccuccu

SEQ ID NO: 20391 - RNA, 19 nt, artificial
  Oligomer
uuacaaagcaggucacuua

SEQ ID NO: 20392 - RNA, 19 nt, artificial
  Oligomer
ucagauguucuucacugug

SEQ ID NO: 20393 - RNA, 19 nt, artificial
  Oligomer
ucugucucucaggcucuuc

SEQ ID NO: 20394 - RNA, 19 nt, artificial
  Oligomer
uuugggagucauaauggac

SEQ ID NO: 20395 - RNA, 19 nt, artificial
  Oligomer
uuggagguguagagcuugg

SEQ ID NO: 20396 - RNA, 19 nt, artificial
  Oligomer
ucacuuaucuggauuugag

SEQ ID NO: 20397 - RNA, 19 nt, artificial
  Oligomer
ucuccuuuguuaccgcuuc

SEQ ID NO: 20398 - RNA, 19 nt, artificial
  Oligomer
uucuuucccgucuccacga

SEQ ID NO: 20399 - RNA, 19 nt, artificial
  Oligomer
uagcuugagguagaagcuc

SEQ ID NO: 20400 - RNA, 19 nt, artificial
  Oligomer
uggaaucucucuucucuug

SEQ ID NO: 20401 - RNA, 19 nt, artificial
  Oligomer
ugccuugaagguuugcacg

SEQ ID NO: 20402 - RNA, 19 nt, artificial
  Oligomer
uuccucuauuuuugccucu

SEQ ID NO: 20403 - RNA, 19 nt, artificial
  Oligomer
auccaugcagacaaccuug

SEQ ID NO: 20404 - RNA, 19 nt, artificial
  Oligomer
uccaguucccgaaaccacu

SEQ ID NO: 20405 - RNA, 19 nt, artificial
  Oligomer
aucuucgugauagcgcuuc

SEQ ID NO: 20406 - RNA, 19 nt, artificial
  Oligomer
ucugcuucuggaaacuaug

SEQ ID NO: 20407 - RNA, 19 nt, artificial
  Oligomer
ugcauguacuucaugaagg

SEQ ID NO: 20408 - RNA, 19 nt, artificial
  Oligomer
aucuccuuuguuaccgcuu

SEQ ID NO: 20409 - RNA, 19 nt, artificial
  Oligomer
cuuaucuggauuugagcuc

SEQ ID NO: 20410 - RNA, 19 nt, artificial
  Oligomer
uuuccaggccucuaccuga

SEQ ID NO: 20411 - RNA, 19 nt, artificial
  Oligomer
uuuaaauacagaggcauaa

SEQ ID NO: 20412 - RNA, 19 nt, artificial
  Oligomer
uguuucuaucuccuuuguu

SEQ ID NO: 20413 - RNA, 19 nt, artificial
  Oligomer
uacagaggcauaaauaacu

SEQ ID NO: 20414 - RNA, 19 nt, artificial
  Oligomer
uucugaucaaugucaugag

SEQ ID NO: 20415 - RNA, 19 nt, artificial
  Oligomer
aauggaaucucucuucucu

SEQ ID NO: 20416 - RNA, 19 nt, artificial
  Oligomer
uguuguugagcucuuucag

SEQ ID NO: 20417 - RNA, 19 nt, artificial
  Oligomer
cucuauuuuugccucuuug

SEQ ID NO: 20418 - RNA, 19 nt, artificial
  Oligomer
acguaguucagcaucuccu

SEQ ID NO: 20419 - RNA, 19 nt, artificial
  Oligomer
ugaacauagaccuugggcu

SEQ ID NO: 20420 - RNA, 19 nt, artificial
  Oligomer
acuucaugaaggauucugc

SEQ ID NO: 20421 - RNA, 19 nt, artificial
  Oligomer
aaucauacagggaagaccc

SEQ ID NO: 20422 - RNA, 19 nt, artificial
  Oligomer
auuuugucuccaagggacc

SEQ ID NO: 20423 - RNA, 19 nt, artificial
  Oligomer
ucacuuaugucacuuaucu

SEQ ID NO: 20424 - RNA, 19 nt, artificial
  Oligomer
cugaaagaaauaguccucg

SEQ ID NO: 20425 - RNA, 19 nt, artificial
  Oligomer
uguuguugaugucuuuuuc

SEQ ID NO: 20426 - RNA, 19 nt, artificial
  Oligomer
uugaccagagauucuggag

SEQ ID NO: 20427 - RNA, 19 nt, artificial
  Oligomer
ugucggacuuuguagauuc

SEQ ID NO: 20428 - RNA, 19 nt, artificial
  Oligomer
ugucucugucgcaaagagg

SEQ ID NO: 20429 - RNA, 19 nt, artificial
  Oligomer
ugucucucaggcucuucug

SEQ ID NO: 20430 - RNA, 19 nt, artificial
  Oligomer
uccuucuucgccucguaag

SEQ ID NO: 20431 - RNA, 19 nt, artificial
  Oligomer
ucaaguaaagggcuugaug

SEQ ID NO: 20432 - RNA, 19 nt, artificial
  Oligomer
auucgauagcuugagguag

SEQ ID NO: 20433 - RNA, 19 nt, artificial
  Oligomer
uuuuaaauacagaggcaua

SEQ ID NO: 20434 - RNA, 19 nt, artificial
  Oligomer
uugagcugaaagaaauagu

SEQ ID NO: 20435 - RNA, 19 nt, artificial
  Oligomer
uaugucacuuaucuggauu

SEQ ID NO: 20436 - RNA, 19 nt, artificial
  Oligomer
augaggcugaguucucugc

SEQ ID NO: 20437 - RNA, 19 nt, artificial
  Oligomer
uuuaagauuuugucuccaa

SEQ ID NO: 20438 - RNA, 19 nt, artificial
  Oligomer
uccauccuuaaguucugug

SEQ ID NO: 20439 - RNA, 19 nt, artificial
  Oligomer
uugacaaauucgauagcuu

SEQ ID NO: 20440 - RNA, 19 nt, artificial
  Oligomer
uauucauucugcauguacu

SEQ ID NO: 20441 - RNA, 19 nt, artificial
  Oligomer
uuggucuugaacagaaauu

SEQ ID NO: 20442 - RNA, 19 nt, artificial
  Oligomer
uucuucaguuucucuccau

SEQ ID NO: 20443 - RNA, 19 nt, artificial
  Oligomer
ugucuuggaaagucauccc

SEQ ID NO: 20444 - RNA, 19 nt, artificial
  Oligomer
auuggagguguagagcuug

SEQ ID NO: 20445 - RNA, 19 nt, artificial
  Oligomer
aaugaggcugaguucucug

SEQ ID NO: 20446 - RNA, 19 nt, artificial
  Oligomer
uguuggugaacuuccacuu

SEQ ID NO: 20447 - RNA, 19 nt, artificial
  Oligomer
uacagcaccaaagauaucu

SEQ ID NO: 20448 - RNA, 19 nt, artificial
  Oligomer
ucauucugcugcuugcuga

SEQ ID NO: 20449 - RNA, 19 nt, artificial
  Oligomer
ugaagagcgauuucuucag

SEQ ID NO: 20450 - RNA, 19 nt, artificial
  Oligomer
cuuuguuaccgcuuccacc

SEQ ID NO: 20451 - RNA, 19 nt, artificial
  Oligomer
ugcaaguuaaaaucccuuu

SEQ ID NO: 20452 - RNA, 19 nt, artificial
  Oligomer
uaggaggucaaguaaaggg

SEQ ID NO: 20453 - RNA, 19 nt, artificial
  Oligomer
ucaagcacaaggucaggug

SEQ ID NO: 20454 - RNA, 19 nt, artificial
  Oligomer
uaucuccuuuguuaccgcu

SEQ ID NO: 20455 - RNA, 19 nt, artificial
  Oligomer
uugccucggacaucaaacg

SEQ ID NO: 20456 - RNA, 19 nt, artificial
  Oligomer
auuugagcucagauguucu

SEQ ID NO: 20457 - RNA, 19 nt, artificial
  Oligomer
uggugguccaugaugguca

SEQ ID NO: 20458 - RNA, 19 nt, artificial
  Oligomer
uucuccacauuguuguuga

SEQ ID NO: 20459 - RNA, 19 nt, artificial
  Oligomer
acuuuagcuccaguucccg

SEQ ID NO: 20460 - RNA, 19 nt, artificial
  Oligomer
gauuucuucaguuucucuc

SEQ ID NO: 20461 - RNA, 19 nt, artificial
  Oligomer
uucgggacugucuagaacu

SEQ ID NO: 20462 - RNA, 19 nt, artificial
  Oligomer
ucucucuucucuugggucu

SEQ ID NO: 20463 - RNA, 19 nt, artificial
  Oligomer
aucucucuucucuuggguc

SEQ ID NO: 20464 - RNA, 19 nt, artificial
  Oligomer
acuuuugggagucauaaug

SEQ ID NO: 20465 - RNA, 19 nt, artificial
  Oligomer
uucauguaaauaucuccau

SEQ ID NO: 20466 - RNA, 19 nt, artificial
  Oligomer
uccuuuguuaccgcuucca

SEQ ID NO: 20467 - RNA, 19 nt, artificial
  Oligomer
uccuuaaguucugugccgg

SEQ ID NO: 20468 - RNA, 19 nt, artificial
  Oligomer
aguuuuuuaaauacagagg

SEQ ID NO: 20469 - RNA, 19 nt, artificial
  Oligomer
uagaagcucaucuggaggg

SEQ ID NO: 20470 - RNA, 19 nt, artificial
  Oligomer
uaucacuuuccuccaucuc

SEQ ID NO: 20471 - RNA, 19 nt, artificial
  Oligomer
ucugucgcaaagaggaugg

SEQ ID NO: 20472 - RNA, 19 nt, artificial
  Oligomer
uccagcuugaccagagauu

SEQ ID NO: 20473 - RNA, 19 nt, artificial
  Oligomer
uuuccaggcccauucuccu

SEQ ID NO: 20474 - RNA, 19 nt, artificial
  Oligomer
auacugaaggucauccugu

SEQ ID NO: 20475 - RNA, 19 nt, artificial
  Oligomer
uucugcuucuggaaacuau

SEQ ID NO: 20476 - RNA, 19 nt, artificial
  Oligomer
ucauguaaauaucuccauc

SEQ ID NO: 20477 - RNA, 19 nt, artificial
  Oligomer
uuuuccugucucugucgca

SEQ ID NO: 20478 - RNA, 19 nt, artificial
  Oligomer
uucgaagagcucaggguca

SEQ ID NO: 20479 - RNA, 19 nt, artificial
  Oligomer
uugaaggagccguaauauu

SEQ ID NO: 20480 - RNA, 19 nt, artificial
  Oligomer
uggauuugagcucagaugu

SEQ ID NO: 20481 - RNA, 19 nt, artificial
  Oligomer
uuucgacucgcuacaaagu

SEQ ID NO: 20482 - RNA, 19 nt, artificial
  Oligomer
ucggacuuuguagauucug

SEQ ID NO: 20483 - RNA, 19 nt, artificial
  Oligomer
gugauguccaggaaguagg

SEQ ID NO: 20484 - RNA, 19 nt, artificial
  Oligomer
uuguuaccgcuuccacccu

SEQ ID NO: 20485 - RNA, 19 nt, artificial
  Oligomer
uauuugggauguuccaugg

SEQ ID NO: 20486 - RNA, 19 nt, artificial
  Oligomer
ucuugaacagaaauuucca

SEQ ID NO: 20487 - RNA, 19 nt, artificial
  Oligomer
acuuuguagauucugccga

SEQ ID NO: 20488 - RNA, 19 nt, artificial
  Oligomer
uacuuauccaugcagacaa

SEQ ID NO: 20489 - RNA, 19 nt, artificial
  Oligomer
uacugaaggucauccugug

SEQ ID NO: 20490 - RNA, 19 nt, artificial
  Oligomer
auguccaggaaguagguga

SEQ ID NO: 20491 - RNA, 19 nt, artificial
  Oligomer
auccucacaggagaguucc

SEQ ID NO: 20492 - RNA, 19 nt, artificial
  Oligomer
aucuccuggugaaacacgg

SEQ ID NO: 20493 - RNA, 19 nt, artificial
  Oligomer
uauccaugcagacaaccuu

SEQ ID NO: 20494 - RNA, 19 nt, artificial
  Oligomer
ugaaguggugcacucagca

SEQ ID NO: 20495 - RNA, 19 nt, artificial
  Oligomer
uagaugugguccucaucug

SEQ ID NO: 20496 - RNA, 19 nt, artificial
  Oligomer
uugccucuuugaaggagcc

SEQ ID NO: 20497 - RNA, 19 nt, artificial
  Oligomer
uguaaauaucuccaucaag

SEQ ID NO: 20498 - RNA, 19 nt, artificial
  Oligomer
uuuuuuaaauacagaggca

SEQ ID NO: 20499 - RNA, 19 nt, artificial
  Oligomer
ucagauaaugcagagcugg

SEQ ID NO: 20500 - RNA, 19 nt, artificial
  Oligomer
uugucuugcgcaucagcau

SEQ ID NO: 20501 - RNA, 19 nt, artificial
  Oligomer
gugauacugaaggucaucc

SEQ ID NO: 20502 - RNA, 19 nt, artificial
  Oligomer
ucacauuggagguguagag

SEQ ID NO: 20503 - RNA, 19 nt, artificial
  Oligomer
uuugaaggagccguaauau

SEQ ID NO: 20504 - RNA, 19 nt, artificial
  Oligomer
auucugccgagauuugagc

SEQ ID NO: 20505 - RNA, 19 nt, artificial
  Oligomer
ugagguagaagcucaucug

SEQ ID NO: 20506 - RNA, 19 nt, artificial
  Oligomer
ucuagcaccuccaggaaug

SEQ ID NO: 20507 - RNA, 19 nt, artificial
  Oligomer
auccuuaaguucugugccg

SEQ ID NO: 20508 - RNA, 19 nt, artificial
  Oligomer
ugcaauucauguaaauauc

SEQ ID NO: 20509 - RNA, 19 nt, artificial
  Oligomer
guaaauaucuccaucaagg

SEQ ID NO: 20510 - RNA, 19 nt, artificial
  Oligomer
uucgauagcuugagguaga

SEQ ID NO: 20511 - RNA, 19 nt, artificial
  Oligomer
uuguuucuaucuccuuugu

SEQ ID NO: 20512 - RNA, 19 nt, artificial
  Oligomer
uuugagcucagauguucuu

SEQ ID NO: 20513 - RNA, 19 nt, artificial
  Oligomer
cgagauuugagccucaugg

SEQ ID NO: 20514 - RNA, 19 nt, artificial
  Oligomer
auguuccucuauuuuugcc

SEQ ID NO: 20515 - RNA, 19 nt, artificial
  Oligomer
cucagcagcaaguuccauc

SEQ ID NO: 20516 - RNA, 19 nt, artificial
  Oligomer
ugcauacugguggaauuug

SEQ ID NO: 20517 - RNA, 19 nt, artificial
  Oligomer
uuaggaggucaaguaaagg

SEQ ID NO: 20518 - RNA, 19 nt, artificial
  Oligomer
augcaauucauguaaauau

SEQ ID NO: 20519 - RNA, 19 nt, artificial
  Oligomer
cugaaugugcuguuugccu

SEQ ID NO: 20520 - RNA, 19 nt, artificial
  Oligomer
aagaugagcucaucucccg

SEQ ID NO: 20521 - RNA, 19 nt, artificial
  Oligomer
uaucuggauuugagcucag

SEQ ID NO: 20522 - RNA, 19 nt, artificial
  Oligomer
ucucuucucuugggucucc

SEQ ID NO: 20523 - RNA, 19 nt, artificial
  Oligomer
aaacguacuggucaccacc

SEQ ID NO: 20524 - RNA, 19 nt, artificial
  Oligomer
uccacauuguuguugaugu

SEQ ID NO: 20525 - RNA, 19 nt, artificial
  Oligomer
cuguuggugaacuuccacu

SEQ ID NO: 20526 - RNA, 19 nt, artificial
  Oligomer
uugcauacugguggaauuu

SEQ ID NO: 20527 - RNA, 19 nt, artificial
  Oligomer
uccaugcagacaaccuugg

SEQ ID NO: 20528 - RNA, 19 nt, artificial
  Oligomer
uccaggauguuguagcgcu

SEQ ID NO: 20529 - RNA, 19 nt, artificial
  Oligomer
auggagcacagcaauguug

SEQ ID NO: 20530 - RNA, 19 nt, artificial
  Oligomer
uuguagauucugccgagau

SEQ ID NO: 20531 - RNA, 19 nt, artificial
  Oligomer
cucauucugcugcuugcug

SEQ ID NO: 20532 - RNA, 19 nt, artificial
  Oligomer
ugguugacaaauucgauag

SEQ ID NO: 20533 - RNA, 19 nt, artificial
  Oligomer
agcuugaccagagauucug

SEQ ID NO: 20534 - RNA, 19 nt, artificial
  Oligomer
ugaacagaaauuuccaagg

SEQ ID NO: 20535 - RNA, 19 nt, artificial
  Oligomer
uaccacuuuagcuccaguu

SEQ ID NO: 20536 - RNA, 19 nt, artificial
  Oligomer
ugauacugaaggucauccu

SEQ ID NO: 20537 - RNA, 19 nt, artificial
  Oligomer
uccagggugcuacuuguua

SEQ ID NO: 20538 - RNA, 19 nt, artificial
  Oligomer
augagcugagcauuccaca

SEQ ID NO: 20539 - RNA, 19 nt, artificial
  Oligomer
guuuuuuaaauacagaggc

SEQ ID NO: 20540 - RNA, 19 nt, artificial
  Oligomer
gauagcuugagguagaagc

SEQ ID NO: 20541 - RNA, 19 nt, artificial
  Oligomer
ugugauacugaaggucauc

SEQ ID NO: 20542 - RNA, 19 nt, artificial
  Oligomer
ucuggauuugagcucagau

SEQ ID NO: 20543 - RNA, 19 nt, artificial
  Oligomer
aaauucgauagcuugaggu

SEQ ID NO: 20544 - RNA, 19 nt, artificial
  Oligomer
uuuccugucucugucgcaa

SEQ ID NO: 20545 - RNA, 19 nt, artificial
  Oligomer
accucaagcagcauguugg

SEQ ID NO: 20546 - RNA, 19 nt, artificial
  Oligomer
guauuugggauguuccaug

SEQ ID NO: 20547 - RNA, 19 nt, artificial
  Oligomer
auuuuaaagcaggaaugag

SEQ ID NO: 20548 - RNA, 19 nt, artificial
  Oligomer
augaaggauucugcagccg

SEQ ID NO: 20549 - RNA, 19 nt, artificial
  Oligomer
ugcugagguugugauacug

SEQ ID NO: 20550 - RNA, 19 nt, artificial
  Oligomer
acuuaucuggauuugagcu

SEQ ID NO: 20551 - RNA, 19 nt, artificial
  Oligomer
auuuuccugucucugucgc

SEQ ID NO: 20552 - RNA, 19 nt, artificial
  Oligomer
ugguagguuccuguuguuu

SEQ ID NO: 20553 - RNA, 19 nt, artificial
  Oligomer
uugaaggcacagcugaaua

SEQ ID NO: 20554 - RNA, 19 nt, artificial
  Oligomer
gugucuuggaaagucaucc

SEQ ID NO: 20555 - RNA, 19 nt, artificial
  Oligomer
ucaauggaaucucucuucu

SEQ ID NO: 20556 - RNA, 19 nt, artificial
  Oligomer
gucuugaacagaaauuucc

SEQ ID NO: 20557 - RNA, 19 nt, artificial
  Oligomer
uucuucgccucguaaggaa

SEQ ID NO: 20558 - RNA, 19 nt, artificial
  Oligomer
ugguggucacuugaagugg

SEQ ID NO: 20559 - RNA, 19 nt, artificial
  Oligomer
acuuccuccaggauguugu

SEQ ID NO: 20560 - RNA, 19 nt, artificial
  Oligomer
ugaaggauucugcagccga

SEQ ID NO: 20561 - RNA, 19 nt, artificial
  Oligomer
ugugccuugagaacuucgg

SEQ ID NO: 20562 - RNA, 19 nt, artificial
  Oligomer
uucugugccggcagcuuua

SEQ ID NO: 20563 - RNA, 19 nt, artificial
  Oligomer
cuucaguuucucuccauug

SEQ ID NO: 20564 - RNA, 19 nt, artificial
  Oligomer
ucuucaguuucucuccauu

SEQ ID NO: 20565 - RNA, 19 nt, artificial
  Oligomer
ucacaggagaguuccacca

SEQ ID NO: 20566 - RNA, 19 nt, artificial
  Oligomer
ugagguugugauacugaag

SEQ ID NO: 20567 - RNA, 19 nt, artificial
  Oligomer
aucaaggaaucauacaggg

SEQ ID NO: 20568 - RNA, 19 nt, artificial
  Oligomer
auguccugaacauagaccu

SEQ ID NO: 20569 - RNA, 19 nt, artificial
  Oligomer
cuggauuugagcucagaug

SEQ ID NO: 20570 - RNA, 19 nt, artificial
  Oligomer
ucagcauacaggcaaagag

SEQ ID NO: 20571 - RNA, 19 nt, artificial
  Oligomer
uguacuucaugaaggauuc

SEQ ID NO: 20572 - RNA, 19 nt, artificial
  Oligomer
uaaggacagucaaaccagg

SEQ ID NO: 20573 - RNA, 19 nt, artificial
  Oligomer
acaaauucgauagcuugag

SEQ ID NO: 20574 - RNA, 19 nt, artificial
  Oligomer
uuccuccaggauguuguag

SEQ ID NO: 20575 - RNA, 19 nt, artificial
  Oligomer
uccugguggucacuugaag

SEQ ID NO: 20576 - RNA, 19 nt, artificial
  Oligomer
aagauuuugucuccaaggg

SEQ ID NO: 20577 - RNA, 19 nt, artificial
  Oligomer
agauucuggagacuucuuu

SEQ ID NO: 20578 - RNA, 19 nt, artificial
  Oligomer
aucugaaugugcuguuugc

SEQ ID NO: 20579 - RNA, 19 nt, artificial
  Oligomer
ugucuagaacugcccaguc

SEQ ID NO: 20580 - RNA, 19 nt, artificial
  Oligomer
auuguuguugaugucuuuu

SEQ ID NO: 20581 - RNA, 19 nt, artificial
  Oligomer
cuugaaguggugcacucag

SEQ ID NO: 20582 - RNA, 19 nt, artificial
  Oligomer
uagauucugccgagauuug

SEQ ID NO: 20583 - RNA, 19 nt, artificial
  Oligomer
uugagcucuuucagcauga

SEQ ID NO: 20584 - RNA, 19 nt, artificial
  Oligomer
uuuugucuccaagggacca

SEQ ID NO: 20585 - RNA, 19 nt, artificial
  Oligomer
ucauucaauuucagcuugg

SEQ ID NO: 20586 - RNA, 19 nt, artificial
  Oligomer
uccugaacauagaccuugg

SEQ ID NO: 20587 - RNA, 19 nt, artificial
  Oligomer
acagucagguggaucucug

SEQ ID NO: 20588 - RNA, 19 nt, artificial
  Oligomer
uguggugauguccaggaag

SEQ ID NO: 20589 - RNA, 19 nt, artificial
  Oligomer
gauaucuucgugauagcgc

SEQ ID NO: 20590 - RNA, 19 nt, artificial
  Oligomer
auuuaagauuuugucucca

SEQ ID NO: 20591 - RNA, 19 nt, artificial
  Oligomer
agucagguggaucucugug

SEQ ID NO: 20592 - RNA, 19 nt, artificial
  Oligomer
gucuuggaaagucaucccg

SEQ ID NO: 20593 - RNA, 19 nt, artificial
  Oligomer
agucaaaccaggaagagac

SEQ ID NO: 20594 - RNA, 19 nt, artificial
  Oligomer
aaagauaucuucgugauag

SEQ ID NO: 20595 - RNA, 19 nt, artificial
  Oligomer
auguugaucucaacgacag

SEQ ID NO: 20596 - RNA, 19 nt, artificial
  Oligomer
uccaaaggcugugaguccu

SEQ ID NO: 20597 - RNA, 19 nt, artificial
  Oligomer
uuuuugccucuuugaagga

SEQ ID NO: 20598 - RNA, 19 nt, artificial
  Oligomer
uugcugagguugugauacu

SEQ ID NO: 20599 - RNA, 19 nt, artificial
  Oligomer
ugggauuucgaagagcuca

SEQ ID NO: 20600 - RNA, 19 nt, artificial
  Oligomer
uccaucuuucacccacuug

SEQ ID NO: 20601 - RNA, 19 nt, artificial
  Oligomer
aucgaagaccugcagguug

SEQ ID NO: 20602 - RNA, 19 nt, artificial
  Oligomer
auaucuucgugauagcgcu

SEQ ID NO: 20603 - RNA, 19 nt, artificial
  Oligomer
aacgacagccuggucuuuc

SEQ ID NO: 20604 - RNA, 19 nt, artificial
  Oligomer
acugucuagaacugcccag

SEQ ID NO: 20605 - RNA, 19 nt, artificial
  Oligomer
agauguuccucuauuuuug

SEQ ID NO: 20606 - RNA, 19 nt, artificial
  Oligomer
aaagaggauggugacucug

SEQ ID NO: 20607 - RNA, 19 nt, artificial
  Oligomer
aagauuuggaccugcaagu

SEQ ID NO: 20608 - RNA, 19 nt, artificial
  Oligomer
uaauauugguugacaaauu

SEQ ID NO: 20609 - RNA, 19 nt, artificial
  Oligomer
gucaguugguagguuccug

SEQ ID NO: 20610 - RNA, 19 nt, artificial
  Oligomer
uggucacuugaaguggugc

SEQ ID NO: 20611 - RNA, 19 nt, artificial
  Oligomer
ucggacaucaaacgucuca

SEQ ID NO: 20612 - RNA, 19 nt, artificial
  Oligomer
cugaacauagaccuugggc

SEQ ID NO: 20613 - RNA, 19 nt, artificial
  Oligomer
uccugguagaugugguccu

SEQ ID NO: 20614 - RNA, 19 nt, artificial
  Oligomer
ucucugugcccauguacca

SEQ ID NO: 20615 - RNA, 19 nt, artificial
  Oligomer
ucguaaggaaauacagcac

SEQ ID NO: 20616 - RNA, 19 nt, artificial
  Oligomer
guuucuaucuccuuuguua

SEQ ID NO: 20617 - RNA, 19 nt, artificial
  Oligomer
ucaaugucaugagcaaagg

SEQ ID NO: 20618 - RNA, 19 nt, artificial
  Oligomer
guuaguuuuuuaaauacag

SEQ ID NO: 20619 - RNA, 19 nt, artificial
  Oligomer
guuguugaugucuuuuucc

SEQ ID NO: 20620 - RNA, 19 nt, artificial
  Oligomer
uccaugauggucacauucu

SEQ ID NO: 20621 - RNA, 19 nt, artificial
  Oligomer
acuucuuucccgucuccac

SEQ ID NO: 20622 - RNA, 19 nt, artificial
  Oligomer
auuuggaccugcaaguuaa

SEQ ID NO: 20623 - RNA, 19 nt, artificial
  Oligomer
uuguuaggaggucaaguaa

SEQ ID NO: 20624 - RNA, 19 nt, artificial
  Oligomer
agccucauggugaacacgu

SEQ ID NO: 20625 - RNA, 19 nt, artificial
  Oligomer
ugauggaguagaaccuggg

SEQ ID NO: 20626 - RNA, 19 nt, artificial
  Oligomer
ucaaacauuucccgggcag

SEQ ID NO: 20627 - RNA, 19 nt, artificial
  Oligomer
acuugcuguacucugaggg

SEQ ID NO: 20628 - RNA, 19 nt, artificial
  Oligomer
uuugagccucauggugaac

SEQ ID NO: 20629 - RNA, 19 nt, artificial
  Oligomer
aauauugguugacaaauuc

SEQ ID NO: 20630 - RNA, 19 nt, artificial
  Oligomer
uccucuauuuuugccucuu

SEQ ID NO: 20631 - RNA, 19 nt, artificial
  Oligomer
ucauacagggaagacccaa

SEQ ID NO: 20632 - RNA, 19 nt, artificial
  Oligomer
cuuuugggagucauaaugg

SEQ ID NO: 20633 - RNA, 19 nt, artificial
  Oligomer
cucguauuugggauguucc

SEQ ID NO: 20634 - RNA, 19 nt, artificial
  Oligomer
cuuucaauggaaucucucu

SEQ ID NO: 20635 - RNA, 19 nt, artificial
  Oligomer
cuucugaucaaugucauga

SEQ ID NO: 20636 - RNA, 19 nt, artificial
  Oligomer
cucauggugaacacguucu

SEQ ID NO: 20637 - RNA, 19 nt, artificial
  Oligomer
ugucuugcgcaucagcaua

SEQ ID NO: 20638 - RNA, 19 nt, artificial
  Oligomer
uugguggaguaacgcacgu

SEQ ID NO: 20639 - RNA, 19 nt, artificial
  Oligomer
guugcauccagcuugacca

SEQ ID NO: 20640 - RNA, 19 nt, artificial
  Oligomer
ugaauuuguuguugagcuc

SEQ ID NO: 20641 - RNA, 19 nt, artificial
  Oligomer
agcuuuuggagcagcagcu

SEQ ID NO: 20642 - RNA, 19 nt, artificial
  Oligomer
agauuugagccucauggug

SEQ ID NO: 20643 - RNA, 19 nt, artificial
  Oligomer
cagacauggguuuuccagg

SEQ ID NO: 20644 - RNA, 19 nt, artificial
  Oligomer
augagcucaucucccguca

SEQ ID NO: 20645 - RNA, 19 nt, artificial
  Oligomer
cacuuaucuggauuugagc

SEQ ID NO: 20646 - RNA, 19 nt, artificial
  Oligomer
cauuguugguggaguaacg

SEQ ID NO: 20647 - RNA, 19 nt, artificial
  Oligomer
uacuuguuaggaggucaag

SEQ ID NO: 20648 - RNA, 19 nt, artificial
  Oligomer
gaaauaguccucgaccugc

SEQ ID NO: 20649 - RNA, 19 nt, artificial
  Oligomer
uugcauccagcuugaccag

SEQ ID NO: 20650 - RNA, 19 nt, artificial
  Oligomer
uugugauacugaaggucau

SEQ ID NO: 20651 - RNA, 19 nt, artificial
  Oligomer
guugugauacugaagguca

SEQ ID NO: 20652 - RNA, 19 nt, artificial
  Oligomer
ucacuugaaguggugcacu

SEQ ID NO: 20653 - RNA, 19 nt, artificial
  Oligomer
aguugguagguuccuguug

SEQ ID NO: 20654 - RNA, 19 nt, artificial
  Oligomer
ugagcugaaagaaauaguc

SEQ ID NO: 20655 - RNA, 19 nt, artificial
  Oligomer
ugagcucagauguucuuca

SEQ ID NO: 20656 - RNA, 19 nt, artificial
  Oligomer
ucuuugaaggagccguaau

SEQ ID NO: 20657 - RNA, 19 nt, artificial
  Oligomer
guuuuugauccucacaugc

SEQ ID NO: 20658 - RNA, 19 nt, artificial
  Oligomer
uacaaagcaggucacuuau

SEQ ID NO: 20659 - RNA, 19 nt, artificial
  Oligomer
aaauaagacuugaggcugg

SEQ ID NO: 20660 - RNA, 19 nt, artificial
  Oligomer
cuccacauuguuguugaug

SEQ ID NO: 20661 - RNA, 19 nt, artificial
  Oligomer
auggaguagaaccugggcu

SEQ ID NO: 20662 - RNA, 19 nt, artificial
  Oligomer
ugucgcaaagaggauggug

SEQ ID NO: 20663 - RNA, 19 nt, artificial
  Oligomer
cucaguuuucgacucgcua

SEQ ID NO: 20664 - RNA, 19 nt, artificial
  Oligomer
acuauggagcacagcaaug

SEQ ID NO: 20665 - RNA, 19 nt, artificial
  Oligomer
uugugcugggagucaugga

SEQ ID NO: 20666 - RNA, 19 nt, artificial
  Oligomer
uggaccugcaaguuaaaau

SEQ ID NO: 20667 - RNA, 19 nt, artificial
  Oligomer
uucauugcauacuggugga

SEQ ID NO: 20668 - RNA, 19 nt, artificial
  Oligomer
aucuccuccugguagaugu

SEQ ID NO: 20669 - RNA, 19 nt, artificial
  Oligomer
uaucuucgugauagcgcuu

SEQ ID NO: 20670 - RNA, 19 nt, artificial
  Oligomer
ucagcagcaaguuccaucu

SEQ ID NO: 20671 - RNA, 19 nt, artificial
  Oligomer
aguuugagagaggaggcuc

SEQ ID NO: 20672 - RNA, 19 nt, artificial
  Oligomer
ugcugcuugcugagguugu

SEQ ID NO: 20673 - RNA, 19 nt, artificial
  Oligomer
aaggucaggugggauuucg

SEQ ID NO: 20674 - RNA, 19 nt, artificial
  Oligomer
guagaugugguccucaucu

SEQ ID NO: 20675 - RNA, 19 nt, artificial
  Oligomer
auucugcauguacuucaug

SEQ ID NO: 20676 - RNA, 19 nt, artificial
  Oligomer
ugucaugagcaaaggcgca

SEQ ID NO: 20677 - RNA, 19 nt, artificial
  Oligomer
auuucgaagagcucagggu

SEQ ID NO: 20678 - RNA, 19 nt, artificial
  Oligomer
uggagacuucuuucccguc

SEQ ID NO: 20679 - RNA, 19 nt, artificial
  Oligomer
auacaggcaaagagcacag

SEQ ID NO: 20680 - RNA, 19 nt, artificial
  Oligomer
uuuggucuugaacagaaau

SEQ ID NO: 20681 - RNA, 19 nt, artificial
  Oligomer
agacuuucaauggaaucuc

SEQ ID NO: 20682 - RNA, 19 nt, artificial
  Oligomer
aucucccgucaguugguag

SEQ ID NO: 20683 - RNA, 19 nt, artificial
  Oligomer
guguucaaacauuucccgg

SEQ ID NO: 20684 - RNA, 19 nt, artificial
  Oligomer
auucugcugcuugcugagg

SEQ ID NO: 20685 - RNA, 19 nt, artificial
  Oligomer
cuucuggaaacuauggagc

SEQ ID NO: 20686 - RNA, 19 nt, artificial
  Oligomer
uuuguagauucugccgaga

SEQ ID NO: 20687 - RNA, 19 nt, artificial
  Oligomer
uuaaauacagaggcauaaa

SEQ ID NO: 20688 - RNA, 19 nt, artificial
  Oligomer
ccaaacaccaaggucaugc

SEQ ID NO: 20689 - RNA, 19 nt, artificial
  Oligomer
acauuggagguguagagcu

SEQ ID NO: 20690 - RNA, 19 nt, artificial
  Oligomer
uacuggucaccaccaacag

SEQ ID NO: 20691 - RNA, 19 nt, artificial
  Oligomer
gacuuuguagauucugccg

SEQ ID NO: 20692 - RNA, 19 nt, artificial
  Oligomer
ugucacuuaucuggauuug

SEQ ID NO: 20693 - RNA, 19 nt, artificial
  Oligomer
acuuguuaggaggucaagu

SEQ ID NO: 20694 - RNA, 19 nt, artificial
  Oligomer
agcaccaaagauaucuucg

SEQ ID NO: 20695 - RNA, 19 nt, artificial
  Oligomer
ugucacugacccaguagcu

SEQ ID NO: 20696 - RNA, 19 nt, artificial
  Oligomer
ucugccgagauuugagccu

SEQ ID NO: 20697 - RNA, 19 nt, artificial
  Oligomer
cugucucucaggcucuucu

SEQ ID NO: 20698 - RNA, 19 nt, artificial
  Oligomer
ggaaucucucuucucuugg

SEQ ID NO: 20699 - RNA, 19 nt, artificial
  Oligomer
aauaucuccaucaaggaau

SEQ ID NO: 20700 - RNA, 19 nt, artificial
  Oligomer
cuuaugucacuuaucugga

SEQ ID NO: 20701 - RNA, 19 nt, artificial
  Oligomer
ugcuucuggaaacuaugga

SEQ ID NO: 20702 - RNA, 19 nt, artificial
  Oligomer
uugcuguacucugagggcu

SEQ ID NO: 20703 - RNA, 19 nt, artificial
  Oligomer
aagcaggucacuuauguca

SEQ ID NO: 20704 - RNA, 19 nt, artificial
  Oligomer
agaaauaguccucgaccug

SEQ ID NO: 20705 - RNA, 19 nt, artificial
  Oligomer
aauguugaucucaacgaca

SEQ ID NO: 20706 - RNA, 19 nt, artificial
  Oligomer
gguagguuccuguuguuuc

SEQ ID NO: 20707 - RNA, 19 nt, artificial
  Oligomer
cuccucauucaauuucagc

SEQ ID NO: 20708 - RNA, 19 nt, artificial
  Oligomer
ugagcugagcauuccacac

SEQ ID NO: 20709 - RNA, 19 nt, artificial
  Oligomer
aagaaauaguccucgaccu

SEQ ID NO: 20710 - RNA, 19 nt, artificial
  Oligomer
ucauggugaacacguucuu

SEQ ID NO: 20711 - RNA, 19 nt, artificial
  Oligomer
aauaagacuugaggcuggg

SEQ ID NO: 20712 - RNA, 19 nt, artificial
  Oligomer
uggaguaacgcacgugucu

SEQ ID NO: 20713 - RNA, 19 nt, artificial
  Oligomer
aaagagcacagcuuugacc

SEQ ID NO: 20714 - RNA, 19 nt, artificial
  Oligomer
cuguuguuucuaucuccuu

SEQ ID NO: 20715 - RNA, 19 nt, artificial
  Oligomer
auagcggaugagcugagca

SEQ ID NO: 20716 - RNA, 19 nt, artificial
  Oligomer
ucugaucaaugucaugagc

SEQ ID NO: 20717 - RNA, 19 nt, artificial
  Oligomer
agauuuuaaagcaggaaug

SEQ ID NO: 20718 - RNA, 19 nt, artificial
  Oligomer
aaauaguccucgaccugcu

SEQ ID NO: 20719 - RNA, 19 nt, artificial
  Oligomer
auacagaggcauaaauaac

SEQ ID NO: 20720 - RNA, 19 nt, artificial
  Oligomer
guuguugagcucuuucagc

SEQ ID NO: 20721 - RNA, 19 nt, artificial
  Oligomer
ugguccaugauggucacau

SEQ ID NO: 20722 - RNA, 19 nt, artificial
  Oligomer
accaaagauaucuucguga

SEQ ID NO: 20723 - RNA, 19 nt, artificial
  Oligomer
uaacgcacgugucugcaga

SEQ ID NO: 20724 - RNA, 19 nt, artificial
  Oligomer
auagcuugagguagaagcu

SEQ ID NO: 20725 - RNA, 19 nt, artificial
  Oligomer
guugaucucaacgacagcc

SEQ ID NO: 20726 - RNA, 19 nt, artificial
  Oligomer
cugaauuuguuguugagcu

SEQ ID NO: 20727 - RNA, 19 nt, artificial
  Oligomer
cuccuuuguuaccgcuucc

SEQ ID NO: 20728 - RNA, 19 nt, artificial
  Oligomer
agaugugguccucaucugg

SEQ ID NO: 20729 - RNA, 19 nt, artificial
  Oligomer
uucccgaaaccacucguau

SEQ ID NO: 20730 - RNA, 19 nt, artificial
  Oligomer
aagaggauggugacucuga

SEQ ID NO: 20731 - RNA, 19 nt, artificial
  Oligomer
aacauagaccuugggcuug

SEQ ID NO: 20732 - RNA, 19 nt, artificial
  Oligomer
uagcggaugagcugagcau

SEQ ID NO: 20733 - RNA, 19 nt, artificial
  Oligomer
gagguugugauacugaagg

SEQ ID NO: 20734 - RNA, 19 nt, artificial
  Oligomer
guaaggacagucaaaccag

SEQ ID NO: 20735 - RNA, 19 nt, artificial
  Oligomer
uagguuccuguuguuucua

SEQ ID NO: 20736 - RNA, 19 nt, artificial
  Oligomer
uacagggaagacccaagug

SEQ ID NO: 20737 - RNA, 19 nt, artificial
  Oligomer
gcaaagaggauggugacuc

SEQ ID NO: 20738 - RNA, 19 nt, artificial
  Oligomer
caggauguccugaacauag

SEQ ID NO: 20739 - RNA, 19 nt, artificial
  Oligomer
guggaauuuggucuugaac

SEQ ID NO: 20740 - RNA, 19 nt, artificial
  Oligomer
uuaaagcaggaaugaggcu

SEQ ID NO: 20741 - RNA, 19 nt, artificial
  Oligomer
caguuuuugauccucacau

SEQ ID NO: 20742 - RNA, 19 nt, artificial
  Oligomer
acucgcuccaggauaccuu

SEQ ID NO: 20743 - RNA, 19 nt, artificial
  Oligomer
ucaggugggauuucgaaga

SEQ ID NO: 20744 - RNA, 19 nt, artificial
  Oligomer
ugauggucacauucugcuu

SEQ ID NO: 20745 - RNA, 19 nt, artificial
  Oligomer
cuaucuccuuuguuaccgc

SEQ ID NO: 20746 - RNA, 19 nt, artificial
  Oligomer
gaucaauccagggugcuac

SEQ ID NO: 20747 - RNA, 19 nt, artificial
  Oligomer
aauaguccucgaccugcuc

SEQ ID NO: 20748 - RNA, 19 nt, artificial
  Oligomer
uugguagguuccuguuguu

SEQ ID NO: 20749 - RNA, 19 nt, artificial
  Oligomer
aggaaauaagacuugaggc

SEQ ID NO: 20750 - RNA, 19 nt, artificial
  Oligomer
uccaggauaccuuggacca

SEQ ID NO: 20751 - RNA, 19 nt, artificial
  Oligomer
auugguugacaaauucgau

SEQ ID NO: 20752 - RNA, 19 nt, artificial
  Oligomer
agcuugagguagaagcuca

SEQ ID NO: 20753 - RNA, 19 nt, artificial
  Oligomer
cugcaaguuaaaaucccuu

SEQ ID NO: 20754 - RNA, 19 nt, artificial
  Oligomer
auguuguagcgcuggacgu

SEQ ID NO: 20755 - RNA, 19 nt, artificial
  Oligomer
aauuuggucuugaacagaa

SEQ ID NO: 20756 - RNA, 19 nt, artificial
  Oligomer
uggucuugaacagaaauuu

SEQ ID NO: 20757 - RNA, 19 nt, artificial
  Oligomer
gcaaguuccaucuuucacc

SEQ ID NO: 20758 - RNA, 19 nt, artificial
  Oligomer
cuauuuuugccucuuugaa

SEQ ID NO: 20759 - RNA, 19 nt, artificial
  Oligomer
uccucuggucaaacuuuug

SEQ ID NO: 20760 - RNA, 19 nt, artificial
  Oligomer
aggaaauacagcaccaaag

SEQ ID NO: 20761 - RNA, 19 nt, artificial
  Oligomer
agauaucuucgugauagcg

SEQ ID NO: 20762 - RNA, 19 nt, artificial
  Oligomer
caugauggucacauucugc

SEQ ID NO: 20763 - RNA, 19 nt, artificial
  Oligomer
guaguucagcaucuccugg

SEQ ID NO: 20764 - RNA, 19 nt, artificial
  Oligomer
ugagugaauuccacguugg

SEQ ID NO: 20765 - RNA, 19 nt, artificial
  Oligomer
cugauuuuccugucucugu

SEQ ID NO: 20766 - RNA, 19 nt, artificial
  Oligomer
cugauggaguagaaccugg

SEQ ID NO: 20767 - RNA, 19 nt, artificial
  Oligomer
cauugugaggguuaaugaa

SEQ ID NO: 20768 - RNA, 19 nt, artificial
  Oligomer
ggaguauuuggaugacaga

SEQ ID NO: 20769 - RNA, 19 nt, artificial
  Oligomer
agagaaucuccgcaagaaa

SEQ ID NO: 20770 - RNA, 19 nt, artificial
  Oligomer
ggauguuugggagauguaa

SEQ ID NO: 20771 - RNA, 19 nt, artificial
  Oligomer
ggucgaccuuaguaccuaa

SEQ ID NO: 20772 - RNA, 19 nt, artificial
  Oligomer
cccggacgauauugaacaa

SEQ ID NO: 20773 - RNA, 19 nt, artificial
  Oligomer
guuaaggguuaguuuacaa

SEQ ID NO: 20774 - RNA, 19 nt, artificial
  Oligomer
ggguuaaugaaauaaugua

SEQ ID NO: 20775 - RNA, 19 nt, artificial
  Oligomer
agcugucccucauguugaa

SEQ ID NO: 20776 - RNA, 19 nt, artificial
  Oligomer
gaauuuucucuaacuucaa

SEQ ID NO: 20777 - RNA, 19 nt, artificial
  Oligomer
auaccagcuuagauuuuaa

SEQ ID NO: 20778 - RNA, 19 nt, artificial
  Oligomer
gcaguuaaggguuaguuua

SEQ ID NO: 20779 - RNA, 19 nt, artificial
  Oligomer
agacccagguccagaugaa

SEQ ID NO: 20780 - RNA, 19 nt, artificial
  Oligomer
gcaucuuauccgaguggaa

SEQ ID NO: 20781 - RNA, 19 nt, artificial
  Oligomer
agauguuccgagagcugaa

SEQ ID NO: 20782 - RNA, 19 nt, artificial
  Oligomer
gggucaacaucuuuuacau

SEQ ID NO: 20783 - RNA, 19 nt, artificial
  Oligomer
gaggguuaaugaaauaaug

SEQ ID NO: 20784 - RNA, 19 nt, artificial
  Oligomer
uggguuuugggucuuugaa

SEQ ID NO: 20785 - RNA, 19 nt, artificial
  Oligomer
cuggauggagaauauuuca

SEQ ID NO: 20786 - RNA, 19 nt, artificial
  Oligomer
guaccaccauccacuacaa

SEQ ID NO: 20787 - RNA, 19 nt, artificial
  Oligomer
gcugaaugaggccuuggaa

SEQ ID NO: 20788 - RNA, 19 nt, artificial
  Oligomer
gggauguuugggagaugua

SEQ ID NO: 20789 - RNA, 19 nt, artificial
  Oligomer
auaaaaaacucauguucaa

SEQ ID NO: 20790 - RNA, 19 nt, artificial
  Oligomer
ugugaggguuaaugaaaua

SEQ ID NO: 20791 - RNA, 19 nt, artificial
  Oligomer
aagagaaucuccgcaagaa

SEQ ID NO: 20792 - RNA, 19 nt, artificial
  Oligomer
gaguauuuggaugacagaa

SEQ ID NO: 20793 - RNA, 19 nt, artificial
  Oligomer
gaaauguucuugcaguuaa

SEQ ID NO: 20794 - RNA, 19 nt, artificial
  Oligomer
cauguugaauuuucucuaa

SEQ ID NO: 20795 - RNA, 19 nt, artificial
  Oligomer
gcauugugaggguuaauga

SEQ ID NO: 20796 - RNA, 19 nt, artificial
  Oligomer
ggaaacuacuuccugaaaa

SEQ ID NO: 20797 - RNA, 19 nt, artificial
  Oligomer
ccaucaucacacuggaaga

SEQ ID NO: 20798 - RNA, 19 nt, artificial
  Oligomer
agugcauugugaggguuaa

SEQ ID NO: 20799 - RNA, 19 nt, artificial
  Oligomer
gcguguggaguauuuggau

SEQ ID NO: 20800 - RNA, 19 nt, artificial
  Oligomer
gguggguugguaguuucua

SEQ ID NO: 20801 - RNA, 19 nt, artificial
  Oligomer
cuuaguaccuaaaaggaaa

SEQ ID NO: 20802 - RNA, 19 nt, artificial
  Oligomer
caauaggugugcgucagaa

SEQ ID NO: 20803 - RNA, 19 nt, artificial
  Oligomer
caugagcgcugcucagaua

SEQ ID NO: 20804 - RNA, 19 nt, artificial
  Oligomer
ccaucuacaagcagucaca

SEQ ID NO: 20805 - RNA, 19 nt, artificial
  Oligomer
guuugggagauguaagaaa

SEQ ID NO: 20806 - RNA, 19 nt, artificial
  Oligomer
gggagauguaagaaauguu

SEQ ID NO: 20807 - RNA, 19 nt, artificial
  Oligomer
cagugguaaucuacuggga

SEQ ID NO: 20808 - RNA, 19 nt, artificial
  Oligomer
ugaucuggauccaccaaga

SEQ ID NO: 20809 - RNA, 19 nt, artificial
  Oligomer
gaaaccacuggauggagaa

SEQ ID NO: 20810 - RNA, 19 nt, artificial
  Oligomer
ggacauaccagcuuagauu

SEQ ID NO: 20811 - RNA, 19 nt, artificial
  Oligomer
cgaucucuuauuuuacaau

SEQ ID NO: 20812 - RNA, 19 nt, artificial
  Oligomer
cccucugagucaggaaaca

SEQ ID NO: 20813 - RNA, 19 nt, artificial
  Oligomer
gaucucuuauuuuacaaua

SEQ ID NO: 20814 - RNA, 19 nt, artificial
  Oligomer
ccagaugaagcucccagaa

SEQ ID NO: 20815 - RNA, 19 nt, artificial
  Oligomer
aguuaaggguuaguuuaca

SEQ ID NO: 20816 - RNA, 19 nt, artificial
  Oligomer
caucuuuuacauucugcaa

SEQ ID NO: 20817 - RNA, 19 nt, artificial
  Oligomer
aacucauguucaagacaga

SEQ ID NO: 20818 - RNA, 19 nt, artificial
  Oligomer
gaagagaaucuccgcaaga

SEQ ID NO: 20819 - RNA, 19 nt, artificial
  Oligomer
gagucaggaaacauuuuca

SEQ ID NO: 20820 - RNA, 19 nt, artificial
  Oligomer
ggauuucaucucuuguaua

SEQ ID NO: 20821 - RNA, 19 nt, artificial
  Oligomer
aggacauaccagcuuagau

SEQ ID NO: 20822 - RNA, 19 nt, artificial
  Oligomer
ccuuaguaccuaaaaggaa

SEQ ID NO: 20823 - RNA, 19 nt, artificial
  Oligomer
ccaccauccacuacaacua

SEQ ID NO: 20824 - RNA, 19 nt, artificial
  Oligomer
caaagaagaaaccacugga

SEQ ID NO: 20825 - RNA, 19 nt, artificial
  Oligomer
aaggguuaguuuacaauca

SEQ ID NO: 20826 - RNA, 19 nt, artificial
  Oligomer
gagaauauuucacccuuca

SEQ ID NO: 20827 - RNA, 19 nt, artificial
  Oligomer
auaucgaucucuuauuuua

SEQ ID NO: 20828 - RNA, 19 nt, artificial
  Oligomer
cgaccuuaguaccuaaaag

SEQ ID NO: 20829 - RNA, 19 nt, artificial
  Oligomer
ugaggguuaaugaaauaau

SEQ ID NO: 20830 - RNA, 19 nt, artificial
  Oligomer
ggaagacuccagugguaau

SEQ ID NO: 20831 - RNA, 19 nt, artificial
  Oligomer
gaggauuucaucucuugua

SEQ ID NO: 20832 - RNA, 19 nt, artificial
  Oligomer
gaagggucaacaucuuuua

SEQ ID NO: 20833 - RNA, 19 nt, artificial
  Oligomer
ggaugacagaaacacuuuu

SEQ ID NO: 20834 - RNA, 19 nt, artificial
  Oligomer
gcgcacagaggaagagaau

SEQ ID NO: 20835 - RNA, 19 nt, artificial
  Oligomer
aaauguucuugcaguuaag

SEQ ID NO: 20836 - RNA, 19 nt, artificial
  Oligomer
cauaaaaaacucauguuca

SEQ ID NO: 20837 - RNA, 19 nt, artificial
  Oligomer
caccaucaucacacuggaa

SEQ ID NO: 20838 - RNA, 19 nt, artificial
  Oligomer
agguagagggaguugucaa

SEQ ID NO: 20839 - RNA, 19 nt, artificial
  Oligomer
ucgaucucuuauuuuacaa

SEQ ID NO: 20840 - RNA, 19 nt, artificial
  Oligomer
cuggaagacuccaguggua

SEQ ID NO: 20841 - RNA, 19 nt, artificial
  Oligomer
uugugaggguuaaugaaau

SEQ ID NO: 20842 - RNA, 19 nt, artificial
  Oligomer
gaauauuucacccuucaga

SEQ ID NO: 20843 - RNA, 19 nt, artificial
  Oligomer
gcuucgagauguuccgaga

SEQ ID NO: 20844 - RNA, 19 nt, artificial
  Oligomer
cgucccaagcaauggauga

SEQ ID NO: 20845 - RNA, 19 nt, artificial
  Oligomer
cauuuucagaccuauggaa

SEQ ID NO: 20846 - RNA, 19 nt, artificial
  Oligomer
ccuugaaaccaccuuuuau

SEQ ID NO: 20847 - RNA, 19 nt, artificial
  Oligomer
uguauaugaugaucuggau

SEQ ID NO: 20848 - RNA, 19 nt, artificial
  Oligomer
gaaacauuuucagaccuau

SEQ ID NO: 20849 - RNA, 19 nt, artificial
  Oligomer
caaggcccauaucugugaa

SEQ ID NO: 20850 - RNA, 19 nt, artificial
  Oligomer
ugaugaucuggauccacca

SEQ ID NO: 20851 - RNA, 19 nt, artificial
  Oligomer
ccaccaagacuuguuuuau

SEQ ID NO: 20852 - RNA, 19 nt, artificial
  Oligomer
ggaagagaaucuccgcaag

SEQ ID NO: 20853 - RNA, 19 nt, artificial
  Oligomer
ggaaacauuuucagaccua

SEQ ID NO: 20854 - RNA, 19 nt, artificial
  Oligomer
gaaauuugcguguggagua

SEQ ID NO: 20855 - RNA, 19 nt, artificial
  Oligomer
accacuggauggagaauau

SEQ ID NO: 20856 - RNA, 19 nt, artificial
  Oligomer
uggguugguaguuucuaca

SEQ ID NO: 20857 - RNA, 19 nt, artificial
  Oligomer
augaggccuuggaacucaa

SEQ ID NO: 20858 - RNA, 19 nt, artificial
  Oligomer
caagcaauggaugauuuga

SEQ ID NO: 20859 - RNA, 19 nt, artificial
  Oligomer
cccucauguugaauuuucu

SEQ ID NO: 20860 - RNA, 19 nt, artificial
  Oligomer
cagcuuagauuuuaagguu

SEQ ID NO: 20861 - RNA, 19 nt, artificial
  Oligomer
cuggaagggucaacaucuu

SEQ ID NO: 20862 - RNA, 19 nt, artificial
  Oligomer
ggcauuugcaccuaccuca

SEQ ID NO: 20863 - RNA, 19 nt, artificial
  Oligomer
aguauuuggaugacagaaa

SEQ ID NO: 20864 - RNA, 19 nt, artificial
  Oligomer
agacuccagugguaaucua

SEQ ID NO: 20865 - RNA, 19 nt, artificial
  Oligomer
gguugguaguuucuacagu

SEQ ID NO: 20866 - RNA, 19 nt, artificial
  Oligomer
gagggaguugucaagucuu

SEQ ID NO: 20867 - RNA, 19 nt, artificial
  Oligomer
aucgaucucuuauuuuaca

SEQ ID NO: 20868 - RNA, 19 nt, artificial
  Oligomer
ucaccaucaucacacugga

SEQ ID NO: 20869 - RNA, 19 nt, artificial
  Oligomer
caccguacuaaccagggaa

SEQ ID NO: 20870 - RNA, 19 nt, artificial
  Oligomer
guggguugguaguuucuac

SEQ ID NO: 20871 - RNA, 19 nt, artificial
  Oligomer
cagaccuauggaaacuacu

SEQ ID NO: 20872 - RNA, 19 nt, artificial
  Oligomer
gcuguggguugauuccaca

SEQ ID NO: 20873 - RNA, 19 nt, artificial
  Oligomer
gcaauaggugugcgucaga

SEQ ID NO: 20874 - RNA, 19 nt, artificial
  Oligomer
ggacgauauugaacaaugg

SEQ ID NO: 20875 - RNA, 19 nt, artificial
  Oligomer
cugacauucuccacuucuu

SEQ ID NO: 20876 - RNA, 19 nt, artificial
  Oligomer
cagaaaaccuaccagggca

SEQ ID NO: 20877 - RNA, 19 nt, artificial
  Oligomer
cagaaacacuuuucgacau

SEQ ID NO: 20878 - RNA, 19 nt, artificial
  Oligomer
ugacagaaacacuuuucga

SEQ ID NO: 20879 - RNA, 19 nt, artificial
  Oligomer
gugcauugugaggguuaau

SEQ ID NO: 20880 - RNA, 19 nt, artificial
  Oligomer
gaaaccaccuuuuauuaca

SEQ ID NO: 20881 - RNA, 19 nt, artificial
  Oligomer
ccuccuucucccuuuuuau

SEQ ID NO: 20882 - RNA, 19 nt, artificial
  Oligomer
aguaggacauaccagcuua

SEQ ID NO: 20883 - RNA, 19 nt, artificial
  Oligomer
gugaggguuaaugaaauaa

SEQ ID NO: 20884 - RNA, 19 nt, artificial
  Oligomer
aaguuuugagcuucucaaa

SEQ ID NO: 20885 - RNA, 19 nt, artificial
  Oligomer
uuggguuuugggucuuuga

SEQ ID NO: 20886 - RNA, 19 nt, artificial
  Oligomer
cauaccagcuuagauuuua

SEQ ID NO: 20887 - RNA, 19 nt, artificial
  Oligomer
aacuacuuccugaaaacaa

SEQ ID NO: 20888 - RNA, 19 nt, artificial
  Oligomer
cugugagggauguuuggga

SEQ ID NO: 20889 - RNA, 19 nt, artificial
  Oligomer
ugaacaaugguucacugaa

SEQ ID NO: 20890 - RNA, 19 nt, artificial
  Oligomer
ccaggacuuccauuugcuu

SEQ ID NO: 20891 - RNA, 19 nt, artificial
  Oligomer
ggaggauuucaucucuugu

SEQ ID NO: 20892 - RNA, 19 nt, artificial
  Oligomer
guugguaguuucuacaguu

SEQ ID NO: 20893 - RNA, 19 nt, artificial
  Oligomer
aagcaauggaugauuugau

SEQ ID NO: 20894 - RNA, 19 nt, artificial
  Oligomer
auguuugggagauguaaga

SEQ ID NO: 20895 - RNA, 19 nt, artificial
  Oligomer
agaccuauggaaacuacuu

SEQ ID NO: 20896 - RNA, 19 nt, artificial
  Oligomer
gaugaucuggauccaccaa

SEQ ID NO: 20897 - RNA, 19 nt, artificial
  Oligomer
aggaagagaaucuccgcaa

SEQ ID NO: 20898 - RNA, 19 nt, artificial
  Oligomer
cucacagagugcauuguga

SEQ ID NO: 20899 - RNA, 19 nt, artificial
  Oligomer
ccaccugaaguccaaaaag

SEQ ID NO: 20900 - RNA, 19 nt, artificial
  Oligomer
guggaguauuuggaugaca

SEQ ID NO: 20901 - RNA, 19 nt, artificial
  Oligomer
ggaguaggacauaccagcu

SEQ ID NO: 20902 - RNA, 19 nt, artificial
  Oligomer
cucugagucaggaaacauu

SEQ ID NO: 20903 - RNA, 19 nt, artificial
  Oligomer
uuauccgaguggaaggaaa

SEQ ID NO: 20904 - RNA, 19 nt, artificial
  Oligomer
cacuggauggagaauauuu

SEQ ID NO: 20905 - RNA, 19 nt, artificial
  Oligomer
ugagcuucucaaaagucua

SEQ ID NO: 20906 - RNA, 19 nt, artificial
  Oligomer
caguuaaggguuaguuuac

SEQ ID NO: 20907 - RNA, 19 nt, artificial
  Oligomer
cccacuucaccguacuaac

SEQ ID NO: 20908 - RNA, 19 nt, artificial
  Oligomer
gcccacuucaccguacuaa

SEQ ID NO: 20909 - RNA, 19 nt, artificial
  Oligomer
uggaaacuacuuccugaaa

SEQ ID NO: 20910 - RNA, 19 nt, artificial
  Oligomer
cauccucaccaucaucaca

SEQ ID NO: 20911 - RNA, 19 nt, artificial
  Oligomer
gagaaucuccgcaagaaag

SEQ ID NO: 20912 - RNA, 19 nt, artificial
  Oligomer
ccugaaguccaaaaagggu

SEQ ID NO: 20913 - RNA, 19 nt, artificial
  Oligomer
auggaaacuacuuccugaa

SEQ ID NO: 20914 - RNA, 19 nt, artificial
  Oligomer
caucuucugucccuuccca

SEQ ID NO: 20915 - RNA, 19 nt, artificial
  Oligomer
gucaggaaacauuuucaga

SEQ ID NO: 20916 - RNA, 19 nt, artificial
  Oligomer
aucccauuuuuauaucgau

SEQ ID NO: 20917 - RNA, 19 nt, artificial
  Oligomer
caccaagacuuguuuuaug

SEQ ID NO: 20918 - RNA, 19 nt, artificial
  Oligomer
cgucugggcuucuugcauu

SEQ ID NO: 20919 - RNA, 19 nt, artificial
  Oligomer
cugagucaggaaacauuuu

SEQ ID NO: 20920 - RNA, 19 nt, artificial
  Oligomer
gaacaaugguucacugaag

SEQ ID NO: 20921 - RNA, 19 nt, artificial
  Oligomer
acucauguucaagacagaa

SEQ ID NO: 20922 - RNA, 19 nt, artificial
  Oligomer
auugugaggguuaaugaaa

SEQ ID NO: 20923 - RNA, 19 nt, artificial
  Oligomer
uaccuaaaaggaaaucuca

SEQ ID NO: 20924 - RNA, 19 nt, artificial
  Oligomer
cgcuaaaaguuuugagcuu

SEQ ID NO: 20925 - RNA, 19 nt, artificial
  Oligomer
aggauuucaucucuuguau

SEQ ID NO: 20926 - RNA, 19 nt, artificial
  Oligomer
cugacuguaccaccaucca

SEQ ID NO: 20927 - RNA, 19 nt, artificial
  Oligomer
gccuugaaaccaccuuuua

SEQ ID NO: 20928 - RNA, 19 nt, artificial
  Oligomer
agcugaaugaggccuugga

SEQ ID NO: 20929 - RNA, 19 nt, artificial
  Oligomer
gaaacuacuuccugaaaac

SEQ ID NO: 20930 - RNA, 19 nt, artificial
  Oligomer
ccauccacuacaacuacau

SEQ ID NO: 20931 - RNA, 19 nt, artificial
  Oligomer
gagcuggaagggucaacau

SEQ ID NO: 20932 - RNA, 19 nt, artificial
  Oligomer
ugaauuuucucuaacuuca

SEQ ID NO: 20933 - RNA, 19 nt, artificial
  Oligomer
uauggaaacuacuuccuga

SEQ ID NO: 20934 - RNA, 19 nt, artificial
  Oligomer
gauuucaucucuuguauau

SEQ ID NO: 20935 - RNA, 19 nt, artificial
  Oligomer
uggaguauuuggaugacag

SEQ ID NO: 20936 - RNA, 19 nt, artificial
  Oligomer
uuugggagauguaagaaau

SEQ ID NO: 20937 - RNA, 19 nt, artificial
  Oligomer
aggguuaguuuacaaucag

SEQ ID NO: 20938 - RNA, 19 nt, artificial
  Oligomer
cucagacugacauucucca

SEQ ID NO: 20939 - RNA, 19 nt, artificial
  Oligomer
gcuuagauuuuaagguuuu

SEQ ID NO: 20940 - RNA, 19 nt, artificial
  Oligomer
ccugcacugguguuuuguu

SEQ ID NO: 20941 - RNA, 19 nt, artificial
  Oligomer
cuuugaggugcguguuugu

SEQ ID NO: 20942 - RNA, 19 nt, artificial
  Oligomer
uccucagcaucuuauccga

SEQ ID NO: 20943 - RNA, 19 nt, artificial
  Oligomer
ugcaguuaaggguuaguuu

SEQ ID NO: 20944 - RNA, 19 nt, artificial
  Oligomer
aggccuuggaacucaagga

SEQ ID NO: 20945 - RNA, 19 nt, artificial
  Oligomer
aagcagucacagcacauga

SEQ ID NO: 20946 - RNA, 19 nt, artificial
  Oligomer
agcugguuagguagaggga

SEQ ID NO: 20947 - RNA, 19 nt, artificial
  Oligomer
ggguuuugggucuuugaac

SEQ ID NO: 20948 - RNA, 19 nt, artificial
  Oligomer
acagaaacacuuuucgaca

SEQ ID NO: 20949 - RNA, 19 nt, artificial
  Oligomer
guaaucuacugggacggaa

SEQ ID NO: 20950 - RNA, 19 nt, artificial
  Oligomer
gguagagggaguugucaag

SEQ ID NO: 20951 - RNA, 19 nt, artificial
  Oligomer
uuuuuauaucgaucucuua

SEQ ID NO: 20952 - RNA, 19 nt, artificial
  Oligomer
ugguggguugguaguuucu

SEQ ID NO: 20953 - RNA, 19 nt, artificial
  Oligomer
cuuuuuauaucccauuuuu

SEQ ID NO: 20954 - RNA, 19 nt, artificial
  Oligomer
cugcccucaacaagauguu

SEQ ID NO: 20955 - RNA, 19 nt, artificial
  Oligomer
aaaguuuugagcuucucaa

SEQ ID NO: 20956 - RNA, 19 nt, artificial
  Oligomer
gaggaagagaaucuccgca

SEQ ID NO: 20957 - RNA, 19 nt, artificial
  Oligomer
gugagcgcuucgagauguu

SEQ ID NO: 20958 - RNA, 19 nt, artificial
  Oligomer
aagcacaucugcauuuuca

SEQ ID NO: 20959 - RNA, 19 nt, artificial
  Oligomer
ggauccaccaagacuuguu

SEQ ID NO: 20960 - RNA, 19 nt, artificial
  Oligomer
cugacaaccucuuggucga

SEQ ID NO: 20961 - RNA, 19 nt, artificial
  Oligomer
uuacauucugcaagcacau

SEQ ID NO: 20962 - RNA, 19 nt, artificial
  Oligomer
uucugucccuucccagaaa

SEQ ID NO: 20963 - RNA, 19 nt, artificial
  Oligomer
ccuggaggauuucaucucu

SEQ ID NO: 20964 - RNA, 19 nt, artificial
  Oligomer
aaggaaauuugcgugugga

SEQ ID NO: 20965 - RNA, 19 nt, artificial
  Oligomer
aagaaauguucuugcaguu

SEQ ID NO: 20966 - RNA, 19 nt, artificial
  Oligomer
gccugacucagacugacau

SEQ ID NO: 20967 - RNA, 19 nt, artificial
  Oligomer
cccaggacuuccauuugcu

SEQ ID NO: 20968 - RNA, 19 nt, artificial
  Oligomer
ccacuggauggagaauauu

SEQ ID NO: 20969 - RNA, 19 nt, artificial
  Oligomer
uccaaaaagggucagucua

SEQ ID NO: 20970 - RNA, 19 nt, artificial
  Oligomer
aacaaugguucacugaaga

SEQ ID NO: 20971 - RNA, 19 nt, artificial
  Oligomer
agauuuuaagguuuuuacu

SEQ ID NO: 20972 - RNA, 19 nt, artificial
  Oligomer
ucgaccuuaguaccuaaaa

SEQ ID NO: 20973 - RNA, 19 nt, artificial
  Oligomer
ccucuuggucgaccuuagu

SEQ ID NO: 20974 - RNA, 19 nt, artificial
  Oligomer
acauuuucagaccuaugga

SEQ ID NO: 20975 - RNA, 19 nt, artificial
  Oligomer
aggguuaaugaaauaaugu

SEQ ID NO: 20976 - RNA, 19 nt, artificial
  Oligomer
ugaagacccagguccagau

SEQ ID NO: 20977 - RNA, 19 nt, artificial
  Oligomer
ugcguguggaguauuugga

SEQ ID NO: 20978 - RNA, 19 nt, artificial
  Oligomer
cccugucugacaaccucuu

SEQ ID NO: 20979 - RNA, 19 nt, artificial
  Oligomer
gauguuugggagauguaag

SEQ ID NO: 20980 - RNA, 19 nt, artificial
  Oligomer
ggcccauaucugugaaaug

SEQ ID NO: 20981 - RNA, 19 nt, artificial
  Oligomer
guguggaguauuuggauga

SEQ ID NO: 20982 - RNA, 19 nt, artificial
  Oligomer
agguuuuuacugugaggga

SEQ ID NO: 20983 - RNA, 19 nt, artificial
  Oligomer
gcugguggguugguaguuu

SEQ ID NO: 20984 - RNA, 19 nt, artificial
  Oligomer
aaaccaccuuuuauuacau

SEQ ID NO: 20985 - RNA, 19 nt, artificial
  Oligomer
ggaguugucaagucuugcu

SEQ ID NO: 20986 - RNA, 19 nt, artificial
  Oligomer
cccucaacaagauguuuug

SEQ ID NO: 20987 - RNA, 19 nt, artificial
  Oligomer
acaucuuuuacauucugca

SEQ ID NO: 20988 - RNA, 19 nt, artificial
  Oligomer
cccuccuucucccuuuuua

SEQ ID NO: 20989 - RNA, 19 nt, artificial
  Oligomer
cccauaucugugaaaugcu

SEQ ID NO: 20990 - RNA, 19 nt, artificial
  Oligomer
aauauuucacccuucagau

SEQ ID NO: 20991 - RNA, 19 nt, artificial
  Oligomer
ccauaucugugaaaugcug

SEQ ID NO: 20992 - RNA, 19 nt, artificial
  Oligomer
augguucacugaagaccca

SEQ ID NO: 20993 - RNA, 19 nt, artificial
  Oligomer
uugggcagcugguuaggua

SEQ ID NO: 20994 - RNA, 19 nt, artificial
  Oligomer
gauauugaacaaugguuca

SEQ ID NO: 20995 - RNA, 19 nt, artificial
  Oligomer
ucccuucccagaaaaccua

SEQ ID NO: 20996 - RNA, 19 nt, artificial
  Oligomer
cuucugucccuucccagaa

SEQ ID NO: 20997 - RNA, 19 nt, artificial
  Oligomer
cuuagauuuuaagguuuuu

SEQ ID NO: 20998 - RNA, 19 nt, artificial
  Oligomer
cuaacuucaaggcccauau

SEQ ID NO: 20999 - RNA, 19 nt, artificial
  Oligomer
gucccuucccagaaaaccu

SEQ ID NO: 21000 - RNA, 19 nt, artificial
  Oligomer
aguuuugagcuucucaaaa

SEQ ID NO: 21001 - RNA, 19 nt, artificial
  Oligomer
agauguaagaaauguucuu

SEQ ID NO: 21002 - RNA, 19 nt, artificial
  Oligomer
ucugucccuucccagaaaa

SEQ ID NO: 21003 - RNA, 19 nt, artificial
  Oligomer
uuuacauucugcaagcaca

SEQ ID NO: 21004 - RNA, 19 nt, artificial
  Oligomer
gagugcauugugaggguua

SEQ ID NO: 21005 - RNA, 19 nt, artificial
  Oligomer
gggcuccacugaacaaguu

SEQ ID NO: 21006 - RNA, 19 nt, artificial
  Oligomer
ggaagcugucccucauguu

SEQ ID NO: 21007 - RNA, 19 nt, artificial
  Oligomer
agaaacacuuuucgacaua

SEQ ID NO: 21008 - RNA, 19 nt, artificial
  Oligomer
ggguugguaguuucuacag

SEQ ID NO: 21009 - RNA, 19 nt, artificial
  Oligomer
ccgaguggaaggaaauuug

SEQ ID NO: 21010 - RNA, 19 nt, artificial
  Oligomer
cccaagcaauggaugauuu

SEQ ID NO: 21011 - RNA, 19 nt, artificial
  Oligomer
gcuggaagggucaacaucu

SEQ ID NO: 21012 - RNA, 19 nt, artificial
  Oligomer
uguuugggagauguaagaa

SEQ ID NO: 21013 - RNA, 19 nt, artificial
  Oligomer
cagagugcauugugagggu

SEQ ID NO: 21014 - RNA, 19 nt, artificial
  Oligomer
gaagaaaccacuggaugga

SEQ ID NO: 21015 - RNA, 19 nt, artificial
  Oligomer
ggccuuggaacucaaggau

SEQ ID NO: 21016 - RNA, 19 nt, artificial
  Oligomer
gucgaccuuaguaccuaaa

SEQ ID NO: 21017 - RNA, 19 nt, artificial
  Oligomer
gguuuuuacugugagggau

SEQ ID NO: 21018 - RNA, 19 nt, artificial
  Oligomer
gauccaccaagacuuguuu

SEQ ID NO: 21019 - RNA, 19 nt, artificial
  Oligomer
acuacuuccugaaaacaac

SEQ ID NO: 21020 - RNA, 19 nt, artificial
  Oligomer
ucauguugaauuuucucua

SEQ ID NO: 21021 - RNA, 19 nt, artificial
  Oligomer
ccaagacuuguuuuaugcu

SEQ ID NO: 21022 - RNA, 19 nt, artificial
  Oligomer
cauuugcaccuaccucaca

SEQ ID NO: 21023 - RNA, 19 nt, artificial
  Oligomer
gguaguuucuacaguuggg

SEQ ID NO: 21024 - RNA, 19 nt, artificial
  Oligomer
gacucagacugacauucuc

SEQ ID NO: 21025 - RNA, 19 nt, artificial
  Oligomer
guauuuggaugacagaaac

SEQ ID NO: 21026 - RNA, 19 nt, artificial
  Oligomer
agagggaguugucaagucu

SEQ ID NO: 21027 - RNA, 19 nt, artificial
  Oligomer
agaaaccacuggauggaga

SEQ ID NO: 21028 - RNA, 19 nt, artificial
  Oligomer
aaagaagaaaccacuggau

SEQ ID NO: 21029 - RNA, 19 nt, artificial
  Oligomer
guaggacauaccagcuuag

SEQ ID NO: 21030 - RNA, 19 nt, artificial
  Oligomer
agucacagcacaugacgga

SEQ ID NO: 21031 - RNA, 19 nt, artificial
  Oligomer
cgaguggaaggaaauuugc

SEQ ID NO: 21032 - RNA, 19 nt, artificial
  Oligomer
ucuggauccaccaagacuu

SEQ ID NO: 21033 - RNA, 19 nt, artificial
  Oligomer
ggccuugaaaccaccuuuu

SEQ ID NO: 21034 - RNA, 19 nt, artificial
  Oligomer
ggguuaguuuacaaucagc

SEQ ID NO: 21035 - RNA, 19 nt, artificial
  Oligomer
gacauaccagcuuagauuu

SEQ ID NO: 21036 - RNA, 19 nt, artificial
  Oligomer
caccugaaguccaaaaagg

SEQ ID NO: 21037 - RNA, 19 nt, artificial
  Oligomer
uguugaauuuucucuaacu

SEQ ID NO: 21038 - RNA, 19 nt, artificial
  Oligomer
cugguuagguagagggagu

SEQ ID NO: 21039 - RNA, 19 nt, artificial
  Oligomer
ccagcuuagauuuuaaggu

SEQ ID NO: 21040 - RNA, 19 nt, artificial
  Oligomer
ggucaacaucuuuuacauu

SEQ ID NO: 21041 - RNA, 19 nt, artificial
  Oligomer
agcacaugacggagguugu

SEQ ID NO: 21042 - RNA, 19 nt, artificial
  Oligomer
ccucugagucaggaaacau

SEQ ID NO: 21043 - RNA, 19 nt, artificial
  Oligomer
ccauccucaccaucaucac

SEQ ID NO: 21044 - RNA, 19 nt, artificial
  Oligomer
cucccuuuuuauaucccau

SEQ ID NO: 21045 - RNA, 19 nt, artificial
  Oligomer
cuugaaaccaccuuuuauu

SEQ ID NO: 21046 - RNA, 19 nt, artificial
  Oligomer
ucugcaagcacaucugcau

SEQ ID NO: 21047 - RNA, 19 nt, artificial
  Oligomer
cuccuucucccuuuuuaua

SEQ ID NO: 21048 - RNA, 19 nt, artificial
  Oligomer
acuguaccaccauccacua

SEQ ID NO: 21049 - RNA, 19 nt, artificial
  Oligomer
uaggacauaccagcuuaga

SEQ ID NO: 21050 - RNA, 19 nt, artificial
  Oligomer
auaugaugaucuggaucca

SEQ ID NO: 21051 - RNA, 19 nt, artificial
  Oligomer
ccugacucagacugacauu

SEQ ID NO: 21052 - RNA, 19 nt, artificial
  Oligomer
cagcuuugaggugcguguu

SEQ ID NO: 21053 - RNA, 19 nt, artificial
  Oligomer
guccaaaaagggucagucu

SEQ ID NO: 21054 - RNA, 19 nt, artificial
  Oligomer
acacccuggaggauuucau

SEQ ID NO: 21055 - RNA, 19 nt, artificial
  Oligomer
gugagggauguuugggaga

SEQ ID NO: 21056 - RNA, 19 nt, artificial
  Oligomer
accuuaguaccuaaaagga

SEQ ID NO: 21057 - RNA, 19 nt, artificial
  Oligomer
ugugcagcuguggguugau

SEQ ID NO: 21058 - RNA, 19 nt, artificial
  Oligomer
cggacgauauugaacaaug

SEQ ID NO: 21059 - RNA, 19 nt, artificial
  Oligomer
caucucuuguauaugauga

SEQ ID NO: 21060 - RNA, 19 nt, artificial
  Oligomer
guugaauuuucucuaacuu

SEQ ID NO: 21061 - RNA, 19 nt, artificial
  Oligomer
uauccgaguggaaggaaau

SEQ ID NO: 21062 - RNA, 19 nt, artificial
  Oligomer
uguaagaaauguucuugca

SEQ ID NO: 21063 - RNA, 19 nt, artificial
  Oligomer
cugcaagcacaucugcauu

SEQ ID NO: 21064 - RNA, 19 nt, artificial
  Oligomer
cuggaggauuucaucucuu

SEQ ID NO: 21065 - RNA, 19 nt, artificial
  Oligomer
uuucaucucuuguauauga

SEQ ID NO: 21066 - RNA, 19 nt, artificial
  Oligomer
aaauuugcguguggaguau

SEQ ID NO: 21067 - RNA, 19 nt, artificial
  Oligomer
gcacagaggaagagaaucu

SEQ ID NO: 21068 - RNA, 19 nt, artificial
  Oligomer
cuucccagaaaaccuacca

SEQ ID NO: 21069 - RNA, 19 nt, artificial
  Oligomer
aagacagaagggccugacu

SEQ ID NO: 21070 - RNA, 19 nt, artificial
  Oligomer
gacgauauugaacaauggu

SEQ ID NO: 21071 - RNA, 19 nt, artificial
  Oligomer
gguaaucuacugggacgga

SEQ ID NO: 21072 - RNA, 19 nt, artificial
  Oligomer
aaucuacugggacggaaca

SEQ ID NO: 21073 - RNA, 19 nt, artificial
  Oligomer
cuuuuacauucugcaagca

SEQ ID NO: 21074 - RNA, 19 nt, artificial
  Oligomer
guuaaugaaauaauguaca

SEQ ID NO: 21075 - RNA, 19 nt, artificial
  Oligomer
ucugagucaggaaacauuu

SEQ ID NO: 21076 - RNA, 19 nt, artificial
  Oligomer
auagugugguggugcccua

SEQ ID NO: 21077 - RNA, 19 nt, artificial
  Oligomer
ucucuaacuucaaggccca

SEQ ID NO: 21078 - RNA, 19 nt, artificial
  Oligomer
aaggcccauaucugugaaa

SEQ ID NO: 21079 - RNA, 19 nt, artificial
  Oligomer
uaucgaucucuuauuuuac

SEQ ID NO: 21080 - RNA, 19 nt, artificial
  Oligomer
cccuuuuuauaucccauuu

SEQ ID NO: 21081 - RNA, 19 nt, artificial
  Oligomer
ggagaauauuucacccuuc

SEQ ID NO: 21082 - RNA, 19 nt, artificial
  Oligomer
cagcuguggguugauucca

SEQ ID NO: 21083 - RNA, 19 nt, artificial
  Oligomer
ccaaaaagggucagucuac

SEQ ID NO: 21084 - RNA, 19 nt, artificial
  Oligomer
ggaagggucaacaucuuuu

SEQ ID NO: 21085 - RNA, 19 nt, artificial
  Oligomer
cacccuggaggauuucauc

SEQ ID NO: 21086 - RNA, 19 nt, artificial
  Oligomer
ccacauucuagguagguag

SEQ ID NO: 21087 - RNA, 19 nt, artificial
  Oligomer
uccagaugaagcucccaga

SEQ ID NO: 21088 - RNA, 19 nt, artificial
  Oligomer
uggucgaccuuaguaccua

SEQ ID NO: 21089 - RNA, 19 nt, artificial
  Oligomer
aaaaaacucauguucaaga

SEQ ID NO: 21090 - RNA, 19 nt, artificial
  Oligomer
cacuucaccguacuaacca

SEQ ID NO: 21091 - RNA, 19 nt, artificial
  Oligomer
uggagaauauuucacccuu

SEQ ID NO: 21092 - RNA, 19 nt, artificial
  Oligomer
gaguaggacauaccagcuu

SEQ ID NO: 21093 - RNA, 19 nt, artificial
  Oligomer
ccuaccucacagagugcau

SEQ ID NO: 21094 - RNA, 19 nt, artificial
  Oligomer
agggucaacaucuuuuaca

SEQ ID NO: 21095 - RNA, 19 nt, artificial
  Oligomer
cauucugcaagcacaucug

SEQ ID NO: 21096 - RNA, 19 nt, artificial
  Oligomer
cugucaucuucugucccuu

SEQ ID NO: 21097 - RNA, 19 nt, artificial
  Oligomer
acaguugggcagcugguua

SEQ ID NO: 21098 - RNA, 19 nt, artificial
  Oligomer
gguuaaugaaauaauguac

SEQ ID NO: 21099 - RNA, 19 nt, artificial
  Oligomer
ggacuuccauuugcuuugu

SEQ ID NO: 21100 - RNA, 19 nt, artificial
  Oligomer
aaacacuuuucgacauagu

SEQ ID NO: 21101 - RNA, 19 nt, artificial
  Oligomer
acccuugcuugcaauaggu

SEQ ID NO: 21102 - RNA, 19 nt, artificial
  Oligomer
uuuggaugacagaaacacu

SEQ ID NO: 21103 - RNA, 19 nt, artificial
  Oligomer
caacaucuuuuacauucug

SEQ ID NO: 21104 - RNA, 19 nt, artificial
  Oligomer
agcuuagauuuuaagguuu

SEQ ID NO: 21105 - RNA, 19 nt, artificial
  Oligomer
cucuuggucgaccuuagua

SEQ ID NO: 21106 - RNA, 19 nt, artificial
  Oligomer
uauuuggaugacagaaaca

SEQ ID NO: 21107 - RNA, 19 nt, artificial
  Oligomer
aaaccuaccagggcagcua

SEQ ID NO: 21108 - RNA, 19 nt, artificial
  Oligomer
caacaacaccagcuccucu

SEQ ID NO: 21109 - RNA, 19 nt, artificial
  Oligomer
cccuccucagcaucuuauc

SEQ ID NO: 21110 - RNA, 19 nt, artificial
  Oligomer
ucaccguacuaaccaggga

SEQ ID NO: 21111 - RNA, 19 nt, artificial
  Oligomer
gacggaacagcuuugaggu

SEQ ID NO: 21112 - RNA, 19 nt, artificial
  Oligomer
agggaguugucaagucuug

SEQ ID NO: 21113 - RNA, 19 nt, artificial
  Oligomer
gagauguuccgagagcuga

SEQ ID NO: 21114 - RNA, 19 nt, artificial
  Oligomer
cuggauccaccaagacuug

SEQ ID NO: 21115 - RNA, 19 nt, artificial
  Oligomer
cugguggguugguaguuuc

SEQ ID NO: 21116 - RNA, 19 nt, artificial
  Oligomer
gggucuuugaacccuugcu

SEQ ID NO: 21117 - RNA, 19 nt, artificial
  Oligomer
ucuucugucccuucccaga

SEQ ID NO: 21118 - RNA, 19 nt, artificial
  Oligomer
ccaagucugugacuugcac

SEQ ID NO: 21119 - RNA, 19 nt, artificial
  Oligomer
gucccaagcaauggaugau

SEQ ID NO: 21120 - RNA, 19 nt, artificial
  Oligomer
ucuacaagcagucacagca

SEQ ID NO: 21121 - RNA, 19 nt, artificial
  Oligomer
cuucaaggcccauaucugu

SEQ ID NO: 21122 - RNA, 19 nt, artificial
  Oligomer
uugaaaccaccuuuuauua

SEQ ID NO: 21123 - RNA, 19 nt, artificial
  Oligomer
ucagaagcacccaggacuu

SEQ ID NO: 21124 - RNA, 19 nt, artificial
  Oligomer
ccaagcaauggaugauuug

SEQ ID NO: 21125 - RNA, 19 nt, artificial
  Oligomer
gcauuugcaccuaccucac

SEQ ID NO: 21126 - RNA, 19 nt, artificial
  Oligomer
uaggugugcgucagaagca

SEQ ID NO: 21127 - RNA, 19 nt, artificial
  Oligomer
accugaaguccaaaaaggg

SEQ ID NO: 21128 - RNA, 19 nt, artificial
  Oligomer
uggaagacuccagugguaa

SEQ ID NO: 21129 - RNA, 19 nt, artificial
  Oligomer
ugggacggaacagcuuuga

SEQ ID NO: 21130 - RNA, 19 nt, artificial
  Oligomer
uuguauaugaugaucugga

SEQ ID NO: 21131 - RNA, 19 nt, artificial
  Oligomer
gacuguaccaccauccacu

SEQ ID NO: 21132 - RNA, 19 nt, artificial
  Oligomer
ggagauguaagaaauguuc

SEQ ID NO: 21133 - RNA, 19 nt, artificial
  Oligomer
gaaggaaauuugcgugugg

SEQ ID NO: 21134 - RNA, 19 nt, artificial
  Oligomer
ucaacaucuuuuacauucu

SEQ ID NO: 21135 - RNA, 19 nt, artificial
  Oligomer
agacugacauucuccacuu

SEQ ID NO: 21136 - RNA, 19 nt, artificial
  Oligomer
uguuccgagagcugaauga

SEQ ID NO: 21137 - RNA, 19 nt, artificial
  Oligomer
uuugaacccuugcuugcaa

SEQ ID NO: 21138 - RNA, 19 nt, artificial
  Oligomer
gagauguaagaaauguucu

SEQ ID NO: 21139 - RNA, 19 nt, artificial
  Oligomer
uaagaaauguucuugcagu

SEQ ID NO: 21140 - RNA, 19 nt, artificial
  Oligomer
agcacaucugcauuuucac

SEQ ID NO: 21141 - RNA, 19 nt, artificial
  Oligomer
uuggaugacagaaacacuu

SEQ ID NO: 21142 - RNA, 19 nt, artificial
  Oligomer
ccuuuuuauaucccauuuu

SEQ ID NO: 21143 - RNA, 19 nt, artificial
  Oligomer
uggaugacagaaacacuuu

SEQ ID NO: 21144 - RNA, 19 nt, artificial
  Oligomer
gugcagcuguggguugauu

SEQ ID NO: 21145 - RNA, 19 nt, artificial
  Oligomer
aagcugucccucauguuga

SEQ ID NO: 21146 - RNA, 19 nt, artificial
  Oligomer
cagaugaagcucccagaau

SEQ ID NO: 21147 - RNA, 19 nt, artificial
  Oligomer
ugaaguccaaaaaggguca

SEQ ID NO: 21148 - RNA, 19 nt, artificial
  Oligomer
aggaaauuugcguguggag

SEQ ID NO: 21149 - RNA, 19 nt, artificial
  Oligomer
ugggagauguaagaaaugu

SEQ ID NO: 21150 - RNA, 19 nt, artificial
  Oligomer
ucuuguauaugaugaucug

SEQ ID NO: 21151 - RNA, 19 nt, artificial
  Oligomer
gacagaaacacuuuucgac

SEQ ID NO: 21152 - RNA, 19 nt, artificial
  Oligomer
acaagcagucacagcacau

SEQ ID NO: 21153 - RNA, 19 nt, artificial
  Oligomer
cuccagugguaaucuacug

SEQ ID NO: 21154 - RNA, 19 nt, artificial
  Oligomer
cguguggaguauuuggaug

SEQ ID NO: 21155 - RNA, 19 nt, artificial
  Oligomer
gagggauguuugggagaug

SEQ ID NO: 21156 - RNA, 19 nt, artificial
  Oligomer
ggaaauuugcguguggagu

SEQ ID NO: 21157 - RNA, 19 nt, artificial
  Oligomer
agggauguuugggagaugu

SEQ ID NO: 21158 - RNA, 19 nt, artificial
  Oligomer
aaacuacuuccugaaaaca

SEQ ID NO: 21159 - RNA, 19 nt, artificial
  Oligomer
cucagauagcgauggucug

SEQ ID NO: 21160 - RNA, 19 nt, artificial
  Oligomer
aucucuuguauaugaugau

SEQ ID NO: 21161 - RNA, 19 nt, artificial
  Oligomer
agcaauggaugauuugaug

SEQ ID NO: 21162 - RNA, 19 nt, artificial
  Oligomer
accauccacuacaacuaca

SEQ ID NO: 21163 - RNA, 19 nt, artificial
  Oligomer
aguggaaggaaauuugcgu

SEQ ID NO: 21164 - RNA, 19 nt, artificial
  Oligomer
ggucuuugaacccuugcuu

SEQ ID NO: 21165 - RNA, 19 nt, artificial
  Oligomer
cccauccucaccaucauca

SEQ ID NO: 21166 - RNA, 19 nt, artificial
  Oligomer
gaguggaaggaaauuugcg

SEQ ID NO: 21167 - RNA, 19 nt, artificial
  Oligomer
cuucuugcauucugggaca

SEQ ID NO: 21168 - RNA, 19 nt, artificial
  Oligomer
uugcaauaggugugcguca

SEQ ID NO: 21169 - RNA, 19 nt, artificial
  Oligomer
aggcccauaucugugaaau

SEQ ID NO: 21170 - RNA, 19 nt, artificial
  Oligomer
cuacaagcagucacagcac

SEQ ID NO: 21171 - RNA, 19 nt, artificial
  Oligomer
uccaccaagacuuguuuua

SEQ ID NO: 21172 - RNA, 19 nt, artificial
  Oligomer
gauguuccgagagcugaau

SEQ ID NO: 21173 - RNA, 19 nt, artificial
  Oligomer
aagcacccaggacuuccau

SEQ ID NO: 21174 - RNA, 19 nt, artificial
  Oligomer
agcuuugaggugcguguuu

SEQ ID NO: 21175 - RNA, 19 nt, artificial
  Oligomer
auuuuuauaucgaucucuu

SEQ ID NO: 21176 - RNA, 19 nt, artificial
  Oligomer
ccauuuuuauaucgaucuc

SEQ ID NO: 21177 - RNA, 19 nt, artificial
  Oligomer
gcacugguguuuuguugug

SEQ ID NO: 21178 - RNA, 19 nt, artificial
  Oligomer
cacaugacggagguuguga

SEQ ID NO: 21179 - RNA, 19 nt, artificial
  Oligomer
cguacuaaccagggaagcu

SEQ ID NO: 21180 - RNA, 19 nt, artificial
  Oligomer
acagcuuugaggugcgugu

SEQ ID NO: 21181 - RNA, 19 nt, artificial
  Oligomer
uccucaccaucaucacacu

SEQ ID NO: 21182 - RNA, 19 nt, artificial
  Oligomer
acuccagugguaaucuacu

SEQ ID NO: 21183 - RNA, 19 nt, artificial
  Oligomer
gggaguugucaagucuugc

SEQ ID NO: 21184 - RNA, 19 nt, artificial
  Oligomer
auuugcguguggaguauuu

SEQ ID NO: 21185 - RNA, 19 nt, artificial
  Oligomer
agaaauguucuugcaguua

SEQ ID NO: 21186 - RNA, 19 nt, artificial
  Oligomer
cugcucagauagcgauggu

SEQ ID NO: 21187 - RNA, 19 nt, artificial
  Oligomer
cauuuuggguuuugggucu

SEQ ID NO: 21188 - RNA, 19 nt, artificial
  Oligomer
accucuuggucgaccuuag

SEQ ID NO: 21189 - RNA, 19 nt, artificial
  Oligomer
uaucccauuuuuauaucga

SEQ ID NO: 21190 - RNA, 19 nt, artificial
  Oligomer
uacugggacggaacagcuu

SEQ ID NO: 21191 - RNA, 19 nt, artificial
  Oligomer
uuaaggguuaguuuacaau

SEQ ID NO: 21192 - RNA, 19 nt, artificial
  Oligomer
gcccucaacaagauguuuu

SEQ ID NO: 21193 - RNA, 19 nt, artificial
  Oligomer
acuggauggagaauauuuc

SEQ ID NO: 21194 - RNA, 19 nt, artificial
  Oligomer
agcuguggguugauuccac

SEQ ID NO: 21195 - RNA, 19 nt, artificial
  Oligomer
ugucccucauguugaauuu

SEQ ID NO: 21196 - RNA, 19 nt, artificial
  Oligomer
agucaggaaacauuuucag

SEQ ID NO: 21197 - RNA, 19 nt, artificial
  Oligomer
cacacccuggaggauuuca

SEQ ID NO: 21198 - RNA, 19 nt, artificial
  Oligomer
gauggagaauauuucaccc

SEQ ID NO: 21199 - RNA, 19 nt, artificial
  Oligomer
acaugacggagguugugag

SEQ ID NO: 21200 - RNA, 19 nt, artificial
  Oligomer
agaauauuucacccuucag

SEQ ID NO: 21201 - RNA, 19 nt, artificial
  Oligomer
uacaagcagucacagcaca

SEQ ID NO: 21202 - RNA, 19 nt, artificial
  Oligomer
gcgcuaaaaguuuugagcu

SEQ ID NO: 21203 - RNA, 19 nt, artificial
  Oligomer
gcacccaggacuuccauuu

SEQ ID NO: 21204 - RNA, 19 nt, artificial
  Oligomer
ugacacgcuucccuggauu

SEQ ID NO: 21205 - RNA, 19 nt, artificial
  Oligomer
gucugugacuugcacguac

SEQ ID NO: 21206 - RNA, 19 nt, artificial
  Oligomer
uagguagagggaguuguca

SEQ ID NO: 21207 - RNA, 19 nt, artificial
  Oligomer
caccauccacuacaacuac

SEQ ID NO: 21208 - RNA, 19 nt, artificial
  Oligomer
gacauucuccacuucuugu

SEQ ID NO: 21209 - RNA, 19 nt, artificial
  Oligomer
uuauaucgaucucuuauuu

SEQ ID NO: 21210 - RNA, 19 nt, artificial
  Oligomer
ugagggauguuugggagau

SEQ ID NO: 21211 - RNA, 19 nt, artificial
  Oligomer
ccugcccucaacaagaugu

SEQ ID NO: 21212 - RNA, 19 nt, artificial
  Oligomer
aaaaguuuugagcuucuca

SEQ ID NO: 21213 - RNA, 19 nt, artificial
  Oligomer
uuugcaccuaccucacaga

SEQ ID NO: 21214 - RNA, 19 nt, artificial
  Oligomer
aaaacucauguucaagaca

SEQ ID NO: 21215 - RNA, 19 nt, artificial
  Oligomer
ugcccucaacaagauguuu

SEQ ID NO: 21216 - RNA, 19 nt, artificial
  Oligomer
cuugcaguuaaggguuagu

SEQ ID NO: 21217 - RNA, 19 nt, artificial
  Oligomer
agaugaagcucccagaaug

SEQ ID NO: 21218 - RNA, 19 nt, artificial
  Oligomer
aauaggugugcgucagaag

SEQ ID NO: 21219 - RNA, 19 nt, artificial
  Oligomer
auuuucagaccuauggaaa

SEQ ID NO: 21220 - RNA, 19 nt, artificial
  Oligomer
acacuuuucgacauagugu

SEQ ID NO: 21221 - RNA, 19 nt, artificial
  Oligomer
gccugcacugguguuuugu

SEQ ID NO: 21222 - RNA, 19 nt, artificial
  Oligomer
uucugcaagcacaucugca

SEQ ID NO: 21223 - RNA, 19 nt, artificial
  Oligomer
gcucagauagcgauggucu

SEQ ID NO: 21224 - RNA, 19 nt, artificial
  Oligomer
gaaacacuuuucgacauag

SEQ ID NO: 21225 - RNA, 19 nt, artificial
  Oligomer
cauccacuacaacuacaug

SEQ ID NO: 21226 - RNA, 19 nt, artificial
  Oligomer
acugggacggaacagcuuu

SEQ ID NO: 21227 - RNA, 19 nt, artificial
  Oligomer
uuuuauaucgaucucuuau

SEQ ID NO: 21228 - RNA, 19 nt, artificial
  Oligomer
guaccuaaaaggaaaucuc

SEQ ID NO: 21229 - RNA, 19 nt, artificial
  Oligomer
uucaucucuuguauaugau

SEQ ID NO: 21230 - RNA, 19 nt, artificial
  Oligomer
ggauggagaauauuucacc

SEQ ID NO: 21231 - RNA, 19 nt, artificial
  Oligomer
ggcuucuugcauucuggga

SEQ ID NO: 21232 - RNA, 19 nt, artificial
  Oligomer
cagaggaagagaaucuccg

SEQ ID NO: 21233 - RNA, 19 nt, artificial
  Oligomer
cuaaaaguuuugagcuucu

SEQ ID NO: 21234 - RNA, 19 nt, artificial
  Oligomer
gaucuggauccaccaagac

SEQ ID NO: 21235 - RNA, 19 nt, artificial
  Oligomer
caauggaugauuugaugcu

SEQ ID NO: 21236 - RNA, 19 nt, artificial
  Oligomer
uguggaguauuuggaugac

SEQ ID NO: 21237 - RNA, 19 nt, artificial
  Oligomer
gcucugacuguaccaccau

SEQ ID NO: 21238 - RNA, 19 nt, artificial
  Oligomer
ugaacccuugcuugcaaua

SEQ ID NO: 21239 - RNA, 19 nt, artificial
  Oligomer
gcaagcacaucugcauuuu

SEQ ID NO: 21240 - RNA, 19 nt, artificial
  Oligomer
caggacuuccauuugcuuu

SEQ ID NO: 21241 - RNA, 19 nt, artificial
  Oligomer
ccugucaucuucugucccu

SEQ ID NO: 21242 - RNA, 19 nt, artificial
  Oligomer
ucauguucaagacagaagg

SEQ ID NO: 21243 - RNA, 19 nt, artificial
  Oligomer
guuuccgucugggcuucuu

SEQ ID NO: 21244 - RNA, 19 nt, artificial
  Oligomer
aaacauuuucagaccuaug

SEQ ID NO: 21245 - RNA, 19 nt, artificial
  Oligomer
uuaguaccuaaaaggaaau

SEQ ID NO: 21246 - RNA, 19 nt, artificial
  Oligomer
cccauuuuuauaucgaucu

SEQ ID NO: 21247 - RNA, 19 nt, artificial
  Oligomer
cacacuggaagacuccagu

SEQ ID NO: 21248 - RNA, 19 nt, artificial
  Oligomer
cucuaacuucaaggcccau

SEQ ID NO: 21249 - RNA, 19 nt, artificial
  Oligomer
guucaagacagaagggccu

SEQ ID NO: 21250 - RNA, 19 nt, artificial
  Oligomer
caaccucuuggucgaccuu

SEQ ID NO: 21251 - RNA, 19 nt, artificial
  Oligomer
agcagucacagcacaugac

SEQ ID NO: 21252 - RNA, 19 nt, artificial
  Oligomer
cucagcaucuuauccgagu

SEQ ID NO: 21253 - RNA, 19 nt, artificial
  Oligomer
acuucaccguacuaaccag

SEQ ID NO: 21254 - RNA, 19 nt, artificial
  Oligomer
ucucccuuuuuauauccca

SEQ ID NO: 21255 - RNA, 19 nt, artificial
  Oligomer
gacuccagugguaaucuac

SEQ ID NO: 21256 - RNA, 19 nt, artificial
  Oligomer
acauaccagcuuagauuuu

SEQ ID NO: 21257 - RNA, 19 nt, artificial
  Oligomer
guaagaaauguucuugcag

SEQ ID NO: 21258 - RNA, 19 nt, artificial
  Oligomer
ucaagacagaagggccuga

SEQ ID NO: 21259 - RNA, 19 nt, artificial
  Oligomer
aagacccagguccagauga

SEQ ID NO: 21260 - RNA, 19 nt, artificial
  Oligomer
cuuugaacccuugcuugca

SEQ ID NO: 21261 - RNA, 19 nt, artificial
  Oligomer
caggaaacauuuucagacc

SEQ ID NO: 21262 - RNA, 19 nt, artificial
  Oligomer
cugucccuucccagaaaac

SEQ ID NO: 21263 - RNA, 19 nt, artificial
  Oligomer
ccauaaaaaacucauguuc

SEQ ID NO: 21264 - RNA, 19 nt, artificial
  Oligomer
augaaauaauguacaucug

SEQ ID NO: 21265 - RNA, 19 nt, artificial
  Oligomer
uggaagggucaacaucuuu

SEQ ID NO: 21266 - RNA, 19 nt, artificial
  Oligomer
cgcacagaggaagagaauc

SEQ ID NO: 21267 - RNA, 19 nt, artificial
  Oligomer
uucauuaacccucacaaug

SEQ ID NO: 21268 - RNA, 19 nt, artificial
  Oligomer
ucugucauccaaauacucc

SEQ ID NO: 21269 - RNA, 19 nt, artificial
  Oligomer
uuucuugcggagauucucu

SEQ ID NO: 21270 - RNA, 19 nt, artificial
  Oligomer
uuacaucucccaaacaucc

SEQ ID NO: 21271 - RNA, 19 nt, artificial
  Oligomer
uuagguacuaaggucgacc

SEQ ID NO: 21272 - RNA, 19 nt, artificial
  Oligomer
uuguucaauaucguccggg

SEQ ID NO: 21273 - RNA, 19 nt, artificial
  Oligomer
uuguaaacuaacccuuaac

SEQ ID NO: 21274 - RNA, 19 nt, artificial
  Oligomer
uacauuauuucauuaaccc

SEQ ID NO: 21275 - RNA, 19 nt, artificial
  Oligomer
uucaacaugagggacagcu

SEQ ID NO: 21276 - RNA, 19 nt, artificial
  Oligomer
uugaaguuagagaaaauuc

SEQ ID NO: 21277 - RNA, 19 nt, artificial
  Oligomer
uuaaaaucuaagcugguau

SEQ ID NO: 21278 - RNA, 19 nt, artificial
  Oligomer
uaaacuaacccuuaacugc

SEQ ID NO: 21279 - RNA, 19 nt, artificial
  Oligomer
uucaucuggaccugggucu

SEQ ID NO: 21280 - RNA, 19 nt, artificial
  Oligomer
uuccacucggauaagaugc

SEQ ID NO: 21281 - RNA, 19 nt, artificial
  Oligomer
uucagcucucggaacaucu

SEQ ID NO: 21282 - RNA, 19 nt, artificial
  Oligomer
auguaaaagauguugaccc

SEQ ID NO: 21283 - RNA, 19 nt, artificial
  Oligomer
cauuauuucauuaacccuc

SEQ ID NO: 21284 - RNA, 19 nt, artificial
  Oligomer
uucaaagacccaaaaccca

SEQ ID NO: 21285 - RNA, 19 nt, artificial
  Oligomer
ugaaauauucuccauccag

SEQ ID NO: 21286 - RNA, 19 nt, artificial
  Oligomer
uuguaguggauggugguac

SEQ ID NO: 21287 - RNA, 19 nt, artificial
  Oligomer
uuccaaggccucauucagc

SEQ ID NO: 21288 - RNA, 19 nt, artificial
  Oligomer
uacaucucccaaacauccc

SEQ ID NO: 21289 - RNA, 19 nt, artificial
  Oligomer
uugaacaugaguuuuuuau

SEQ ID NO: 21290 - RNA, 19 nt, artificial
  Oligomer
uauuucauuaacccucaca

SEQ ID NO: 21291 - RNA, 19 nt, artificial
  Oligomer
uucuugcggagauucucuu

SEQ ID NO: 21292 - RNA, 19 nt, artificial
  Oligomer
uucugucauccaaauacuc

SEQ ID NO: 21293 - RNA, 19 nt, artificial
  Oligomer
uuaacugcaagaacauuuc

SEQ ID NO: 21294 - RNA, 19 nt, artificial
  Oligomer
uuagagaaaauucaacaug

SEQ ID NO: 21295 - RNA, 19 nt, artificial
  Oligomer
ucauuaacccucacaaugc

SEQ ID NO: 21296 - RNA, 19 nt, artificial
  Oligomer
uuuucaggaaguaguuucc

SEQ ID NO: 21297 - RNA, 19 nt, artificial
  Oligomer
ucuuccagugugaugaugg

SEQ ID NO: 21298 - RNA, 19 nt, artificial
  Oligomer
uuaacccucacaaugcacu

SEQ ID NO: 21299 - RNA, 19 nt, artificial
  Oligomer
auccaaauacuccacacgc

SEQ ID NO: 21300 - RNA, 19 nt, artificial
  Oligomer
uagaaacuaccaacccacc

SEQ ID NO: 21301 - RNA, 19 nt, artificial
  Oligomer
uuuccuuuuagguacuaag

SEQ ID NO: 21302 - RNA, 19 nt, artificial
  Oligomer
uucugacgcacaccuauug

SEQ ID NO: 21303 - RNA, 19 nt, artificial
  Oligomer
uaucugagcagcgcucaug

SEQ ID NO: 21304 - RNA, 19 nt, artificial
  Oligomer
ugugacugcuuguagaugg

SEQ ID NO: 21305 - RNA, 19 nt, artificial
  Oligomer
uuucuuacaucucccaaac

SEQ ID NO: 21306 - RNA, 19 nt, artificial
  Oligomer
aacauuucuuacaucuccc

SEQ ID NO: 21307 - RNA, 19 nt, artificial
  Oligomer
ucccaguagauuaccacug

SEQ ID NO: 21308 - RNA, 19 nt, artificial
  Oligomer
ucuugguggauccagauca

SEQ ID NO: 21309 - RNA, 19 nt, artificial
  Oligomer
uucuccauccagugguuuc

SEQ ID NO: 21310 - RNA, 19 nt, artificial
  Oligomer
aaucuaagcugguaugucc

SEQ ID NO: 21311 - RNA, 19 nt, artificial
  Oligomer
auuguaaaauaagagaucg

SEQ ID NO: 21312 - RNA, 19 nt, artificial
  Oligomer
uguuuccugacucagaggg

SEQ ID NO: 21313 - RNA, 19 nt, artificial
  Oligomer
uauuguaaaauaagagauc

SEQ ID NO: 21314 - RNA, 19 nt, artificial
  Oligomer
uucugggagcuucaucugg

SEQ ID NO: 21315 - RNA, 19 nt, artificial
  Oligomer
uguaaacuaacccuuaacu

SEQ ID NO: 21316 - RNA, 19 nt, artificial
  Oligomer
uugcagaauguaaaagaug

SEQ ID NO: 21317 - RNA, 19 nt, artificial
  Oligomer
ucugucuugaacaugaguu

SEQ ID NO: 21318 - RNA, 19 nt, artificial
  Oligomer
ucuugcggagauucucuuc

SEQ ID NO: 21319 - RNA, 19 nt, artificial
  Oligomer
ugaaaauguuuccugacuc

SEQ ID NO: 21320 - RNA, 19 nt, artificial
  Oligomer
uauacaagagaugaaaucc

SEQ ID NO: 21321 - RNA, 19 nt, artificial
  Oligomer
aucuaagcugguauguccu

SEQ ID NO: 21322 - RNA, 19 nt, artificial
  Oligomer
uuccuuuuagguacuaagg

SEQ ID NO: 21323 - RNA, 19 nt, artificial
  Oligomer
uaguuguaguggauggugg

SEQ ID NO: 21324 - RNA, 19 nt, artificial
  Oligomer
uccagugguuucuucuuug

SEQ ID NO: 21325 - RNA, 19 nt, artificial
  Oligomer
ugauuguaaacuaacccuu

SEQ ID NO: 21326 - RNA, 19 nt, artificial
  Oligomer
ugaagggugaaauauucuc

SEQ ID NO: 21327 - RNA, 19 nt, artificial
  Oligomer
uaaaauaagagaucgauau

SEQ ID NO: 21328 - RNA, 19 nt, artificial
  Oligomer
cuuuuagguacuaaggucg

SEQ ID NO: 21329 - RNA, 19 nt, artificial
  Oligomer
auuauuucauuaacccuca

SEQ ID NO: 21330 - RNA, 19 nt, artificial
  Oligomer
auuaccacuggagucuucc

SEQ ID NO: 21331 - RNA, 19 nt, artificial
  Oligomer
uacaagagaugaaauccuc

SEQ ID NO: 21332 - RNA, 19 nt, artificial
  Oligomer
uaaaagauguugacccuuc

SEQ ID NO: 21333 - RNA, 19 nt, artificial
  Oligomer
aaaaguguuucugucaucc

SEQ ID NO: 21334 - RNA, 19 nt, artificial
  Oligomer
auucucuuccucugugcgc

SEQ ID NO: 21335 - RNA, 19 nt, artificial
  Oligomer
cuuaacugcaagaacauuu

SEQ ID NO: 21336 - RNA, 19 nt, artificial
  Oligomer
ugaacaugaguuuuuuaug

SEQ ID NO: 21337 - RNA, 19 nt, artificial
  Oligomer
uuccagugugaugauggug

SEQ ID NO: 21338 - RNA, 19 nt, artificial
  Oligomer
uugacaacucccucuaccu

SEQ ID NO: 21339 - RNA, 19 nt, artificial
  Oligomer
uuguaaaauaagagaucga

SEQ ID NO: 21340 - RNA, 19 nt, artificial
  Oligomer
uaccacuggagucuuccag

SEQ ID NO: 21341 - RNA, 19 nt, artificial
  Oligomer
auuucauuaacccucacaa

SEQ ID NO: 21342 - RNA, 19 nt, artificial
  Oligomer
ucugaagggugaaauauuc

SEQ ID NO: 21343 - RNA, 19 nt, artificial
  Oligomer
ucucggaacaucucgaagc

SEQ ID NO: 21344 - RNA, 19 nt, artificial
  Oligomer
ucauccauugcuugggacg

SEQ ID NO: 21345 - RNA, 19 nt, artificial
  Oligomer
uuccauaggucugaaaaug

SEQ ID NO: 21346 - RNA, 19 nt, artificial
  Oligomer
auaaaaggugguuucaagg

SEQ ID NO: 21347 - RNA, 19 nt, artificial
  Oligomer
auccagaucaucauauaca

SEQ ID NO: 21348 - RNA, 19 nt, artificial
  Oligomer
auaggucugaaaauguuuc

SEQ ID NO: 21349 - RNA, 19 nt, artificial
  Oligomer
uucacagauaugggccuug

SEQ ID NO: 21350 - RNA, 19 nt, artificial
  Oligomer
ugguggauccagaucauca

SEQ ID NO: 21351 - RNA, 19 nt, artificial
  Oligomer
auaaaacaagucuuggugg

SEQ ID NO: 21352 - RNA, 19 nt, artificial
  Oligomer
cuugcggagauucucuucc

SEQ ID NO: 21353 - RNA, 19 nt, artificial
  Oligomer
uaggucugaaaauguuucc

SEQ ID NO: 21354 - RNA, 19 nt, artificial
  Oligomer
uacuccacacgcaaauuuc

SEQ ID NO: 21355 - RNA, 19 nt, artificial
  Oligomer
auauucuccauccaguggu

SEQ ID NO: 21356 - RNA, 19 nt, artificial
  Oligomer
uguagaaacuaccaaccca

SEQ ID NO: 21357 - RNA, 19 nt, artificial
  Oligomer
uugaguuccaaggccucau

SEQ ID NO: 21358 - RNA, 19 nt, artificial
  Oligomer
ucaaaucauccauugcuug

SEQ ID NO: 21359 - RNA, 19 nt, artificial
  Oligomer
agaaaauucaacaugaggg

SEQ ID NO: 21360 - RNA, 19 nt, artificial
  Oligomer
aaccuuaaaaucuaagcug

SEQ ID NO: 21361 - RNA, 19 nt, artificial
  Oligomer
aagauguugacccuuccag

SEQ ID NO: 21362 - RNA, 19 nt, artificial
  Oligomer
ugagguaggugcaaaugcc

SEQ ID NO: 21363 - RNA, 19 nt, artificial
  Oligomer
uuucugucauccaaauacu

SEQ ID NO: 21364 - RNA, 19 nt, artificial
  Oligomer
uagauuaccacuggagucu

SEQ ID NO: 21365 - RNA, 19 nt, artificial
  Oligomer
acuguagaaacuaccaacc

SEQ ID NO: 21366 - RNA, 19 nt, artificial
  Oligomer
aagacuugacaacucccuc

SEQ ID NO: 21367 - RNA, 19 nt, artificial
  Oligomer
uguaaaauaagagaucgau

SEQ ID NO: 21368 - RNA, 19 nt, artificial
  Oligomer
uccagugugaugaugguga

SEQ ID NO: 21369 - RNA, 19 nt, artificial
  Oligomer
uucccugguuaguacggug

SEQ ID NO: 21370 - RNA, 19 nt, artificial
  Oligomer
guagaaacuaccaacccac

SEQ ID NO: 21371 - RNA, 19 nt, artificial
  Oligomer
aguaguuuccauaggucug

SEQ ID NO: 21372 - RNA, 19 nt, artificial
  Oligomer
uguggaaucaacccacagc

SEQ ID NO: 21373 - RNA, 19 nt, artificial
  Oligomer
ucugacgcacaccuauugc

SEQ ID NO: 21374 - RNA, 19 nt, artificial
  Oligomer
ccauuguucaauaucgucc

SEQ ID NO: 21375 - RNA, 19 nt, artificial
  Oligomer
aagaaguggagaaugucag

SEQ ID NO: 21376 - RNA, 19 nt, artificial
  Oligomer
ugcccugguagguuuucug

SEQ ID NO: 21377 - RNA, 19 nt, artificial
  Oligomer
augucgaaaaguguuucug

SEQ ID NO: 21378 - RNA, 19 nt, artificial
  Oligomer
ucgaaaaguguuucuguca

SEQ ID NO: 21379 - RNA, 19 nt, artificial
  Oligomer
auuaacccucacaaugcac

SEQ ID NO: 21380 - RNA, 19 nt, artificial
  Oligomer
uguaauaaaaggugguuuc

SEQ ID NO: 21381 - RNA, 19 nt, artificial
  Oligomer
auaaaaagggagaaggagg

SEQ ID NO: 21382 - RNA, 19 nt, artificial
  Oligomer
uaagcugguauguccuacu

SEQ ID NO: 21383 - RNA, 19 nt, artificial
  Oligomer
uuauuucauuaacccucac

SEQ ID NO: 21384 - RNA, 19 nt, artificial
  Oligomer
uuugagaagcucaaaacuu

SEQ ID NO: 21385 - RNA, 19 nt, artificial
  Oligomer
ucaaagacccaaaacccaa

SEQ ID NO: 21386 - RNA, 19 nt, artificial
  Oligomer
uaaaaucuaagcugguaug

SEQ ID NO: 21387 - RNA, 19 nt, artificial
  Oligomer
uuguuuucaggaaguaguu

SEQ ID NO: 21388 - RNA, 19 nt, artificial
  Oligomer
ucccaaacaucccucacag

SEQ ID NO: 21389 - RNA, 19 nt, artificial
  Oligomer
uucagugaaccauuguuca

SEQ ID NO: 21390 - RNA, 19 nt, artificial
  Oligomer
aagcaaauggaaguccugg

SEQ ID NO: 21391 - RNA, 19 nt, artificial
  Oligomer
acaagagaugaaauccucc

SEQ ID NO: 21392 - RNA, 19 nt, artificial
  Oligomer
aacuguagaaacuaccaac

SEQ ID NO: 21393 - RNA, 19 nt, artificial
  Oligomer
aucaaaucauccauugcuu

SEQ ID NO: 21394 - RNA, 19 nt, artificial
  Oligomer
ucuuacaucucccaaacau

SEQ ID NO: 21395 - RNA, 19 nt, artificial
  Oligomer
aaguaguuuccauaggucu

SEQ ID NO: 21396 - RNA, 19 nt, artificial
  Oligomer
uugguggauccagaucauc

SEQ ID NO: 21397 - RNA, 19 nt, artificial
  Oligomer
uugcggagauucucuuccu

SEQ ID NO: 21398 - RNA, 19 nt, artificial
  Oligomer
ucacaaugcacucugugag

SEQ ID NO: 21399 - RNA, 19 nt, artificial
  Oligomer
cuuuuuggacuucaggugg

SEQ ID NO: 21400 - RNA, 19 nt, artificial
  Oligomer
ugucauccaaauacuccac

SEQ ID NO: 21401 - RNA, 19 nt, artificial
  Oligomer
agcugguauguccuacucc

SEQ ID NO: 21402 - RNA, 19 nt, artificial
  Oligomer
aauguuuccugacucagag

SEQ ID NO: 21403 - RNA, 19 nt, artificial
  Oligomer
uuuccuuccacucggauaa

SEQ ID NO: 21404 - RNA, 19 nt, artificial
  Oligomer
aaauauucuccauccagug

SEQ ID NO: 21405 - RNA, 19 nt, artificial
  Oligomer
uagacuuuugagaagcuca

SEQ ID NO: 21406 - RNA, 19 nt, artificial
  Oligomer
guaaacuaacccuuaacug

SEQ ID NO: 21407 - RNA, 19 nt, artificial
  Oligomer
guuaguacggugaaguggg

SEQ ID NO: 21408 - RNA, 19 nt, artificial
  Oligomer
uuaguacggugaagugggc

SEQ ID NO: 21409 - RNA, 19 nt, artificial
  Oligomer
uuucaggaaguaguuucca

SEQ ID NO: 21410 - RNA, 19 nt, artificial
  Oligomer
ugugaugauggugaggaug

SEQ ID NO: 21411 - RNA, 19 nt, artificial
  Oligomer
cuuucuugcggagauucuc

SEQ ID NO: 21412 - RNA, 19 nt, artificial
  Oligomer
acccuuuuuggacuucagg

SEQ ID NO: 21413 - RNA, 19 nt, artificial
  Oligomer
uucaggaaguaguuuccau

SEQ ID NO: 21414 - RNA, 19 nt, artificial
  Oligomer
ugggaagggacagaagaug

SEQ ID NO: 21415 - RNA, 19 nt, artificial
  Oligomer
ucugaaaauguuuccugac

SEQ ID NO: 21416 - RNA, 19 nt, artificial
  Oligomer
aucgauauaaaaaugggau

SEQ ID NO: 21417 - RNA, 19 nt, artificial
  Oligomer
cauaaaacaagucuuggug

SEQ ID NO: 21418 - RNA, 19 nt, artificial
  Oligomer
aaugcaagaagcccagacg

SEQ ID NO: 21419 - RNA, 19 nt, artificial
  Oligomer
aaaauguuuccugacucag

SEQ ID NO: 21420 - RNA, 19 nt, artificial
  Oligomer
cuucagugaaccauuguuc

SEQ ID NO: 21421 - RNA, 19 nt, artificial
  Oligomer
uucugucuugaacaugagu

SEQ ID NO: 21422 - RNA, 19 nt, artificial
  Oligomer
uuucauuaacccucacaau

SEQ ID NO: 21423 - RNA, 19 nt, artificial
  Oligomer
ugagauuuccuuuuaggua

SEQ ID NO: 21424 - RNA, 19 nt, artificial
  Oligomer
aagcucaaaacuuuuagcg

SEQ ID NO: 21425 - RNA, 19 nt, artificial
  Oligomer
auacaagagaugaaauccu

SEQ ID NO: 21426 - RNA, 19 nt, artificial
  Oligomer
uggauggugguacagucag

SEQ ID NO: 21427 - RNA, 19 nt, artificial
  Oligomer
uaaaaggugguuucaaggc

SEQ ID NO: 21428 - RNA, 19 nt, artificial
  Oligomer
uccaaggccucauucagcu

SEQ ID NO: 21429 - RNA, 19 nt, artificial
  Oligomer
guuuucaggaaguaguuuc

SEQ ID NO: 21430 - RNA, 19 nt, artificial
  Oligomer
auguaguuguaguggaugg

SEQ ID NO: 21431 - RNA, 19 nt, artificial
  Oligomer
auguugacccuuccagcuc

SEQ ID NO: 21432 - RNA, 19 nt, artificial
  Oligomer
ugaaguuagagaaaauuca

SEQ ID NO: 21433 - RNA, 19 nt, artificial
  Oligomer
ucaggaaguaguuuccaua

SEQ ID NO: 21434 - RNA, 19 nt, artificial
  Oligomer
auauacaagagaugaaauc

SEQ ID NO: 21435 - RNA, 19 nt, artificial
  Oligomer
cugucauccaaauacucca

SEQ ID NO: 21436 - RNA, 19 nt, artificial
  Oligomer
auuucuuacaucucccaaa

SEQ ID NO: 21437 - RNA, 19 nt, artificial
  Oligomer
cugauuguaaacuaacccu

SEQ ID NO: 21438 - RNA, 19 nt, artificial
  Oligomer
uggagaaugucagucugag

SEQ ID NO: 21439 - RNA, 19 nt, artificial
  Oligomer
aaaaccuuaaaaucuaagc

SEQ ID NO: 21440 - RNA, 19 nt, artificial
  Oligomer
aacaaaacaccagugcagg

SEQ ID NO: 21441 - RNA, 19 nt, artificial
  Oligomer
acaaacacgcaccucaaag

SEQ ID NO: 21442 - RNA, 19 nt, artificial
  Oligomer
ucggauaagaugcugagga

SEQ ID NO: 21443 - RNA, 19 nt, artificial
  Oligomer
aaacuaacccuuaacugca

SEQ ID NO: 21444 - RNA, 19 nt, artificial
  Oligomer
uccuugaguuccaaggccu

SEQ ID NO: 21445 - RNA, 19 nt, artificial
  Oligomer
ucaugugcugugacugcuu

SEQ ID NO: 21446 - RNA, 19 nt, artificial
  Oligomer
ucccucuaccuaaccagcu

SEQ ID NO: 21447 - RNA, 19 nt, artificial
  Oligomer
guucaaagacccaaaaccc

SEQ ID NO: 21448 - RNA, 19 nt, artificial
  Oligomer
ugucgaaaaguguuucugu

SEQ ID NO: 21449 - RNA, 19 nt, artificial
  Oligomer
uuccgucccaguagauuac

SEQ ID NO: 21450 - RNA, 19 nt, artificial
  Oligomer
cuugacaacucccucuacc

SEQ ID NO: 21451 - RNA, 19 nt, artificial
  Oligomer
uaagagaucgauauaaaaa

SEQ ID NO: 21452 - RNA, 19 nt, artificial
  Oligomer
agaaacuaccaacccacca

SEQ ID NO: 21453 - RNA, 19 nt, artificial
  Oligomer
aaaaaugggauauaaaaag

SEQ ID NO: 21454 - RNA, 19 nt, artificial
  Oligomer
aacaucuuguugagggcag

SEQ ID NO: 21455 - RNA, 19 nt, artificial
  Oligomer
uugagaagcucaaaacuuu

SEQ ID NO: 21456 - RNA, 19 nt, artificial
  Oligomer
ugcggagauucucuuccuc

SEQ ID NO: 21457 - RNA, 19 nt, artificial
  Oligomer
aacaucucgaagcgcucac

SEQ ID NO: 21458 - RNA, 19 nt, artificial
  Oligomer
ugaaaaugcagaugugcuu

SEQ ID NO: 21459 - RNA, 19 nt, artificial
  Oligomer
aacaagucuugguggaucc

SEQ ID NO: 21460 - RNA, 19 nt, artificial
  Oligomer
ucgaccaagagguugucag

SEQ ID NO: 21461 - RNA, 19 nt, artificial
  Oligomer
augugcuugcagaauguaa

SEQ ID NO: 21462 - RNA, 19 nt, artificial
  Oligomer
uuucugggaagggacagaa

SEQ ID NO: 21463 - RNA, 19 nt, artificial
  Oligomer
agagaugaaauccuccagg

SEQ ID NO: 21464 - RNA, 19 nt, artificial
  Oligomer
uccacacgcaaauuuccuu

SEQ ID NO: 21465 - RNA, 19 nt, artificial
  Oligomer
aacugcaagaacauuucuu

SEQ ID NO: 21466 - RNA, 19 nt, artificial
  Oligomer
augucagucugagucaggc

SEQ ID NO: 21467 - RNA, 19 nt, artificial
  Oligomer
agcaaauggaaguccuggg

SEQ ID NO: 21468 - RNA, 19 nt, artificial
  Oligomer
aauauucuccauccagugg

SEQ ID NO: 21469 - RNA, 19 nt, artificial
  Oligomer
uagacugacccuuuuugga

SEQ ID NO: 21470 - RNA, 19 nt, artificial
  Oligomer
ucuucagugaaccauuguu

SEQ ID NO: 21471 - RNA, 19 nt, artificial
  Oligomer
aguaaaaaccuuaaaaucu

SEQ ID NO: 21472 - RNA, 19 nt, artificial
  Oligomer
uuuuagguacuaaggucga

SEQ ID NO: 21473 - RNA, 19 nt, artificial
  Oligomer
acuaaggucgaccaagagg

SEQ ID NO: 21474 - RNA, 19 nt, artificial
  Oligomer
uccauaggucugaaaaugu

SEQ ID NO: 21475 - RNA, 19 nt, artificial
  Oligomer
acauuauuucauuaacccu

SEQ ID NO: 21476 - RNA, 19 nt, artificial
  Oligomer
aucuggaccugggucuuca

SEQ ID NO: 21477 - RNA, 19 nt, artificial
  Oligomer
uccaaauacuccacacgca

SEQ ID NO: 21478 - RNA, 19 nt, artificial
  Oligomer
aagagguugucagacaggg

SEQ ID NO: 21479 - RNA, 19 nt, artificial
  Oligomer
cuuacaucucccaaacauc

SEQ ID NO: 21480 - RNA, 19 nt, artificial
  Oligomer
cauuucacagauaugggcc

SEQ ID NO: 21481 - RNA, 19 nt, artificial
  Oligomer
ucauccaaauacuccacac

SEQ ID NO: 21482 - RNA, 19 nt, artificial
  Oligomer
ucccucacaguaaaaaccu

SEQ ID NO: 21483 - RNA, 19 nt, artificial
  Oligomer
aaacuaccaacccaccagc

SEQ ID NO: 21484 - RNA, 19 nt, artificial
  Oligomer
auguaauaaaaggugguuu

SEQ ID NO: 21485 - RNA, 19 nt, artificial
  Oligomer
agcaagacuugacaacucc

SEQ ID NO: 21486 - RNA, 19 nt, artificial
  Oligomer
caaaacaucuuguugaggg

SEQ ID NO: 21487 - RNA, 19 nt, artificial
  Oligomer
ugcagaauguaaaagaugu

SEQ ID NO: 21488 - RNA, 19 nt, artificial
  Oligomer
uaaaaagggagaaggaggg

SEQ ID NO: 21489 - RNA, 19 nt, artificial
  Oligomer
agcauuucacagauauggg

SEQ ID NO: 21490 - RNA, 19 nt, artificial
  Oligomer
aucugaagggugaaauauu

SEQ ID NO: 21491 - RNA, 19 nt, artificial
  Oligomer
cagcauuucacagauaugg

SEQ ID NO: 21492 - RNA, 19 nt, artificial
  Oligomer
ugggucuucagugaaccau

SEQ ID NO: 21493 - RNA, 19 nt, artificial
  Oligomer
uaccuaaccagcugcccaa

SEQ ID NO: 21494 - RNA, 19 nt, artificial
  Oligomer
ugaaccauuguucaauauc

SEQ ID NO: 21495 - RNA, 19 nt, artificial
  Oligomer
uagguuuucugggaaggga

SEQ ID NO: 21496 - RNA, 19 nt, artificial
  Oligomer
uucugggaagggacagaag

SEQ ID NO: 21497 - RNA, 19 nt, artificial
  Oligomer
aaaaaccuuaaaaucuaag

SEQ ID NO: 21498 - RNA, 19 nt, artificial
  Oligomer
auaugggccuugaaguuag

SEQ ID NO: 21499 - RNA, 19 nt, artificial
  Oligomer
agguuuucugggaagggac

SEQ ID NO: 21500 - RNA, 19 nt, artificial
  Oligomer
uuuugagaagcucaaaacu

SEQ ID NO: 21501 - RNA, 19 nt, artificial
  Oligomer
aagaacauuucuuacaucu

SEQ ID NO: 21502 - RNA, 19 nt, artificial
  Oligomer
uuuucugggaagggacaga

SEQ ID NO: 21503 - RNA, 19 nt, artificial
  Oligomer
ugugcuugcagaauguaaa

SEQ ID NO: 21504 - RNA, 19 nt, artificial
  Oligomer
uaacccucacaaugcacuc

SEQ ID NO: 21505 - RNA, 19 nt, artificial
  Oligomer
aacuuguucaguggagccc

SEQ ID NO: 21506 - RNA, 19 nt, artificial
  Oligomer
aacaugagggacagcuucc

SEQ ID NO: 21507 - RNA, 19 nt, artificial
  Oligomer
uaugucgaaaaguguuucu

SEQ ID NO: 21508 - RNA, 19 nt, artificial
  Oligomer
cuguagaaacuaccaaccc

SEQ ID NO: 21509 - RNA, 19 nt, artificial
  Oligomer
caaauuuccuuccacucgg

SEQ ID NO: 21510 - RNA, 19 nt, artificial
  Oligomer
aaaucauccauugcuuggg

SEQ ID NO: 21511 - RNA, 19 nt, artificial
  Oligomer
agauguugacccuuccagc

SEQ ID NO: 21512 - RNA, 19 nt, artificial
  Oligomer
uucuuacaucucccaaaca

SEQ ID NO: 21513 - RNA, 19 nt, artificial
  Oligomer
acccucacaaugcacucug

SEQ ID NO: 21514 - RNA, 19 nt, artificial
  Oligomer
uccauccagugguuucuuc

SEQ ID NO: 21515 - RNA, 19 nt, artificial
  Oligomer
auccuugaguuccaaggcc

SEQ ID NO: 21516 - RNA, 19 nt, artificial
  Oligomer
uuuagguacuaaggucgac

SEQ ID NO: 21517 - RNA, 19 nt, artificial
  Oligomer
aucccucacaguaaaaacc

SEQ ID NO: 21518 - RNA, 19 nt, artificial
  Oligomer
aaacaagucuugguggauc

SEQ ID NO: 21519 - RNA, 19 nt, artificial
  Oligomer
guuguuuucaggaaguagu

SEQ ID NO: 21520 - RNA, 19 nt, artificial
  Oligomer
uagagaaaauucaacauga

SEQ ID NO: 21521 - RNA, 19 nt, artificial
  Oligomer
agcauaaaacaagucuugg

SEQ ID NO: 21522 - RNA, 19 nt, artificial
  Oligomer
ugugagguaggugcaaaug

SEQ ID NO: 21523 - RNA, 19 nt, artificial
  Oligomer
cccaacuguagaaacuacc

SEQ ID NO: 21524 - RNA, 19 nt, artificial
  Oligomer
gagaaugucagucugaguc

SEQ ID NO: 21525 - RNA, 19 nt, artificial
  Oligomer
guuucugucauccaaauac

SEQ ID NO: 21526 - RNA, 19 nt, artificial
  Oligomer
agacuugacaacucccucu

SEQ ID NO: 21527 - RNA, 19 nt, artificial
  Oligomer
ucuccauccagugguuucu

SEQ ID NO: 21528 - RNA, 19 nt, artificial
  Oligomer
auccagugguuucuucuuu

SEQ ID NO: 21529 - RNA, 19 nt, artificial
  Oligomer
cuaagcugguauguccuac

SEQ ID NO: 21530 - RNA, 19 nt, artificial
  Oligomer
uccgucaugugcugugacu

SEQ ID NO: 21531 - RNA, 19 nt, artificial
  Oligomer
gcaaauuuccuuccacucg

SEQ ID NO: 21532 - RNA, 19 nt, artificial
  Oligomer
aagucuugguggauccaga

SEQ ID NO: 21533 - RNA, 19 nt, artificial
  Oligomer
aaaaggugguuucaaggcc

SEQ ID NO: 21534 - RNA, 19 nt, artificial
  Oligomer
gcugauuguaaacuaaccc

SEQ ID NO: 21535 - RNA, 19 nt, artificial
  Oligomer
aaaucuaagcugguauguc

SEQ ID NO: 21536 - RNA, 19 nt, artificial
  Oligomer
ccuuuuuggacuucaggug

SEQ ID NO: 21537 - RNA, 19 nt, artificial
  Oligomer
aguuagagaaaauucaaca

SEQ ID NO: 21538 - RNA, 19 nt, artificial
  Oligomer
acucccucuaccuaaccag

SEQ ID NO: 21539 - RNA, 19 nt, artificial
  Oligomer
accuuaaaaucuaagcugg

SEQ ID NO: 21540 - RNA, 19 nt, artificial
  Oligomer
aauguaaaagauguugacc

SEQ ID NO: 21541 - RNA, 19 nt, artificial
  Oligomer
acaaccuccgucaugugcu

SEQ ID NO: 21542 - RNA, 19 nt, artificial
  Oligomer
auguuuccugacucagagg

SEQ ID NO: 21543 - RNA, 19 nt, artificial
  Oligomer
gugaugauggugaggaugg

SEQ ID NO: 21544 - RNA, 19 nt, artificial
  Oligomer
augggauauaaaaagggag

SEQ ID NO: 21545 - RNA, 19 nt, artificial
  Oligomer
aauaaaaggugguuucaag

SEQ ID NO: 21546 - RNA, 19 nt, artificial
  Oligomer
augcagaugugcuugcaga

SEQ ID NO: 21547 - RNA, 19 nt, artificial
  Oligomer
uauaaaaagggagaaggag

SEQ ID NO: 21548 - RNA, 19 nt, artificial
  Oligomer
uaguggauggugguacagu

SEQ ID NO: 21549 - RNA, 19 nt, artificial
  Oligomer
ucuaagcugguauguccua

SEQ ID NO: 21550 - RNA, 19 nt, artificial
  Oligomer
uggauccagaucaucauau

SEQ ID NO: 21551 - RNA, 19 nt, artificial
  Oligomer
aaugucagucugagucagg

SEQ ID NO: 21552 - RNA, 19 nt, artificial
  Oligomer
aacacgcaccucaaagcug

SEQ ID NO: 21553 - RNA, 19 nt, artificial
  Oligomer
agacugacccuuuuuggac

SEQ ID NO: 21554 - RNA, 19 nt, artificial
  Oligomer
augaaauccuccagggugu

SEQ ID NO: 21555 - RNA, 19 nt, artificial
  Oligomer
ucucccaaacaucccucac

SEQ ID NO: 21556 - RNA, 19 nt, artificial
  Oligomer
uccuuuuagguacuaaggu

SEQ ID NO: 21557 - RNA, 19 nt, artificial
  Oligomer
aucaacccacagcugcaca

SEQ ID NO: 21558 - RNA, 19 nt, artificial
  Oligomer
cauuguucaauaucguccg

SEQ ID NO: 21559 - RNA, 19 nt, artificial
  Oligomer
ucaucauauacaagagaug

SEQ ID NO: 21560 - RNA, 19 nt, artificial
  Oligomer
aaguuagagaaaauucaac

SEQ ID NO: 21561 - RNA, 19 nt, artificial
  Oligomer
auuuccuuccacucggaua

SEQ ID NO: 21562 - RNA, 19 nt, artificial
  Oligomer
ugcaagaacauuucuuaca

SEQ ID NO: 21563 - RNA, 19 nt, artificial
  Oligomer
aaugcagaugugcuugcag

SEQ ID NO: 21564 - RNA, 19 nt, artificial
  Oligomer
aagagaugaaauccuccag

SEQ ID NO: 21565 - RNA, 19 nt, artificial
  Oligomer
ucauauacaagagaugaaa

SEQ ID NO: 21566 - RNA, 19 nt, artificial
  Oligomer
auacuccacacgcaaauuu

SEQ ID NO: 21567 - RNA, 19 nt, artificial
  Oligomer
agauucucuuccucugugc

SEQ ID NO: 21568 - RNA, 19 nt, artificial
  Oligomer
ugguagguuuucugggaag

SEQ ID NO: 21569 - RNA, 19 nt, artificial
  Oligomer
agucaggcccuucugucuu

SEQ ID NO: 21570 - RNA, 19 nt, artificial
  Oligomer
accauuguucaauaucguc

SEQ ID NO: 21571 - RNA, 19 nt, artificial
  Oligomer
uccgucccaguagauuacc

SEQ ID NO: 21572 - RNA, 19 nt, artificial
  Oligomer
uguuccgucccaguagauu

SEQ ID NO: 21573 - RNA, 19 nt, artificial
  Oligomer
ugcuugcagaauguaaaag

SEQ ID NO: 21574 - RNA, 19 nt, artificial
  Oligomer
uguacauuauuucauuaac

SEQ ID NO: 21575 - RNA, 19 nt, artificial
  Oligomer
aaauguuuccugacucaga

SEQ ID NO: 21576 - RNA, 19 nt, artificial
  Oligomer
uagggcaccaccacacuau

SEQ ID NO: 21577 - RNA, 19 nt, artificial
  Oligomer
ugggccuugaaguuagaga

SEQ ID NO: 21578 - RNA, 19 nt, artificial
  Oligomer
uuucacagauaugggccuu

SEQ ID NO: 21579 - RNA, 19 nt, artificial
  Oligomer
guaaaauaagagaucgaua

SEQ ID NO: 21580 - RNA, 19 nt, artificial
  Oligomer
aaaugggauauaaaaaggg

SEQ ID NO: 21581 - RNA, 19 nt, artificial
  Oligomer
gaagggugaaauauucucc

SEQ ID NO: 21582 - RNA, 19 nt, artificial
  Oligomer
uggaaucaacccacagcug

SEQ ID NO: 21583 - RNA, 19 nt, artificial
  Oligomer
guagacugacccuuuuugg

SEQ ID NO: 21584 - RNA, 19 nt, artificial
  Oligomer
aaaagauguugacccuucc

SEQ ID NO: 21585 - RNA, 19 nt, artificial
  Oligomer
gaugaaauccuccagggug

SEQ ID NO: 21586 - RNA, 19 nt, artificial
  Oligomer
cuaccuaccuagaaugugg

SEQ ID NO: 21587 - RNA, 19 nt, artificial
  Oligomer
ucugggagcuucaucugga

SEQ ID NO: 21588 - RNA, 19 nt, artificial
  Oligomer
uagguacuaaggucgacca

SEQ ID NO: 21589 - RNA, 19 nt, artificial
  Oligomer
ucuugaacaugaguuuuuu

SEQ ID NO: 21590 - RNA, 19 nt, artificial
  Oligomer
ugguuaguacggugaagug

SEQ ID NO: 21591 - RNA, 19 nt, artificial
  Oligomer
aagggugaaauauucucca

SEQ ID NO: 21592 - RNA, 19 nt, artificial
  Oligomer
aagcugguauguccuacuc

SEQ ID NO: 21593 - RNA, 19 nt, artificial
  Oligomer
augcacucugugagguagg

SEQ ID NO: 21594 - RNA, 19 nt, artificial
  Oligomer
uguaaaagauguugacccu

SEQ ID NO: 21595 - RNA, 19 nt, artificial
  Oligomer
cagaugugcuugcagaaug

SEQ ID NO: 21596 - RNA, 19 nt, artificial
  Oligomer
aagggacagaagaugacag

SEQ ID NO: 21597 - RNA, 19 nt, artificial
  Oligomer
uaaccagcugcccaacugu

SEQ ID NO: 21598 - RNA, 19 nt, artificial
  Oligomer
guacauuauuucauuaacc

SEQ ID NO: 21599 - RNA, 19 nt, artificial
  Oligomer
acaaagcaaauggaagucc

SEQ ID NO: 21600 - RNA, 19 nt, artificial
  Oligomer
acuaugucgaaaaguguuu

SEQ ID NO: 21601 - RNA, 19 nt, artificial
  Oligomer
accuauugcaagcaagggu

SEQ ID NO: 21602 - RNA, 19 nt, artificial
  Oligomer
aguguuucugucauccaaa

SEQ ID NO: 21603 - RNA, 19 nt, artificial
  Oligomer
cagaauguaaaagauguug

SEQ ID NO: 21604 - RNA, 19 nt, artificial
  Oligomer
aaaccuuaaaaucuaagcu

SEQ ID NO: 21605 - RNA, 19 nt, artificial
  Oligomer
uacuaaggucgaccaagag

SEQ ID NO: 21606 - RNA, 19 nt, artificial
  Oligomer
uguuucugucauccaaaua

SEQ ID NO: 21607 - RNA, 19 nt, artificial
  Oligomer
uagcugcccugguagguuu

SEQ ID NO: 21608 - RNA, 19 nt, artificial
  Oligomer
agaggagcugguguuguug

SEQ ID NO: 21609 - RNA, 19 nt, artificial
  Oligomer
gauaagaugcugaggaggg

SEQ ID NO: 21610 - RNA, 19 nt, artificial
  Oligomer
ucccugguuaguacgguga

SEQ ID NO: 21611 - RNA, 19 nt, artificial
  Oligomer
accucaaagcuguuccguc

SEQ ID NO: 21612 - RNA, 19 nt, artificial
  Oligomer
caagacuugacaacucccu

SEQ ID NO: 21613 - RNA, 19 nt, artificial
  Oligomer
ucagcucucggaacaucuc

SEQ ID NO: 21614 - RNA, 19 nt, artificial
  Oligomer
caagucuugguggauccag

SEQ ID NO: 21615 - RNA, 19 nt, artificial
  Oligomer
gaaacuaccaacccaccag

SEQ ID NO: 21616 - RNA, 19 nt, artificial
  Oligomer
agcaaggguucaaagaccc

SEQ ID NO: 21617 - RNA, 19 nt, artificial
  Oligomer
ucugggaagggacagaaga

SEQ ID NO: 21618 - RNA, 19 nt, artificial
  Oligomer
gugcaagucacagacuugg

SEQ ID NO: 21619 - RNA, 19 nt, artificial
  Oligomer
aucauccauugcuugggac

SEQ ID NO: 21620 - RNA, 19 nt, artificial
  Oligomer
ugcugugacugcuuguaga

SEQ ID NO: 21621 - RNA, 19 nt, artificial
  Oligomer
acagauaugggccuugaag

SEQ ID NO: 21622 - RNA, 19 nt, artificial
  Oligomer
uaauaaaaggugguuucaa

SEQ ID NO: 21623 - RNA, 19 nt, artificial
  Oligomer
aaguccugggugcuucuga

SEQ ID NO: 21624 - RNA, 19 nt, artificial
  Oligomer
caaaucauccauugcuugg

SEQ ID NO: 21625 - RNA, 19 nt, artificial
  Oligomer
gugagguaggugcaaaugc

SEQ ID NO: 21626 - RNA, 19 nt, artificial
  Oligomer
ugcuucugacgcacaccua

SEQ ID NO: 21627 - RNA, 19 nt, artificial
  Oligomer
cccuuuuuggacuucaggu

SEQ ID NO: 21628 - RNA, 19 nt, artificial
  Oligomer
uuaccacuggagucuucca

SEQ ID NO: 21629 - RNA, 19 nt, artificial
  Oligomer
ucaaagcuguuccguccca

SEQ ID NO: 21630 - RNA, 19 nt, artificial
  Oligomer
uccagaucaucauauacaa

SEQ ID NO: 21631 - RNA, 19 nt, artificial
  Oligomer
aguggauggugguacaguc

SEQ ID NO: 21632 - RNA, 19 nt, artificial
  Oligomer
gaacauuucuuacaucucc

SEQ ID NO: 21633 - RNA, 19 nt, artificial
  Oligomer
ccacacgcaaauuuccuuc

SEQ ID NO: 21634 - RNA, 19 nt, artificial
  Oligomer
agaauguaaaagauguuga

SEQ ID NO: 21635 - RNA, 19 nt, artificial
  Oligomer
aaguggagaaugucagucu

SEQ ID NO: 21636 - RNA, 19 nt, artificial
  Oligomer
ucauucagcucucggaaca

SEQ ID NO: 21637 - RNA, 19 nt, artificial
  Oligomer
uugcaagcaaggguucaaa

SEQ ID NO: 21638 - RNA, 19 nt, artificial
  Oligomer
agaacauuucuuacaucuc

SEQ ID NO: 21639 - RNA, 19 nt, artificial
  Oligomer
acugcaagaacauuucuua

SEQ ID NO: 21640 - RNA, 19 nt, artificial
  Oligomer
gugaaaaugcagaugugcu

SEQ ID NO: 21641 - RNA, 19 nt, artificial
  Oligomer
aaguguuucugucauccaa

SEQ ID NO: 21642 - RNA, 19 nt, artificial
  Oligomer
aaaaugggauauaaaaagg

SEQ ID NO: 21643 - RNA, 19 nt, artificial
  Oligomer
aaaguguuucugucaucca

SEQ ID NO: 21644 - RNA, 19 nt, artificial
  Oligomer
aaucaacccacagcugcac

SEQ ID NO: 21645 - RNA, 19 nt, artificial
  Oligomer
ucaacaugagggacagcuu

SEQ ID NO: 21646 - RNA, 19 nt, artificial
  Oligomer
auucugggagcuucaucug

SEQ ID NO: 21647 - RNA, 19 nt, artificial
  Oligomer
ugacccuuuuuggacuuca

SEQ ID NO: 21648 - RNA, 19 nt, artificial
  Oligomer
cuccacacgcaaauuuccu

SEQ ID NO: 21649 - RNA, 19 nt, artificial
  Oligomer
acauuucuuacaucuccca

SEQ ID NO: 21650 - RNA, 19 nt, artificial
  Oligomer
cagaucaucauauacaaga

SEQ ID NO: 21651 - RNA, 19 nt, artificial
  Oligomer
gucgaaaaguguuucuguc

SEQ ID NO: 21652 - RNA, 19 nt, artificial
  Oligomer
augugcugugacugcuugu

SEQ ID NO: 21653 - RNA, 19 nt, artificial
  Oligomer
caguagauuaccacuggag

SEQ ID NO: 21654 - RNA, 19 nt, artificial
  Oligomer
cauccaaauacuccacacg

SEQ ID NO: 21655 - RNA, 19 nt, artificial
  Oligomer
caucucccaaacaucccuc

SEQ ID NO: 21656 - RNA, 19 nt, artificial
  Oligomer
acuccacacgcaaauuucc

SEQ ID NO: 21657 - RNA, 19 nt, artificial
  Oligomer
acaucucccaaacaucccu

SEQ ID NO: 21658 - RNA, 19 nt, artificial
  Oligomer
uguuuucaggaaguaguuu

SEQ ID NO: 21659 - RNA, 19 nt, artificial
  Oligomer
cagaccaucgcuaucugag

SEQ ID NO: 21660 - RNA, 19 nt, artificial
  Oligomer
aucaucauauacaagagau

SEQ ID NO: 21661 - RNA, 19 nt, artificial
  Oligomer
caucaaaucauccauugcu

SEQ ID NO: 21662 - RNA, 19 nt, artificial
  Oligomer
uguaguuguaguggauggu

SEQ ID NO: 21663 - RNA, 19 nt, artificial
  Oligomer
acgcaaauuuccuuccacu

SEQ ID NO: 21664 - RNA, 19 nt, artificial
  Oligomer
aagcaaggguucaaagacc

SEQ ID NO: 21665 - RNA, 19 nt, artificial
  Oligomer
ugaugauggugaggauggg

SEQ ID NO: 21666 - RNA, 19 nt, artificial
  Oligomer
cgcaaauuuccuuccacuc

SEQ ID NO: 21667 - RNA, 19 nt, artificial
  Oligomer
ugucccagaaugcaagaag

SEQ ID NO: 21668 - RNA, 19 nt, artificial
  Oligomer
ugacgcacaccuauugcaa

SEQ ID NO: 21669 - RNA, 19 nt, artificial
  Oligomer
auuucacagauaugggccu

SEQ ID NO: 21670 - RNA, 19 nt, artificial
  Oligomer
gugcugugacugcuuguag

SEQ ID NO: 21671 - RNA, 19 nt, artificial
  Oligomer
uaaaacaagucuuggugga

SEQ ID NO: 21672 - RNA, 19 nt, artificial
  Oligomer
auucagcucucggaacauc

SEQ ID NO: 21673 - RNA, 19 nt, artificial
  Oligomer
auggaaguccugggugcuu

SEQ ID NO: 21674 - RNA, 19 nt, artificial
  Oligomer
aaacacgcaccucaaagcu

SEQ ID NO: 21675 - RNA, 19 nt, artificial
  Oligomer
aagagaucgauauaaaaau

SEQ ID NO: 21676 - RNA, 19 nt, artificial
  Oligomer
gagaucgauauaaaaaugg

SEQ ID NO: 21677 - RNA, 19 nt, artificial
  Oligomer
cacaacaaaacaccagugc

SEQ ID NO: 21678 - RNA, 19 nt, artificial
  Oligomer
ucacaaccuccgucaugug

SEQ ID NO: 21679 - RNA, 19 nt, artificial
  Oligomer
agcuucccugguuaguacg

SEQ ID NO: 21680 - RNA, 19 nt, artificial
  Oligomer
acacgcaccucaaagcugu

SEQ ID NO: 21681 - RNA, 19 nt, artificial
  Oligomer
agugugaugauggugagga

SEQ ID NO: 21682 - RNA, 19 nt, artificial
  Oligomer
aguagauuaccacuggagu

SEQ ID NO: 21683 - RNA, 19 nt, artificial
  Oligomer
gcaagacuugacaacuccc

SEQ ID NO: 21684 - RNA, 19 nt, artificial
  Oligomer
aaauacuccacacgcaaau

SEQ ID NO: 21685 - RNA, 19 nt, artificial
  Oligomer
uaacugcaagaacauuucu

SEQ ID NO: 21686 - RNA, 19 nt, artificial
  Oligomer
accaucgcuaucugagcag

SEQ ID NO: 21687 - RNA, 19 nt, artificial
  Oligomer
agacccaaaacccaaaaug

SEQ ID NO: 21688 - RNA, 19 nt, artificial
  Oligomer
cuaaggucgaccaagaggu

SEQ ID NO: 21689 - RNA, 19 nt, artificial
  Oligomer
ucgauauaaaaaugggaua

SEQ ID NO: 21690 - RNA, 19 nt, artificial
  Oligomer
aagcuguuccgucccagua

SEQ ID NO: 21691 - RNA, 19 nt, artificial
  Oligomer
auuguaaacuaacccuuaa

SEQ ID NO: 21692 - RNA, 19 nt, artificial
  Oligomer
aaaacaucuuguugagggc

SEQ ID NO: 21693 - RNA, 19 nt, artificial
  Oligomer
gaaauauucuccauccagu

SEQ ID NO: 21694 - RNA, 19 nt, artificial
  Oligomer
guggaaucaacccacagcu

SEQ ID NO: 21695 - RNA, 19 nt, artificial
  Oligomer
aaauucaacaugagggaca

SEQ ID NO: 21696 - RNA, 19 nt, artificial
  Oligomer
cugaaaauguuuccugacu

SEQ ID NO: 21697 - RNA, 19 nt, artificial
  Oligomer
ugaaauccuccagggugug

SEQ ID NO: 21698 - RNA, 19 nt, artificial
  Oligomer
gggugaaauauucuccauc

SEQ ID NO: 21699 - RNA, 19 nt, artificial
  Oligomer
cucacaaccuccgucaugu

SEQ ID NO: 21700 - RNA, 19 nt, artificial
  Oligomer
cugaagggugaaauauucu

SEQ ID NO: 21701 - RNA, 19 nt, artificial
  Oligomer
ugugcugugacugcuugua

SEQ ID NO: 21702 - RNA, 19 nt, artificial
  Oligomer
agcucaaaacuuuuagcgc

SEQ ID NO: 21703 - RNA, 19 nt, artificial
  Oligomer
aaauggaaguccugggugc

SEQ ID NO: 21704 - RNA, 19 nt, artificial
  Oligomer
aauccagggaagcguguca

SEQ ID NO: 21705 - RNA, 19 nt, artificial
  Oligomer
guacgugcaagucacagac

SEQ ID NO: 21706 - RNA, 19 nt, artificial
  Oligomer
ugacaacucccucuaccua

SEQ ID NO: 21707 - RNA, 19 nt, artificial
  Oligomer
guaguuguaguggauggug

SEQ ID NO: 21708 - RNA, 19 nt, artificial
  Oligomer
acaagaaguggagaauguc

SEQ ID NO: 21709 - RNA, 19 nt, artificial
  Oligomer
aaauaagagaucgauauaa

SEQ ID NO: 21710 - RNA, 19 nt, artificial
  Oligomer
aucucccaaacaucccuca

SEQ ID NO: 21711 - RNA, 19 nt, artificial
  Oligomer
acaucuuguugagggcagg

SEQ ID NO: 21712 - RNA, 19 nt, artificial
  Oligomer
ugagaagcucaaaacuuuu

SEQ ID NO: 21713 - RNA, 19 nt, artificial
  Oligomer
ucugugagguaggugcaaa

SEQ ID NO: 21714 - RNA, 19 nt, artificial
  Oligomer
ugucuugaacaugaguuuu

SEQ ID NO: 21715 - RNA, 19 nt, artificial
  Oligomer
aaacaucuuguugagggca

SEQ ID NO: 21716 - RNA, 19 nt, artificial
  Oligomer
acuaacccuuaacugcaag

SEQ ID NO: 21717 - RNA, 19 nt, artificial
  Oligomer
cauucugggagcuucaucu

SEQ ID NO: 21718 - RNA, 19 nt, artificial
  Oligomer
cuucugacgcacaccuauu

SEQ ID NO: 21719 - RNA, 19 nt, artificial
  Oligomer
uuuccauaggucugaaaau

SEQ ID NO: 21720 - RNA, 19 nt, artificial
  Oligomer
acacuaugucgaaaagugu

SEQ ID NO: 21721 - RNA, 19 nt, artificial
  Oligomer
acaaaacaccagugcaggc

SEQ ID NO: 21722 - RNA, 19 nt, artificial
  Oligomer
ugcagaugugcuugcagaa

SEQ ID NO: 21723 - RNA, 19 nt, artificial
  Oligomer
agaccaucgcuaucugagc

SEQ ID NO: 21724 - RNA, 19 nt, artificial
  Oligomer
cuaugucgaaaaguguuuc

SEQ ID NO: 21725 - RNA, 19 nt, artificial
  Oligomer
cauguaguuguaguggaug

SEQ ID NO: 21726 - RNA, 19 nt, artificial
  Oligomer
aaagcuguuccgucccagu

SEQ ID NO: 21727 - RNA, 19 nt, artificial
  Oligomer
auaagagaucgauauaaaa

SEQ ID NO: 21728 - RNA, 19 nt, artificial
  Oligomer
gagauuuccuuuuagguac

SEQ ID NO: 21729 - RNA, 19 nt, artificial
  Oligomer
aucauauacaagagaugaa

SEQ ID NO: 21730 - RNA, 19 nt, artificial
  Oligomer
ggugaaauauucuccaucc

SEQ ID NO: 21731 - RNA, 19 nt, artificial
  Oligomer
ucccagaaugcaagaagcc

SEQ ID NO: 21732 - RNA, 19 nt, artificial
  Oligomer
cggagauucucuuccucug

SEQ ID NO: 21733 - RNA, 19 nt, artificial
  Oligomer
agaagcucaaaacuuuuag

SEQ ID NO: 21734 - RNA, 19 nt, artificial
  Oligomer
gucuugguggauccagauc

SEQ ID NO: 21735 - RNA, 19 nt, artificial
  Oligomer
agcaucaaaucauccauug

SEQ ID NO: 21736 - RNA, 19 nt, artificial
  Oligomer
gucauccaaauacuccaca

SEQ ID NO: 21737 - RNA, 19 nt, artificial
  Oligomer
auggugguacagucagagc

SEQ ID NO: 21738 - RNA, 19 nt, artificial
  Oligomer
uauugcaagcaaggguuca

SEQ ID NO: 21739 - RNA, 19 nt, artificial
  Oligomer
aaaaugcagaugugcuugc

SEQ ID NO: 21740 - RNA, 19 nt, artificial
  Oligomer
aaagcaaauggaaguccug

SEQ ID NO: 21741 - RNA, 19 nt, artificial
  Oligomer
agggacagaagaugacagg

SEQ ID NO: 21742 - RNA, 19 nt, artificial
  Oligomer
ccuucugucuugaacauga

SEQ ID NO: 21743 - RNA, 19 nt, artificial
  Oligomer
aagaagcccagacggaaac

SEQ ID NO: 21744 - RNA, 19 nt, artificial
  Oligomer
cauaggucugaaaauguuu

SEQ ID NO: 21745 - RNA, 19 nt, artificial
  Oligomer
auuuccuuuuagguacuaa

SEQ ID NO: 21746 - RNA, 19 nt, artificial
  Oligomer
agaucgauauaaaaauggg

SEQ ID NO: 21747 - RNA, 19 nt, artificial
  Oligomer
acuggagucuuccagugug

SEQ ID NO: 21748 - RNA, 19 nt, artificial
  Oligomer
augggccuugaaguuagag

SEQ ID NO: 21749 - RNA, 19 nt, artificial
  Oligomer
aggcccuucugucuugaac

SEQ ID NO: 21750 - RNA, 19 nt, artificial
  Oligomer
aaggucgaccaagagguug

SEQ ID NO: 21751 - RNA, 19 nt, artificial
  Oligomer
gucaugugcugugacugcu

SEQ ID NO: 21752 - RNA, 19 nt, artificial
  Oligomer
acucggauaagaugcugag

SEQ ID NO: 21753 - RNA, 19 nt, artificial
  Oligomer
cugguuaguacggugaagu

SEQ ID NO: 21754 - RNA, 19 nt, artificial
  Oligomer
ugggauauaaaaagggaga

SEQ ID NO: 21755 - RNA, 19 nt, artificial
  Oligomer
guagauuaccacuggaguc

SEQ ID NO: 21756 - RNA, 19 nt, artificial
  Oligomer
aaaaucuaagcugguaugu

SEQ ID NO: 21757 - RNA, 19 nt, artificial
  Oligomer
cugcaagaacauuucuuac

SEQ ID NO: 21758 - RNA, 19 nt, artificial
  Oligomer
ucaggcccuucugucuuga

SEQ ID NO: 21759 - RNA, 19 nt, artificial
  Oligomer
ucaucuggaccugggucuu

SEQ ID NO: 21760 - RNA, 19 nt, artificial
  Oligomer
ugcaagcaaggguucaaag

SEQ ID NO: 21761 - RNA, 19 nt, artificial
  Oligomer
ggucugaaaauguuuccug

SEQ ID NO: 21762 - RNA, 19 nt, artificial
  Oligomer
guuuucugggaagggacag

SEQ ID NO: 21763 - RNA, 19 nt, artificial
  Oligomer
gaacaugaguuuuuuaugg

SEQ ID NO: 21764 - RNA, 19 nt, artificial
  Oligomer
cagauguacauuauuucau

SEQ ID NO: 21765 - RNA, 19 nt, artificial
  Oligomer
aaagauguugacccuucca

SEQ ID NO: 21766 - RNA, 19 nt, artificial
  Oligomer
gauucucuuccucugugcg

SEQ ID NO: 21767 - RNA, 19 nt, artificial
  Oligomer
ggaggaagguaucaacaaa

SEQ ID NO: 21768 - RNA, 19 nt, artificial
  Oligomer
ggcgaagaagaaaucuaaa

SEQ ID NO: 21769 - RNA, 19 nt, artificial
  Oligomer
ugcugaaacugaaauucaa

SEQ ID NO: 21770 - RNA, 19 nt, artificial
  Oligomer
ugaagaagcugacaguaaa

SEQ ID NO: 21771 - RNA, 19 nt, artificial
  Oligomer
ggugaucgguagcaacaaa

SEQ ID NO: 21772 - RNA, 19 nt, artificial
  Oligomer
uggaaaagaugaauaagaa

SEQ ID NO: 21773 - RNA, 19 nt, artificial
  Oligomer
gaaugaaauuaacucuuaa

SEQ ID NO: 21774 - RNA, 19 nt, artificial
  Oligomer
ggauaguaagcuugaaaaa

SEQ ID NO: 21775 - RNA, 19 nt, artificial
  Oligomer
accugaucuggaacaucaa

SEQ ID NO: 21776 - RNA, 19 nt, artificial
  Oligomer
cggugaucgguagcaacaa

SEQ ID NO: 21777 - RNA, 19 nt, artificial
  Oligomer
cgcccauguuugauggaaa

SEQ ID NO: 21778 - RNA, 19 nt, artificial
  Oligomer
caaggauaguaagcuugaa

SEQ ID NO: 21779 - RNA, 19 nt, artificial
  Oligomer
caacaaaucugaaaagaga

SEQ ID NO: 21780 - RNA, 19 nt, artificial
  Oligomer
ggguaguaccuguacuaaa

SEQ ID NO: 21781 - RNA, 19 nt, artificial
  Oligomer
gggcaagcacagugucaaa

SEQ ID NO: 21782 - RNA, 19 nt, artificial
  Oligomer
gcccauguuugauggaaaa

SEQ ID NO: 21783 - RNA, 19 nt, artificial
  Oligomer
caaggacgagcuaaagaaa

SEQ ID NO: 21784 - RNA, 19 nt, artificial
  Oligomer
gaagaaaucuaaaaaagaa

SEQ ID NO: 21785 - RNA, 19 nt, artificial
  Oligomer
uaguaauacucgauuaaaa

SEQ ID NO: 21786 - RNA, 19 nt, artificial
  Oligomer
cagaaaggauuuuacagaa

SEQ ID NO: 21787 - RNA, 19 nt, artificial
  Oligomer
cgaagaagaaaucuaaaaa

SEQ ID NO: 21788 - RNA, 19 nt, artificial
  Oligomer
gguguauggagaagauaga

SEQ ID NO: 21789 - RNA, 19 nt, artificial
  Oligomer
gguugacagagauucugaa

SEQ ID NO: 21790 - RNA, 19 nt, artificial
  Oligomer
gaaccaacuccuacuacaa

SEQ ID NO: 21791 - RNA, 19 nt, artificial
  Oligomer
ccugguggacaucguuaaa

SEQ ID NO: 21792 - RNA, 19 nt, artificial
  Oligomer
gauagagcgugaaggcgaa

SEQ ID NO: 21793 - RNA, 19 nt, artificial
  Oligomer
ggaacaaggaugaagugaa

SEQ ID NO: 21794 - RNA, 19 nt, artificial
  Oligomer
uguggauccugauucugga

SEQ ID NO: 21795 - RNA, 19 nt, artificial
  Oligomer
caggcugcuuugucaagaa

SEQ ID NO: 21796 - RNA, 19 nt, artificial
  Oligomer
caggcuacauguuugguaa

SEQ ID NO: 21797 - RNA, 19 nt, artificial
  Oligomer
agcacuucaugaaauuaua

SEQ ID NO: 21798 - RNA, 19 nt, artificial
  Oligomer
gguggauggaguggaugaa

SEQ ID NO: 21799 - RNA, 19 nt, artificial
  Oligomer
gguagauaaaacugacaua

SEQ ID NO: 21800 - RNA, 19 nt, artificial
  Oligomer
gaaauugaagguuaaaaaa

SEQ ID NO: 21801 - RNA, 19 nt, artificial
  Oligomer
cagcaaggaucccaucgau

SEQ ID NO: 21802 - RNA, 19 nt, artificial
  Oligomer
aguaauacucgauuaaaaa

SEQ ID NO: 21803 - RNA, 19 nt, artificial
  Oligomer
agguggaaaugcuugacaa

SEQ ID NO: 21804 - RNA, 19 nt, artificial
  Oligomer
gugggaugaccagcagaaa

SEQ ID NO: 21805 - RNA, 19 nt, artificial
  Oligomer
gcugcgcucuccaaaaaaa

SEQ ID NO: 21806 - RNA, 19 nt, artificial
  Oligomer
agguggaaaagaugaauaa

SEQ ID NO: 21807 - RNA, 19 nt, artificial
  Oligomer
acaucaaggacgagcuaaa

SEQ ID NO: 21808 - RNA, 19 nt, artificial
  Oligomer
ggaccaaguguauggucaa

SEQ ID NO: 21809 - RNA, 19 nt, artificial
  Oligomer
cgguagcaacaaacuggaa

SEQ ID NO: 21810 - RNA, 19 nt, artificial
  Oligomer
aggaggaagguaucaacaa

SEQ ID NO: 21811 - RNA, 19 nt, artificial
  Oligomer
guauggagaagauagaaaa

SEQ ID NO: 21812 - RNA, 19 nt, artificial
  Oligomer
cgaguacauugucuaugau

SEQ ID NO: 21813 - RNA, 19 nt, artificial
  Oligomer
gagucaagagugaaggaaa

SEQ ID NO: 21814 - RNA, 19 nt, artificial
  Oligomer
gaagaagaaaucuaaaaaa

SEQ ID NO: 21815 - RNA, 19 nt, artificial
  Oligomer
cgcucuccaaaaaaagcaa

SEQ ID NO: 21816 - RNA, 19 nt, artificial
  Oligomer
agguaucaacaaaucugaa

SEQ ID NO: 21817 - RNA, 19 nt, artificial
  Oligomer
ccaaaggaauuccgagaaa

SEQ ID NO: 21818 - RNA, 19 nt, artificial
  Oligomer
ggcuaauaguaauacucga

SEQ ID NO: 21819 - RNA, 19 nt, artificial
  Oligomer
gaacaugggagcucuugaa

SEQ ID NO: 21820 - RNA, 19 nt, artificial
  Oligomer
ucaagaaauugaagguuaa

SEQ ID NO: 21821 - RNA, 19 nt, artificial
  Oligomer
ucuggaggacgacaaggaa

SEQ ID NO: 21822 - RNA, 19 nt, artificial
  Oligomer
gguggacaucguuaaagga

SEQ ID NO: 21823 - RNA, 19 nt, artificial
  Oligomer
ccagggaaggaaaaauaca

SEQ ID NO: 21824 - RNA, 19 nt, artificial
  Oligomer
agaaauugaagguuaaaaa

SEQ ID NO: 21825 - RNA, 19 nt, artificial
  Oligomer
ggagagagauucuguugca

SEQ ID NO: 21826 - RNA, 19 nt, artificial
  Oligomer
caaugcguaugacuuggaa

SEQ ID NO: 21827 - RNA, 19 nt, artificial
  Oligomer
agaagauggaggaaguaaa

SEQ ID NO: 21828 - RNA, 19 nt, artificial
  Oligomer
gaaacauguaugaacugaa

SEQ ID NO: 21829 - RNA, 19 nt, artificial
  Oligomer
gaagaagcugacaguaaau

SEQ ID NO: 21830 - RNA, 19 nt, artificial
  Oligomer
gaugaucuuugauguggaa

SEQ ID NO: 21831 - RNA, 19 nt, artificial
  Oligomer
cuaugauauugcucaggua

SEQ ID NO: 21832 - RNA, 19 nt, artificial
  Oligomer
cuuuugucuuccaaauuaa

SEQ ID NO: 21833 - RNA, 19 nt, artificial
  Oligomer
gcaacaaacuggaacagau

SEQ ID NO: 21834 - RNA, 19 nt, artificial
  Oligomer
gaaggcagagccuguugaa

SEQ ID NO: 21835 - RNA, 19 nt, artificial
  Oligomer
gaaaagagaaugaaauuaa

SEQ ID NO: 21836 - RNA, 19 nt, artificial
  Oligomer
caagaaauugaagguuaaa

SEQ ID NO: 21837 - RNA, 19 nt, artificial
  Oligomer
cauugagcacuucaugaaa

SEQ ID NO: 21838 - RNA, 19 nt, artificial
  Oligomer
ccaaaaauuucacgaagua

SEQ ID NO: 21839 - RNA, 19 nt, artificial
  Oligomer
gcgaagaagaaaucuaaaa

SEQ ID NO: 21840 - RNA, 19 nt, artificial
  Oligomer
uggaggacgacaaggaaaa

SEQ ID NO: 21841 - RNA, 19 nt, artificial
  Oligomer
ggcugcgcucuccaaaaaa

SEQ ID NO: 21842 - RNA, 19 nt, artificial
  Oligomer
cgcgccucuugcaagaaau

SEQ ID NO: 21843 - RNA, 19 nt, artificial
  Oligomer
cuggaggacgacaaggaaa

SEQ ID NO: 21844 - RNA, 19 nt, artificial
  Oligomer
agcucaaaacugacauuaa

SEQ ID NO: 21845 - RNA, 19 nt, artificial
  Oligomer
cgacaaggaaaacagguau

SEQ ID NO: 21846 - RNA, 19 nt, artificial
  Oligomer
acgacuuugggaugaagaa

SEQ ID NO: 21847 - RNA, 19 nt, artificial
  Oligomer
ccucugcuucagcagauaa

SEQ ID NO: 21848 - RNA, 19 nt, artificial
  Oligomer
ccagguagauaaaacugac

SEQ ID NO: 21849 - RNA, 19 nt, artificial
  Oligomer
ugacagagauucugaagaa

SEQ ID NO: 21850 - RNA, 19 nt, artificial
  Oligomer
gggcacuuuugucuuccaa

SEQ ID NO: 21851 - RNA, 19 nt, artificial
  Oligomer
aauuaaaacucuaccacaa

SEQ ID NO: 21852 - RNA, 19 nt, artificial
  Oligomer
gagugaaggaaagagaaaa

SEQ ID NO: 21853 - RNA, 19 nt, artificial
  Oligomer
aagagugaaggaaagagaa

SEQ ID NO: 21854 - RNA, 19 nt, artificial
  Oligomer
gaggaagguaucaacaaau

SEQ ID NO: 21855 - RNA, 19 nt, artificial
  Oligomer
ugugcaucagcaccaaaaa

SEQ ID NO: 21856 - RNA, 19 nt, artificial
  Oligomer
ccacaaauauacuuaccca

SEQ ID NO: 21857 - RNA, 19 nt, artificial
  Oligomer
gaccugaucuggaacauca

SEQ ID NO: 21858 - RNA, 19 nt, artificial
  Oligomer
guacuaaaccaccucagaa

SEQ ID NO: 21859 - RNA, 19 nt, artificial
  Oligomer
aggauaguaagcuugaaaa

SEQ ID NO: 21860 - RNA, 19 nt, artificial
  Oligomer
caacuaugagaagcucaaa

SEQ ID NO: 21861 - RNA, 19 nt, artificial
  Oligomer
aagccgagaucaucaggaa

SEQ ID NO: 21862 - RNA, 19 nt, artificial
  Oligomer
guauguuaagaacacucau

SEQ ID NO: 21863 - RNA, 19 nt, artificial
  Oligomer
uccugauucuggacuggaa

SEQ ID NO: 21864 - RNA, 19 nt, artificial
  Oligomer
ccgagaucaucaggaagua

SEQ ID NO: 21865 - RNA, 19 nt, artificial
  Oligomer
gaacaucaaggacgagcua

SEQ ID NO: 21866 - RNA, 19 nt, artificial
  Oligomer
guaucugcugaaacugaaa

SEQ ID NO: 21867 - RNA, 19 nt, artificial
  Oligomer
ggaucuauuucgcugacau

SEQ ID NO: 21868 - RNA, 19 nt, artificial
  Oligomer
gccugguggacaucguuaa

SEQ ID NO: 21869 - RNA, 19 nt, artificial
  Oligomer
gcugaaacugaaauucaau

SEQ ID NO: 21870 - RNA, 19 nt, artificial
  Oligomer
uguggaaaguaugaagaaa

SEQ ID NO: 21871 - RNA, 19 nt, artificial
  Oligomer
guacggugaucgguagcaa

SEQ ID NO: 21872 - RNA, 19 nt, artificial
  Oligomer
gacucugggugacuuugca

SEQ ID NO: 21873 - RNA, 19 nt, artificial
  Oligomer
aguaucugcugaaacugaa

SEQ ID NO: 21874 - RNA, 19 nt, artificial
  Oligomer
cagguagauaaaacugaca

SEQ ID NO: 21875 - RNA, 19 nt, artificial
  Oligomer
guguauggagaagauagaa

SEQ ID NO: 21876 - RNA, 19 nt, artificial
  Oligomer
gcaucagcaccaaaaagga

SEQ ID NO: 21877 - RNA, 19 nt, artificial
  Oligomer
cgaaguaucccaaaaaguu

SEQ ID NO: 21878 - RNA, 19 nt, artificial
  Oligomer
gcagcuucauaaccgaaga

SEQ ID NO: 21879 - RNA, 19 nt, artificial
  Oligomer
gauccuucagcuaacauua

SEQ ID NO: 21880 - RNA, 19 nt, artificial
  Oligomer
gauggaggaaguaaaggaa

SEQ ID NO: 21881 - RNA, 19 nt, artificial
  Oligomer
ggaaccaacuccuacuaca

SEQ ID NO: 21882 - RNA, 19 nt, artificial
  Oligomer
cagcagaaagucaagaaga

SEQ ID NO: 21883 - RNA, 19 nt, artificial
  Oligomer
ccucagaaaggauuuuaca

SEQ ID NO: 21884 - RNA, 19 nt, artificial
  Oligomer
ugcuacagaggauaaagaa

SEQ ID NO: 21885 - RNA, 19 nt, artificial
  Oligomer
agacuaguccuauggaaaa

SEQ ID NO: 21886 - RNA, 19 nt, artificial
  Oligomer
ccaacagaaguacgugcaa

SEQ ID NO: 21887 - RNA, 19 nt, artificial
  Oligomer
guaucaacaaaucugaaaa

SEQ ID NO: 21888 - RNA, 19 nt, artificial
  Oligomer
ccuucuccaggaauacuga

SEQ ID NO: 21889 - RNA, 19 nt, artificial
  Oligomer
guggaaaagaugaauaaga

SEQ ID NO: 21890 - RNA, 19 nt, artificial
  Oligomer
caucgauaucuuuaagaua

SEQ ID NO: 21891 - RNA, 19 nt, artificial
  Oligomer
cgagaaaucucuuaccuca

SEQ ID NO: 21892 - RNA, 19 nt, artificial
  Oligomer
cuucaagagcgaugccuau

SEQ ID NO: 21893 - RNA, 19 nt, artificial
  Oligomer
aggagguggaaaagaugaa

SEQ ID NO: 21894 - RNA, 19 nt, artificial
  Oligomer
ggaugaagaggcagugaag

SEQ ID NO: 21895 - RNA, 19 nt, artificial
  Oligomer
aaagguuugggcaaaacua

SEQ ID NO: 21896 - RNA, 19 nt, artificial
  Oligomer
aagucaucgauaucuuuaa

SEQ ID NO: 21897 - RNA, 19 nt, artificial
  Oligomer
gaaagauguuaagcauuua

SEQ ID NO: 21898 - RNA, 19 nt, artificial
  Oligomer
ggagcucuugaaauaugua

SEQ ID NO: 21899 - RNA, 19 nt, artificial
  Oligomer
ugagguggauggaguggau

SEQ ID NO: 21900 - RNA, 19 nt, artificial
  Oligomer
ugguaugaauucacccgaa

SEQ ID NO: 21901 - RNA, 19 nt, artificial
  Oligomer
gcaaguuacccaagggcaa

SEQ ID NO: 21902 - RNA, 19 nt, artificial
  Oligomer
ccaaaaaggagguggaaaa

SEQ ID NO: 21903 - RNA, 19 nt, artificial
  Oligomer
ggcacuuuugucuuccaaa

SEQ ID NO: 21904 - RNA, 19 nt, artificial
  Oligomer
ggagaaguugcccuuggaa

SEQ ID NO: 21905 - RNA, 19 nt, artificial
  Oligomer
cuuccaaauuaaaacucua

SEQ ID NO: 21906 - RNA, 19 nt, artificial
  Oligomer
gaacacucaugcaaccaca

SEQ ID NO: 21907 - RNA, 19 nt, artificial
  Oligomer
ucucauacuuagaaacaaa

SEQ ID NO: 21908 - RNA, 19 nt, artificial
  Oligomer
agaugaauaagaagaugga

SEQ ID NO: 21909 - RNA, 19 nt, artificial
  Oligomer
agaacgaccugaucuggaa

SEQ ID NO: 21910 - RNA, 19 nt, artificial
  Oligomer
agaaaaggcuggagagaga

SEQ ID NO: 21911 - RNA, 19 nt, artificial
  Oligomer
gaacaaggaugaagugaag

SEQ ID NO: 21912 - RNA, 19 nt, artificial
  Oligomer
ccuuuaagcagcuucauaa

SEQ ID NO: 21913 - RNA, 19 nt, artificial
  Oligomer
ucaggaaguauguuaagaa

SEQ ID NO: 21914 - RNA, 19 nt, artificial
  Oligomer
acaccucucuacuauauaa

SEQ ID NO: 21915 - RNA, 19 nt, artificial
  Oligomer
ugaucuggaacaucaagga

SEQ ID NO: 21916 - RNA, 19 nt, artificial
  Oligomer
aauugaagguuaaaaaaca

SEQ ID NO: 21917 - RNA, 19 nt, artificial
  Oligomer
aacaaaucugaaaagagaa

SEQ ID NO: 21918 - RNA, 19 nt, artificial
  Oligomer
gauuuuggaaagauguuaa

SEQ ID NO: 21919 - RNA, 19 nt, artificial
  Oligomer
ccaaaggaaggaacgcuaa

SEQ ID NO: 21920 - RNA, 19 nt, artificial
  Oligomer
aucugaaaagagaaugaaa

SEQ ID NO: 21921 - RNA, 19 nt, artificial
  Oligomer
cucucaaaucgcuuuuaca

SEQ ID NO: 21922 - RNA, 19 nt, artificial
  Oligomer
agagugaaggaaagagaaa

SEQ ID NO: 21923 - RNA, 19 nt, artificial
  Oligomer
gaagaagccgagaucauca

SEQ ID NO: 21924 - RNA, 19 nt, artificial
  Oligomer
caugaaauuauaugaagaa

SEQ ID NO: 21925 - RNA, 19 nt, artificial
  Oligomer
gcucaaaacugacauuaag

SEQ ID NO: 21926 - RNA, 19 nt, artificial
  Oligomer
caagagugaaggaaagaga

SEQ ID NO: 21927 - RNA, 19 nt, artificial
  Oligomer
acgaguacauugucuauga

SEQ ID NO: 21928 - RNA, 19 nt, artificial
  Oligomer
caugggagcucuugaaaua

SEQ ID NO: 21929 - RNA, 19 nt, artificial
  Oligomer
ccaagguggaaaugcuuga

SEQ ID NO: 21930 - RNA, 19 nt, artificial
  Oligomer
ucuggaacaucaaggacga

SEQ ID NO: 21931 - RNA, 19 nt, artificial
  Oligomer
uguuaaagguuuucucuaa

SEQ ID NO: 21932 - RNA, 19 nt, artificial
  Oligomer
gguaucaacaaaucugaaa

SEQ ID NO: 21933 - RNA, 19 nt, artificial
  Oligomer
agaaaggauuuuacagaaa

SEQ ID NO: 21934 - RNA, 19 nt, artificial
  Oligomer
gauccuggaucucucaaau

SEQ ID NO: 21935 - RNA, 19 nt, artificial
  Oligomer
gacuaguccuauggaaaaa

SEQ ID NO: 21936 - RNA, 19 nt, artificial
  Oligomer
aaggaaaaauacacuucca

SEQ ID NO: 21937 - RNA, 19 nt, artificial
  Oligomer
ggugguugacagagauucu

SEQ ID NO: 21938 - RNA, 19 nt, artificial
  Oligomer
gggucugaugauagcagca

SEQ ID NO: 21939 - RNA, 19 nt, artificial
  Oligomer
cugccuggaccaaguguau

SEQ ID NO: 21940 - RNA, 19 nt, artificial
  Oligomer
agcgaugccuauuacugca

SEQ ID NO: 21941 - RNA, 19 nt, artificial
  Oligomer
ccaucgaugucaacuauga

SEQ ID NO: 21942 - RNA, 19 nt, artificial
  Oligomer
agcuguggauccugauucu

SEQ ID NO: 21943 - RNA, 19 nt, artificial
  Oligomer
aggagcuacucaucuucaa

SEQ ID NO: 21944 - RNA, 19 nt, artificial
  Oligomer
cccaagggcuaauaguaau

SEQ ID NO: 21945 - RNA, 19 nt, artificial
  Oligomer
gagaaaucucuuaccucaa

SEQ ID NO: 21946 - RNA, 19 nt, artificial
  Oligomer
ccauuauccaacaugaaga

SEQ ID NO: 21947 - RNA, 19 nt, artificial
  Oligomer
acccaagggcuaauaguaa

SEQ ID NO: 21948 - RNA, 19 nt, artificial
  Oligomer
agaagaaaucuaaaaaaga

SEQ ID NO: 21949 - RNA, 19 nt, artificial
  Oligomer
ucaucaggaaguauguuaa

SEQ ID NO: 21950 - RNA, 19 nt, artificial
  Oligomer
gcagaaagucaagaagaca

SEQ ID NO: 21951 - RNA, 19 nt, artificial
  Oligomer
ccuugcuacagaggauaaa

SEQ ID NO: 21952 - RNA, 19 nt, artificial
  Oligomer
gauucuguugcauagacua

SEQ ID NO: 21953 - RNA, 19 nt, artificial
  Oligomer
ucgcugacauggucuccaa

SEQ ID NO: 21954 - RNA, 19 nt, artificial
  Oligomer
cucauacuuagaaacaaaa

SEQ ID NO: 21955 - RNA, 19 nt, artificial
  Oligomer
ccauugagcacuucaugaa

SEQ ID NO: 21956 - RNA, 19 nt, artificial
  Oligomer
guccuauggaaaaaaccaa

SEQ ID NO: 21957 - RNA, 19 nt, artificial
  Oligomer
aaggauaguaagcuugaaa

SEQ ID NO: 21958 - RNA, 19 nt, artificial
  Oligomer
aggcuacauguuugguaaa

SEQ ID NO: 21959 - RNA, 19 nt, artificial
  Oligomer
cuugaaauauguaguauua

SEQ ID NO: 21960 - RNA, 19 nt, artificial
  Oligomer
agaugaucuuugaugugga

SEQ ID NO: 21961 - RNA, 19 nt, artificial
  Oligomer
ucaucaagaugaucuuuga

SEQ ID NO: 21962 - RNA, 19 nt, artificial
  Oligomer
agcguuacaagcccuuuaa

SEQ ID NO: 21963 - RNA, 19 nt, artificial
  Oligomer
ggaaaacagguauuggaua

SEQ ID NO: 21964 - RNA, 19 nt, artificial
  Oligomer
gauaaaacugacauagaga

SEQ ID NO: 21965 - RNA, 19 nt, artificial
  Oligomer
guacauugucuaugauauu

SEQ ID NO: 21966 - RNA, 19 nt, artificial
  Oligomer
agucaagaagacagcggaa

SEQ ID NO: 21967 - RNA, 19 nt, artificial
  Oligomer
aaggaaaacagguauugga

SEQ ID NO: 21968 - RNA, 19 nt, artificial
  Oligomer
aaggaaggaacgcuaacaa

SEQ ID NO: 21969 - RNA, 19 nt, artificial
  Oligomer
ugagcaaaaggcagaucca

SEQ ID NO: 21970 - RNA, 19 nt, artificial
  Oligomer
auuaaaaguugcauuugaa

SEQ ID NO: 21971 - RNA, 19 nt, artificial
  Oligomer
cagcguuacaagcccuuua

SEQ ID NO: 21972 - RNA, 19 nt, artificial
  Oligomer
caacuaaugaccugaagga

SEQ ID NO: 21973 - RNA, 19 nt, artificial
  Oligomer
ucgauaucuuuaagauaga

SEQ ID NO: 21974 - RNA, 19 nt, artificial
  Oligomer
ggaagucaucgauaucuuu

SEQ ID NO: 21975 - RNA, 19 nt, artificial
  Oligomer
auguggaaaguaugaagaa

SEQ ID NO: 21976 - RNA, 19 nt, artificial
  Oligomer
agauaaaacugacauagag

SEQ ID NO: 21977 - RNA, 19 nt, artificial
  Oligomer
ucaaggacgagcuaaagaa

SEQ ID NO: 21978 - RNA, 19 nt, artificial
  Oligomer
ccuuggaaacauguaugaa

SEQ ID NO: 21979 - RNA, 19 nt, artificial
  Oligomer
ggaaaagaugaauaagaag

SEQ ID NO: 21980 - RNA, 19 nt, artificial
  Oligomer
aaacucuaccacaaauaua

SEQ ID NO: 21981 - RNA, 19 nt, artificial
  Oligomer
ccgugacaggcuacauguu

SEQ ID NO: 21982 - RNA, 19 nt, artificial
  Oligomer
agcagcuguggauccugau

SEQ ID NO: 21983 - RNA, 19 nt, artificial
  Oligomer
gugaagaagcugacaguaa

SEQ ID NO: 21984 - RNA, 19 nt, artificial
  Oligomer
ggguguauggagaagauag

SEQ ID NO: 21985 - RNA, 19 nt, artificial
  Oligomer
ggucagcuggucuucaaga

SEQ ID NO: 21986 - RNA, 19 nt, artificial
  Oligomer
cauuaaggugguugacaga

SEQ ID NO: 21987 - RNA, 19 nt, artificial
  Oligomer
caguucaggaccucaucaa

SEQ ID NO: 21988 - RNA, 19 nt, artificial
  Oligomer
agcuggucuucaagagcga

SEQ ID NO: 21989 - RNA, 19 nt, artificial
  Oligomer
aaggaggaagguaucaaca

SEQ ID NO: 21990 - RNA, 19 nt, artificial
  Oligomer
gaaugacaccucucuacua

SEQ ID NO: 21991 - RNA, 19 nt, artificial
  Oligomer
gcuggagagagauucuguu

SEQ ID NO: 21992 - RNA, 19 nt, artificial
  Oligomer
cauacuccauccucaguga

SEQ ID NO: 21993 - RNA, 19 nt, artificial
  Oligomer
ucacgaaguaucccaaaaa

SEQ ID NO: 21994 - RNA, 19 nt, artificial
  Oligomer
cacagcuaggcaugauuga

SEQ ID NO: 21995 - RNA, 19 nt, artificial
  Oligomer
ggcagagccuguugaaguu

SEQ ID NO: 21996 - RNA, 19 nt, artificial
  Oligomer
aaaccaagcuucguuagaa

SEQ ID NO: 21997 - RNA, 19 nt, artificial
  Oligomer
gcuuaauccuguugggaga

SEQ ID NO: 21998 - RNA, 19 nt, artificial
  Oligomer
cuuccacccuuuuuucuaa

SEQ ID NO: 21999 - RNA, 19 nt, artificial
  Oligomer
gguuguuuuuguuuuuucu

SEQ ID NO: 22000 - RNA, 19 nt, artificial
  Oligomer
cuuaccucaagaaauugaa

SEQ ID NO: 22001 - RNA, 19 nt, artificial
  Oligomer
ugaugauagcagcaaggau

SEQ ID NO: 22002 - RNA, 19 nt, artificial
  Oligomer
uguuaagaacacucaugca

SEQ ID NO: 22003 - RNA, 19 nt, artificial
  Oligomer
cuuuaguuuugauuuugga

SEQ ID NO: 22004 - RNA, 19 nt, artificial
  Oligomer
cuccaggaauacugaacau

SEQ ID NO: 22005 - RNA, 19 nt, artificial
  Oligomer
gugucaaagguuugggcaa

SEQ ID NO: 22006 - RNA, 19 nt, artificial
  Oligomer
cuaaaaaagaaaaagacaa

SEQ ID NO: 22007 - RNA, 19 nt, artificial
  Oligomer
gaaauuaacucuuaaagga

SEQ ID NO: 22008 - RNA, 19 nt, artificial
  Oligomer
cccaaaggaauuccgagaa

SEQ ID NO: 22009 - RNA, 19 nt, artificial
  Oligomer
cacaaauauacuuacccaa

SEQ ID NO: 22010 - RNA, 19 nt, artificial
  Oligomer
gcacuuuugucuuccaaau

SEQ ID NO: 22011 - RNA, 19 nt, artificial
  Oligomer
aacagguauuggauauuca

SEQ ID NO: 22012 - RNA, 19 nt, artificial
  Oligomer
uuuugucuuccaaauuaaa

SEQ ID NO: 22013 - RNA, 19 nt, artificial
  Oligomer
cauugucuaugauauugcu

SEQ ID NO: 22014 - RNA, 19 nt, artificial
  Oligomer
aaaagaugaauaagaagau

SEQ ID NO: 22015 - RNA, 19 nt, artificial
  Oligomer
gagcuuuccuucuccagga

SEQ ID NO: 22016 - RNA, 19 nt, artificial
  Oligomer
ccaagagccuucaggaguu

SEQ ID NO: 22017 - RNA, 19 nt, artificial
  Oligomer
ggaaguauguuaagaacac

SEQ ID NO: 22018 - RNA, 19 nt, artificial
  Oligomer
aagguaucaacaaaucuga

SEQ ID NO: 22019 - RNA, 19 nt, artificial
  Oligomer
cugaagaagccgagaucau

SEQ ID NO: 22020 - RNA, 19 nt, artificial
  Oligomer
caaaggaauuccgagaaau

SEQ ID NO: 22021 - RNA, 19 nt, artificial
  Oligomer
ccuccuugcuacagaggau

SEQ ID NO: 22022 - RNA, 19 nt, artificial
  Oligomer
ucauacuuagaaacaaaaa

SEQ ID NO: 22023 - RNA, 19 nt, artificial
  Oligomer
gggagcucuugaaauaugu

SEQ ID NO: 22024 - RNA, 19 nt, artificial
  Oligomer
cagugaagaagcugacagu

SEQ ID NO: 22025 - RNA, 19 nt, artificial
  Oligomer
ccaugguggaguaugagau

SEQ ID NO: 22026 - RNA, 19 nt, artificial
  Oligomer
cacuucuccugcuucugga

SEQ ID NO: 22027 - RNA, 19 nt, artificial
  Oligomer
aggaccucaucaagaugau

SEQ ID NO: 22028 - RNA, 19 nt, artificial
  Oligomer
ggagguggaaaagaugaau

SEQ ID NO: 22029 - RNA, 19 nt, artificial
  Oligomer
cccaggagucaagagugaa

SEQ ID NO: 22030 - RNA, 19 nt, artificial
  Oligomer
ccaaauuaaaacucuacca

SEQ ID NO: 22031 - RNA, 19 nt, artificial
  Oligomer
cuucuccaggaauacugaa

SEQ ID NO: 22032 - RNA, 19 nt, artificial
  Oligomer
cgucuuuaguuuugauuuu

SEQ ID NO: 22033 - RNA, 19 nt, artificial
  Oligomer
cacgcuucacauaucagca

SEQ ID NO: 22034 - RNA, 19 nt, artificial
  Oligomer
caagagcgaugccuauuac

SEQ ID NO: 22035 - RNA, 19 nt, artificial
  Oligomer
aaaaagacaaggauaguaa

SEQ ID NO: 22036 - RNA, 19 nt, artificial
  Oligomer
cccugauccuucagcuaac

SEQ ID NO: 22037 - RNA, 19 nt, artificial
  Oligomer
cccggaacaaggaugaagu

SEQ ID NO: 22038 - RNA, 19 nt, artificial
  Oligomer
gagagagauucuguugcau

SEQ ID NO: 22039 - RNA, 19 nt, artificial
  Oligomer
cugaaaagagaaugaaauu

SEQ ID NO: 22040 - RNA, 19 nt, artificial
  Oligomer
cguaugacuuggaagucau

SEQ ID NO: 22041 - RNA, 19 nt, artificial
  Oligomer
uaaggugguugacagagau

SEQ ID NO: 22042 - RNA, 19 nt, artificial
  Oligomer
gaguacauugucuaugaua

SEQ ID NO: 22043 - RNA, 19 nt, artificial
  Oligomer
ucagcaaucuaucagggaa

SEQ ID NO: 22044 - RNA, 19 nt, artificial
  Oligomer
guugcauagacuaguccua

SEQ ID NO: 22045 - RNA, 19 nt, artificial
  Oligomer
cgcuccugaacaaugcaga

SEQ ID NO: 22046 - RNA, 19 nt, artificial
  Oligomer
ggacgacaaggaaaacagg

SEQ ID NO: 22047 - RNA, 19 nt, artificial
  Oligomer
gcacuucaugaaauuauau

SEQ ID NO: 22048 - RNA, 19 nt, artificial
  Oligomer
augagaagcucaaaacuga

SEQ ID NO: 22049 - RNA, 19 nt, artificial
  Oligomer
uagauaaaacugacauaga

SEQ ID NO: 22050 - RNA, 19 nt, artificial
  Oligomer
cgaugucaacuaugagaag

SEQ ID NO: 22051 - RNA, 19 nt, artificial
  Oligomer
augaagaggcagugaagaa

SEQ ID NO: 22052 - RNA, 19 nt, artificial
  Oligomer
ugcgcauguccuggagaaa

SEQ ID NO: 22053 - RNA, 19 nt, artificial
  Oligomer
gggaaggaaaaauacacuu

SEQ ID NO: 22054 - RNA, 19 nt, artificial
  Oligomer
gaacuccucugcuucagca

SEQ ID NO: 22055 - RNA, 19 nt, artificial
  Oligomer
caggaaguauguuaagaac

SEQ ID NO: 22056 - RNA, 19 nt, artificial
  Oligomer
ccugaacaaugcagacagu

SEQ ID NO: 22057 - RNA, 19 nt, artificial
  Oligomer
augagaucgaccuucagaa

SEQ ID NO: 22058 - RNA, 19 nt, artificial
  Oligomer
cauccaggcugcuuuguca

SEQ ID NO: 22059 - RNA, 19 nt, artificial
  Oligomer
gaugaagaggcagugaaga

SEQ ID NO: 22060 - RNA, 19 nt, artificial
  Oligomer
aggucaaggaggaagguau

SEQ ID NO: 22061 - RNA, 19 nt, artificial
  Oligomer
ggaagguaucaacaaaucu

SEQ ID NO: 22062 - RNA, 19 nt, artificial
  Oligomer
cauagacuaguccuaugga

SEQ ID NO: 22063 - RNA, 19 nt, artificial
  Oligomer
uggaacagaugccguccaa

SEQ ID NO: 22064 - RNA, 19 nt, artificial
  Oligomer
uggaggagugacaggcaaa

SEQ ID NO: 22065 - RNA, 19 nt, artificial
  Oligomer
agcuacucaucuucaacaa

SEQ ID NO: 22066 - RNA, 19 nt, artificial
  Oligomer
aauaguaauacucgauuaa

SEQ ID NO: 22067 - RNA, 19 nt, artificial
  Oligomer
agaucgaccuucagaagau

SEQ ID NO: 22068 - RNA, 19 nt, artificial
  Oligomer
aaaagagaaugaaauuaac

SEQ ID NO: 22069 - RNA, 19 nt, artificial
  Oligomer
gaacgcuaacaauuucuca

SEQ ID NO: 22070 - RNA, 19 nt, artificial
  Oligomer
ccaagggcuaauaguaaua

SEQ ID NO: 22071 - RNA, 19 nt, artificial
  Oligomer
cugugcaucagcaccaaaa

SEQ ID NO: 22072 - RNA, 19 nt, artificial
  Oligomer
aggaucccaucgaugucaa

SEQ ID NO: 22073 - RNA, 19 nt, artificial
  Oligomer
aaaucugaaaagagaauga

SEQ ID NO: 22074 - RNA, 19 nt, artificial
  Oligomer
ccugauccuucagcuaaca

SEQ ID NO: 22075 - RNA, 19 nt, artificial
  Oligomer
uuuacagaaacguguuaaa

SEQ ID NO: 22076 - RNA, 19 nt, artificial
  Oligomer
cagcuaacauuagucugga

SEQ ID NO: 22077 - RNA, 19 nt, artificial
  Oligomer
gaggcagugaagaagcuga

SEQ ID NO: 22078 - RNA, 19 nt, artificial
  Oligomer
cacgaaguaucccaaaaag

SEQ ID NO: 22079 - RNA, 19 nt, artificial
  Oligomer
agagagauucuguugcaua

SEQ ID NO: 22080 - RNA, 19 nt, artificial
  Oligomer
cccacgacuuugggaugaa

SEQ ID NO: 22081 - RNA, 19 nt, artificial
  Oligomer
gguuuucucuaacuucuca

SEQ ID NO: 22082 - RNA, 19 nt, artificial
  Oligomer
cucccugugguaauuggga

SEQ ID NO: 22083 - RNA, 19 nt, artificial
  Oligomer
gaaacguguuaaagguuuu

SEQ ID NO: 22084 - RNA, 19 nt, artificial
  Oligomer
ggcugcuuugucaagaaca

SEQ ID NO: 22085 - RNA, 19 nt, artificial
  Oligomer
gugacuuugcagcagagua

SEQ ID NO: 22086 - RNA, 19 nt, artificial
  Oligomer
ggaugguguagacguuccu

SEQ ID NO: 22087 - RNA, 19 nt, artificial
  Oligomer
auuaaaacucuaccacaaa

SEQ ID NO: 22088 - RNA, 19 nt, artificial
  Oligomer
gucaaagguuugggcaaaa

SEQ ID NO: 22089 - RNA, 19 nt, artificial
  Oligomer
guucgucuuuaguuuugau

SEQ ID NO: 22090 - RNA, 19 nt, artificial
  Oligomer
ggaggacgacaaggaaaac

SEQ ID NO: 22091 - RNA, 19 nt, artificial
  Oligomer
caggaauacugaacauggg

SEQ ID NO: 22092 - RNA, 19 nt, artificial
  Oligomer
ugauauugcucagguaaau

SEQ ID NO: 22093 - RNA, 19 nt, artificial
  Oligomer
aaccaagcuucguuagaau

SEQ ID NO: 22094 - RNA, 19 nt, artificial
  Oligomer
aggaugaagaggcagugaa

SEQ ID NO: 22095 - RNA, 19 nt, artificial
  Oligomer
gagguggaaaagaugaaua

SEQ ID NO: 22096 - RNA, 19 nt, artificial
  Oligomer
cguuagaaugucugccuua

SEQ ID NO: 22097 - RNA, 19 nt, artificial
  Oligomer
gagagauucuguugcauag

SEQ ID NO: 22098 - RNA, 19 nt, artificial
  Oligomer
uguacuaaaccaccucaga

SEQ ID NO: 22099 - RNA, 19 nt, artificial
  Oligomer
gauucugaagaagccgaga

SEQ ID NO: 22100 - RNA, 19 nt, artificial
  Oligomer
aguacauugucuaugauau

SEQ ID NO: 22101 - RNA, 19 nt, artificial
  Oligomer
agauguuaagcauuuauuu

SEQ ID NO: 22102 - RNA, 19 nt, artificial
  Oligomer
guucaacuaaugaccugaa

SEQ ID NO: 22103 - RNA, 19 nt, artificial
  Oligomer
cauuauccaacaugaagau

SEQ ID NO: 22104 - RNA, 19 nt, artificial
  Oligomer
cagagaagacucuggguga

SEQ ID NO: 22105 - RNA, 19 nt, artificial
  Oligomer
aaaacucuaccacaaauau

SEQ ID NO: 22106 - RNA, 19 nt, artificial
  Oligomer
gaauaagaagauggaggaa

SEQ ID NO: 22107 - RNA, 19 nt, artificial
  Oligomer
cacgacuuugggaugaaga

SEQ ID NO: 22108 - RNA, 19 nt, artificial
  Oligomer
ucaagagcgaugccuauua

SEQ ID NO: 22109 - RNA, 19 nt, artificial
  Oligomer
caauuucucauacuuagaa

SEQ ID NO: 22110 - RNA, 19 nt, artificial
  Oligomer
cggagucuucggauaagcu

SEQ ID NO: 22111 - RNA, 19 nt, artificial
  Oligomer
caaggaggaagguaucaac

SEQ ID NO: 22112 - RNA, 19 nt, artificial
  Oligomer
cugacauuaaggugguuga

SEQ ID NO: 22113 - RNA, 19 nt, artificial
  Oligomer
aggaguuguucuuagcgca

SEQ ID NO: 22114 - RNA, 19 nt, artificial
  Oligomer
aacuaugagaagcucaaaa

SEQ ID NO: 22115 - RNA, 19 nt, artificial
  Oligomer
uccucugcuucagcagaua

SEQ ID NO: 22116 - RNA, 19 nt, artificial
  Oligomer
caucaaggacgagcuaaag

SEQ ID NO: 22117 - RNA, 19 nt, artificial
  Oligomer
aggaaggaacgcuaacaau

SEQ ID NO: 22118 - RNA, 19 nt, artificial
  Oligomer
gagaaguugcccuuggaaa

SEQ ID NO: 22119 - RNA, 19 nt, artificial
  Oligomer
cugcugaaacugaaauuca

SEQ ID NO: 22120 - RNA, 19 nt, artificial
  Oligomer
aguuguucuuagcgcacau

SEQ ID NO: 22121 - RNA, 19 nt, artificial
  Oligomer
ggcagugaagaagcugaca

SEQ ID NO: 22122 - RNA, 19 nt, artificial
  Oligomer
ggaagcugagcaaaaggca

SEQ ID NO: 22123 - RNA, 19 nt, artificial
  Oligomer
cggauaagcucuaucgagu

SEQ ID NO: 22124 - RNA, 19 nt, artificial
  Oligomer
ugcagucgcccauguuuga

SEQ ID NO: 22125 - RNA, 19 nt, artificial
  Oligomer
ucaacuaugagaagcucaa

SEQ ID NO: 22126 - RNA, 19 nt, artificial
  Oligomer
gaaggaacgcuaacaauuu

SEQ ID NO: 22127 - RNA, 19 nt, artificial
  Oligomer
gguggaaaugcuugacaac

SEQ ID NO: 22128 - RNA, 19 nt, artificial
  Oligomer
gcagcuguggauccugauu

SEQ ID NO: 22129 - RNA, 19 nt, artificial
  Oligomer
cauuagucuggauggugua

SEQ ID NO: 22130 - RNA, 19 nt, artificial
  Oligomer
agguggauggaguggauga

SEQ ID NO: 22131 - RNA, 19 nt, artificial
  Oligomer
auaguaauacucgauuaaa

SEQ ID NO: 22132 - RNA, 19 nt, artificial
  Oligomer
caccaaaaaggagguggaa

SEQ ID NO: 22133 - RNA, 19 nt, artificial
  Oligomer
aggaaaacagguauuggau

SEQ ID NO: 22134 - RNA, 19 nt, artificial
  Oligomer
aaauuaaaacucuaccaca

SEQ ID NO: 22135 - RNA, 19 nt, artificial
  Oligomer
cccuaaaggcucagaacga

SEQ ID NO: 22136 - RNA, 19 nt, artificial
  Oligomer
gugguaauugggagaggua

SEQ ID NO: 22137 - RNA, 19 nt, artificial
  Oligomer
agggcaagcacagugucaa

SEQ ID NO: 22138 - RNA, 19 nt, artificial
  Oligomer
guguuaaagguuuucucua

SEQ ID NO: 22139 - RNA, 19 nt, artificial
  Oligomer
gguaguaccuguacuaaac

SEQ ID NO: 22140 - RNA, 19 nt, artificial
  Oligomer
guggacaucguuaaaggaa

SEQ ID NO: 22141 - RNA, 19 nt, artificial
  Oligomer
gaaaagaugaauaagaaga

SEQ ID NO: 22142 - RNA, 19 nt, artificial
  Oligomer
cugaaauucaauuuuaaga

SEQ ID NO: 22143 - RNA, 19 nt, artificial
  Oligomer
auagacuaguccuauggaa

SEQ ID NO: 22144 - RNA, 19 nt, artificial
  Oligomer
gcucuugaaauauguagua

SEQ ID NO: 22145 - RNA, 19 nt, artificial
  Oligomer
acgacaaggaaaacaggua

SEQ ID NO: 22146 - RNA, 19 nt, artificial
  Oligomer
auaucagcaaguuacccaa

SEQ ID NO: 22147 - RNA, 19 nt, artificial
  Oligomer
ggaaggaacgcuaacaauu

SEQ ID NO: 22148 - RNA, 19 nt, artificial
  Oligomer
uaacgaguacauugucuau

SEQ ID NO: 22149 - RNA, 19 nt, artificial
  Oligomer
cccuuuaagcagcuucaua

SEQ ID NO: 22150 - RNA, 19 nt, artificial
  Oligomer
gcuuugucaagaacaggga

SEQ ID NO: 22151 - RNA, 19 nt, artificial
  Oligomer
ucuucaagagcgaugccua

SEQ ID NO: 22152 - RNA, 19 nt, artificial
  Oligomer
cgagaucaucaggaaguau

SEQ ID NO: 22153 - RNA, 19 nt, artificial
  Oligomer
ggauuuuacagaaacgugu

SEQ ID NO: 22154 - RNA, 19 nt, artificial
  Oligomer
cuaauuucauacuauuuag

SEQ ID NO: 22155 - RNA, 19 nt, artificial
  Oligomer
aguugcauuugaaauucuu

SEQ ID NO: 22156 - RNA, 19 nt, artificial
  Oligomer
acagugcgagucagcucaa

SEQ ID NO: 22157 - RNA, 19 nt, artificial
  Oligomer
cuccucugcuucagcagau

SEQ ID NO: 22158 - RNA, 19 nt, artificial
  Oligomer
ugaaauucuugacuuucuu

SEQ ID NO: 22159 - RNA, 19 nt, artificial
  Oligomer
ggaacaucaaggacgagcu

SEQ ID NO: 22160 - RNA, 19 nt, artificial
  Oligomer
gguggaaaagaugaauaag

SEQ ID NO: 22161 - RNA, 19 nt, artificial
  Oligomer
aaccggaaggaguggguaa

SEQ ID NO: 22162 - RNA, 19 nt, artificial
  Oligomer
cuuggaccgaguagcugau

SEQ ID NO: 22163 - RNA, 19 nt, artificial
  Oligomer
ggaagaccaaaggaaggaa

SEQ ID NO: 22164 - RNA, 19 nt, artificial
  Oligomer
gcugcuuugucaagaacag

SEQ ID NO: 22165 - RNA, 19 nt, artificial
  Oligomer
aggaauacugaacauggga

SEQ ID NO: 22166 - RNA, 19 nt, artificial
  Oligomer
ggcuggagagagauucugu

SEQ ID NO: 22167 - RNA, 19 nt, artificial
  Oligomer
gaauugguagcaaggcaga

SEQ ID NO: 22168 - RNA, 19 nt, artificial
  Oligomer
guagcaacaaacuggaaca

SEQ ID NO: 22169 - RNA, 19 nt, artificial
  Oligomer
caagcacagugucaaaggu

SEQ ID NO: 22170 - RNA, 19 nt, artificial
  Oligomer
ggauggaguggaugaagug

SEQ ID NO: 22171 - RNA, 19 nt, artificial
  Oligomer
gaaguauguuaagaacacu

SEQ ID NO: 22172 - RNA, 19 nt, artificial
  Oligomer
ccugaucuggaacaucaag

SEQ ID NO: 22173 - RNA, 19 nt, artificial
  Oligomer
guuaagaacacucaugcaa

SEQ ID NO: 22174 - RNA, 19 nt, artificial
  Oligomer
cccugugguaauugggaga

SEQ ID NO: 22175 - RNA, 19 nt, artificial
  Oligomer
uacccaagggcuaauagua

SEQ ID NO: 22176 - RNA, 19 nt, artificial
  Oligomer
gagcacuucaugaaauuau

SEQ ID NO: 22177 - RNA, 19 nt, artificial
  Oligomer
gaaaaagacaaggauagua

SEQ ID NO: 22178 - RNA, 19 nt, artificial
  Oligomer
gguagcaaggcagagaaga

SEQ ID NO: 22179 - RNA, 19 nt, artificial
  Oligomer
gaagauggaggaaguaaag

SEQ ID NO: 22180 - RNA, 19 nt, artificial
  Oligomer
aguccuauggaaaaaacca

SEQ ID NO: 22181 - RNA, 19 nt, artificial
  Oligomer
cguguuaaagguuuucucu

SEQ ID NO: 22182 - RNA, 19 nt, artificial
  Oligomer
ggauggaauugguagcaag

SEQ ID NO: 22183 - RNA, 19 nt, artificial
  Oligomer
uacuaaaccaccucagaaa

SEQ ID NO: 22184 - RNA, 19 nt, artificial
  Oligomer
augauauugcucagguaaa

SEQ ID NO: 22185 - RNA, 19 nt, artificial
  Oligomer
gacaccucucuacuauaua

SEQ ID NO: 22186 - RNA, 19 nt, artificial
  Oligomer
agaucaucaggaaguaugu

SEQ ID NO: 22187 - RNA, 19 nt, artificial
  Oligomer
ggucaaggaggaagguauc

SEQ ID NO: 22188 - RNA, 19 nt, artificial
  Oligomer
aggagucaagagugaagga

SEQ ID NO: 22189 - RNA, 19 nt, artificial
  Oligomer
uugcucagguaaaucugaa

SEQ ID NO: 22190 - RNA, 19 nt, artificial
  Oligomer
gaaauucuugacuuucuua

SEQ ID NO: 22191 - RNA, 19 nt, artificial
  Oligomer
agacaaggauaguaagcuu

SEQ ID NO: 22192 - RNA, 19 nt, artificial
  Oligomer
agcagaaagucaagaagac

SEQ ID NO: 22193 - RNA, 19 nt, artificial
  Oligomer
uuaaaaguugcauuugaaa

SEQ ID NO: 22194 - RNA, 19 nt, artificial
  Oligomer
acuucuccugcuucuggaa

SEQ ID NO: 22195 - RNA, 19 nt, artificial
  Oligomer
agcuugaaaaagcccuaaa

SEQ ID NO: 22196 - RNA, 19 nt, artificial
  Oligomer
acagaaacguguuaaaggu

SEQ ID NO: 22197 - RNA, 19 nt, artificial
  Oligomer
uagacuaguccuauggaaa

SEQ ID NO: 22198 - RNA, 19 nt, artificial
  Oligomer
agguaaaucugaaguaucu

SEQ ID NO: 22199 - RNA, 19 nt, artificial
  Oligomer
cccuuggaaacauguauga

SEQ ID NO: 22200 - RNA, 19 nt, artificial
  Oligomer
ggaguaugagaucgaccuu

SEQ ID NO: 22201 - RNA, 19 nt, artificial
  Oligomer
uggguaguaccuguacuaa

SEQ ID NO: 22202 - RNA, 19 nt, artificial
  Oligomer
uaagcagcuucauaaccga

SEQ ID NO: 22203 - RNA, 19 nt, artificial
  Oligomer
gguggaguaugagaucgac

SEQ ID NO: 22204 - RNA, 19 nt, artificial
  Oligomer
gccucuugcaagaaaugca

SEQ ID NO: 22205 - RNA, 19 nt, artificial
  Oligomer
aaaaggagguggaaaagau

SEQ ID NO: 22206 - RNA, 19 nt, artificial
  Oligomer
guaugagaucgaccuucag

SEQ ID NO: 22207 - RNA, 19 nt, artificial
  Oligomer
ugggcacuuuugucuucca

SEQ ID NO: 22208 - RNA, 19 nt, artificial
  Oligomer
cagggaaggaaaaauacac

SEQ ID NO: 22209 - RNA, 19 nt, artificial
  Oligomer
uugguagcaaggcagagaa

SEQ ID NO: 22210 - RNA, 19 nt, artificial
  Oligomer
aguaugagaucgaccuuca

SEQ ID NO: 22211 - RNA, 19 nt, artificial
  Oligomer
acuccaaaaauuucacgaa

SEQ ID NO: 22212 - RNA, 19 nt, artificial
  Oligomer
gccuguccaagaagauggu

SEQ ID NO: 22213 - RNA, 19 nt, artificial
  Oligomer
aggcaucagcaaucuauca

SEQ ID NO: 22214 - RNA, 19 nt, artificial
  Oligomer
gucccggaacaaggaugaa

SEQ ID NO: 22215 - RNA, 19 nt, artificial
  Oligomer
cuucaugaaauuauaugaa

SEQ ID NO: 22216 - RNA, 19 nt, artificial
  Oligomer
uuggaaagauguuaagcau

SEQ ID NO: 22217 - RNA, 19 nt, artificial
  Oligomer
agcucuaucgagucgagua

SEQ ID NO: 22218 - RNA, 19 nt, artificial
  Oligomer
accagcagaaagucaagaa

SEQ ID NO: 22219 - RNA, 19 nt, artificial
  Oligomer
ugaacaugggagcucuuga

SEQ ID NO: 22220 - RNA, 19 nt, artificial
  Oligomer
ggaaagauguuaagcauuu

SEQ ID NO: 22221 - RNA, 19 nt, artificial
  Oligomer
guuugauggaaaaguccca

SEQ ID NO: 22222 - RNA, 19 nt, artificial
  Oligomer
aagaaauugaagguuaaaa

SEQ ID NO: 22223 - RNA, 19 nt, artificial
  Oligomer
ccugugcaucagcaccaaa

SEQ ID NO: 22224 - RNA, 19 nt, artificial
  Oligomer
gauaaagaagcccugaaga

SEQ ID NO: 22225 - RNA, 19 nt, artificial
  Oligomer
agaaugaaauuaacucuua

SEQ ID NO: 22226 - RNA, 19 nt, artificial
  Oligomer
gcaugauugaccgcuggua

SEQ ID NO: 22227 - RNA, 19 nt, artificial
  Oligomer
ggauuucaucuggugugaa

SEQ ID NO: 22228 - RNA, 19 nt, artificial
  Oligomer
uggaauugguagcaaggca

SEQ ID NO: 22229 - RNA, 19 nt, artificial
  Oligomer
uaacaauuucucauacuua

SEQ ID NO: 22230 - RNA, 19 nt, artificial
  Oligomer
gcaccaaaaaggaggugga

SEQ ID NO: 22231 - RNA, 19 nt, artificial
  Oligomer
agauccuggaucucucaaa

SEQ ID NO: 22232 - RNA, 19 nt, artificial
  Oligomer
caaguguauggucaagaca

SEQ ID NO: 22233 - RNA, 19 nt, artificial
  Oligomer
auaaaacugacauagagaa

SEQ ID NO: 22234 - RNA, 19 nt, artificial
  Oligomer
ugcgccuguccaagaagau

SEQ ID NO: 22235 - RNA, 19 nt, artificial
  Oligomer
gggaugaccagcagaaagu

SEQ ID NO: 22236 - RNA, 19 nt, artificial
  Oligomer
aacagaugccguccaagga

SEQ ID NO: 22237 - RNA, 19 nt, artificial
  Oligomer
cuaugagaagcucaaaacu

SEQ ID NO: 22238 - RNA, 19 nt, artificial
  Oligomer
aaagaaaaagacaaggaua

SEQ ID NO: 22239 - RNA, 19 nt, artificial
  Oligomer
agcuuuccuucuccaggaa

SEQ ID NO: 22240 - RNA, 19 nt, artificial
  Oligomer
ugguguagacguuccucuu

SEQ ID NO: 22241 - RNA, 19 nt, artificial
  Oligomer
aagcacgcuucacauauca

SEQ ID NO: 22242 - RNA, 19 nt, artificial
  Oligomer
aauuucucauacuuagaaa

SEQ ID NO: 22243 - RNA, 19 nt, artificial
  Oligomer
ugggugacuuugcagcaga

SEQ ID NO: 22244 - RNA, 19 nt, artificial
  Oligomer
agucaagagugaaggaaag

SEQ ID NO: 22245 - RNA, 19 nt, artificial
  Oligomer
ugacuuugcagcagaguau

SEQ ID NO: 22246 - RNA, 19 nt, artificial
  Oligomer
uaaaaaacaggaccguaua

SEQ ID NO: 22247 - RNA, 19 nt, artificial
  Oligomer
augaccagcagaaagucaa

SEQ ID NO: 22248 - RNA, 19 nt, artificial
  Oligomer
acgcuucacauaucagcaa

SEQ ID NO: 22249 - RNA, 19 nt, artificial
  Oligomer
ugguggaguaugagaucga

SEQ ID NO: 22250 - RNA, 19 nt, artificial
  Oligomer
uguccaagaagauggugga

SEQ ID NO: 22251 - RNA, 19 nt, artificial
  Oligomer
cuugggaccgggauuucau

SEQ ID NO: 22252 - RNA, 19 nt, artificial
  Oligomer
ugugaaugacaccucucua

SEQ ID NO: 22253 - RNA, 19 nt, artificial
  Oligomer
acaugaagauccugacucu

SEQ ID NO: 22254 - RNA, 19 nt, artificial
  Oligomer
cuuuaagauagagcgugaa

SEQ ID NO: 22255 - RNA, 19 nt, artificial
  Oligomer
auacuuagaaacaaaaaga

SEQ ID NO: 22256 - RNA, 19 nt, artificial
  Oligomer
uguauggagaagauagaaa

SEQ ID NO: 22257 - RNA, 19 nt, artificial
  Oligomer
caucgaugucaacuaugag

SEQ ID NO: 22258 - RNA, 19 nt, artificial
  Oligomer
cgauaucuuuaagauagag

SEQ ID NO: 22259 - RNA, 19 nt, artificial
  Oligomer
agguggauggguucucuga

SEQ ID NO: 22260 - RNA, 19 nt, artificial
  Oligomer
auaaagaagcccugaagaa

SEQ ID NO: 22261 - RNA, 19 nt, artificial
  Oligomer
ccagcagaaagucaagaag

SEQ ID NO: 22262 - RNA, 19 nt, artificial
  Oligomer
caucaagaugaucuuugau

SEQ ID NO: 22263 - RNA, 19 nt, artificial
  Oligomer
aaaucucuuaccucaagaa

SEQ ID NO: 22264 - RNA, 19 nt, artificial
  Oligomer
acugaagcacgcuucacau

SEQ ID NO: 22265 - RNA, 19 nt, artificial
  Oligomer
gaggacgacaaggaaaaca

SEQ ID NO: 22266 - RNA, 19 nt, artificial
  Oligomer
ucaugaaauuauaugaaga

SEQ ID NO: 22267 - RNA, 19 nt, artificial
  Oligomer
uuuguugauaccuuccucc

SEQ ID NO: 22268 - RNA, 19 nt, artificial
  Oligomer
uuuagauuucuucuucgcc

SEQ ID NO: 22269 - RNA, 19 nt, artificial
  Oligomer
uugaauuucaguuucagca

SEQ ID NO: 22270 - RNA, 19 nt, artificial
  Oligomer
uuuacugucagcuucuuca

SEQ ID NO: 22271 - RNA, 19 nt, artificial
  Oligomer
uuuguugcuaccgaucacc

SEQ ID NO: 22272 - RNA, 19 nt, artificial
  Oligomer
uucuuauucaucuuuucca

SEQ ID NO: 22273 - RNA, 19 nt, artificial
  Oligomer
uuaagaguuaauuucauuc

SEQ ID NO: 22274 - RNA, 19 nt, artificial
  Oligomer
uuuuucaagcuuacuaucc

SEQ ID NO: 22275 - RNA, 19 nt, artificial
  Oligomer
uugauguuccagaucaggu

SEQ ID NO: 22276 - RNA, 19 nt, artificial
  Oligomer
uuguugcuaccgaucaccg

SEQ ID NO: 22277 - RNA, 19 nt, artificial
  Oligomer
uuuccaucaaacaugggcg

SEQ ID NO: 22278 - RNA, 19 nt, artificial
  Oligomer
uucaagcuuacuauccuug

SEQ ID NO: 22279 - RNA, 19 nt, artificial
  Oligomer
ucucuuuucagauuuguug

SEQ ID NO: 22280 - RNA, 19 nt, artificial
  Oligomer
uuuaguacagguacuaccc

SEQ ID NO: 22281 - RNA, 19 nt, artificial
  Oligomer
uuugacacugugcuugccc

SEQ ID NO: 22282 - RNA, 19 nt, artificial
  Oligomer
uuuuccaucaaacaugggc

SEQ ID NO: 22283 - RNA, 19 nt, artificial
  Oligomer
uuucuuuagcucguccuug

SEQ ID NO: 22284 - RNA, 19 nt, artificial
  Oligomer
uucuuuuuuagauuucuuc

SEQ ID NO: 22285 - RNA, 19 nt, artificial
  Oligomer
uuuuaaucgaguauuacua

SEQ ID NO: 22286 - RNA, 19 nt, artificial
  Oligomer
uucuguaaaauccuuucug

SEQ ID NO: 22287 - RNA, 19 nt, artificial
  Oligomer
uuuuuagauuucuucuucg

SEQ ID NO: 22288 - RNA, 19 nt, artificial
  Oligomer
ucuaucuucuccauacacc

SEQ ID NO: 22289 - RNA, 19 nt, artificial
  Oligomer
uucagaaucucugucaacc

SEQ ID NO: 22290 - RNA, 19 nt, artificial
  Oligomer
uuguaguaggaguugguuc

SEQ ID NO: 22291 - RNA, 19 nt, artificial
  Oligomer
uuuaacgauguccaccagg

SEQ ID NO: 22292 - RNA, 19 nt, artificial
  Oligomer
uucgccuucacgcucuauc

SEQ ID NO: 22293 - RNA, 19 nt, artificial
  Oligomer
uucacuucauccuuguucc

SEQ ID NO: 22294 - RNA, 19 nt, artificial
  Oligomer
uccagaaucaggauccaca

SEQ ID NO: 22295 - RNA, 19 nt, artificial
  Oligomer
uucuugacaaagcagccug

SEQ ID NO: 22296 - RNA, 19 nt, artificial
  Oligomer
uuaccaaacauguagccug

SEQ ID NO: 22297 - RNA, 19 nt, artificial
  Oligomer
uauaauuucaugaagugcu

SEQ ID NO: 22298 - RNA, 19 nt, artificial
  Oligomer
uucauccacuccauccacc

SEQ ID NO: 22299 - RNA, 19 nt, artificial
  Oligomer
uaugucaguuuuaucuacc

SEQ ID NO: 22300 - RNA, 19 nt, artificial
  Oligomer
uuuuuuaaccuucaauuuc

SEQ ID NO: 22301 - RNA, 19 nt, artificial
  Oligomer
aucgaugggauccuugcug

SEQ ID NO: 22302 - RNA, 19 nt, artificial
  Oligomer
uuuuuaaucgaguauuacu

SEQ ID NO: 22303 - RNA, 19 nt, artificial
  Oligomer
uugucaagcauuuccaccu

SEQ ID NO: 22304 - RNA, 19 nt, artificial
  Oligomer
uuucugcuggucaucccac

SEQ ID NO: 22305 - RNA, 19 nt, artificial
  Oligomer
uuuuuuuggagagcgcagc

SEQ ID NO: 22306 - RNA, 19 nt, artificial
  Oligomer
uuauucaucuuuuccaccu

SEQ ID NO: 22307 - RNA, 19 nt, artificial
  Oligomer
uuuagcucguccuugaugu

SEQ ID NO: 22308 - RNA, 19 nt, artificial
  Oligomer
uugaccauacacuuggucc

SEQ ID NO: 22309 - RNA, 19 nt, artificial
  Oligomer
uuccaguuuguugcuaccg

SEQ ID NO: 22310 - RNA, 19 nt, artificial
  Oligomer
uuguugauaccuuccuccu

SEQ ID NO: 22311 - RNA, 19 nt, artificial
  Oligomer
uuuucuaucuucuccauac

SEQ ID NO: 22312 - RNA, 19 nt, artificial
  Oligomer
aucauagacaauguacucg

SEQ ID NO: 22313 - RNA, 19 nt, artificial
  Oligomer
uuuccuucacucuugacuc

SEQ ID NO: 22314 - RNA, 19 nt, artificial
  Oligomer
uuuuuuagauuucuucuuc

SEQ ID NO: 22315 - RNA, 19 nt, artificial
  Oligomer
uugcuuuuuuuggagagcg

SEQ ID NO: 22316 - RNA, 19 nt, artificial
  Oligomer
uucagauuuguugauaccu

SEQ ID NO: 22317 - RNA, 19 nt, artificial
  Oligomer
uuucucggaauuccuuugg

SEQ ID NO: 22318 - RNA, 19 nt, artificial
  Oligomer
ucgaguauuacuauuagcc

SEQ ID NO: 22319 - RNA, 19 nt, artificial
  Oligomer
uucaagagcucccauguuc

SEQ ID NO: 22320 - RNA, 19 nt, artificial
  Oligomer
uuaaccuucaauuucuuga

SEQ ID NO: 22321 - RNA, 19 nt, artificial
  Oligomer
uuccuugucguccuccaga

SEQ ID NO: 22322 - RNA, 19 nt, artificial
  Oligomer
uccuuuaacgauguccacc

SEQ ID NO: 22323 - RNA, 19 nt, artificial
  Oligomer
uguauuuuuccuucccugg

SEQ ID NO: 22324 - RNA, 19 nt, artificial
  Oligomer
uuuuuaaccuucaauuucu

SEQ ID NO: 22325 - RNA, 19 nt, artificial
  Oligomer
ugcaacagaaucucucucc

SEQ ID NO: 22326 - RNA, 19 nt, artificial
  Oligomer
uuccaagucauacgcauug

SEQ ID NO: 22327 - RNA, 19 nt, artificial
  Oligomer
uuuacuuccuccaucuucu

SEQ ID NO: 22328 - RNA, 19 nt, artificial
  Oligomer
uucaguucauacauguuuc

SEQ ID NO: 22329 - RNA, 19 nt, artificial
  Oligomer
auuuacugucagcuucuuc

SEQ ID NO: 22330 - RNA, 19 nt, artificial
  Oligomer
uuccacaucaaagaucauc

SEQ ID NO: 22331 - RNA, 19 nt, artificial
  Oligomer
uaccugagcaauaucauag

SEQ ID NO: 22332 - RNA, 19 nt, artificial
  Oligomer
uuaauuuggaagacaaaag

SEQ ID NO: 22333 - RNA, 19 nt, artificial
  Oligomer
aucuguuccaguuuguugc

SEQ ID NO: 22334 - RNA, 19 nt, artificial
  Oligomer
uucaacaggcucugccuuc

SEQ ID NO: 22335 - RNA, 19 nt, artificial
  Oligomer
uuaauuucauucucuuuuc

SEQ ID NO: 22336 - RNA, 19 nt, artificial
  Oligomer
uuuaaccuucaauuucuug

SEQ ID NO: 22337 - RNA, 19 nt, artificial
  Oligomer
uuucaugaagugcucaaug

SEQ ID NO: 22338 - RNA, 19 nt, artificial
  Oligomer
uacuucgugaaauuuuugg

SEQ ID NO: 22339 - RNA, 19 nt, artificial
  Oligomer
uuuuagauuucuucuucgc

SEQ ID NO: 22340 - RNA, 19 nt, artificial
  Oligomer
uuuuccuugucguccucca

SEQ ID NO: 22341 - RNA, 19 nt, artificial
  Oligomer
uuuuuuggagagcgcagcc

SEQ ID NO: 22342 - RNA, 19 nt, artificial
  Oligomer
auuucuugcaagaggcgcg

SEQ ID NO: 22343 - RNA, 19 nt, artificial
  Oligomer
uuuccuugucguccuccag

SEQ ID NO: 22344 - RNA, 19 nt, artificial
  Oligomer
uuaaugucaguuuugagcu

SEQ ID NO: 22345 - RNA, 19 nt, artificial
  Oligomer
auaccuguuuuccuugucg

SEQ ID NO: 22346 - RNA, 19 nt, artificial
  Oligomer
uucuucaucccaaagucgu

SEQ ID NO: 22347 - RNA, 19 nt, artificial
  Oligomer
uuaucugcugaagcagagg

SEQ ID NO: 22348 - RNA, 19 nt, artificial
  Oligomer
gucaguuuuaucuaccugg

SEQ ID NO: 22349 - RNA, 19 nt, artificial
  Oligomer
uucuucagaaucucuguca

SEQ ID NO: 22350 - RNA, 19 nt, artificial
  Oligomer
uuggaagacaaaagugccc

SEQ ID NO: 22351 - RNA, 19 nt, artificial
  Oligomer
uugugguagaguuuuaauu

SEQ ID NO: 22352 - RNA, 19 nt, artificial
  Oligomer
uuuucucuuuccuucacuc

SEQ ID NO: 22353 - RNA, 19 nt, artificial
  Oligomer
uucucuuuccuucacucuu

SEQ ID NO: 22354 - RNA, 19 nt, artificial
  Oligomer
auuuguugauaccuuccuc

SEQ ID NO: 22355 - RNA, 19 nt, artificial
  Oligomer
uuuuuggugcugaugcaca

SEQ ID NO: 22356 - RNA, 19 nt, artificial
  Oligomer
uggguaaguauauuugugg

SEQ ID NO: 22357 - RNA, 19 nt, artificial
  Oligomer
ugauguuccagaucagguc

SEQ ID NO: 22358 - RNA, 19 nt, artificial
  Oligomer
uucugaggugguuuaguac

SEQ ID NO: 22359 - RNA, 19 nt, artificial
  Oligomer
uuuucaagcuuacuauccu

SEQ ID NO: 22360 - RNA, 19 nt, artificial
  Oligomer
uuugagcuucucauaguug

SEQ ID NO: 22361 - RNA, 19 nt, artificial
  Oligomer
uuccugaugaucucggcuu

SEQ ID NO: 22362 - RNA, 19 nt, artificial
  Oligomer
augaguguucuuaacauac

SEQ ID NO: 22363 - RNA, 19 nt, artificial
  Oligomer
uuccaguccagaaucagga

SEQ ID NO: 22364 - RNA, 19 nt, artificial
  Oligomer
uacuuccugaugaucucgg

SEQ ID NO: 22365 - RNA, 19 nt, artificial
  Oligomer
uagcucguccuugauguuc

SEQ ID NO: 22366 - RNA, 19 nt, artificial
  Oligomer
uuucaguuucagcagauac

SEQ ID NO: 22367 - RNA, 19 nt, artificial
  Oligomer
augucagcgaaauagaucc

SEQ ID NO: 22368 - RNA, 19 nt, artificial
  Oligomer
uuaacgauguccaccaggc

SEQ ID NO: 22369 - RNA, 19 nt, artificial
  Oligomer
auugaauuucaguuucagc

SEQ ID NO: 22370 - RNA, 19 nt, artificial
  Oligomer
uuucuucauacuuuccaca

SEQ ID NO: 22371 - RNA, 19 nt, artificial
  Oligomer
uugcuaccgaucaccguac

SEQ ID NO: 22372 - RNA, 19 nt, artificial
  Oligomer
ugcaaagucacccagaguc

SEQ ID NO: 22373 - RNA, 19 nt, artificial
  Oligomer
uucaguuucagcagauacu

SEQ ID NO: 22374 - RNA, 19 nt, artificial
  Oligomer
ugucaguuuuaucuaccug

SEQ ID NO: 22375 - RNA, 19 nt, artificial
  Oligomer
uucuaucuucuccauacac

SEQ ID NO: 22376 - RNA, 19 nt, artificial
  Oligomer
uccuuuuuggugcugaugc

SEQ ID NO: 22377 - RNA, 19 nt, artificial
  Oligomer
aacuuuuugggauacuucg

SEQ ID NO: 22378 - RNA, 19 nt, artificial
  Oligomer
ucuucgguuaugaagcugc

SEQ ID NO: 22379 - RNA, 19 nt, artificial
  Oligomer
uaauguuagcugaaggauc

SEQ ID NO: 22380 - RNA, 19 nt, artificial
  Oligomer
uuccuuuacuuccuccauc

SEQ ID NO: 22381 - RNA, 19 nt, artificial
  Oligomer
uguaguaggaguugguucc

SEQ ID NO: 22382 - RNA, 19 nt, artificial
  Oligomer
ucuucuugacuuucugcug

SEQ ID NO: 22383 - RNA, 19 nt, artificial
  Oligomer
uguaaaauccuuucugagg

SEQ ID NO: 22384 - RNA, 19 nt, artificial
  Oligomer
uucuuuauccucuguagca

SEQ ID NO: 22385 - RNA, 19 nt, artificial
  Oligomer
uuuuccauaggacuagucu

SEQ ID NO: 22386 - RNA, 19 nt, artificial
  Oligomer
uugcacguacuucuguugg

SEQ ID NO: 22387 - RNA, 19 nt, artificial
  Oligomer
uuuucagauuuguugauac

SEQ ID NO: 22388 - RNA, 19 nt, artificial
  Oligomer
ucaguauuccuggagaagg

SEQ ID NO: 22389 - RNA, 19 nt, artificial
  Oligomer
ucuuauucaucuuuuccac

SEQ ID NO: 22390 - RNA, 19 nt, artificial
  Oligomer
uaucuuaaagauaucgaug

SEQ ID NO: 22391 - RNA, 19 nt, artificial
  Oligomer
ugagguaagagauuucucg

SEQ ID NO: 22392 - RNA, 19 nt, artificial
  Oligomer
auaggcaucgcucuugaag

SEQ ID NO: 22393 - RNA, 19 nt, artificial
  Oligomer
uucaucuuuuccaccuccu

SEQ ID NO: 22394 - RNA, 19 nt, artificial
  Oligomer
cuucacugccucuucaucc

SEQ ID NO: 22395 - RNA, 19 nt, artificial
  Oligomer
uaguuuugcccaaaccuuu

SEQ ID NO: 22396 - RNA, 19 nt, artificial
  Oligomer
uuaaagauaucgaugacuu

SEQ ID NO: 22397 - RNA, 19 nt, artificial
  Oligomer
uaaaugcuuaacaucuuuc

SEQ ID NO: 22398 - RNA, 19 nt, artificial
  Oligomer
uacauauuucaagagcucc

SEQ ID NO: 22399 - RNA, 19 nt, artificial
  Oligomer
auccacuccauccaccuca

SEQ ID NO: 22400 - RNA, 19 nt, artificial
  Oligomer
uucgggugaauucauacca

SEQ ID NO: 22401 - RNA, 19 nt, artificial
  Oligomer
uugcccuuggguaacuugc

SEQ ID NO: 22402 - RNA, 19 nt, artificial
  Oligomer
uuuuccaccuccuuuuugg

SEQ ID NO: 22403 - RNA, 19 nt, artificial
  Oligomer
uuuggaagacaaaagugcc

SEQ ID NO: 22404 - RNA, 19 nt, artificial
  Oligomer
uuccaagggcaacuucucc

SEQ ID NO: 22405 - RNA, 19 nt, artificial
  Oligomer
uagaguuuuaauuuggaag

SEQ ID NO: 22406 - RNA, 19 nt, artificial
  Oligomer
ugugguugcaugaguguuc

SEQ ID NO: 22407 - RNA, 19 nt, artificial
  Oligomer
uuuguuucuaaguaugaga

SEQ ID NO: 22408 - RNA, 19 nt, artificial
  Oligomer
uccaucuucuuauucaucu

SEQ ID NO: 22409 - RNA, 19 nt, artificial
  Oligomer
uuccagaucaggucguucu

SEQ ID NO: 22410 - RNA, 19 nt, artificial
  Oligomer
ucucucuccagccuuuucu

SEQ ID NO: 22411 - RNA, 19 nt, artificial
  Oligomer
cuucacuucauccuuguuc

SEQ ID NO: 22412 - RNA, 19 nt, artificial
  Oligomer
uuaugaagcugcuuaaagg

SEQ ID NO: 22413 - RNA, 19 nt, artificial
  Oligomer
uucuuaacauacuuccuga

SEQ ID NO: 22414 - RNA, 19 nt, artificial
  Oligomer
uuauauaguagagaggugu

SEQ ID NO: 22415 - RNA, 19 nt, artificial
  Oligomer
uccuugauguuccagauca

SEQ ID NO: 22416 - RNA, 19 nt, artificial
  Oligomer
uguuuuuuaaccuucaauu

SEQ ID NO: 22417 - RNA, 19 nt, artificial
  Oligomer
uucucuuuucagauuuguu

SEQ ID NO: 22418 - RNA, 19 nt, artificial
  Oligomer
uuaacaucuuuccaaaauc

SEQ ID NO: 22419 - RNA, 19 nt, artificial
  Oligomer
uuagcguuccuuccuuugg

SEQ ID NO: 22420 - RNA, 19 nt, artificial
  Oligomer
uuucauucucuuuucagau

SEQ ID NO: 22421 - RNA, 19 nt, artificial
  Oligomer
uguaaaagcgauuugagag

SEQ ID NO: 22422 - RNA, 19 nt, artificial
  Oligomer
uuucucuuuccuucacucu

SEQ ID NO: 22423 - RNA, 19 nt, artificial
  Oligomer
ugaugaucucggcuucuuc

SEQ ID NO: 22424 - RNA, 19 nt, artificial
  Oligomer
uucuucauauaauuucaug

SEQ ID NO: 22425 - RNA, 19 nt, artificial
  Oligomer
cuuaaugucaguuuugagc

SEQ ID NO: 22426 - RNA, 19 nt, artificial
  Oligomer
ucucuuuccuucacucuug

SEQ ID NO: 22427 - RNA, 19 nt, artificial
  Oligomer
ucauagacaauguacucgu

SEQ ID NO: 22428 - RNA, 19 nt, artificial
  Oligomer
uauuucaagagcucccaug

SEQ ID NO: 22429 - RNA, 19 nt, artificial
  Oligomer
ucaagcauuuccaccuugg

SEQ ID NO: 22430 - RNA, 19 nt, artificial
  Oligomer
ucguccuugauguuccaga

SEQ ID NO: 22431 - RNA, 19 nt, artificial
  Oligomer
uuagagaaaaccuuuaaca

SEQ ID NO: 22432 - RNA, 19 nt, artificial
  Oligomer
uuucagauuuguugauacc

SEQ ID NO: 22433 - RNA, 19 nt, artificial
  Oligomer
uuucuguaaaauccuuucu

SEQ ID NO: 22434 - RNA, 19 nt, artificial
  Oligomer
auuugagagauccaggauc

SEQ ID NO: 22435 - RNA, 19 nt, artificial
  Oligomer
uuuuuccauaggacuaguc

SEQ ID NO: 22436 - RNA, 19 nt, artificial
  Oligomer
uggaaguguauuuuuccuu

SEQ ID NO: 22437 - RNA, 19 nt, artificial
  Oligomer
agaaucucugucaaccacc

SEQ ID NO: 22438 - RNA, 19 nt, artificial
  Oligomer
ugcugcuaucaucagaccc

SEQ ID NO: 22439 - RNA, 19 nt, artificial
  Oligomer
auacacuugguccaggcag

SEQ ID NO: 22440 - RNA, 19 nt, artificial
  Oligomer
ugcaguaauaggcaucgcu

SEQ ID NO: 22441 - RNA, 19 nt, artificial
  Oligomer
ucauaguugacaucgaugg

SEQ ID NO: 22442 - RNA, 19 nt, artificial
  Oligomer
agaaucaggauccacagcu

SEQ ID NO: 22443 - RNA, 19 nt, artificial
  Oligomer
uugaagaugaguagcuccu

SEQ ID NO: 22444 - RNA, 19 nt, artificial
  Oligomer
auuacuauuagcccuuggg

SEQ ID NO: 22445 - RNA, 19 nt, artificial
  Oligomer
uugagguaagagauuucuc

SEQ ID NO: 22446 - RNA, 19 nt, artificial
  Oligomer
ucuucauguuggauaaugg

SEQ ID NO: 22447 - RNA, 19 nt, artificial
  Oligomer
uuacuauuagcccuugggu

SEQ ID NO: 22448 - RNA, 19 nt, artificial
  Oligomer
ucuuuuuuagauuucuucu

SEQ ID NO: 22449 - RNA, 19 nt, artificial
  Oligomer
uuaacauacuuccugauga

SEQ ID NO: 22450 - RNA, 19 nt, artificial
  Oligomer
ugucuucuugacuuucugc

SEQ ID NO: 22451 - RNA, 19 nt, artificial
  Oligomer
uuuauccucuguagcaagg

SEQ ID NO: 22452 - RNA, 19 nt, artificial
  Oligomer
uagucuaugcaacagaauc

SEQ ID NO: 22453 - RNA, 19 nt, artificial
  Oligomer
uuggagaccaugucagcga

SEQ ID NO: 22454 - RNA, 19 nt, artificial
  Oligomer
uuuuguuucuaaguaugag

SEQ ID NO: 22455 - RNA, 19 nt, artificial
  Oligomer
uucaugaagugcucaaugg

SEQ ID NO: 22456 - RNA, 19 nt, artificial
  Oligomer
uugguuuuuuccauaggac

SEQ ID NO: 22457 - RNA, 19 nt, artificial
  Oligomer
uuucaagcuuacuauccuu

SEQ ID NO: 22458 - RNA, 19 nt, artificial
  Oligomer
uuuaccaaacauguagccu

SEQ ID NO: 22459 - RNA, 19 nt, artificial
  Oligomer
uaauacuacauauuucaag

SEQ ID NO: 22460 - RNA, 19 nt, artificial
  Oligomer
uccacaucaaagaucaucu

SEQ ID NO: 22461 - RNA, 19 nt, artificial
  Oligomer
ucaaagaucaucuugauga

SEQ ID NO: 22462 - RNA, 19 nt, artificial
  Oligomer
uuaaagggcuuguaacgcu

SEQ ID NO: 22463 - RNA, 19 nt, artificial
  Oligomer
uauccaauaccuguuuucc

SEQ ID NO: 22464 - RNA, 19 nt, artificial
  Oligomer
ucucuaugucaguuuuauc

SEQ ID NO: 22465 - RNA, 19 nt, artificial
  Oligomer
aauaucauagacaauguac

SEQ ID NO: 22466 - RNA, 19 nt, artificial
  Oligomer
uuccgcugucuucuugacu

SEQ ID NO: 22467 - RNA, 19 nt, artificial
  Oligomer
uccaauaccuguuuuccuu

SEQ ID NO: 22468 - RNA, 19 nt, artificial
  Oligomer
uuguuagcguuccuuccuu

SEQ ID NO: 22469 - RNA, 19 nt, artificial
  Oligomer
uggaucugccuuuugcuca

SEQ ID NO: 22470 - RNA, 19 nt, artificial
  Oligomer
uucaaaugcaacuuuuaau

SEQ ID NO: 22471 - RNA, 19 nt, artificial
  Oligomer
uaaagggcuuguaacgcug

SEQ ID NO: 22472 - RNA, 19 nt, artificial
  Oligomer
uccuucaggucauuaguug

SEQ ID NO: 22473 - RNA, 19 nt, artificial
  Oligomer
ucuaucuuaaagauaucga

SEQ ID NO: 22474 - RNA, 19 nt, artificial
  Oligomer
aaagauaucgaugacuucc

SEQ ID NO: 22475 - RNA, 19 nt, artificial
  Oligomer
uucuucauacuuuccacau

SEQ ID NO: 22476 - RNA, 19 nt, artificial
  Oligomer
cucuaugucaguuuuaucu

SEQ ID NO: 22477 - RNA, 19 nt, artificial
  Oligomer
uucuuuagcucguccuuga

SEQ ID NO: 22478 - RNA, 19 nt, artificial
  Oligomer
uucauacauguuuccaagg

SEQ ID NO: 22479 - RNA, 19 nt, artificial
  Oligomer
cuucuuauucaucuuuucc

SEQ ID NO: 22480 - RNA, 19 nt, artificial
  Oligomer
uauauuugugguagaguuu

SEQ ID NO: 22481 - RNA, 19 nt, artificial
  Oligomer
aacauguagccugucacgg

SEQ ID NO: 22482 - RNA, 19 nt, artificial
  Oligomer
aucaggauccacagcugcu

SEQ ID NO: 22483 - RNA, 19 nt, artificial
  Oligomer
uuacugucagcuucuucac

SEQ ID NO: 22484 - RNA, 19 nt, artificial
  Oligomer
cuaucuucuccauacaccc

SEQ ID NO: 22485 - RNA, 19 nt, artificial
  Oligomer
ucuugaagaccagcugacc

SEQ ID NO: 22486 - RNA, 19 nt, artificial
  Oligomer
ucugucaaccaccuuaaug

SEQ ID NO: 22487 - RNA, 19 nt, artificial
  Oligomer
uugaugagguccugaacug

SEQ ID NO: 22488 - RNA, 19 nt, artificial
  Oligomer
ucgcucuugaagaccagcu

SEQ ID NO: 22489 - RNA, 19 nt, artificial
  Oligomer
uguugauaccuuccuccuu

SEQ ID NO: 22490 - RNA, 19 nt, artificial
  Oligomer
uaguagagaggugucauuc

SEQ ID NO: 22491 - RNA, 19 nt, artificial
  Oligomer
aacagaaucucucuccagc

SEQ ID NO: 22492 - RNA, 19 nt, artificial
  Oligomer
ucacugaggauggaguaug

SEQ ID NO: 22493 - RNA, 19 nt, artificial
  Oligomer
uuuuugggauacuucguga

SEQ ID NO: 22494 - RNA, 19 nt, artificial
  Oligomer
ucaaucaugccuagcugug

SEQ ID NO: 22495 - RNA, 19 nt, artificial
  Oligomer
aacuucaacaggcucugcc

SEQ ID NO: 22496 - RNA, 19 nt, artificial
  Oligomer
uucuaacgaagcuugguuu

SEQ ID NO: 22497 - RNA, 19 nt, artificial
  Oligomer
ucucccaacaggauuaagc

SEQ ID NO: 22498 - RNA, 19 nt, artificial
  Oligomer
uuagaaaaaaggguggaag

SEQ ID NO: 22499 - RNA, 19 nt, artificial
  Oligomer
agaaaaaacaaaaacaacc

SEQ ID NO: 22500 - RNA, 19 nt, artificial
  Oligomer
uucaauuucuugagguaag

SEQ ID NO: 22501 - RNA, 19 nt, artificial
  Oligomer
auccuugcugcuaucauca

SEQ ID NO: 22502 - RNA, 19 nt, artificial
  Oligomer
ugcaugaguguucuuaaca

SEQ ID NO: 22503 - RNA, 19 nt, artificial
  Oligomer
uccaaaaucaaaacuaaag

SEQ ID NO: 22504 - RNA, 19 nt, artificial
  Oligomer
auguucaguauuccuggag

SEQ ID NO: 22505 - RNA, 19 nt, artificial
  Oligomer
uugcccaaaccuuugacac

SEQ ID NO: 22506 - RNA, 19 nt, artificial
  Oligomer
uugucuuuuucuuuuuuag

SEQ ID NO: 22507 - RNA, 19 nt, artificial
  Oligomer
uccuuuaagaguuaauuuc

SEQ ID NO: 22508 - RNA, 19 nt, artificial
  Oligomer
uucucggaauuccuuuggg

SEQ ID NO: 22509 - RNA, 19 nt, artificial
  Oligomer
uuggguaaguauauuugug

SEQ ID NO: 22510 - RNA, 19 nt, artificial
  Oligomer
auuuggaagacaaaagugc

SEQ ID NO: 22511 - RNA, 19 nt, artificial
  Oligomer
ugaauauccaauaccuguu

SEQ ID NO: 22512 - RNA, 19 nt, artificial
  Oligomer
uuuaauuuggaagacaaaa

SEQ ID NO: 22513 - RNA, 19 nt, artificial
  Oligomer
agcaauaucauagacaaug

SEQ ID NO: 22514 - RNA, 19 nt, artificial
  Oligomer
aucuucuuauucaucuuuu

SEQ ID NO: 22515 - RNA, 19 nt, artificial
  Oligomer
uccuggagaaggaaagcuc

SEQ ID NO: 22516 - RNA, 19 nt, artificial
  Oligomer
aacuccugaaggcucuugg

SEQ ID NO: 22517 - RNA, 19 nt, artificial
  Oligomer
guguucuuaacauacuucc

SEQ ID NO: 22518 - RNA, 19 nt, artificial
  Oligomer
ucagauuuguugauaccuu

SEQ ID NO: 22519 - RNA, 19 nt, artificial
  Oligomer
augaucucggcuucuucag

SEQ ID NO: 22520 - RNA, 19 nt, artificial
  Oligomer
auuucucggaauuccuuug

SEQ ID NO: 22521 - RNA, 19 nt, artificial
  Oligomer
auccucuguagcaaggagg

SEQ ID NO: 22522 - RNA, 19 nt, artificial
  Oligomer
uuuuuguuucuaaguauga

SEQ ID NO: 22523 - RNA, 19 nt, artificial
  Oligomer
acauauuucaagagcuccc

SEQ ID NO: 22524 - RNA, 19 nt, artificial
  Oligomer
acugucagcuucuucacug

SEQ ID NO: 22525 - RNA, 19 nt, artificial
  Oligomer
aucucauacuccaccaugg

SEQ ID NO: 22526 - RNA, 19 nt, artificial
  Oligomer
uccagaagcaggagaagug

SEQ ID NO: 22527 - RNA, 19 nt, artificial
  Oligomer
aucaucuugaugagguccu

SEQ ID NO: 22528 - RNA, 19 nt, artificial
  Oligomer
auucaucuuuuccaccucc

SEQ ID NO: 22529 - RNA, 19 nt, artificial
  Oligomer
uucacucuugacuccuggg

SEQ ID NO: 22530 - RNA, 19 nt, artificial
  Oligomer
ugguagaguuuuaauuugg

SEQ ID NO: 22531 - RNA, 19 nt, artificial
  Oligomer
uucaguauuccuggagaag

SEQ ID NO: 22532 - RNA, 19 nt, artificial
  Oligomer
aaaaucaaaacuaaagacg

SEQ ID NO: 22533 - RNA, 19 nt, artificial
  Oligomer
ugcugauaugugaagcgug

SEQ ID NO: 22534 - RNA, 19 nt, artificial
  Oligomer
guaauaggcaucgcucuug

SEQ ID NO: 22535 - RNA, 19 nt, artificial
  Oligomer
uuacuauccuugucuuuuu

SEQ ID NO: 22536 - RNA, 19 nt, artificial
  Oligomer
guuagcugaaggaucaggg

SEQ ID NO: 22537 - RNA, 19 nt, artificial
  Oligomer
acuucauccuuguuccggg

SEQ ID NO: 22538 - RNA, 19 nt, artificial
  Oligomer
augcaacagaaucucucuc

SEQ ID NO: 22539 - RNA, 19 nt, artificial
  Oligomer
aauuucauucucuuuucag

SEQ ID NO: 22540 - RNA, 19 nt, artificial
  Oligomer
augacuuccaagucauacg

SEQ ID NO: 22541 - RNA, 19 nt, artificial
  Oligomer
aucucugucaaccaccuua

SEQ ID NO: 22542 - RNA, 19 nt, artificial
  Oligomer
uaucauagacaauguacuc

SEQ ID NO: 22543 - RNA, 19 nt, artificial
  Oligomer
uucccugauagauugcuga

SEQ ID NO: 22544 - RNA, 19 nt, artificial
  Oligomer
uaggacuagucuaugcaac

SEQ ID NO: 22545 - RNA, 19 nt, artificial
  Oligomer
ucugcauuguucaggagcg

SEQ ID NO: 22546 - RNA, 19 nt, artificial
  Oligomer
ccuguuuuccuugucgucc

SEQ ID NO: 22547 - RNA, 19 nt, artificial
  Oligomer
auauaauuucaugaagugc

SEQ ID NO: 22548 - RNA, 19 nt, artificial
  Oligomer
ucaguuuugagcuucucau

SEQ ID NO: 22549 - RNA, 19 nt, artificial
  Oligomer
ucuaugucaguuuuaucua

SEQ ID NO: 22550 - RNA, 19 nt, artificial
  Oligomer
cuucucauaguugacaucg

SEQ ID NO: 22551 - RNA, 19 nt, artificial
  Oligomer
uucuucacugccucuucau

SEQ ID NO: 22552 - RNA, 19 nt, artificial
  Oligomer
uuucuccaggacaugcgca

SEQ ID NO: 22553 - RNA, 19 nt, artificial
  Oligomer
aaguguauuuuuccuuccc

SEQ ID NO: 22554 - RNA, 19 nt, artificial
  Oligomer
ugcugaagcagaggaguuc

SEQ ID NO: 22555 - RNA, 19 nt, artificial
  Oligomer
guucuuaacauacuuccug

SEQ ID NO: 22556 - RNA, 19 nt, artificial
  Oligomer
acugucugcauuguucagg

SEQ ID NO: 22557 - RNA, 19 nt, artificial
  Oligomer
uucugaaggucgaucucau

SEQ ID NO: 22558 - RNA, 19 nt, artificial
  Oligomer
ugacaaagcagccuggaug

SEQ ID NO: 22559 - RNA, 19 nt, artificial
  Oligomer
ucuucacugccucuucauc

SEQ ID NO: 22560 - RNA, 19 nt, artificial
  Oligomer
auaccuuccuccuugaccu

SEQ ID NO: 22561 - RNA, 19 nt, artificial
  Oligomer
agauuuguugauaccuucc

SEQ ID NO: 22562 - RNA, 19 nt, artificial
  Oligomer
uccauaggacuagucuaug

SEQ ID NO: 22563 - RNA, 19 nt, artificial
  Oligomer
uuggacggcaucuguucca

SEQ ID NO: 22564 - RNA, 19 nt, artificial
  Oligomer
uuugccugucacuccucca

SEQ ID NO: 22565 - RNA, 19 nt, artificial
  Oligomer
uuguugaagaugaguagcu

SEQ ID NO: 22566 - RNA, 19 nt, artificial
  Oligomer
uuaaucgaguauuacuauu

SEQ ID NO: 22567 - RNA, 19 nt, artificial
  Oligomer
aucuucugaaggucgaucu

SEQ ID NO: 22568 - RNA, 19 nt, artificial
  Oligomer
guuaauuucauucucuuuu

SEQ ID NO: 22569 - RNA, 19 nt, artificial
  Oligomer
ugagaaauuguuagcguuc

SEQ ID NO: 22570 - RNA, 19 nt, artificial
  Oligomer
uauuacuauuagcccuugg

SEQ ID NO: 22571 - RNA, 19 nt, artificial
  Oligomer
uuuuggugcugaugcacag

SEQ ID NO: 22572 - RNA, 19 nt, artificial
  Oligomer
uugacaucgaugggauccu

SEQ ID NO: 22573 - RNA, 19 nt, artificial
  Oligomer
ucauucucuuuucagauuu

SEQ ID NO: 22574 - RNA, 19 nt, artificial
  Oligomer
uguuagcugaaggaucagg

SEQ ID NO: 22575 - RNA, 19 nt, artificial
  Oligomer
uuuaacacguuucuguaaa

SEQ ID NO: 22576 - RNA, 19 nt, artificial
  Oligomer
uccagacuaauguuagcug

SEQ ID NO: 22577 - RNA, 19 nt, artificial
  Oligomer
ucagcuucuucacugccuc

SEQ ID NO: 22578 - RNA, 19 nt, artificial
  Oligomer
cuuuuugggauacuucgug

SEQ ID NO: 22579 - RNA, 19 nt, artificial
  Oligomer
uaugcaacagaaucucucu

SEQ ID NO: 22580 - RNA, 19 nt, artificial
  Oligomer
uucaucccaaagucguggg

SEQ ID NO: 22581 - RNA, 19 nt, artificial
  Oligomer
ugagaaguuagagaaaacc

SEQ ID NO: 22582 - RNA, 19 nt, artificial
  Oligomer
ucccaauuaccacagggag

SEQ ID NO: 22583 - RNA, 19 nt, artificial
  Oligomer
aaaaccuuuaacacguuuc

SEQ ID NO: 22584 - RNA, 19 nt, artificial
  Oligomer
uguucuugacaaagcagcc

SEQ ID NO: 22585 - RNA, 19 nt, artificial
  Oligomer
uacucugcugcaaagucac

SEQ ID NO: 22586 - RNA, 19 nt, artificial
  Oligomer
aggaacgucuacaccaucc

SEQ ID NO: 22587 - RNA, 19 nt, artificial
  Oligomer
uuugugguagaguuuuaau

SEQ ID NO: 22588 - RNA, 19 nt, artificial
  Oligomer
uuuugcccaaaccuuugac

SEQ ID NO: 22589 - RNA, 19 nt, artificial
  Oligomer
aucaaaacuaaagacgaac

SEQ ID NO: 22590 - RNA, 19 nt, artificial
  Oligomer
guuuuccuugucguccucc

SEQ ID NO: 22591 - RNA, 19 nt, artificial
  Oligomer
cccauguucaguauuccug

SEQ ID NO: 22592 - RNA, 19 nt, artificial
  Oligomer
auuuaccugagcaauauca

SEQ ID NO: 22593 - RNA, 19 nt, artificial
  Oligomer
auucuaacgaagcuugguu

SEQ ID NO: 22594 - RNA, 19 nt, artificial
  Oligomer
uucacugccucuucauccu

SEQ ID NO: 22595 - RNA, 19 nt, artificial
  Oligomer
uauucaucuuuuccaccuc

SEQ ID NO: 22596 - RNA, 19 nt, artificial
  Oligomer
uaaggcagacauucuaacg

SEQ ID NO: 22597 - RNA, 19 nt, artificial
  Oligomer
cuaugcaacagaaucucuc

SEQ ID NO: 22598 - RNA, 19 nt, artificial
  Oligomer
ucugaggugguuuaguaca

SEQ ID NO: 22599 - RNA, 19 nt, artificial
  Oligomer
ucucggcuucuucagaauc

SEQ ID NO: 22600 - RNA, 19 nt, artificial
  Oligomer
auaucauagacaauguacu

SEQ ID NO: 22601 - RNA, 19 nt, artificial
  Oligomer
aaauaaaugcuuaacaucu

SEQ ID NO: 22602 - RNA, 19 nt, artificial
  Oligomer
uucaggucauuaguugaac

SEQ ID NO: 22603 - RNA, 19 nt, artificial
  Oligomer
aucuucauguuggauaaug

SEQ ID NO: 22604 - RNA, 19 nt, artificial
  Oligomer
ucacccagagucuucucug

SEQ ID NO: 22605 - RNA, 19 nt, artificial
  Oligomer
auauuugugguagaguuuu

SEQ ID NO: 22606 - RNA, 19 nt, artificial
  Oligomer
uuccuccaucuucuuauuc

SEQ ID NO: 22607 - RNA, 19 nt, artificial
  Oligomer
ucuucaucccaaagucgug

SEQ ID NO: 22608 - RNA, 19 nt, artificial
  Oligomer
uaauaggcaucgcucuuga

SEQ ID NO: 22609 - RNA, 19 nt, artificial
  Oligomer
uucuaaguaugagaaauug

SEQ ID NO: 22610 - RNA, 19 nt, artificial
  Oligomer
agcuuauccgaagacuccg

SEQ ID NO: 22611 - RNA, 19 nt, artificial
  Oligomer
guugauaccuuccuccuug

SEQ ID NO: 22612 - RNA, 19 nt, artificial
  Oligomer
ucaaccaccuuaaugucag

SEQ ID NO: 22613 - RNA, 19 nt, artificial
  Oligomer
ugcgcuaagaacaacuccu

SEQ ID NO: 22614 - RNA, 19 nt, artificial
  Oligomer
uuuugagcuucucauaguu

SEQ ID NO: 22615 - RNA, 19 nt, artificial
  Oligomer
uaucugcugaagcagagga

SEQ ID NO: 22616 - RNA, 19 nt, artificial
  Oligomer
cuuuagcucguccuugaug

SEQ ID NO: 22617 - RNA, 19 nt, artificial
  Oligomer
auuguuagcguuccuuccu

SEQ ID NO: 22618 - RNA, 19 nt, artificial
  Oligomer
uuuccaagggcaacuucuc

SEQ ID NO: 22619 - RNA, 19 nt, artificial
  Oligomer
ugaauuucaguuucagcag

SEQ ID NO: 22620 - RNA, 19 nt, artificial
  Oligomer
augugcgcuaagaacaacu

SEQ ID NO: 22621 - RNA, 19 nt, artificial
  Oligomer
ugucagcuucuucacugcc

SEQ ID NO: 22622 - RNA, 19 nt, artificial
  Oligomer
ugccuuuugcucagcuucc

SEQ ID NO: 22623 - RNA, 19 nt, artificial
  Oligomer
acucgauagagcuuauccg

SEQ ID NO: 22624 - RNA, 19 nt, artificial
  Oligomer
ucaaacaugggcgacugca

SEQ ID NO: 22625 - RNA, 19 nt, artificial
  Oligomer
uugagcuucucauaguuga

SEQ ID NO: 22626 - RNA, 19 nt, artificial
  Oligomer
aaauuguuagcguuccuuc

SEQ ID NO: 22627 - RNA, 19 nt, artificial
  Oligomer
guugucaagcauuuccacc

SEQ ID NO: 22628 - RNA, 19 nt, artificial
  Oligomer
aaucaggauccacagcugc

SEQ ID NO: 22629 - RNA, 19 nt, artificial
  Oligomer
uacaccauccagacuaaug

SEQ ID NO: 22630 - RNA, 19 nt, artificial
  Oligomer
ucauccacuccauccaccu

SEQ ID NO: 22631 - RNA, 19 nt, artificial
  Oligomer
uuuaaucgaguauuacuau

SEQ ID NO: 22632 - RNA, 19 nt, artificial
  Oligomer
uuccaccuccuuuuuggug

SEQ ID NO: 22633 - RNA, 19 nt, artificial
  Oligomer
auccaauaccuguuuuccu

SEQ ID NO: 22634 - RNA, 19 nt, artificial
  Oligomer
ugugguagaguuuuaauuu

SEQ ID NO: 22635 - RNA, 19 nt, artificial
  Oligomer
ucguucugagccuuuaggg

SEQ ID NO: 22636 - RNA, 19 nt, artificial
  Oligomer
uaccucucccaauuaccac

SEQ ID NO: 22637 - RNA, 19 nt, artificial
  Oligomer
uugacacugugcuugcccu

SEQ ID NO: 22638 - RNA, 19 nt, artificial
  Oligomer
uagagaaaaccuuuaacac

SEQ ID NO: 22639 - RNA, 19 nt, artificial
  Oligomer
guuuaguacagguacuacc

SEQ ID NO: 22640 - RNA, 19 nt, artificial
  Oligomer
uuccuuuaacgauguccac

SEQ ID NO: 22641 - RNA, 19 nt, artificial
  Oligomer
ucuucuuauucaucuuuuc

SEQ ID NO: 22642 - RNA, 19 nt, artificial
  Oligomer
ucuuaaaauugaauuucag

SEQ ID NO: 22643 - RNA, 19 nt, artificial
  Oligomer
uuccauaggacuagucuau

SEQ ID NO: 22644 - RNA, 19 nt, artificial
  Oligomer
uacuacauauuucaagagc

SEQ ID NO: 22645 - RNA, 19 nt, artificial
  Oligomer
uaccuguuuuccuugucgu

SEQ ID NO: 22646 - RNA, 19 nt, artificial
  Oligomer
uuggguaacuugcugauau

SEQ ID NO: 22647 - RNA, 19 nt, artificial
  Oligomer
aauuguuagcguuccuucc

SEQ ID NO: 22648 - RNA, 19 nt, artificial
  Oligomer
auagacaauguacucguua

SEQ ID NO: 22649 - RNA, 19 nt, artificial
  Oligomer
uaugaagcugcuuaaaggg

SEQ ID NO: 22650 - RNA, 19 nt, artificial
  Oligomer
ucccuguucuugacaaagc

SEQ ID NO: 22651 - RNA, 19 nt, artificial
  Oligomer
uaggcaucgcucuugaaga

SEQ ID NO: 22652 - RNA, 19 nt, artificial
  Oligomer
auacuuccugaugaucucg

SEQ ID NO: 22653 - RNA, 19 nt, artificial
  Oligomer
acacguuucuguaaaaucc

SEQ ID NO: 22654 - RNA, 19 nt, artificial
  Oligomer
cuaaauaguaugaaauuag

SEQ ID NO: 22655 - RNA, 19 nt, artificial
  Oligomer
aagaauuucaaaugcaacu

SEQ ID NO: 22656 - RNA, 19 nt, artificial
  Oligomer
uugagcugacucgcacugu

SEQ ID NO: 22657 - RNA, 19 nt, artificial
  Oligomer
aucugcugaagcagaggag

SEQ ID NO: 22658 - RNA, 19 nt, artificial
  Oligomer
aagaaagucaagaauuuca

SEQ ID NO: 22659 - RNA, 19 nt, artificial
  Oligomer
agcucguccuugauguucc

SEQ ID NO: 22660 - RNA, 19 nt, artificial
  Oligomer
cuuauucaucuuuuccacc

SEQ ID NO: 22661 - RNA, 19 nt, artificial
  Oligomer
uuacccacuccuuccgguu

SEQ ID NO: 22662 - RNA, 19 nt, artificial
  Oligomer
aucagcuacucgguccaag

SEQ ID NO: 22663 - RNA, 19 nt, artificial
  Oligomer
uuccuuccuuuggucuucc

SEQ ID NO: 22664 - RNA, 19 nt, artificial
  Oligomer
cuguucuugacaaagcagc

SEQ ID NO: 22665 - RNA, 19 nt, artificial
  Oligomer
ucccauguucaguauuccu

SEQ ID NO: 22666 - RNA, 19 nt, artificial
  Oligomer
acagaaucucucuccagcc

SEQ ID NO: 22667 - RNA, 19 nt, artificial
  Oligomer
ucugccuugcuaccaauuc

SEQ ID NO: 22668 - RNA, 19 nt, artificial
  Oligomer
uguuccaguuuguugcuac

SEQ ID NO: 22669 - RNA, 19 nt, artificial
  Oligomer
accuuugacacugugcuug

SEQ ID NO: 22670 - RNA, 19 nt, artificial
  Oligomer
cacuucauccacuccaucc

SEQ ID NO: 22671 - RNA, 19 nt, artificial
  Oligomer
aguguucuuaacauacuuc

SEQ ID NO: 22672 - RNA, 19 nt, artificial
  Oligomer
cuugauguuccagaucagg

SEQ ID NO: 22673 - RNA, 19 nt, artificial
  Oligomer
uugcaugaguguucuuaac

SEQ ID NO: 22674 - RNA, 19 nt, artificial
  Oligomer
ucucccaauuaccacaggg

SEQ ID NO: 22675 - RNA, 19 nt, artificial
  Oligomer
uacuauuagcccuugggua

SEQ ID NO: 22676 - RNA, 19 nt, artificial
  Oligomer
auaauuucaugaagugcuc

SEQ ID NO: 22677 - RNA, 19 nt, artificial
  Oligomer
uacuauccuugucuuuuuc

SEQ ID NO: 22678 - RNA, 19 nt, artificial
  Oligomer
ucuucucugccuugcuacc

SEQ ID NO: 22679 - RNA, 19 nt, artificial
  Oligomer
cuuuacuuccuccaucuuc

SEQ ID NO: 22680 - RNA, 19 nt, artificial
  Oligomer
ugguuuuuuccauaggacu

SEQ ID NO: 22681 - RNA, 19 nt, artificial
  Oligomer
agagaaaaccuuuaacacg

SEQ ID NO: 22682 - RNA, 19 nt, artificial
  Oligomer
cuugcuaccaauuccaucc

SEQ ID NO: 22683 - RNA, 19 nt, artificial
  Oligomer
uuucugaggugguuuagua

SEQ ID NO: 22684 - RNA, 19 nt, artificial
  Oligomer
uuuaccugagcaauaucau

SEQ ID NO: 22685 - RNA, 19 nt, artificial
  Oligomer
uauauaguagagagguguc

SEQ ID NO: 22686 - RNA, 19 nt, artificial
  Oligomer
acauacuuccugaugaucu

SEQ ID NO: 22687 - RNA, 19 nt, artificial
  Oligomer
gauaccuuccuccuugacc

SEQ ID NO: 22688 - RNA, 19 nt, artificial
  Oligomer
uccuucacucuugacuccu

SEQ ID NO: 22689 - RNA, 19 nt, artificial
  Oligomer
uucagauuuaccugagcaa

SEQ ID NO: 22690 - RNA, 19 nt, artificial
  Oligomer
uaagaaagucaagaauuuc

SEQ ID NO: 22691 - RNA, 19 nt, artificial
  Oligomer
aagcuuacuauccuugucu

SEQ ID NO: 22692 - RNA, 19 nt, artificial
  Oligomer
gucuucuugacuuucugcu

SEQ ID NO: 22693 - RNA, 19 nt, artificial
  Oligomer
uuucaaaugcaacuuuuaa

SEQ ID NO: 22694 - RNA, 19 nt, artificial
  Oligomer
uuccagaagcaggagaagu

SEQ ID NO: 22695 - RNA, 19 nt, artificial
  Oligomer
uuuagggcuuuuucaagcu

SEQ ID NO: 22696 - RNA, 19 nt, artificial
  Oligomer
accuuuaacacguuucugu

SEQ ID NO: 22697 - RNA, 19 nt, artificial
  Oligomer
uuuccauaggacuagucua

SEQ ID NO: 22698 - RNA, 19 nt, artificial
  Oligomer
agauacuucagauuuaccu

SEQ ID NO: 22699 - RNA, 19 nt, artificial
  Oligomer
ucauacauguuuccaaggg

SEQ ID NO: 22700 - RNA, 19 nt, artificial
  Oligomer
aaggucgaucucauacucc

SEQ ID NO: 22701 - RNA, 19 nt, artificial
  Oligomer
uuaguacagguacuaccca

SEQ ID NO: 22702 - RNA, 19 nt, artificial
  Oligomer
ucgguuaugaagcugcuua

SEQ ID NO: 22703 - RNA, 19 nt, artificial
  Oligomer
gucgaucucauacuccacc

SEQ ID NO: 22704 - RNA, 19 nt, artificial
  Oligomer
ugcauuucuugcaagaggc

SEQ ID NO: 22705 - RNA, 19 nt, artificial
  Oligomer
aucuuuuccaccuccuuuu

SEQ ID NO: 22706 - RNA, 19 nt, artificial
  Oligomer
cugaaggucgaucucauac

SEQ ID NO: 22707 - RNA, 19 nt, artificial
  Oligomer
uggaagacaaaagugccca

SEQ ID NO: 22708 - RNA, 19 nt, artificial
  Oligomer
guguauuuuuccuucccug

SEQ ID NO: 22709 - RNA, 19 nt, artificial
  Oligomer
uucucugccuugcuaccaa

SEQ ID NO: 22710 - RNA, 19 nt, artificial
  Oligomer
ugaaggucgaucucauacu

SEQ ID NO: 22711 - RNA, 19 nt, artificial
  Oligomer
uucgugaaauuuuuggagu

SEQ ID NO: 22712 - RNA, 19 nt, artificial
  Oligomer
accaucuucuuggacaggc

SEQ ID NO: 22713 - RNA, 19 nt, artificial
  Oligomer
ugauagauugcugaugccu

SEQ ID NO: 22714 - RNA, 19 nt, artificial
  Oligomer
uucauccuuguuccgggac

SEQ ID NO: 22715 - RNA, 19 nt, artificial
  Oligomer
uucauauaauuucaugaag

SEQ ID NO: 22716 - RNA, 19 nt, artificial
  Oligomer
augcuuaacaucuuuccaa

SEQ ID NO: 22717 - RNA, 19 nt, artificial
  Oligomer
uacucgacucgauagagcu

SEQ ID NO: 22718 - RNA, 19 nt, artificial
  Oligomer
uucuugacuuucugcuggu

SEQ ID NO: 22719 - RNA, 19 nt, artificial
  Oligomer
ucaagagcucccauguuca

SEQ ID NO: 22720 - RNA, 19 nt, artificial
  Oligomer
aaaugcuuaacaucuuucc

SEQ ID NO: 22721 - RNA, 19 nt, artificial
  Oligomer
ugggacuuuuccaucaaac

SEQ ID NO: 22722 - RNA, 19 nt, artificial
  Oligomer
uuuuaaccuucaauuucuu

SEQ ID NO: 22723 - RNA, 19 nt, artificial
  Oligomer
uuuggugcugaugcacagg

SEQ ID NO: 22724 - RNA, 19 nt, artificial
  Oligomer
ucuucagggcuucuuuauc

SEQ ID NO: 22725 - RNA, 19 nt, artificial
  Oligomer
uaagaguuaauuucauucu

SEQ ID NO: 22726 - RNA, 19 nt, artificial
  Oligomer
uaccagcggucaaucaugc

SEQ ID NO: 22727 - RNA, 19 nt, artificial
  Oligomer
uucacaccagaugaaaucc

SEQ ID NO: 22728 - RNA, 19 nt, artificial
  Oligomer
ugccuugcuaccaauucca

SEQ ID NO: 22729 - RNA, 19 nt, artificial
  Oligomer
uaaguaugagaaauuguua

SEQ ID NO: 22730 - RNA, 19 nt, artificial
  Oligomer
uccaccuccuuuuuggugc

SEQ ID NO: 22731 - RNA, 19 nt, artificial
  Oligomer
uuugagagauccaggaucu

SEQ ID NO: 22732 - RNA, 19 nt, artificial
  Oligomer
ugucuugaccauacacuug

SEQ ID NO: 22733 - RNA, 19 nt, artificial
  Oligomer
uucucuaugucaguuuuau

SEQ ID NO: 22734 - RNA, 19 nt, artificial
  Oligomer
aucuucuuggacaggcgca

SEQ ID NO: 22735 - RNA, 19 nt, artificial
  Oligomer
acuuucugcuggucauccc

SEQ ID NO: 22736 - RNA, 19 nt, artificial
  Oligomer
uccuuggacggcaucuguu

SEQ ID NO: 22737 - RNA, 19 nt, artificial
  Oligomer
aguuuugagcuucucauag

SEQ ID NO: 22738 - RNA, 19 nt, artificial
  Oligomer
uauccuugucuuuuucuuu

SEQ ID NO: 22739 - RNA, 19 nt, artificial
  Oligomer
uuccuggagaaggaaagcu

SEQ ID NO: 22740 - RNA, 19 nt, artificial
  Oligomer
aagaggaacgucuacacca

SEQ ID NO: 22741 - RNA, 19 nt, artificial
  Oligomer
ugauaugugaagcgugcuu

SEQ ID NO: 22742 - RNA, 19 nt, artificial
  Oligomer
uuucuaaguaugagaaauu

SEQ ID NO: 22743 - RNA, 19 nt, artificial
  Oligomer
ucugcugcaaagucaccca

SEQ ID NO: 22744 - RNA, 19 nt, artificial
  Oligomer
cuuuccuucacucuugacu

SEQ ID NO: 22745 - RNA, 19 nt, artificial
  Oligomer
auacucugcugcaaaguca

SEQ ID NO: 22746 - RNA, 19 nt, artificial
  Oligomer
uauacgguccuguuuuuua

SEQ ID NO: 22747 - RNA, 19 nt, artificial
  Oligomer
uugacuuucugcuggucau

SEQ ID NO: 22748 - RNA, 19 nt, artificial
  Oligomer
uugcugauaugugaagcgu

SEQ ID NO: 22749 - RNA, 19 nt, artificial
  Oligomer
ucgaucucauacuccacca

SEQ ID NO: 22750 - RNA, 19 nt, artificial
  Oligomer
uccaccaucuucuuggaca

SEQ ID NO: 22751 - RNA, 19 nt, artificial
  Oligomer
augaaaucccggucccaag

SEQ ID NO: 22752 - RNA, 19 nt, artificial
  Oligomer
uagagaggugucauucaca

SEQ ID NO: 22753 - RNA, 19 nt, artificial
  Oligomer
agagucaggaucuucaugu

SEQ ID NO: 22754 - RNA, 19 nt, artificial
  Oligomer
uucacgcucuaucuuaaag

SEQ ID NO: 22755 - RNA, 19 nt, artificial
  Oligomer
ucuuuuuguuucuaaguau

SEQ ID NO: 22756 - RNA, 19 nt, artificial
  Oligomer
uuucuaucuucuccauaca

SEQ ID NO: 22757 - RNA, 19 nt, artificial
  Oligomer
cucauaguugacaucgaug

SEQ ID NO: 22758 - RNA, 19 nt, artificial
  Oligomer
cucuaucuuaaagauaucg

SEQ ID NO: 22759 - RNA, 19 nt, artificial
  Oligomer
ucagagaacccauccaccu

SEQ ID NO: 22760 - RNA, 19 nt, artificial
  Oligomer
uucuucagggcuucuuuau

SEQ ID NO: 22761 - RNA, 19 nt, artificial
  Oligomer
cuucuugacuuucugcugg

SEQ ID NO: 22762 - RNA, 19 nt, artificial
  Oligomer
aucaaagaucaucuugaug

SEQ ID NO: 22763 - RNA, 19 nt, artificial
  Oligomer
uucuugagguaagagauuu

SEQ ID NO: 22764 - RNA, 19 nt, artificial
  Oligomer
augugaagcgugcuucagu

SEQ ID NO: 22765 - RNA, 19 nt, artificial
  Oligomer
uguuuuccuugucguccuc

SEQ ID NO: 22766 - RNA, 19 nt, artificial
  Oligomer
ucuucauauaauuucauga

SEQ ID NO: 22767 - RNA, 19 nt, artificial
  Oligomer
ggagauuggugcuguaaaa

SEQ ID NO: 22768 - RNA, 19 nt, artificial
  Oligomer
gcagcuuuauaguuuuuaa

SEQ ID NO: 22769 - RNA, 19 nt, artificial
  Oligomer
caguguaacccgagcaaaa

SEQ ID NO: 22770 - RNA, 19 nt, artificial
  Oligomer
cagucuuugugauuucaua

SEQ ID NO: 22771 - RNA, 19 nt, artificial
  Oligomer
cauccuagugggaacuaaa

SEQ ID NO: 22772 - RNA, 19 nt, artificial
  Oligomer
cauuguacaaggaaugaaa

SEQ ID NO: 22773 - RNA, 19 nt, artificial
  Oligomer
ggauacagcuggacaagaa

SEQ ID NO: 22774 - RNA, 19 nt, artificial
  Oligomer
gcauuuaauucaucuuuaa

SEQ ID NO: 22775 - RNA, 19 nt, artificial
  Oligomer
gcauguaugacuuaauaaa

SEQ ID NO: 22776 - RNA, 19 nt, artificial
  Oligomer
aguccugcaucauuugaaa

SEQ ID NO: 22777 - RNA, 19 nt, artificial
  Oligomer
agaagauuaugacagauua

SEQ ID NO: 22778 - RNA, 19 nt, artificial
  Oligomer
gacucacauucuauuaaaa

SEQ ID NO: 22779 - RNA, 19 nt, artificial
  Oligomer
cagcuuuauaguuuuuaaa

SEQ ID NO: 22780 - RNA, 19 nt, artificial
  Oligomer
cgagcacugaacuuugcaa

SEQ ID NO: 22781 - RNA, 19 nt, artificial
  Oligomer
aggagauuggugcuguaaa

SEQ ID NO: 22782 - RNA, 19 nt, artificial
  Oligomer
gcggagauuuugaacagaa

SEQ ID NO: 22783 - RNA, 19 nt, artificial
  Oligomer
agguuuuguuuguucuaaa

SEQ ID NO: 22784 - RNA, 19 nt, artificial
  Oligomer
ugaagaagaggaagagaaa

SEQ ID NO: 22785 - RNA, 19 nt, artificial
  Oligomer
cgauguucuguacaacuua

SEQ ID NO: 22786 - RNA, 19 nt, artificial
  Oligomer
ugaucuuagggaugauaaa

SEQ ID NO: 22787 - RNA, 19 nt, artificial
  Oligomer
ccauucuuguucagauuaa

SEQ ID NO: 22788 - RNA, 19 nt, artificial
  Oligomer
acacgaucgagaaacugaa

SEQ ID NO: 22789 - RNA, 19 nt, artificial
  Oligomer
ggacaagaagauuaugaca

SEQ ID NO: 22790 - RNA, 19 nt, artificial
  Oligomer
ccuugugaguccugcauca

SEQ ID NO: 22791 - RNA, 19 nt, artificial
  Oligomer
caaugcauuuccuggagaa

SEQ ID NO: 22792 - RNA, 19 nt, artificial
  Oligomer
gaaaaugccugcuguugua

SEQ ID NO: 22793 - RNA, 19 nt, artificial
  Oligomer
ugcaguagaugaugaaaga

SEQ ID NO: 22794 - RNA, 19 nt, artificial
  Oligomer
cuaguaacuagguguaaaa

SEQ ID NO: 22795 - RNA, 19 nt, artificial
  Oligomer
aaaugacaagccuucuuaa

SEQ ID NO: 22796 - RNA, 19 nt, artificial
  Oligomer
ccauguuacuuuauucaga

SEQ ID NO: 22797 - RNA, 19 nt, artificial
  Oligomer
gccucaagacaguguuuga

SEQ ID NO: 22798 - RNA, 19 nt, artificial
  Oligomer
cccaaauugggcauuuaau

SEQ ID NO: 22799 - RNA, 19 nt, artificial
  Oligomer
cauguaugacuuaauaaau

SEQ ID NO: 22800 - RNA, 19 nt, artificial
  Oligomer
gauguucuguacaacuuaa

SEQ ID NO: 22801 - RNA, 19 nt, artificial
  Oligomer
ucgagaaacugaaggagaa

SEQ ID NO: 22802 - RNA, 19 nt, artificial
  Oligomer
cacggguaaaaacucuaaa

SEQ ID NO: 22803 - RNA, 19 nt, artificial
  Oligomer
ccuggagaauauaucccua

SEQ ID NO: 22804 - RNA, 19 nt, artificial
  Oligomer
gugggagacggaaacaaga

SEQ ID NO: 22805 - RNA, 19 nt, artificial
  Oligomer
gguugguauuaucaggaaa

SEQ ID NO: 22806 - RNA, 19 nt, artificial
  Oligomer
acuuuuuguuacagauuaa

SEQ ID NO: 22807 - RNA, 19 nt, artificial
  Oligomer
acggguaaaaacucuaaaa

SEQ ID NO: 22808 - RNA, 19 nt, artificial
  Oligomer
agacucacauucuauuaaa

SEQ ID NO: 22809 - RNA, 19 nt, artificial
  Oligomer
gaagaagaggaagagaaaa

SEQ ID NO: 22810 - RNA, 19 nt, artificial
  Oligomer
uaaggagauuggugcugua

SEQ ID NO: 22811 - RNA, 19 nt, artificial
  Oligomer
cggagauuuugaacagaac

SEQ ID NO: 22812 - RNA, 19 nt, artificial
  Oligomer
aagguuaauuucugucaaa

SEQ ID NO: 22813 - RNA, 19 nt, artificial
  Oligomer
gagaacaccgagcacugaa

SEQ ID NO: 22814 - RNA, 19 nt, artificial
  Oligomer
aaccaaucaguaauuuuaa

SEQ ID NO: 22815 - RNA, 19 nt, artificial
  Oligomer
aagugcuuuucuuauagaa

SEQ ID NO: 22816 - RNA, 19 nt, artificial
  Oligomer
caguagaugaugaaagaaa

SEQ ID NO: 22817 - RNA, 19 nt, artificial
  Oligomer
gccuccuuguauuauaaaa

SEQ ID NO: 22818 - RNA, 19 nt, artificial
  Oligomer
cacugucacuugaccaaua

SEQ ID NO: 22819 - RNA, 19 nt, artificial
  Oligomer
aaaugcaguagaugaugaa

SEQ ID NO: 22820 - RNA, 19 nt, artificial
  Oligomer
gcacguguucccgacauaa

SEQ ID NO: 22821 - RNA, 19 nt, artificial
  Oligomer
ucagaugcguaaagcagaa

SEQ ID NO: 22822 - RNA, 19 nt, artificial
  Oligomer
cuuuauucagagcuaauaa

SEQ ID NO: 22823 - RNA, 19 nt, artificial
  Oligomer
gaaccaaucaguaauuuua

SEQ ID NO: 22824 - RNA, 19 nt, artificial
  Oligomer
uucugauaaugcauuagaa

SEQ ID NO: 22825 - RNA, 19 nt, artificial
  Oligomer
guauagagcuguagguaaa

SEQ ID NO: 22826 - RNA, 19 nt, artificial
  Oligomer
acaagaagauuaugacaga

SEQ ID NO: 22827 - RNA, 19 nt, artificial
  Oligomer
caauguuaugguagaugga

SEQ ID NO: 22828 - RNA, 19 nt, artificial
  Oligomer
gcauuuccuggagaauaua

SEQ ID NO: 22829 - RNA, 19 nt, artificial
  Oligomer
gguuuuguuuguucuaaau

SEQ ID NO: 22830 - RNA, 19 nt, artificial
  Oligomer
aagccuucuuaaagccuua

SEQ ID NO: 22831 - RNA, 19 nt, artificial
  Oligomer
gaguccugcaucauuugaa

SEQ ID NO: 22832 - RNA, 19 nt, artificial
  Oligomer
cagauuaauuuuuccauaa

SEQ ID NO: 22833 - RNA, 19 nt, artificial
  Oligomer
cugacgauguucuguacaa

SEQ ID NO: 22834 - RNA, 19 nt, artificial
  Oligomer
acaguauuuugacaaaaua

SEQ ID NO: 22835 - RNA, 19 nt, artificial
  Oligomer
gcaguagaugaugaaagaa

SEQ ID NO: 22836 - RNA, 19 nt, artificial
  Oligomer
agugggaacuaaacuugau

SEQ ID NO: 22837 - RNA, 19 nt, artificial
  Oligomer
aaagguuaauuucugucaa

SEQ ID NO: 22838 - RNA, 19 nt, artificial
  Oligomer
caaaauaccuucugaacua

SEQ ID NO: 22839 - RNA, 19 nt, artificial
  Oligomer
aguggagauuuacacuaca

SEQ ID NO: 22840 - RNA, 19 nt, artificial
  Oligomer
aaacuaugaaccuucuuaa

SEQ ID NO: 22841 - RNA, 19 nt, artificial
  Oligomer
guauuuugacaaaauacga

SEQ ID NO: 22842 - RNA, 19 nt, artificial
  Oligomer
aguucagacucacauucua

SEQ ID NO: 22843 - RNA, 19 nt, artificial
  Oligomer
gacuuaauaaauccuugaa

SEQ ID NO: 22844 - RNA, 19 nt, artificial
  Oligomer
gaaagugucacggguaaaa

SEQ ID NO: 22845 - RNA, 19 nt, artificial
  Oligomer
agauuggugcuguaaaaua

SEQ ID NO: 22846 - RNA, 19 nt, artificial
  Oligomer
gcagaauuguggaguguuu

SEQ ID NO: 22847 - RNA, 19 nt, artificial
  Oligomer
ccgagcacugaacuuugca

SEQ ID NO: 22848 - RNA, 19 nt, artificial
  Oligomer
agaagaagcugacucccau

SEQ ID NO: 22849 - RNA, 19 nt, artificial
  Oligomer
caagacaguguuugacgaa

SEQ ID NO: 22850 - RNA, 19 nt, artificial
  Oligomer
agaccuucgucuuugagaa

SEQ ID NO: 22851 - RNA, 19 nt, artificial
  Oligomer
agcuggacaagaagauuau

SEQ ID NO: 22852 - RNA, 19 nt, artificial
  Oligomer
ggcauuuaauucaucuuua

SEQ ID NO: 22853 - RNA, 19 nt, artificial
  Oligomer
acguguucccgacauaaca

SEQ ID NO: 22854 - RNA, 19 nt, artificial
  Oligomer
ccaaauugggcauuuaauu

SEQ ID NO: 22855 - RNA, 19 nt, artificial
  Oligomer
cgugaagaagaggaagaga

SEQ ID NO: 22856 - RNA, 19 nt, artificial
  Oligomer
ugacaaaauacgaagugga

SEQ ID NO: 22857 - RNA, 19 nt, artificial
  Oligomer
ggucugugagguucuguaa

SEQ ID NO: 22858 - RNA, 19 nt, artificial
  Oligomer
gggucugugagguucugua

SEQ ID NO: 22859 - RNA, 19 nt, artificial
  Oligomer
ugcauuuccuggagaauau

SEQ ID NO: 22860 - RNA, 19 nt, artificial
  Oligomer
ugggagacggaaacaagaa

SEQ ID NO: 22861 - RNA, 19 nt, artificial
  Oligomer
gagcacugaacuuugcaaa

SEQ ID NO: 22862 - RNA, 19 nt, artificial
  Oligomer
gcuuuugcggagauuuuga

SEQ ID NO: 22863 - RNA, 19 nt, artificial
  Oligomer
uguuaugguagauggaaaa

SEQ ID NO: 22864 - RNA, 19 nt, artificial
  Oligomer
gaccaauacugacccucuu

SEQ ID NO: 22865 - RNA, 19 nt, artificial
  Oligomer
gaacagccucccgaaugaa

SEQ ID NO: 22866 - RNA, 19 nt, artificial
  Oligomer
aauacgaaguggagauuua

SEQ ID NO: 22867 - RNA, 19 nt, artificial
  Oligomer
cagacucacauucuauuaa

SEQ ID NO: 22868 - RNA, 19 nt, artificial
  Oligomer
cucccgugaagaagaggaa

SEQ ID NO: 22869 - RNA, 19 nt, artificial
  Oligomer
ccaacuuuuuguuacagau

SEQ ID NO: 22870 - RNA, 19 nt, artificial
  Oligomer
cagcuuuugcggagauuuu

SEQ ID NO: 22871 - RNA, 19 nt, artificial
  Oligomer
gacggaaacaagaaucuca

SEQ ID NO: 22872 - RNA, 19 nt, artificial
  Oligomer
cacuacauuguacaaggaa

SEQ ID NO: 22873 - RNA, 19 nt, artificial
  Oligomer
guuagucgcuaacuuagua

SEQ ID NO: 22874 - RNA, 19 nt, artificial
  Oligomer
aaaucuuucugauaaugca

SEQ ID NO: 22875 - RNA, 19 nt, artificial
  Oligomer
caaagaccuucgucuuuga

SEQ ID NO: 22876 - RNA, 19 nt, artificial
  Oligomer
cugugcuagugcugacgau

SEQ ID NO: 22877 - RNA, 19 nt, artificial
  Oligomer
agaaacugaaggagaagaa

SEQ ID NO: 22878 - RNA, 19 nt, artificial
  Oligomer
aaugacaagccuucuuaaa

SEQ ID NO: 22879 - RNA, 19 nt, artificial
  Oligomer
cgaaguggagauuuacacu

SEQ ID NO: 22880 - RNA, 19 nt, artificial
  Oligomer
uugcauguaugacuuaaua

SEQ ID NO: 22881 - RNA, 19 nt, artificial
  Oligomer
agaacagccucccgaauga

SEQ ID NO: 22882 - RNA, 19 nt, artificial
  Oligomer
caguguuugacgaagcgau

SEQ ID NO: 22883 - RNA, 19 nt, artificial
  Oligomer
gauuggugcuguaaaauac

SEQ ID NO: 22884 - RNA, 19 nt, artificial
  Oligomer
gguaaaacuugccuacuga

SEQ ID NO: 22885 - RNA, 19 nt, artificial
  Oligomer
gggagacggaaacaagaau

SEQ ID NO: 22886 - RNA, 19 nt, artificial
  Oligomer
cauaaaaccauuuuuugaa

SEQ ID NO: 22887 - RNA, 19 nt, artificial
  Oligomer
guuuuuuugucgauuagua

SEQ ID NO: 22888 - RNA, 19 nt, artificial
  Oligomer
caaagacaguauuuugaca

SEQ ID NO: 22889 - RNA, 19 nt, artificial
  Oligomer
ccauaaaaccauuuuuuga

SEQ ID NO: 22890 - RNA, 19 nt, artificial
  Oligomer
cgaucgagaaacugaagga

SEQ ID NO: 22891 - RNA, 19 nt, artificial
  Oligomer
caagaagauuaugacagau

SEQ ID NO: 22892 - RNA, 19 nt, artificial
  Oligomer
gauaauucuuaaacuauga

SEQ ID NO: 22893 - RNA, 19 nt, artificial
  Oligomer
gcuuuuccuuucucuuaca

SEQ ID NO: 22894 - RNA, 19 nt, artificial
  Oligomer
ggaguguuuuuacauugau

SEQ ID NO: 22895 - RNA, 19 nt, artificial
  Oligomer
cgaguuuucugaccagcuu

SEQ ID NO: 22896 - RNA, 19 nt, artificial
  Oligomer
ccuucugacugagcaauau

SEQ ID NO: 22897 - RNA, 19 nt, artificial
  Oligomer
guuuguucuaaauguaaga

SEQ ID NO: 22898 - RNA, 19 nt, artificial
  Oligomer
augccuccuuguauuauaa

SEQ ID NO: 22899 - RNA, 19 nt, artificial
  Oligomer
cagcuggacaagaagauua

SEQ ID NO: 22900 - RNA, 19 nt, artificial
  Oligomer
gugaagaagaggaagagaa

SEQ ID NO: 22901 - RNA, 19 nt, artificial
  Oligomer
gacaguauuuugacaaaau

SEQ ID NO: 22902 - RNA, 19 nt, artificial
  Oligomer
cucagaugcguaaagcaga

SEQ ID NO: 22903 - RNA, 19 nt, artificial
  Oligomer
cuaugaaccuucuuaacau

SEQ ID NO: 22904 - RNA, 19 nt, artificial
  Oligomer
guaguucucagaugcguaa

SEQ ID NO: 22905 - RNA, 19 nt, artificial
  Oligomer
cuuaaagccuuauuuuuca

SEQ ID NO: 22906 - RNA, 19 nt, artificial
  Oligomer
auguuaugguagauggaaa

SEQ ID NO: 22907 - RNA, 19 nt, artificial
  Oligomer
ucaggaaauguuuucuuaa

SEQ ID NO: 22908 - RNA, 19 nt, artificial
  Oligomer
agcugacucccaucaccua

SEQ ID NO: 22909 - RNA, 19 nt, artificial
  Oligomer
ugaucuuuugcuaaugcaa

SEQ ID NO: 22910 - RNA, 19 nt, artificial
  Oligomer
ugcuauuuccucuaaugaa

SEQ ID NO: 22911 - RNA, 19 nt, artificial
  Oligomer
gcagcucagcucuuuggau

SEQ ID NO: 22912 - RNA, 19 nt, artificial
  Oligomer
aguagaugaugaaagaaag

SEQ ID NO: 22913 - RNA, 19 nt, artificial
  Oligomer
gaaugaaagugucacgggu

SEQ ID NO: 22914 - RNA, 19 nt, artificial
  Oligomer
cuuuugcggagauuuugaa

SEQ ID NO: 22915 - RNA, 19 nt, artificial
  Oligomer
cagcguugcuuguauagag

SEQ ID NO: 22916 - RNA, 19 nt, artificial
  Oligomer
agguugguauuaucaggaa

SEQ ID NO: 22917 - RNA, 19 nt, artificial
  Oligomer
augggauacagcuggacaa

SEQ ID NO: 22918 - RNA, 19 nt, artificial
  Oligomer
cuacaacagaauuuuuuaa

SEQ ID NO: 22919 - RNA, 19 nt, artificial
  Oligomer
aaagccuuauuuuucaaaa

SEQ ID NO: 22920 - RNA, 19 nt, artificial
  Oligomer
gaaagaaagguugguauua

SEQ ID NO: 22921 - RNA, 19 nt, artificial
  Oligomer
aaugcaguagaugaugaaa

SEQ ID NO: 22922 - RNA, 19 nt, artificial
  Oligomer
acacuacauuguacaagga

SEQ ID NO: 22923 - RNA, 19 nt, artificial
  Oligomer
uagugggaacuaaacuuga

SEQ ID NO: 22924 - RNA, 19 nt, artificial
  Oligomer
ccuucugaacuacacugca

SEQ ID NO: 22925 - RNA, 19 nt, artificial
  Oligomer
aagacaguauuuugacaaa

SEQ ID NO: 22926 - RNA, 19 nt, artificial
  Oligomer
ccauuuuuugaaccaauca

SEQ ID NO: 22927 - RNA, 19 nt, artificial
  Oligomer
cguguucccgacauaacau

SEQ ID NO: 22928 - RNA, 19 nt, artificial
  Oligomer
aaagugucacggguaaaaa

SEQ ID NO: 22929 - RNA, 19 nt, artificial
  Oligomer
guuacuuuauucagagcua

SEQ ID NO: 22930 - RNA, 19 nt, artificial
  Oligomer
ugaucaaaggacaaagaca

SEQ ID NO: 22931 - RNA, 19 nt, artificial
  Oligomer
acauaacauuguacuguaa

SEQ ID NO: 22932 - RNA, 19 nt, artificial
  Oligomer
ccauugaacucaccaguga

SEQ ID NO: 22933 - RNA, 19 nt, artificial
  Oligomer
caauaugccuccuuguauu

SEQ ID NO: 22934 - RNA, 19 nt, artificial
  Oligomer
agauuuacacuacauugua

SEQ ID NO: 22935 - RNA, 19 nt, artificial
  Oligomer
gaagauuaugacagauuac

SEQ ID NO: 22936 - RNA, 19 nt, artificial
  Oligomer
ugugaucaaaggacaaaga

SEQ ID NO: 22937 - RNA, 19 nt, artificial
  Oligomer
aaagaaagguugguauuau

SEQ ID NO: 22938 - RNA, 19 nt, artificial
  Oligomer
aguaagugcuuuucuuaua

SEQ ID NO: 22939 - RNA, 19 nt, artificial
  Oligomer
cgugcaaagugguauccug

SEQ ID NO: 22940 - RNA, 19 nt, artificial
  Oligomer
cuacugucuuugacaauua

SEQ ID NO: 22941 - RNA, 19 nt, artificial
  Oligomer
gacauaacauuguacugua

SEQ ID NO: 22942 - RNA, 19 nt, artificial
  Oligomer
uacgaaguggagauuuaca

SEQ ID NO: 22943 - RNA, 19 nt, artificial
  Oligomer
cccuucugacugagcaaua

SEQ ID NO: 22944 - RNA, 19 nt, artificial
  Oligomer
gucacuugaccaauacuga

SEQ ID NO: 22945 - RNA, 19 nt, artificial
  Oligomer
ccuucuuaaagccuuauuu

SEQ ID NO: 22946 - RNA, 19 nt, artificial
  Oligomer
caaaauacgaaguggagau

SEQ ID NO: 22947 - RNA, 19 nt, artificial
  Oligomer
cggaaacaagaaucucagu

SEQ ID NO: 22948 - RNA, 19 nt, artificial
  Oligomer
cuuaguaagugcuuuucuu

SEQ ID NO: 22949 - RNA, 19 nt, artificial
  Oligomer
uuuuuuugucgauuaguaa

SEQ ID NO: 22950 - RNA, 19 nt, artificial
  Oligomer
guggagauuuacacuacau

SEQ ID NO: 22951 - RNA, 19 nt, artificial
  Oligomer
gucccuuggaaccuuugua

SEQ ID NO: 22952 - RNA, 19 nt, artificial
  Oligomer
gaaccuucuuaacaucacu

SEQ ID NO: 22953 - RNA, 19 nt, artificial
  Oligomer
gugcaaagugguauccuga

SEQ ID NO: 22954 - RNA, 19 nt, artificial
  Oligomer
gacacugucacuugaccaa

SEQ ID NO: 22955 - RNA, 19 nt, artificial
  Oligomer
gucugugagguucuguaaa

SEQ ID NO: 22956 - RNA, 19 nt, artificial
  Oligomer
cucaguguaacccgagcaa

SEQ ID NO: 22957 - RNA, 19 nt, artificial
  Oligomer
acagauuaauuuuuccaua

SEQ ID NO: 22958 - RNA, 19 nt, artificial
  Oligomer
cggugaaucugggcuuaug

SEQ ID NO: 22959 - RNA, 19 nt, artificial
  Oligomer
ugcauguaugacuuaauaa

SEQ ID NO: 22960 - RNA, 19 nt, artificial
  Oligomer
acuacauuguacaaggaau

SEQ ID NO: 22961 - RNA, 19 nt, artificial
  Oligomer
cuauuaaaauuuagcccua

SEQ ID NO: 22962 - RNA, 19 nt, artificial
  Oligomer
aaaugccugcuguuguaaa

SEQ ID NO: 22963 - RNA, 19 nt, artificial
  Oligomer
ggagauuuugaacagaacu

SEQ ID NO: 22964 - RNA, 19 nt, artificial
  Oligomer
uuguuuguucuaaauguaa

SEQ ID NO: 22965 - RNA, 19 nt, artificial
  Oligomer
cgacacugucacuugacca

SEQ ID NO: 22966 - RNA, 19 nt, artificial
  Oligomer
uauuuugacaaaauacgaa

SEQ ID NO: 22967 - RNA, 19 nt, artificial
  Oligomer
gagauuggugcuguaaaau

SEQ ID NO: 22968 - RNA, 19 nt, artificial
  Oligomer
aaugccugcuguuguaaau

SEQ ID NO: 22969 - RNA, 19 nt, artificial
  Oligomer
gacaaaauacgaaguggag

SEQ ID NO: 22970 - RNA, 19 nt, artificial
  Oligomer
agcacguguucccgacaua

SEQ ID NO: 22971 - RNA, 19 nt, artificial
  Oligomer
ucuaguaacuagguguaaa

SEQ ID NO: 22972 - RNA, 19 nt, artificial
  Oligomer
auuaaaauuuagcccuaaa

SEQ ID NO: 22973 - RNA, 19 nt, artificial
  Oligomer
ugcuuuccauguuacuuua

SEQ ID NO: 22974 - RNA, 19 nt, artificial
  Oligomer
uacugucuuugacaauuau

SEQ ID NO: 22975 - RNA, 19 nt, artificial
  Oligomer
gacaaagacaguauuuuga

SEQ ID NO: 22976 - RNA, 19 nt, artificial
  Oligomer
cagauuaccgacacuguca

SEQ ID NO: 22977 - RNA, 19 nt, artificial
  Oligomer
ccaauacugacccucuuua

SEQ ID NO: 22978 - RNA, 19 nt, artificial
  Oligomer
gggcuuaugggauacagcu

SEQ ID NO: 22979 - RNA, 19 nt, artificial
  Oligomer
gaacuaaacuugaucuuag

SEQ ID NO: 22980 - RNA, 19 nt, artificial
  Oligomer
cuugccuacugaucaguua

SEQ ID NO: 22981 - RNA, 19 nt, artificial
  Oligomer
cauuauguuuugcauguau

SEQ ID NO: 22982 - RNA, 19 nt, artificial
  Oligomer
cuuugugauuucauagcga

SEQ ID NO: 22983 - RNA, 19 nt, artificial
  Oligomer
cgcuuugccuauugauguu

SEQ ID NO: 22984 - RNA, 19 nt, artificial
  Oligomer
gacgguagcuucugcaguu

SEQ ID NO: 22985 - RNA, 19 nt, artificial
  Oligomer
uuuguuuguucuaaaugua

SEQ ID NO: 22986 - RNA, 19 nt, artificial
  Oligomer
gaaucucaguguaacccga

SEQ ID NO: 22987 - RNA, 19 nt, artificial
  Oligomer
gggauacagcuggacaaga

SEQ ID NO: 22988 - RNA, 19 nt, artificial
  Oligomer
caacacucccaucauccua

SEQ ID NO: 22989 - RNA, 19 nt, artificial
  Oligomer
cgucuuugagaagacggua

SEQ ID NO: 22990 - RNA, 19 nt, artificial
  Oligomer
agcucagcucuuuggauca

SEQ ID NO: 22991 - RNA, 19 nt, artificial
  Oligomer
gauacagcuggacaagaag

SEQ ID NO: 22992 - RNA, 19 nt, artificial
  Oligomer
uuacuuuauucagagcuaa

SEQ ID NO: 22993 - RNA, 19 nt, artificial
  Oligomer
ggaacuaaacuugaucuua

SEQ ID NO: 22994 - RNA, 19 nt, artificial
  Oligomer
gaaguggagauuuacacua

SEQ ID NO: 22995 - RNA, 19 nt, artificial
  Oligomer
gcagacacuugcucuccua

SEQ ID NO: 22996 - RNA, 19 nt, artificial
  Oligomer
uauccuauccgcaaacaga

SEQ ID NO: 22997 - RNA, 19 nt, artificial
  Oligomer
acuacaacagaauuuuuua

SEQ ID NO: 22998 - RNA, 19 nt, artificial
  Oligomer
gcauuauguuuugcaugua

SEQ ID NO: 22999 - RNA, 19 nt, artificial
  Oligomer
guaagaguucagacucaca

SEQ ID NO: 23000 - RNA, 19 nt, artificial
  Oligomer
agacaguauuuugacaaaa

SEQ ID NO: 23001 - RNA, 19 nt, artificial
  Oligomer
caccgagcacugaacuuug

SEQ ID NO: 23002 - RNA, 19 nt, artificial
  Oligomer
ugacuuaauaaauccuuga

SEQ ID NO: 23003 - RNA, 19 nt, artificial
  Oligomer
aaaccauuuuuugaaccaa

SEQ ID NO: 23004 - RNA, 19 nt, artificial
  Oligomer
gucccaacacucccaucau

SEQ ID NO: 23005 - RNA, 19 nt, artificial
  Oligomer
aagguuuuguuuguucuaa

SEQ ID NO: 23006 - RNA, 19 nt, artificial
  Oligomer
guccugcaucauuugaaaa

SEQ ID NO: 23007 - RNA, 19 nt, artificial
  Oligomer
augaaagugucacggguaa

SEQ ID NO: 23008 - RNA, 19 nt, artificial
  Oligomer
gguaaaaacucuaaaaggu

SEQ ID NO: 23009 - RNA, 19 nt, artificial
  Oligomer
aaaagugcuuuccauguua

SEQ ID NO: 23010 - RNA, 19 nt, artificial
  Oligomer
uaguaacuagguguaaaaa

SEQ ID NO: 23011 - RNA, 19 nt, artificial
  Oligomer
aaacaagaaucucagugua

SEQ ID NO: 23012 - RNA, 19 nt, artificial
  Oligomer
cccgugaagaagaggaaga

SEQ ID NO: 23013 - RNA, 19 nt, artificial
  Oligomer
uaagguuuuguuuguucua

SEQ ID NO: 23014 - RNA, 19 nt, artificial
  Oligomer
aaccauuuuuugaaccaau

SEQ ID NO: 23015 - RNA, 19 nt, artificial
  Oligomer
ugcggagauuuugaacaga

SEQ ID NO: 23016 - RNA, 19 nt, artificial
  Oligomer
gagcaauaugccuccuugu

SEQ ID NO: 23017 - RNA, 19 nt, artificial
  Oligomer
uggaguguuuuuacauuga

SEQ ID NO: 23018 - RNA, 19 nt, artificial
  Oligomer
cggguaaaaacucuaaaag

SEQ ID NO: 23019 - RNA, 19 nt, artificial
  Oligomer
ccuccuuguauuauaaaau

SEQ ID NO: 23020 - RNA, 19 nt, artificial
  Oligomer
ugucaaaugcaguagauga

SEQ ID NO: 23021 - RNA, 19 nt, artificial
  Oligomer
ucacggguaaaaacucuaa

SEQ ID NO: 23022 - RNA, 19 nt, artificial
  Oligomer
cugcaucauuugaaaaugu

SEQ ID NO: 23023 - RNA, 19 nt, artificial
  Oligomer
caaaugcaguagaugauga

SEQ ID NO: 23024 - RNA, 19 nt, artificial
  Oligomer
gcaauaugccuccuuguau

SEQ ID NO: 23025 - RNA, 19 nt, artificial
  Oligomer
ucuguuagucgcuaacuua

SEQ ID NO: 23026 - RNA, 19 nt, artificial
  Oligomer
aaggagauuggugcuguaa

SEQ ID NO: 23027 - RNA, 19 nt, artificial
  Oligomer
gucaaaugcaguagaugau

SEQ ID NO: 23028 - RNA, 19 nt, artificial
  Oligomer
aacuagguguaaaaaucau

SEQ ID NO: 23029 - RNA, 19 nt, artificial
  Oligomer
gcccuaaaaugacaagccu

SEQ ID NO: 23030 - RNA, 19 nt, artificial
  Oligomer
cacugaacuuugcaaagac

SEQ ID NO: 23031 - RNA, 19 nt, artificial
  Oligomer
ugcuagugcugacgauguu

SEQ ID NO: 23032 - RNA, 19 nt, artificial
  Oligomer
aagguuuuuuugucgauua

SEQ ID NO: 23033 - RNA, 19 nt, artificial
  Oligomer
guauuaucaggaaauguuu

SEQ ID NO: 23034 - RNA, 19 nt, artificial
  Oligomer
aaauuuagcccuaaaauga

SEQ ID NO: 23035 - RNA, 19 nt, artificial
  Oligomer
gaacugcuauuuccucuaa

SEQ ID NO: 23036 - RNA, 19 nt, artificial
  Oligomer
uaccgacacugucacuuga

SEQ ID NO: 23037 - RNA, 19 nt, artificial
  Oligomer
ccuagugggaacuaaacuu

SEQ ID NO: 23038 - RNA, 19 nt, artificial
  Oligomer
caggaaauguuuucuuaag

SEQ ID NO: 23039 - RNA, 19 nt, artificial
  Oligomer
aguguaacccgagcaaaau

SEQ ID NO: 23040 - RNA, 19 nt, artificial
  Oligomer
uuaaaauuuagcccuaaaa

SEQ ID NO: 23041 - RNA, 19 nt, artificial
  Oligomer
ccacuacaacagaauuuuu

SEQ ID NO: 23042 - RNA, 19 nt, artificial
  Oligomer
gugcuguaaaauaccugga

SEQ ID NO: 23043 - RNA, 19 nt, artificial
  Oligomer
caguuaggaggugcagaca

SEQ ID NO: 23044 - RNA, 19 nt, artificial
  Oligomer
cucuaaugaagaauucugu

SEQ ID NO: 23045 - RNA, 19 nt, artificial
  Oligomer
guugcagcuuuauaguuuu

SEQ ID NO: 23046 - RNA, 19 nt, artificial
  Oligomer
uguaguucucagaugcgua

SEQ ID NO: 23047 - RNA, 19 nt, artificial
  Oligomer
uaaauugacaguugcagaa

SEQ ID NO: 23048 - RNA, 19 nt, artificial
  Oligomer
agguuaauuucugucaaau

SEQ ID NO: 23049 - RNA, 19 nt, artificial
  Oligomer
gcuguaaaauaccuggagu

SEQ ID NO: 23050 - RNA, 19 nt, artificial
  Oligomer
gucucagcguugcuuguau

SEQ ID NO: 23051 - RNA, 19 nt, artificial
  Oligomer
gugcugacgauguucugua

SEQ ID NO: 23052 - RNA, 19 nt, artificial
  Oligomer
acauuguacaaggaaugaa

SEQ ID NO: 23053 - RNA, 19 nt, artificial
  Oligomer
cauuuccuggagaauauau

SEQ ID NO: 23054 - RNA, 19 nt, artificial
  Oligomer
ugugaguccugcaucauuu

SEQ ID NO: 23055 - RNA, 19 nt, artificial
  Oligomer
uggugggagacggaaacaa

SEQ ID NO: 23056 - RNA, 19 nt, artificial
  Oligomer
cucacauucuauuaaaauu

SEQ ID NO: 23057 - RNA, 19 nt, artificial
  Oligomer
uaugccuccuuguauuaua

SEQ ID NO: 23058 - RNA, 19 nt, artificial
  Oligomer
uacuuuauucagagcuaau

SEQ ID NO: 23059 - RNA, 19 nt, artificial
  Oligomer
ggacaaagacaguauuuug

SEQ ID NO: 23060 - RNA, 19 nt, artificial
  Oligomer
cugcuauuuccucuaauga

SEQ ID NO: 23061 - RNA, 19 nt, artificial
  Oligomer
ucaagacaguguuugacga

SEQ ID NO: 23062 - RNA, 19 nt, artificial
  Oligomer
caaaggacaaagacaguau

SEQ ID NO: 23063 - RNA, 19 nt, artificial
  Oligomer
aagaaagguugguauuauc

SEQ ID NO: 23064 - RNA, 19 nt, artificial
  Oligomer
gacacgaucgagaaacuga

SEQ ID NO: 23065 - RNA, 19 nt, artificial
  Oligomer
agaugaugaaagaaagguu

SEQ ID NO: 23066 - RNA, 19 nt, artificial
  Oligomer
ucauccuagugggaacuaa

SEQ ID NO: 23067 - RNA, 19 nt, artificial
  Oligomer
cgagaaacugaaggagaag

SEQ ID NO: 23068 - RNA, 19 nt, artificial
  Oligomer
gguucuguaaacugugcua

SEQ ID NO: 23069 - RNA, 19 nt, artificial
  Oligomer
aacuuuuuguuacagauua

SEQ ID NO: 23070 - RNA, 19 nt, artificial
  Oligomer
agucgcuuugccuauugau

SEQ ID NO: 23071 - RNA, 19 nt, artificial
  Oligomer
agagaaaaugccugcuguu

SEQ ID NO: 23072 - RNA, 19 nt, artificial
  Oligomer
uaaagacacgaucgagaaa

SEQ ID NO: 23073 - RNA, 19 nt, artificial
  Oligomer
uuauguuuugcauguauga

SEQ ID NO: 23074 - RNA, 19 nt, artificial
  Oligomer
cauucuuguucagauuaag

SEQ ID NO: 23075 - RNA, 19 nt, artificial
  Oligomer
aaugaaagugucacgggua

SEQ ID NO: 23076 - RNA, 19 nt, artificial
  Oligomer
ucucagcguugcuuguaua

SEQ ID NO: 23077 - RNA, 19 nt, artificial
  Oligomer
uaguaaaagugcuuuccau

SEQ ID NO: 23078 - RNA, 19 nt, artificial
  Oligomer
uauagagcuguagguaaaa

SEQ ID NO: 23079 - RNA, 19 nt, artificial
  Oligomer
aaugaagaauucuguuuag

SEQ ID NO: 23080 - RNA, 19 nt, artificial
  Oligomer
agcagcucagcucuuugga

SEQ ID NO: 23081 - RNA, 19 nt, artificial
  Oligomer
uugaaaauguccgugcaaa

SEQ ID NO: 23082 - RNA, 19 nt, artificial
  Oligomer
ugcuguuguaaaugucuca

SEQ ID NO: 23083 - RNA, 19 nt, artificial
  Oligomer
cuggacaagaagauuauga

SEQ ID NO: 23084 - RNA, 19 nt, artificial
  Oligomer
gcacugaacuuugcaaaga

SEQ ID NO: 23085 - RNA, 19 nt, artificial
  Oligomer
agaaagguugguauuauca

SEQ ID NO: 23086 - RNA, 19 nt, artificial
  Oligomer
caagccuucuuaaagccuu

SEQ ID NO: 23087 - RNA, 19 nt, artificial
  Oligomer
gguauuaucaggaaauguu

SEQ ID NO: 23088 - RNA, 19 nt, artificial
  Oligomer
ccaaugcauuuccuggaga

SEQ ID NO: 23089 - RNA, 19 nt, artificial
  Oligomer
ugaaagugucacggguaaa

SEQ ID NO: 23090 - RNA, 19 nt, artificial
  Oligomer
ugccuccuuguauuauaaa

SEQ ID NO: 23091 - RNA, 19 nt, artificial
  Oligomer
ggcuaaggagauuggugcu

SEQ ID NO: 23092 - RNA, 19 nt, artificial
  Oligomer
uuuuuugucgauuaguaaa

SEQ ID NO: 23093 - RNA, 19 nt, artificial
  Oligomer
agaggaagagaaaaugccu

SEQ ID NO: 23094 - RNA, 19 nt, artificial
  Oligomer
uguauagagcuguagguaa

SEQ ID NO: 23095 - RNA, 19 nt, artificial
  Oligomer
gaugaaagaaagguuggua

SEQ ID NO: 23096 - RNA, 19 nt, artificial
  Oligomer
uaacuagguguaaaaauca

SEQ ID NO: 23097 - RNA, 19 nt, artificial
  Oligomer
gcuaaugcaauuagcauua

SEQ ID NO: 23098 - RNA, 19 nt, artificial
  Oligomer
ccgugaagaagaggaagag

SEQ ID NO: 23099 - RNA, 19 nt, artificial
  Oligomer
aauugggcauuuaauucau

SEQ ID NO: 23100 - RNA, 19 nt, artificial
  Oligomer
ucaguguaacccgagcaaa

SEQ ID NO: 23101 - RNA, 19 nt, artificial
  Oligomer
cuucugaacuacacugcau

SEQ ID NO: 23102 - RNA, 19 nt, artificial
  Oligomer
ugaaaauguccgugcaaag

SEQ ID NO: 23103 - RNA, 19 nt, artificial
  Oligomer
agcaauaugccuccuugua

SEQ ID NO: 23104 - RNA, 19 nt, artificial
  Oligomer
gagaagaagcugacuccca

SEQ ID NO: 23105 - RNA, 19 nt, artificial
  Oligomer
ugcuuuccuuaguuuucua

SEQ ID NO: 23106 - RNA, 19 nt, artificial
  Oligomer
gaagaauucuguuuagcug

SEQ ID NO: 23107 - RNA, 19 nt, artificial
  Oligomer
ggguaaaaacucuaaaagg

SEQ ID NO: 23108 - RNA, 19 nt, artificial
  Oligomer
gcuaauaagugcuuuccuu

SEQ ID NO: 23109 - RNA, 19 nt, artificial
  Oligomer
gucgauuaguaaaagugcu

SEQ ID NO: 23110 - RNA, 19 nt, artificial
  Oligomer
agagcuguagguaaaacuu

SEQ ID NO: 23111 - RNA, 19 nt, artificial
  Oligomer
uuuggaucagucuuuguga

SEQ ID NO: 23112 - RNA, 19 nt, artificial
  Oligomer
cuucuuaaagccuuauuuu

SEQ ID NO: 23113 - RNA, 19 nt, artificial
  Oligomer
ggaucagucuuugugauuu

SEQ ID NO: 23114 - RNA, 19 nt, artificial
  Oligomer
ggagauuuacacuacauug

SEQ ID NO: 23115 - RNA, 19 nt, artificial
  Oligomer
uucucagaugcguaaagca

SEQ ID NO: 23116 - RNA, 19 nt, artificial
  Oligomer
aacugaaggagaagaagcu

SEQ ID NO: 23117 - RNA, 19 nt, artificial
  Oligomer
cauuguugugccgagaaca

SEQ ID NO: 23118 - RNA, 19 nt, artificial
  Oligomer
cagugaguuagcagcacgu

SEQ ID NO: 23119 - RNA, 19 nt, artificial
  Oligomer
gcguaaagcagaacagccu

SEQ ID NO: 23120 - RNA, 19 nt, artificial
  Oligomer
uaaugaagaauucuguuua

SEQ ID NO: 23121 - RNA, 19 nt, artificial
  Oligomer
ucccuacugucuuugacaa

SEQ ID NO: 23122 - RNA, 19 nt, artificial
  Oligomer
gaucuuuugcuaaugcaau

SEQ ID NO: 23123 - RNA, 19 nt, artificial
  Oligomer
cuccuauguaguucucaga

SEQ ID NO: 23124 - RNA, 19 nt, artificial
  Oligomer
gaggccucaagacaguguu

SEQ ID NO: 23125 - RNA, 19 nt, artificial
  Oligomer
cagaauuuuuuaaauugac

SEQ ID NO: 23126 - RNA, 19 nt, artificial
  Oligomer
acaaggaaugaaaguguca

SEQ ID NO: 23127 - RNA, 19 nt, artificial
  Oligomer
ccggugaaucugggcuuau

SEQ ID NO: 23128 - RNA, 19 nt, artificial
  Oligomer
gaagacgguagcuucugca

SEQ ID NO: 23129 - RNA, 19 nt, artificial
  Oligomer
ccuuguauuauaaaaucuu

SEQ ID NO: 23130 - RNA, 19 nt, artificial
  Oligomer
uauuaaaauuuagcccuaa

SEQ ID NO: 23131 - RNA, 19 nt, artificial
  Oligomer
caauuagcauuauguuuug

SEQ ID NO: 23132 - RNA, 19 nt, artificial
  Oligomer
gguuaauuucugucaaaug

SEQ ID NO: 23133 - RNA, 19 nt, artificial
  Oligomer
agcaaaaucgcgcgucuca

SEQ ID NO: 23134 - RNA, 19 nt, artificial
  Oligomer
aguaacuagguguaaaaau

SEQ ID NO: 23135 - RNA, 19 nt, artificial
  Oligomer
ccaacacucccaucauccu

SEQ ID NO: 23136 - RNA, 19 nt, artificial
  Oligomer
uguucuaaauguaagaguu

SEQ ID NO: 23137 - RNA, 19 nt, artificial
  Oligomer
caguauuuugacaaaauac

SEQ ID NO: 23138 - RNA, 19 nt, artificial
  Oligomer
uguggaguguuuuuacauu

SEQ ID NO: 23139 - RNA, 19 nt, artificial
  Oligomer
cgcuaacuuaguaagugcu

SEQ ID NO: 23140 - RNA, 19 nt, artificial
  Oligomer
ccuguuucucugcaguuuu

SEQ ID NO: 23141 - RNA, 19 nt, artificial
  Oligomer
uuugaaaauguccgugcaa

SEQ ID NO: 23142 - RNA, 19 nt, artificial
  Oligomer
guugguauuaucaggaaau

SEQ ID NO: 23143 - RNA, 19 nt, artificial
  Oligomer
cccuaaaaugacaagccuu

SEQ ID NO: 23144 - RNA, 19 nt, artificial
  Oligomer
cuuaugggauacagcugga

SEQ ID NO: 23145 - RNA, 19 nt, artificial
  Oligomer
guaaaacuugccuacugau

SEQ ID NO: 23146 - RNA, 19 nt, artificial
  Oligomer
aagaagaggaagagaaaau

SEQ ID NO: 23147 - RNA, 19 nt, artificial
  Oligomer
uuaaagccuuauuuuucaa

SEQ ID NO: 23148 - RNA, 19 nt, artificial
  Oligomer
cugcauuguugugccgaga

SEQ ID NO: 23149 - RNA, 19 nt, artificial
  Oligomer
agguuuuuuugucgauuag

SEQ ID NO: 23150 - RNA, 19 nt, artificial
  Oligomer
ucugucaaaugcaguagau

SEQ ID NO: 23151 - RNA, 19 nt, artificial
  Oligomer
gaauuguggaguguuuuua

SEQ ID NO: 23152 - RNA, 19 nt, artificial
  Oligomer
aaaaacucuaaaagguuaa

SEQ ID NO: 23153 - RNA, 19 nt, artificial
  Oligomer
cauguuacuuuauucagag

SEQ ID NO: 23154 - RNA, 19 nt, artificial
  Oligomer
ccuguagucgcuuugccua

SEQ ID NO: 23155 - RNA, 19 nt, artificial
  Oligomer
acaguugcagaauugugga

SEQ ID NO: 23156 - RNA, 19 nt, artificial
  Oligomer
auaaagacacgaucgagaa

SEQ ID NO: 23157 - RNA, 19 nt, artificial
  Oligomer
cagaauuguggaguguuuu

SEQ ID NO: 23158 - RNA, 19 nt, artificial
  Oligomer
acuuaauaaauccuugaau

SEQ ID NO: 23159 - RNA, 19 nt, artificial
  Oligomer
agauggaaaaccggugaau

SEQ ID NO: 23160 - RNA, 19 nt, artificial
  Oligomer
gaaucugggcuuaugggau

SEQ ID NO: 23161 - RNA, 19 nt, artificial
  Oligomer
aauugacaguugcagaauu

SEQ ID NO: 23162 - RNA, 19 nt, artificial
  Oligomer
gacgauguucuguacaacu

SEQ ID NO: 23163 - RNA, 19 nt, artificial
  Oligomer
ucuuucugauaaugcauua

SEQ ID NO: 23164 - RNA, 19 nt, artificial
  Oligomer
uuggaucagucuuugugau

SEQ ID NO: 23165 - RNA, 19 nt, artificial
  Oligomer
uggagauuuacacuacauu

SEQ ID NO: 23166 - RNA, 19 nt, artificial
  Oligomer
gcugacucccaucaccuau

SEQ ID NO: 23167 - RNA, 19 nt, artificial
  Oligomer
guagcuucugcaguuagga

SEQ ID NO: 23168 - RNA, 19 nt, artificial
  Oligomer
uuuuugaaccaaucaguaa

SEQ ID NO: 23169 - RNA, 19 nt, artificial
  Oligomer
gugauuucauagcgaguuu

SEQ ID NO: 23170 - RNA, 19 nt, artificial
  Oligomer
agaugcguaaagcagaaca

SEQ ID NO: 23171 - RNA, 19 nt, artificial
  Oligomer
aaaggacaaagacaguauu

SEQ ID NO: 23172 - RNA, 19 nt, artificial
  Oligomer
uaagugcuuuucuuauaga

SEQ ID NO: 23173 - RNA, 19 nt, artificial
  Oligomer
gaaggagaagaagcugacu

SEQ ID NO: 23174 - RNA, 19 nt, artificial
  Oligomer
acuuuauucagagcuaaua

SEQ ID NO: 23175 - RNA, 19 nt, artificial
  Oligomer
auccuauccgcaaacagau

SEQ ID NO: 23176 - RNA, 19 nt, artificial
  Oligomer
agaagguuuuuuugucgau

SEQ ID NO: 23177 - RNA, 19 nt, artificial
  Oligomer
cuuuuuguuacagauuaau

SEQ ID NO: 23178 - RNA, 19 nt, artificial
  Oligomer
cugcaguuuuccucagcuu

SEQ ID NO: 23179 - RNA, 19 nt, artificial
  Oligomer
cuaauaagugcuuuccuua

SEQ ID NO: 23180 - RNA, 19 nt, artificial
  Oligomer
cuauuuccucuaaugaaga

SEQ ID NO: 23181 - RNA, 19 nt, artificial
  Oligomer
uuuuuugaaccaaucagua

SEQ ID NO: 23182 - RNA, 19 nt, artificial
  Oligomer
acaaaauacgaaguggaga

SEQ ID NO: 23183 - RNA, 19 nt, artificial
  Oligomer
gggaacuaaacuugaucuu

SEQ ID NO: 23184 - RNA, 19 nt, artificial
  Oligomer
auggaaaaccggugaaucu

SEQ ID NO: 23185 - RNA, 19 nt, artificial
  Oligomer
uugcuuguauagagcugua

SEQ ID NO: 23186 - RNA, 19 nt, artificial
  Oligomer
acuugaucuuagggaugau

SEQ ID NO: 23187 - RNA, 19 nt, artificial
  Oligomer
accggugaaucugggcuua

SEQ ID NO: 23188 - RNA, 19 nt, artificial
  Oligomer
aaccaaugcauuuccugga

SEQ ID NO: 23189 - RNA, 19 nt, artificial
  Oligomer
cguagcagcucagcucuuu

SEQ ID NO: 23190 - RNA, 19 nt, artificial
  Oligomer
cccauucuuguucagauua

SEQ ID NO: 23191 - RNA, 19 nt, artificial
  Oligomer
gaaacugaaggagaagaag

SEQ ID NO: 23192 - RNA, 19 nt, artificial
  Oligomer
auguaagaguucagacuca

SEQ ID NO: 23193 - RNA, 19 nt, artificial
  Oligomer
cuguacaacuuaacucacu

SEQ ID NO: 23194 - RNA, 19 nt, artificial
  Oligomer
gugugaucaaaggacaaag

SEQ ID NO: 23195 - RNA, 19 nt, artificial
  Oligomer
uaaaauuuagcccuaaaau

SEQ ID NO: 23196 - RNA, 19 nt, artificial
  Oligomer
gagaaacugaaggagaaga

SEQ ID NO: 23197 - RNA, 19 nt, artificial
  Oligomer
aauucaucuuuaaacuggu

SEQ ID NO: 23198 - RNA, 19 nt, artificial
  Oligomer
uaaacugguuguucuguua

SEQ ID NO: 23199 - RNA, 19 nt, artificial
  Oligomer
aagugucacggguaaaaac

SEQ ID NO: 23200 - RNA, 19 nt, artificial
  Oligomer
gaugcguaaagcagaacag

SEQ ID NO: 23201 - RNA, 19 nt, artificial
  Oligomer
ugaagaauucuguuuagcu

SEQ ID NO: 23202 - RNA, 19 nt, artificial
  Oligomer
auuugaaaauguccgugca

SEQ ID NO: 23203 - RNA, 19 nt, artificial
  Oligomer
caccagugaguuagcagca

SEQ ID NO: 23204 - RNA, 19 nt, artificial
  Oligomer
cugacugagcaauaugccu

SEQ ID NO: 23205 - RNA, 19 nt, artificial
  Oligomer
gguuguucuguuagucgcu

SEQ ID NO: 23206 - RNA, 19 nt, artificial
  Oligomer
uaguaagugcuuuucuuau

SEQ ID NO: 23207 - RNA, 19 nt, artificial
  Oligomer
guucagacucacauucuau

SEQ ID NO: 23208 - RNA, 19 nt, artificial
  Oligomer
aaucugggcuuaugggaua

SEQ ID NO: 23209 - RNA, 19 nt, artificial
  Oligomer
uuacauugaucuuuugcua

SEQ ID NO: 23210 - RNA, 19 nt, artificial
  Oligomer
uucccuugugaguccugca

SEQ ID NO: 23211 - RNA, 19 nt, artificial
  Oligomer
caauacugacccucuuuac

SEQ ID NO: 23212 - RNA, 19 nt, artificial
  Oligomer
uauuuccucuaaugaagaa

SEQ ID NO: 23213 - RNA, 19 nt, artificial
  Oligomer
auacagcuggacaagaaga

SEQ ID NO: 23214 - RNA, 19 nt, artificial
  Oligomer
ccagcuuuugcggagauuu

SEQ ID NO: 23215 - RNA, 19 nt, artificial
  Oligomer
ccaucauccuagugggaac

SEQ ID NO: 23216 - RNA, 19 nt, artificial
  Oligomer
augcauuuccuggagaaua

SEQ ID NO: 23217 - RNA, 19 nt, artificial
  Oligomer
cccuacugucuuugacaau

SEQ ID NO: 23218 - RNA, 19 nt, artificial
  Oligomer
ggaaauguuuucuuaagcu

SEQ ID NO: 23219 - RNA, 19 nt, artificial
  Oligomer
aagacacgaucgagaaacu

SEQ ID NO: 23220 - RNA, 19 nt, artificial
  Oligomer
cuaaaagguuaauuucugu

SEQ ID NO: 23221 - RNA, 19 nt, artificial
  Oligomer
gucacggguaaaaacucua

SEQ ID NO: 23222 - RNA, 19 nt, artificial
  Oligomer
cugucacuugaccaauacu

SEQ ID NO: 23223 - RNA, 19 nt, artificial
  Oligomer
gagauuuacacuacauugu

SEQ ID NO: 23224 - RNA, 19 nt, artificial
  Oligomer
cacgaucgagaaacugaag

SEQ ID NO: 23225 - RNA, 19 nt, artificial
  Oligomer
aggccucaagacaguguuu

SEQ ID NO: 23226 - RNA, 19 nt, artificial
  Oligomer
ugaaagaaagguugguauu

SEQ ID NO: 23227 - RNA, 19 nt, artificial
  Oligomer
gaaagguugguauuaucag

SEQ ID NO: 23228 - RNA, 19 nt, artificial
  Oligomer
uuaaauugacaguugcaga

SEQ ID NO: 23229 - RNA, 19 nt, artificial
  Oligomer
ccugcaucauuugaaaaug

SEQ ID NO: 23230 - RNA, 19 nt, artificial
  Oligomer
gccuauugauguuccuuug

SEQ ID NO: 23231 - RNA, 19 nt, artificial
  Oligomer
cacaaccaaugcauuuccu

SEQ ID NO: 23232 - RNA, 19 nt, artificial
  Oligomer
gccuucuuaaagccuuauu

SEQ ID NO: 23233 - RNA, 19 nt, artificial
  Oligomer
aacaagaaucucaguguaa

SEQ ID NO: 23234 - RNA, 19 nt, artificial
  Oligomer
uuguucuguuagucgcuaa

SEQ ID NO: 23235 - RNA, 19 nt, artificial
  Oligomer
gaguuuucugaccagcuuu

SEQ ID NO: 23236 - RNA, 19 nt, artificial
  Oligomer
acagcuggacaagaagauu

SEQ ID NO: 23237 - RNA, 19 nt, artificial
  Oligomer
guuugacgaagcgauccga

SEQ ID NO: 23238 - RNA, 19 nt, artificial
  Oligomer
cugaaggagaagaagcuga

SEQ ID NO: 23239 - RNA, 19 nt, artificial
  Oligomer
gggcauuuaauucaucuuu

SEQ ID NO: 23240 - RNA, 19 nt, artificial
  Oligomer
cgucucagcguugcuugua

SEQ ID NO: 23241 - RNA, 19 nt, artificial
  Oligomer
ccuuaguuuucuaguaacu

SEQ ID NO: 23242 - RNA, 19 nt, artificial
  Oligomer
gguuuuuuugucgauuagu

SEQ ID NO: 23243 - RNA, 19 nt, artificial
  Oligomer
gcuggacaagaagauuaug

SEQ ID NO: 23244 - RNA, 19 nt, artificial
  Oligomer
uuugcauguaugacuuaau

SEQ ID NO: 23245 - RNA, 19 nt, artificial
  Oligomer
uuagcauuauguuuugcau

SEQ ID NO: 23246 - RNA, 19 nt, artificial
  Oligomer
uuuacacuacauuguacaa

SEQ ID NO: 23247 - RNA, 19 nt, artificial
  Oligomer
uguuccuuugggucuguga

SEQ ID NO: 23248 - RNA, 19 nt, artificial
  Oligomer
uagauggaaaaccggugaa

SEQ ID NO: 23249 - RNA, 19 nt, artificial
  Oligomer
aauguuaugguagauggaa

SEQ ID NO: 23250 - RNA, 19 nt, artificial
  Oligomer
guaugacuuaauaaauccu

SEQ ID NO: 23251 - RNA, 19 nt, artificial
  Oligomer
cuaaauguaagaguucaga

SEQ ID NO: 23252 - RNA, 19 nt, artificial
  Oligomer
cuguuagucgcuaacuuag

SEQ ID NO: 23253 - RNA, 19 nt, artificial
  Oligomer
uuuuugucgauuaguaaaa

SEQ ID NO: 23254 - RNA, 19 nt, artificial
  Oligomer
uuaguaagugcuuuucuua

SEQ ID NO: 23255 - RNA, 19 nt, artificial
  Oligomer
aucaggaaauguuuucuua

SEQ ID NO: 23256 - RNA, 19 nt, artificial
  Oligomer
uagucgcuuugccuauuga

SEQ ID NO: 23257 - RNA, 19 nt, artificial
  Oligomer
ccagauuaccgacacuguc

SEQ ID NO: 23258 - RNA, 19 nt, artificial
  Oligomer
aacuaaacuugaucuuagg

SEQ ID NO: 23259 - RNA, 19 nt, artificial
  Oligomer
cuguaauggagugagcgua

SEQ ID NO: 23260 - RNA, 19 nt, artificial
  Oligomer
uacagcuggacaagaagau

SEQ ID NO: 23261 - RNA, 19 nt, artificial
  Oligomer
uaaaaacucuaaaagguua

SEQ ID NO: 23262 - RNA, 19 nt, artificial
  Oligomer
guuuuuacauugaucuuuu

SEQ ID NO: 23263 - RNA, 19 nt, artificial
  Oligomer
ggugcuguaaaauaccugg

SEQ ID NO: 23264 - RNA, 19 nt, artificial
  Oligomer
uugugaguccugcaucauu

SEQ ID NO: 23265 - RNA, 19 nt, artificial
  Oligomer
aagccuuauuuuucaaaag

SEQ ID NO: 23266 - RNA, 19 nt, artificial
  Oligomer
ccugucccuuggaaccuuu

SEQ ID NO: 23267 - RNA, 19 nt, artificial
  Oligomer
uuuuacagcaccaaucucc

SEQ ID NO: 23268 - RNA, 19 nt, artificial
  Oligomer
uuaaaaacuauaaagcugc

SEQ ID NO: 23269 - RNA, 19 nt, artificial
  Oligomer
uuuugcucggguuacacug

SEQ ID NO: 23270 - RNA, 19 nt, artificial
  Oligomer
uaugaaaucacaaagacug

SEQ ID NO: 23271 - RNA, 19 nt, artificial
  Oligomer
uuuaguucccacuaggaug

SEQ ID NO: 23272 - RNA, 19 nt, artificial
  Oligomer
uuucauuccuuguacaaug

SEQ ID NO: 23273 - RNA, 19 nt, artificial
  Oligomer
uucuuguccagcuguaucc

SEQ ID NO: 23274 - RNA, 19 nt, artificial
  Oligomer
uuaaagaugaauuaaaugc

SEQ ID NO: 23275 - RNA, 19 nt, artificial
  Oligomer
uuuauuaagucauacaugc

SEQ ID NO: 23276 - RNA, 19 nt, artificial
  Oligomer
uuucaaaugaugcaggacu

SEQ ID NO: 23277 - RNA, 19 nt, artificial
  Oligomer
uaaucugucauaaucuucu

SEQ ID NO: 23278 - RNA, 19 nt, artificial
  Oligomer
uuuuaauagaaugugaguc

SEQ ID NO: 23279 - RNA, 19 nt, artificial
  Oligomer
uuuaaaaacuauaaagcug

SEQ ID NO: 23280 - RNA, 19 nt, artificial
  Oligomer
uugcaaaguucagugcucg

SEQ ID NO: 23281 - RNA, 19 nt, artificial
  Oligomer
uuuacagcaccaaucuccu

SEQ ID NO: 23282 - RNA, 19 nt, artificial
  Oligomer
uucuguucaaaaucuccgc

SEQ ID NO: 23283 - RNA, 19 nt, artificial
  Oligomer
uuuagaacaaacaaaaccu

SEQ ID NO: 23284 - RNA, 19 nt, artificial
  Oligomer
uuucucuuccucuucuuca

SEQ ID NO: 23285 - RNA, 19 nt, artificial
  Oligomer
uaaguuguacagaacaucg

SEQ ID NO: 23286 - RNA, 19 nt, artificial
  Oligomer
uuuaucaucccuaagauca

SEQ ID NO: 23287 - RNA, 19 nt, artificial
  Oligomer
uuaaucugaacaagaaugg

SEQ ID NO: 23288 - RNA, 19 nt, artificial
  Oligomer
uucaguuucucgaucgugu

SEQ ID NO: 23289 - RNA, 19 nt, artificial
  Oligomer
ugucauaaucuucuugucc

SEQ ID NO: 23290 - RNA, 19 nt, artificial
  Oligomer
ugaugcaggacucacaagg

SEQ ID NO: 23291 - RNA, 19 nt, artificial
  Oligomer
uucuccaggaaaugcauug

SEQ ID NO: 23292 - RNA, 19 nt, artificial
  Oligomer
uacaacagcaggcauuuuc

SEQ ID NO: 23293 - RNA, 19 nt, artificial
  Oligomer
ucuuucaucaucuacugca

SEQ ID NO: 23294 - RNA, 19 nt, artificial
  Oligomer
uuuuacaccuaguuacuag

SEQ ID NO: 23295 - RNA, 19 nt, artificial
  Oligomer
uuaagaaggcuugucauuu

SEQ ID NO: 23296 - RNA, 19 nt, artificial
  Oligomer
ucugaauaaaguaacaugg

SEQ ID NO: 23297 - RNA, 19 nt, artificial
  Oligomer
ucaaacacugucuugaggc

SEQ ID NO: 23298 - RNA, 19 nt, artificial
  Oligomer
auuaaaugcccaauuuggg

SEQ ID NO: 23299 - RNA, 19 nt, artificial
  Oligomer
auuuauuaagucauacaug

SEQ ID NO: 23300 - RNA, 19 nt, artificial
  Oligomer
uuaaguuguacagaacauc

SEQ ID NO: 23301 - RNA, 19 nt, artificial
  Oligomer
uucuccuucaguuucucga

SEQ ID NO: 23302 - RNA, 19 nt, artificial
  Oligomer
uuuagaguuuuuacccgug

SEQ ID NO: 23303 - RNA, 19 nt, artificial
  Oligomer
uagggauauauucuccagg

SEQ ID NO: 23304 - RNA, 19 nt, artificial
  Oligomer
ucuuguuuccgucucccac

SEQ ID NO: 23305 - RNA, 19 nt, artificial
  Oligomer
uuuccugauaauaccaacc

SEQ ID NO: 23306 - RNA, 19 nt, artificial
  Oligomer
uuaaucuguaacaaaaagu

SEQ ID NO: 23307 - RNA, 19 nt, artificial
  Oligomer
uuuuagaguuuuuacccgu

SEQ ID NO: 23308 - RNA, 19 nt, artificial
  Oligomer
uuuaauagaaugugagucu

SEQ ID NO: 23309 - RNA, 19 nt, artificial
  Oligomer
uuuucucuuccucuucuuc

SEQ ID NO: 23310 - RNA, 19 nt, artificial
  Oligomer
uacagcaccaaucuccuua

SEQ ID NO: 23311 - RNA, 19 nt, artificial
  Oligomer
guucuguucaaaaucuccg

SEQ ID NO: 23312 - RNA, 19 nt, artificial
  Oligomer
uuugacagaaauuaaccuu

SEQ ID NO: 23313 - RNA, 19 nt, artificial
  Oligomer
uucagugcucgguguucuc

SEQ ID NO: 23314 - RNA, 19 nt, artificial
  Oligomer
uuaaaauuacugauugguu

SEQ ID NO: 23315 - RNA, 19 nt, artificial
  Oligomer
uucuauaagaaaagcacuu

SEQ ID NO: 23316 - RNA, 19 nt, artificial
  Oligomer
uuucuuucaucaucuacug

SEQ ID NO: 23317 - RNA, 19 nt, artificial
  Oligomer
uuuuauaauacaaggaggc

SEQ ID NO: 23318 - RNA, 19 nt, artificial
  Oligomer
uauuggucaagugacagug

SEQ ID NO: 23319 - RNA, 19 nt, artificial
  Oligomer
uucaucaucuacugcauuu

SEQ ID NO: 23320 - RNA, 19 nt, artificial
  Oligomer
uuaugucgggaacacgugc

SEQ ID NO: 23321 - RNA, 19 nt, artificial
  Oligomer
uucugcuuuacgcaucuga

SEQ ID NO: 23322 - RNA, 19 nt, artificial
  Oligomer
uuauuagcucugaauaaag

SEQ ID NO: 23323 - RNA, 19 nt, artificial
  Oligomer
uaaaauuacugauugguuc

SEQ ID NO: 23324 - RNA, 19 nt, artificial
  Oligomer
uucuaaugcauuaucagaa

SEQ ID NO: 23325 - RNA, 19 nt, artificial
  Oligomer
uuuaccuacagcucuauac

SEQ ID NO: 23326 - RNA, 19 nt, artificial
  Oligomer
ucugucauaaucuucuugu

SEQ ID NO: 23327 - RNA, 19 nt, artificial
  Oligomer
uccaucuaccauaacauug

SEQ ID NO: 23328 - RNA, 19 nt, artificial
  Oligomer
uauauucuccaggaaaugc

SEQ ID NO: 23329 - RNA, 19 nt, artificial
  Oligomer
auuuagaacaaacaaaacc

SEQ ID NO: 23330 - RNA, 19 nt, artificial
  Oligomer
uaaggcuuuaagaaggcuu

SEQ ID NO: 23331 - RNA, 19 nt, artificial
  Oligomer
uucaaaugaugcaggacuc

SEQ ID NO: 23332 - RNA, 19 nt, artificial
  Oligomer
uuauggaaaaauuaaucug

SEQ ID NO: 23333 - RNA, 19 nt, artificial
  Oligomer
uuguacagaacaucgucag

SEQ ID NO: 23334 - RNA, 19 nt, artificial
  Oligomer
uauuuugucaaaauacugu

SEQ ID NO: 23335 - RNA, 19 nt, artificial
  Oligomer
uucuuucaucaucuacugc

SEQ ID NO: 23336 - RNA, 19 nt, artificial
  Oligomer
aucaaguuuaguucccacu

SEQ ID NO: 23337 - RNA, 19 nt, artificial
  Oligomer
uugacagaaauuaaccuuu

SEQ ID NO: 23338 - RNA, 19 nt, artificial
  Oligomer
uaguucagaagguauuuug

SEQ ID NO: 23339 - RNA, 19 nt, artificial
  Oligomer
uguaguguaaaucuccacu

SEQ ID NO: 23340 - RNA, 19 nt, artificial
  Oligomer
uuaagaagguucauaguuu

SEQ ID NO: 23341 - RNA, 19 nt, artificial
  Oligomer
ucguauuuugucaaaauac

SEQ ID NO: 23342 - RNA, 19 nt, artificial
  Oligomer
uagaaugugagucugaacu

SEQ ID NO: 23343 - RNA, 19 nt, artificial
  Oligomer
uucaaggauuuauuaaguc

SEQ ID NO: 23344 - RNA, 19 nt, artificial
  Oligomer
uuuuacccgugacacuuuc

SEQ ID NO: 23345 - RNA, 19 nt, artificial
  Oligomer
uauuuuacagcaccaaucu

SEQ ID NO: 23346 - RNA, 19 nt, artificial
  Oligomer
aaacacuccacaauucugc

SEQ ID NO: 23347 - RNA, 19 nt, artificial
  Oligomer
ugcaaaguucagugcucgg

SEQ ID NO: 23348 - RNA, 19 nt, artificial
  Oligomer
augggagucagcuucuucu

SEQ ID NO: 23349 - RNA, 19 nt, artificial
  Oligomer
uucgucaaacacugucuug

SEQ ID NO: 23350 - RNA, 19 nt, artificial
  Oligomer
uucucaaagacgaaggucu

SEQ ID NO: 23351 - RNA, 19 nt, artificial
  Oligomer
auaaucuucuuguccagcu

SEQ ID NO: 23352 - RNA, 19 nt, artificial
  Oligomer
uaaagaugaauuaaaugcc

SEQ ID NO: 23353 - RNA, 19 nt, artificial
  Oligomer
uguuaugucgggaacacgu

SEQ ID NO: 23354 - RNA, 19 nt, artificial
  Oligomer
aauuaaaugcccaauuugg

SEQ ID NO: 23355 - RNA, 19 nt, artificial
  Oligomer
ucucuuccucuucuucacg

SEQ ID NO: 23356 - RNA, 19 nt, artificial
  Oligomer
uccacuucguauuuuguca

SEQ ID NO: 23357 - RNA, 19 nt, artificial
  Oligomer
uuacagaaccucacagacc

SEQ ID NO: 23358 - RNA, 19 nt, artificial
  Oligomer
uacagaaccucacagaccc

SEQ ID NO: 23359 - RNA, 19 nt, artificial
  Oligomer
auauucuccaggaaaugca

SEQ ID NO: 23360 - RNA, 19 nt, artificial
  Oligomer
uucuuguuuccgucuccca

SEQ ID NO: 23361 - RNA, 19 nt, artificial
  Oligomer
uuugcaaaguucagugcuc

SEQ ID NO: 23362 - RNA, 19 nt, artificial
  Oligomer
ucaaaaucuccgcaaaagc

SEQ ID NO: 23363 - RNA, 19 nt, artificial
  Oligomer
uuuuccaucuaccauaaca

SEQ ID NO: 23364 - RNA, 19 nt, artificial
  Oligomer
aagagggucaguauugguc

SEQ ID NO: 23365 - RNA, 19 nt, artificial
  Oligomer
uucauucgggaggcuguuc

SEQ ID NO: 23366 - RNA, 19 nt, artificial
  Oligomer
uaaaucuccacuucguauu

SEQ ID NO: 23367 - RNA, 19 nt, artificial
  Oligomer
uuaauagaaugugagucug

SEQ ID NO: 23368 - RNA, 19 nt, artificial
  Oligomer
uuccucuucuucacgggag

SEQ ID NO: 23369 - RNA, 19 nt, artificial
  Oligomer
aucuguaacaaaaaguugg

SEQ ID NO: 23370 - RNA, 19 nt, artificial
  Oligomer
aaaaucuccgcaaaagcug

SEQ ID NO: 23371 - RNA, 19 nt, artificial
  Oligomer
ugagauucuuguuuccguc

SEQ ID NO: 23372 - RNA, 19 nt, artificial
  Oligomer
uuccuuguacaauguagug

SEQ ID NO: 23373 - RNA, 19 nt, artificial
  Oligomer
uacuaaguuagcgacuaac

SEQ ID NO: 23374 - RNA, 19 nt, artificial
  Oligomer
ugcauuaucagaaagauuu

SEQ ID NO: 23375 - RNA, 19 nt, artificial
  Oligomer
ucaaagacgaaggucuuug

SEQ ID NO: 23376 - RNA, 19 nt, artificial
  Oligomer
aucgucagcacuagcacag

SEQ ID NO: 23377 - RNA, 19 nt, artificial
  Oligomer
uucuucuccuucaguuucu

SEQ ID NO: 23378 - RNA, 19 nt, artificial
  Oligomer
uuuaagaaggcuugucauu

SEQ ID NO: 23379 - RNA, 19 nt, artificial
  Oligomer
aguguaaaucuccacuucg

SEQ ID NO: 23380 - RNA, 19 nt, artificial
  Oligomer
uauuaagucauacaugcaa

SEQ ID NO: 23381 - RNA, 19 nt, artificial
  Oligomer
ucauucgggaggcuguucu

SEQ ID NO: 23382 - RNA, 19 nt, artificial
  Oligomer
aucgcuucgucaaacacug

SEQ ID NO: 23383 - RNA, 19 nt, artificial
  Oligomer
guauuuuacagcaccaauc

SEQ ID NO: 23384 - RNA, 19 nt, artificial
  Oligomer
ucaguaggcaaguuuuacc

SEQ ID NO: 23385 - RNA, 19 nt, artificial
  Oligomer
auucuuguuuccgucuccc

SEQ ID NO: 23386 - RNA, 19 nt, artificial
  Oligomer
uucaaaaaaugguuuuaug

SEQ ID NO: 23387 - RNA, 19 nt, artificial
  Oligomer
uacuaaucgacaaaaaaac

SEQ ID NO: 23388 - RNA, 19 nt, artificial
  Oligomer
ugucaaaauacugucuuug

SEQ ID NO: 23389 - RNA, 19 nt, artificial
  Oligomer
ucaaaaaaugguuuuaugg

SEQ ID NO: 23390 - RNA, 19 nt, artificial
  Oligomer
uccuucaguuucucgaucg

SEQ ID NO: 23391 - RNA, 19 nt, artificial
  Oligomer
aucugucauaaucuucuug

SEQ ID NO: 23392 - RNA, 19 nt, artificial
  Oligomer
ucauaguuuaagaauuauc

SEQ ID NO: 23393 - RNA, 19 nt, artificial
  Oligomer
uguaagagaaaggaaaagc

SEQ ID NO: 23394 - RNA, 19 nt, artificial
  Oligomer
aucaauguaaaaacacucc

SEQ ID NO: 23395 - RNA, 19 nt, artificial
  Oligomer
aagcuggucagaaaacucg

SEQ ID NO: 23396 - RNA, 19 nt, artificial
  Oligomer
auauugcucagucagaagg

SEQ ID NO: 23397 - RNA, 19 nt, artificial
  Oligomer
ucuuacauuuagaacaaac

SEQ ID NO: 23398 - RNA, 19 nt, artificial
  Oligomer
uuauaauacaaggaggcau

SEQ ID NO: 23399 - RNA, 19 nt, artificial
  Oligomer
uaaucuucuuguccagcug

SEQ ID NO: 23400 - RNA, 19 nt, artificial
  Oligomer
uucucuuccucuucuucac

SEQ ID NO: 23401 - RNA, 19 nt, artificial
  Oligomer
auuuugucaaaauacuguc

SEQ ID NO: 23402 - RNA, 19 nt, artificial
  Oligomer
ucugcuuuacgcaucugag

SEQ ID NO: 23403 - RNA, 19 nt, artificial
  Oligomer
auguuaagaagguucauag

SEQ ID NO: 23404 - RNA, 19 nt, artificial
  Oligomer
uuacgcaucugagaacuac

SEQ ID NO: 23405 - RNA, 19 nt, artificial
  Oligomer
ugaaaaauaaggcuuuaag

SEQ ID NO: 23406 - RNA, 19 nt, artificial
  Oligomer
uuuccaucuaccauaacau

SEQ ID NO: 23407 - RNA, 19 nt, artificial
  Oligomer
uuaagaaaacauuuccuga

SEQ ID NO: 23408 - RNA, 19 nt, artificial
  Oligomer
uaggugaugggagucagcu

SEQ ID NO: 23409 - RNA, 19 nt, artificial
  Oligomer
uugcauuagcaaaagauca

SEQ ID NO: 23410 - RNA, 19 nt, artificial
  Oligomer
uucauuagaggaaauagca

SEQ ID NO: 23411 - RNA, 19 nt, artificial
  Oligomer
auccaaagagcugagcugc

SEQ ID NO: 23412 - RNA, 19 nt, artificial
  Oligomer
cuuucuuucaucaucuacu

SEQ ID NO: 23413 - RNA, 19 nt, artificial
  Oligomer
acccgugacacuuucauuc

SEQ ID NO: 23414 - RNA, 19 nt, artificial
  Oligomer
uucaaaaucuccgcaaaag

SEQ ID NO: 23415 - RNA, 19 nt, artificial
  Oligomer
cucuauacaagcaacgcug

SEQ ID NO: 23416 - RNA, 19 nt, artificial
  Oligomer
uuccugauaauaccaaccu

SEQ ID NO: 23417 - RNA, 19 nt, artificial
  Oligomer
uuguccagcuguaucccau

SEQ ID NO: 23418 - RNA, 19 nt, artificial
  Oligomer
uuaaaaaauucuguuguag

SEQ ID NO: 23419 - RNA, 19 nt, artificial
  Oligomer
uuuugaaaaauaaggcuuu

SEQ ID NO: 23420 - RNA, 19 nt, artificial
  Oligomer
uaauaccaaccuuucuuuc

SEQ ID NO: 23421 - RNA, 19 nt, artificial
  Oligomer
uuucaucaucuacugcauu

SEQ ID NO: 23422 - RNA, 19 nt, artificial
  Oligomer
uccuuguacaauguagugu

SEQ ID NO: 23423 - RNA, 19 nt, artificial
  Oligomer
ucaaguuuaguucccacua

SEQ ID NO: 23424 - RNA, 19 nt, artificial
  Oligomer
ugcaguguaguucagaagg

SEQ ID NO: 23425 - RNA, 19 nt, artificial
  Oligomer
uuugucaaaauacugucuu

SEQ ID NO: 23426 - RNA, 19 nt, artificial
  Oligomer
ugauugguucaaaaaaugg

SEQ ID NO: 23427 - RNA, 19 nt, artificial
  Oligomer
auguuaugucgggaacacg

SEQ ID NO: 23428 - RNA, 19 nt, artificial
  Oligomer
uuuuuacccgugacacuuu

SEQ ID NO: 23429 - RNA, 19 nt, artificial
  Oligomer
uagcucugaauaaaguaac

SEQ ID NO: 23430 - RNA, 19 nt, artificial
  Oligomer
ugucuuuguccuuugauca

SEQ ID NO: 23431 - RNA, 19 nt, artificial
  Oligomer
uuacaguacaauguuaugu

SEQ ID NO: 23432 - RNA, 19 nt, artificial
  Oligomer
ucacuggugaguucaaugg

SEQ ID NO: 23433 - RNA, 19 nt, artificial
  Oligomer
aauacaaggaggcauauug

SEQ ID NO: 23434 - RNA, 19 nt, artificial
  Oligomer
uacaauguaguguaaaucu

SEQ ID NO: 23435 - RNA, 19 nt, artificial
  Oligomer
guaaucugucauaaucuuc

SEQ ID NO: 23436 - RNA, 19 nt, artificial
  Oligomer
ucuuuguccuuugaucaca

SEQ ID NO: 23437 - RNA, 19 nt, artificial
  Oligomer
auaauaccaaccuuucuuu

SEQ ID NO: 23438 - RNA, 19 nt, artificial
  Oligomer
uauaagaaaagcacuuacu

SEQ ID NO: 23439 - RNA, 19 nt, artificial
  Oligomer
caggauaccacuuugcacg

SEQ ID NO: 23440 - RNA, 19 nt, artificial
  Oligomer
uaauugucaaagacaguag

SEQ ID NO: 23441 - RNA, 19 nt, artificial
  Oligomer
uacaguacaauguuauguc

SEQ ID NO: 23442 - RNA, 19 nt, artificial
  Oligomer
uguaaaucuccacuucgua

SEQ ID NO: 23443 - RNA, 19 nt, artificial
  Oligomer
uauugcucagucagaaggg

SEQ ID NO: 23444 - RNA, 19 nt, artificial
  Oligomer
ucaguauuggucaagugac

SEQ ID NO: 23445 - RNA, 19 nt, artificial
  Oligomer
aaauaaggcuuuaagaagg

SEQ ID NO: 23446 - RNA, 19 nt, artificial
  Oligomer
aucuccacuucguauuuug

SEQ ID NO: 23447 - RNA, 19 nt, artificial
  Oligomer
acugagauucuuguuuccg

SEQ ID NO: 23448 - RNA, 19 nt, artificial
  Oligomer
aagaaaagcacuuacuaag

SEQ ID NO: 23449 - RNA, 19 nt, artificial
  Oligomer
uuacuaaucgacaaaaaaa

SEQ ID NO: 23450 - RNA, 19 nt, artificial
  Oligomer
auguaguguaaaucuccac

SEQ ID NO: 23451 - RNA, 19 nt, artificial
  Oligomer
uacaaagguuccaagggac

SEQ ID NO: 23452 - RNA, 19 nt, artificial
  Oligomer
agugauguuaagaagguuc

SEQ ID NO: 23453 - RNA, 19 nt, artificial
  Oligomer
ucaggauaccacuuugcac

SEQ ID NO: 23454 - RNA, 19 nt, artificial
  Oligomer
uuggucaagugacaguguc

SEQ ID NO: 23455 - RNA, 19 nt, artificial
  Oligomer
uuuacagaaccucacagac

SEQ ID NO: 23456 - RNA, 19 nt, artificial
  Oligomer
uugcucggguuacacugag

SEQ ID NO: 23457 - RNA, 19 nt, artificial
  Oligomer
uauggaaaaauuaaucugu

SEQ ID NO: 23458 - RNA, 19 nt, artificial
  Oligomer
cauaagcccagauucaccg

SEQ ID NO: 23459 - RNA, 19 nt, artificial
  Oligomer
uuauuaagucauacaugca

SEQ ID NO: 23460 - RNA, 19 nt, artificial
  Oligomer
auuccuuguacaauguagu

SEQ ID NO: 23461 - RNA, 19 nt, artificial
  Oligomer
uagggcuaaauuuuaauag

SEQ ID NO: 23462 - RNA, 19 nt, artificial
  Oligomer
uuuacaacagcaggcauuu

SEQ ID NO: 23463 - RNA, 19 nt, artificial
  Oligomer
aguucuguucaaaaucucc

SEQ ID NO: 23464 - RNA, 19 nt, artificial
  Oligomer
uuacauuuagaacaaacaa

SEQ ID NO: 23465 - RNA, 19 nt, artificial
  Oligomer
uggucaagugacagugucg

SEQ ID NO: 23466 - RNA, 19 nt, artificial
  Oligomer
uucguauuuugucaaaaua

SEQ ID NO: 23467 - RNA, 19 nt, artificial
  Oligomer
auuuuacagcaccaaucuc

SEQ ID NO: 23468 - RNA, 19 nt, artificial
  Oligomer
auuuacaacagcaggcauu

SEQ ID NO: 23469 - RNA, 19 nt, artificial
  Oligomer
cuccacuucguauuuuguc

SEQ ID NO: 23470 - RNA, 19 nt, artificial
  Oligomer
uaugucgggaacacgugcu

SEQ ID NO: 23471 - RNA, 19 nt, artificial
  Oligomer
uuuacaccuaguuacuaga

SEQ ID NO: 23472 - RNA, 19 nt, artificial
  Oligomer
uuuagggcuaaauuuuaau

SEQ ID NO: 23473 - RNA, 19 nt, artificial
  Oligomer
uaaaguaacauggaaagca

SEQ ID NO: 23474 - RNA, 19 nt, artificial
  Oligomer
auaauugucaaagacagua

SEQ ID NO: 23475 - RNA, 19 nt, artificial
  Oligomer
ucaaaauacugucuuuguc

SEQ ID NO: 23476 - RNA, 19 nt, artificial
  Oligomer
ugacagugucgguaaucug

SEQ ID NO: 23477 - RNA, 19 nt, artificial
  Oligomer
uaaagagggucaguauugg

SEQ ID NO: 23478 - RNA, 19 nt, artificial
  Oligomer
agcuguaucccauaagccc

SEQ ID NO: 23479 - RNA, 19 nt, artificial
  Oligomer
cuaagaucaaguuuaguuc

SEQ ID NO: 23480 - RNA, 19 nt, artificial
  Oligomer
uaacugaucaguaggcaag

SEQ ID NO: 23481 - RNA, 19 nt, artificial
  Oligomer
auacaugcaaaacauaaug

SEQ ID NO: 23482 - RNA, 19 nt, artificial
  Oligomer
ucgcuaugaaaucacaaag

SEQ ID NO: 23483 - RNA, 19 nt, artificial
  Oligomer
aacaucaauaggcaaagcg

SEQ ID NO: 23484 - RNA, 19 nt, artificial
  Oligomer
aacugcagaagcuaccguc

SEQ ID NO: 23485 - RNA, 19 nt, artificial
  Oligomer
uacauuuagaacaaacaaa

SEQ ID NO: 23486 - RNA, 19 nt, artificial
  Oligomer
ucggguuacacugagauuc

SEQ ID NO: 23487 - RNA, 19 nt, artificial
  Oligomer
ucuuguccagcuguauccc

SEQ ID NO: 23488 - RNA, 19 nt, artificial
  Oligomer
uaggaugaugggaguguug

SEQ ID NO: 23489 - RNA, 19 nt, artificial
  Oligomer
uaccgucuucucaaagacg

SEQ ID NO: 23490 - RNA, 19 nt, artificial
  Oligomer
ugauccaaagagcugagcu

SEQ ID NO: 23491 - RNA, 19 nt, artificial
  Oligomer
cuucuuguccagcuguauc

SEQ ID NO: 23492 - RNA, 19 nt, artificial
  Oligomer
uuagcucugaauaaaguaa

SEQ ID NO: 23493 - RNA, 19 nt, artificial
  Oligomer
uaagaucaaguuuaguucc

SEQ ID NO: 23494 - RNA, 19 nt, artificial
  Oligomer
uaguguaaaucuccacuuc

SEQ ID NO: 23495 - RNA, 19 nt, artificial
  Oligomer
uaggagagcaagugucugc

SEQ ID NO: 23496 - RNA, 19 nt, artificial
  Oligomer
ucuguuugcggauaggaua

SEQ ID NO: 23497 - RNA, 19 nt, artificial
  Oligomer
uaaaaaauucuguuguagu

SEQ ID NO: 23498 - RNA, 19 nt, artificial
  Oligomer
uacaugcaaaacauaaugc

SEQ ID NO: 23499 - RNA, 19 nt, artificial
  Oligomer
ugugagucugaacucuuac

SEQ ID NO: 23500 - RNA, 19 nt, artificial
  Oligomer
uuuugucaaaauacugucu

SEQ ID NO: 23501 - RNA, 19 nt, artificial
  Oligomer
caaaguucagugcucggug

SEQ ID NO: 23502 - RNA, 19 nt, artificial
  Oligomer
ucaaggauuuauuaaguca

SEQ ID NO: 23503 - RNA, 19 nt, artificial
  Oligomer
uugguucaaaaaaugguuu

SEQ ID NO: 23504 - RNA, 19 nt, artificial
  Oligomer
augaugggaguguugggac

SEQ ID NO: 23505 - RNA, 19 nt, artificial
  Oligomer
uuagaacaaacaaaaccuu

SEQ ID NO: 23506 - RNA, 19 nt, artificial
  Oligomer
uuuucaaaugaugcaggac

SEQ ID NO: 23507 - RNA, 19 nt, artificial
  Oligomer
uuacccgugacacuuucau

SEQ ID NO: 23508 - RNA, 19 nt, artificial
  Oligomer
accuuuuagaguuuuuacc

SEQ ID NO: 23509 - RNA, 19 nt, artificial
  Oligomer
uaacauggaaagcacuuuu

SEQ ID NO: 23510 - RNA, 19 nt, artificial
  Oligomer
uuuuuacaccuaguuacua

SEQ ID NO: 23511 - RNA, 19 nt, artificial
  Oligomer
uacacugagauucuuguuu

SEQ ID NO: 23512 - RNA, 19 nt, artificial
  Oligomer
ucuuccucuucuucacggg

SEQ ID NO: 23513 - RNA, 19 nt, artificial
  Oligomer
uagaacaaacaaaaccuua

SEQ ID NO: 23514 - RNA, 19 nt, artificial
  Oligomer
auugguucaaaaaaugguu

SEQ ID NO: 23515 - RNA, 19 nt, artificial
  Oligomer
ucuguucaaaaucuccgca

SEQ ID NO: 23516 - RNA, 19 nt, artificial
  Oligomer
acaaggaggcauauugcuc

SEQ ID NO: 23517 - RNA, 19 nt, artificial
  Oligomer
ucaauguaaaaacacucca

SEQ ID NO: 23518 - RNA, 19 nt, artificial
  Oligomer
cuuuuagaguuuuuacccg

SEQ ID NO: 23519 - RNA, 19 nt, artificial
  Oligomer
auuuuauaauacaaggagg

SEQ ID NO: 23520 - RNA, 19 nt, artificial
  Oligomer
ucaucuacugcauuugaca

SEQ ID NO: 23521 - RNA, 19 nt, artificial
  Oligomer
uuagaguuuuuacccguga

SEQ ID NO: 23522 - RNA, 19 nt, artificial
  Oligomer
acauuuucaaaugaugcag

SEQ ID NO: 23523 - RNA, 19 nt, artificial
  Oligomer
ucaucaucuacugcauuug

SEQ ID NO: 23524 - RNA, 19 nt, artificial
  Oligomer
auacaaggaggcauauugc

SEQ ID NO: 23525 - RNA, 19 nt, artificial
  Oligomer
uaaguuagcgacuaacaga

SEQ ID NO: 23526 - RNA, 19 nt, artificial
  Oligomer
uuacagcaccaaucuccuu

SEQ ID NO: 23527 - RNA, 19 nt, artificial
  Oligomer
aucaucuacugcauuugac

SEQ ID NO: 23528 - RNA, 19 nt, artificial
  Oligomer
augauuuuuacaccuaguu

SEQ ID NO: 23529 - RNA, 19 nt, artificial
  Oligomer
aggcuugucauuuuagggc

SEQ ID NO: 23530 - RNA, 19 nt, artificial
  Oligomer
gucuuugcaaaguucagug

SEQ ID NO: 23531 - RNA, 19 nt, artificial
  Oligomer
aacaucgucagcacuagca

SEQ ID NO: 23532 - RNA, 19 nt, artificial
  Oligomer
uaaucgacaaaaaaaccuu

SEQ ID NO: 23533 - RNA, 19 nt, artificial
  Oligomer
aaacauuuccugauaauac

SEQ ID NO: 23534 - RNA, 19 nt, artificial
  Oligomer
ucauuuuagggcuaaauuu

SEQ ID NO: 23535 - RNA, 19 nt, artificial
  Oligomer
uuagaggaaauagcaguuc

SEQ ID NO: 23536 - RNA, 19 nt, artificial
  Oligomer
ucaagugacagugucggua

SEQ ID NO: 23537 - RNA, 19 nt, artificial
  Oligomer
aaguuuaguucccacuagg

SEQ ID NO: 23538 - RNA, 19 nt, artificial
  Oligomer
cuuaagaaaacauuuccug

SEQ ID NO: 23539 - RNA, 19 nt, artificial
  Oligomer
auuuugcucggguuacacu

SEQ ID NO: 23540 - RNA, 19 nt, artificial
  Oligomer
uuuuagggcuaaauuuuaa

SEQ ID NO: 23541 - RNA, 19 nt, artificial
  Oligomer
aaaaauucuguuguagugg

SEQ ID NO: 23542 - RNA, 19 nt, artificial
  Oligomer
uccagguauuuuacagcac

SEQ ID NO: 23543 - RNA, 19 nt, artificial
  Oligomer
ugucugcaccuccuaacug

SEQ ID NO: 23544 - RNA, 19 nt, artificial
  Oligomer
acagaauucuucauuagag

SEQ ID NO: 23545 - RNA, 19 nt, artificial
  Oligomer
aaaacuauaaagcugcaac

SEQ ID NO: 23546 - RNA, 19 nt, artificial
  Oligomer
uacgcaucugagaacuaca

SEQ ID NO: 23547 - RNA, 19 nt, artificial
  Oligomer
uucugcaacugucaauuua

SEQ ID NO: 23548 - RNA, 19 nt, artificial
  Oligomer
auuugacagaaauuaaccu

SEQ ID NO: 23549 - RNA, 19 nt, artificial
  Oligomer
acuccagguauuuuacagc

SEQ ID NO: 23550 - RNA, 19 nt, artificial
  Oligomer
auacaagcaacgcugagac

SEQ ID NO: 23551 - RNA, 19 nt, artificial
  Oligomer
uacagaacaucgucagcac

SEQ ID NO: 23552 - RNA, 19 nt, artificial
  Oligomer
uucauuccuuguacaaugu

SEQ ID NO: 23553 - RNA, 19 nt, artificial
  Oligomer
auauauucuccaggaaaug

SEQ ID NO: 23554 - RNA, 19 nt, artificial
  Oligomer
aaaugaugcaggacucaca

SEQ ID NO: 23555 - RNA, 19 nt, artificial
  Oligomer
uuguuuccgucucccacca

SEQ ID NO: 23556 - RNA, 19 nt, artificial
  Oligomer
aauuuuaauagaaugugag

SEQ ID NO: 23557 - RNA, 19 nt, artificial
  Oligomer
uauaauacaaggaggcaua

SEQ ID NO: 23558 - RNA, 19 nt, artificial
  Oligomer
auuagcucugaauaaagua

SEQ ID NO: 23559 - RNA, 19 nt, artificial
  Oligomer
caaaauacugucuuugucc

SEQ ID NO: 23560 - RNA, 19 nt, artificial
  Oligomer
ucauuagaggaaauagcag

SEQ ID NO: 23561 - RNA, 19 nt, artificial
  Oligomer
ucgucaaacacugucuuga

SEQ ID NO: 23562 - RNA, 19 nt, artificial
  Oligomer
auacugucuuuguccuuug

SEQ ID NO: 23563 - RNA, 19 nt, artificial
  Oligomer
gauaauaccaaccuuucuu

SEQ ID NO: 23564 - RNA, 19 nt, artificial
  Oligomer
ucaguuucucgaucguguc

SEQ ID NO: 23565 - RNA, 19 nt, artificial
  Oligomer
aaccuuucuuucaucaucu

SEQ ID NO: 23566 - RNA, 19 nt, artificial
  Oligomer
uuaguucccacuaggauga

SEQ ID NO: 23567 - RNA, 19 nt, artificial
  Oligomer
cuucuccuucaguuucucg

SEQ ID NO: 23568 - RNA, 19 nt, artificial
  Oligomer
uagcacaguuuacagaacc

SEQ ID NO: 23569 - RNA, 19 nt, artificial
  Oligomer
uaaucuguaacaaaaaguu

SEQ ID NO: 23570 - RNA, 19 nt, artificial
  Oligomer
aucaauaggcaaagcgacu

SEQ ID NO: 23571 - RNA, 19 nt, artificial
  Oligomer
aacagcaggcauuuucucu

SEQ ID NO: 23572 - RNA, 19 nt, artificial
  Oligomer
uuucucgaucgugucuuua

SEQ ID NO: 23573 - RNA, 19 nt, artificial
  Oligomer
ucauacaugcaaaacauaa

SEQ ID NO: 23574 - RNA, 19 nt, artificial
  Oligomer
cuuaaucugaacaagaaug

SEQ ID NO: 23575 - RNA, 19 nt, artificial
  Oligomer
uacccgugacacuuucauu

SEQ ID NO: 23576 - RNA, 19 nt, artificial
  Oligomer
uauacaagcaacgcugaga

SEQ ID NO: 23577 - RNA, 19 nt, artificial
  Oligomer
auggaaagcacuuuuacua

SEQ ID NO: 23578 - RNA, 19 nt, artificial
  Oligomer
uuuuaccuacagcucuaua

SEQ ID NO: 23579 - RNA, 19 nt, artificial
  Oligomer
cuaaacagaauucuucauu

SEQ ID NO: 23580 - RNA, 19 nt, artificial
  Oligomer
uccaaagagcugagcugcu

SEQ ID NO: 23581 - RNA, 19 nt, artificial
  Oligomer
uuugcacggacauuuucaa

SEQ ID NO: 23582 - RNA, 19 nt, artificial
  Oligomer
ugagacauuuacaacagca

SEQ ID NO: 23583 - RNA, 19 nt, artificial
  Oligomer
ucauaaucuucuuguccag

SEQ ID NO: 23584 - RNA, 19 nt, artificial
  Oligomer
ucuuugcaaaguucagugc

SEQ ID NO: 23585 - RNA, 19 nt, artificial
  Oligomer
ugauaauaccaaccuuucu

SEQ ID NO: 23586 - RNA, 19 nt, artificial
  Oligomer
aaggcuuuaagaaggcuug

SEQ ID NO: 23587 - RNA, 19 nt, artificial
  Oligomer
aacauuuccugauaauacc

SEQ ID NO: 23588 - RNA, 19 nt, artificial
  Oligomer
ucuccaggaaaugcauugg

SEQ ID NO: 23589 - RNA, 19 nt, artificial
  Oligomer
uuuacccgugacacuuuca

SEQ ID NO: 23590 - RNA, 19 nt, artificial
  Oligomer
uuuauaauacaaggaggca

SEQ ID NO: 23591 - RNA, 19 nt, artificial
  Oligomer
agcaccaaucuccuuagcc

SEQ ID NO: 23592 - RNA, 19 nt, artificial
  Oligomer
uuuacuaaucgacaaaaaa

SEQ ID NO: 23593 - RNA, 19 nt, artificial
  Oligomer
aggcauuuucucuuccucu

SEQ ID NO: 23594 - RNA, 19 nt, artificial
  Oligomer
uuaccuacagcucuauaca

SEQ ID NO: 23595 - RNA, 19 nt, artificial
  Oligomer
uaccaaccuuucuuucauc

SEQ ID NO: 23596 - RNA, 19 nt, artificial
  Oligomer
ugauuuuuacaccuaguua

SEQ ID NO: 23597 - RNA, 19 nt, artificial
  Oligomer
uaaugcuaauugcauuagc

SEQ ID NO: 23598 - RNA, 19 nt, artificial
  Oligomer
cucuuccucuucuucacgg

SEQ ID NO: 23599 - RNA, 19 nt, artificial
  Oligomer
augaauuaaaugcccaauu

SEQ ID NO: 23600 - RNA, 19 nt, artificial
  Oligomer
uuugcucggguuacacuga

SEQ ID NO: 23601 - RNA, 19 nt, artificial
  Oligomer
augcaguguaguucagaag

SEQ ID NO: 23602 - RNA, 19 nt, artificial
  Oligomer
cuuugcacggacauuuuca

SEQ ID NO: 23603 - RNA, 19 nt, artificial
  Oligomer
uacaaggaggcauauugcu

SEQ ID NO: 23604 - RNA, 19 nt, artificial
  Oligomer
ugggagucagcuucuucuc

SEQ ID NO: 23605 - RNA, 19 nt, artificial
  Oligomer
uagaaaacuaaggaaagca

SEQ ID NO: 23606 - RNA, 19 nt, artificial
  Oligomer
cagcuaaacagaauucuuc

SEQ ID NO: 23607 - RNA, 19 nt, artificial
  Oligomer
ccuuuuagaguuuuuaccc

SEQ ID NO: 23608 - RNA, 19 nt, artificial
  Oligomer
aaggaaagcacuuauuagc

SEQ ID NO: 23609 - RNA, 19 nt, artificial
  Oligomer
agcacuuuuacuaaucgac

SEQ ID NO: 23610 - RNA, 19 nt, artificial
  Oligomer
aaguuuuaccuacagcucu

SEQ ID NO: 23611 - RNA, 19 nt, artificial
  Oligomer
ucacaaagacugauccaaa

SEQ ID NO: 23612 - RNA, 19 nt, artificial
  Oligomer
aaaauaaggcuuuaagaag

SEQ ID NO: 23613 - RNA, 19 nt, artificial
  Oligomer
aaaucacaaagacugaucc

SEQ ID NO: 23614 - RNA, 19 nt, artificial
  Oligomer
caauguaguguaaaucucc

SEQ ID NO: 23615 - RNA, 19 nt, artificial
  Oligomer
ugcuuuacgcaucugagaa

SEQ ID NO: 23616 - RNA, 19 nt, artificial
  Oligomer
agcuucuucuccuucaguu

SEQ ID NO: 23617 - RNA, 19 nt, artificial
  Oligomer
uguucucggcacaacaaug

SEQ ID NO: 23618 - RNA, 19 nt, artificial
  Oligomer
acgugcugcuaacucacug

SEQ ID NO: 23619 - RNA, 19 nt, artificial
  Oligomer
aggcuguucugcuuuacgc

SEQ ID NO: 23620 - RNA, 19 nt, artificial
  Oligomer
uaaacagaauucuucauua

SEQ ID NO: 23621 - RNA, 19 nt, artificial
  Oligomer
uugucaaagacaguaggga

SEQ ID NO: 23622 - RNA, 19 nt, artificial
  Oligomer
auugcauuagcaaaagauc

SEQ ID NO: 23623 - RNA, 19 nt, artificial
  Oligomer
ucugagaacuacauaggag

SEQ ID NO: 23624 - RNA, 19 nt, artificial
  Oligomer
aacacugucuugaggccuc

SEQ ID NO: 23625 - RNA, 19 nt, artificial
  Oligomer
gucaauuuaaaaaauucug

SEQ ID NO: 23626 - RNA, 19 nt, artificial
  Oligomer
ugacacuuucauuccuugu

SEQ ID NO: 23627 - RNA, 19 nt, artificial
  Oligomer
auaagcccagauucaccgg

SEQ ID NO: 23628 - RNA, 19 nt, artificial
  Oligomer
ugcagaagcuaccgucuuc

SEQ ID NO: 23629 - RNA, 19 nt, artificial
  Oligomer
aagauuuuauaauacaagg

SEQ ID NO: 23630 - RNA, 19 nt, artificial
  Oligomer
uuagggcuaaauuuuaaua

SEQ ID NO: 23631 - RNA, 19 nt, artificial
  Oligomer
caaaacauaaugcuaauug

SEQ ID NO: 23632 - RNA, 19 nt, artificial
  Oligomer
cauuugacagaaauuaacc

SEQ ID NO: 23633 - RNA, 19 nt, artificial
  Oligomer
ugagacgcgcgauuuugcu

SEQ ID NO: 23634 - RNA, 19 nt, artificial
  Oligomer
auuuuuacaccuaguuacu

SEQ ID NO: 23635 - RNA, 19 nt, artificial
  Oligomer
aggaugaugggaguguugg

SEQ ID NO: 23636 - RNA, 19 nt, artificial
  Oligomer
aacucuuacauuuagaaca

SEQ ID NO: 23637 - RNA, 19 nt, artificial
  Oligomer
guauuuugucaaaauacug

SEQ ID NO: 23638 - RNA, 19 nt, artificial
  Oligomer
aauguaaaaacacuccaca

SEQ ID NO: 23639 - RNA, 19 nt, artificial
  Oligomer
agcacuuacuaaguuagcg

SEQ ID NO: 23640 - RNA, 19 nt, artificial
  Oligomer
aaaacugcagagaaacagg

SEQ ID NO: 23641 - RNA, 19 nt, artificial
  Oligomer
uugcacggacauuuucaaa

SEQ ID NO: 23642 - RNA, 19 nt, artificial
  Oligomer
auuuccugauaauaccaac

SEQ ID NO: 23643 - RNA, 19 nt, artificial
  Oligomer
aaggcuugucauuuuaggg

SEQ ID NO: 23644 - RNA, 19 nt, artificial
  Oligomer
uccagcuguaucccauaag

SEQ ID NO: 23645 - RNA, 19 nt, artificial
  Oligomer
aucaguaggcaaguuuuac

SEQ ID NO: 23646 - RNA, 19 nt, artificial
  Oligomer
auuuucucuuccucuucuu

SEQ ID NO: 23647 - RNA, 19 nt, artificial
  Oligomer
uugaaaaauaaggcuuuaa

SEQ ID NO: 23648 - RNA, 19 nt, artificial
  Oligomer
ucucggcacaacaaugcag

SEQ ID NO: 23649 - RNA, 19 nt, artificial
  Oligomer
cuaaucgacaaaaaaaccu

SEQ ID NO: 23650 - RNA, 19 nt, artificial
  Oligomer
aucuacugcauuugacaga

SEQ ID NO: 23651 - RNA, 19 nt, artificial
  Oligomer
uaaaaacacuccacaauuc

SEQ ID NO: 23652 - RNA, 19 nt, artificial
  Oligomer
uuaaccuuuuagaguuuuu

SEQ ID NO: 23653 - RNA, 19 nt, artificial
  Oligomer
cucugaauaaaguaacaug

SEQ ID NO: 23654 - RNA, 19 nt, artificial
  Oligomer
uaggcaaagcgacuacagg

SEQ ID NO: 23655 - RNA, 19 nt, artificial
  Oligomer
uccacaauucugcaacugu

SEQ ID NO: 23656 - RNA, 19 nt, artificial
  Oligomer
uucucgaucgugucuuuau

SEQ ID NO: 23657 - RNA, 19 nt, artificial
  Oligomer
aaaacacuccacaauucug

SEQ ID NO: 23658 - RNA, 19 nt, artificial
  Oligomer
auucaaggauuuauuaagu

SEQ ID NO: 23659 - RNA, 19 nt, artificial
  Oligomer
auucaccgguuuuccaucu

SEQ ID NO: 23660 - RNA, 19 nt, artificial
  Oligomer
aucccauaagcccagauuc

SEQ ID NO: 23661 - RNA, 19 nt, artificial
  Oligomer
aauucugcaacugucaauu

SEQ ID NO: 23662 - RNA, 19 nt, artificial
  Oligomer
aguuguacagaacaucguc

SEQ ID NO: 23663 - RNA, 19 nt, artificial
  Oligomer
uaaugcauuaucagaaaga

SEQ ID NO: 23664 - RNA, 19 nt, artificial
  Oligomer
aucacaaagacugauccaa

SEQ ID NO: 23665 - RNA, 19 nt, artificial
  Oligomer
aauguaguguaaaucucca

SEQ ID NO: 23666 - RNA, 19 nt, artificial
  Oligomer
auaggugaugggagucagc

SEQ ID NO: 23667 - RNA, 19 nt, artificial
  Oligomer
uccuaacugcagaagcuac

SEQ ID NO: 23668 - RNA, 19 nt, artificial
  Oligomer
uuacugauugguucaaaaa

SEQ ID NO: 23669 - RNA, 19 nt, artificial
  Oligomer
aaacucgcuaugaaaucac

SEQ ID NO: 23670 - RNA, 19 nt, artificial
  Oligomer
uguucugcuuuacgcaucu

SEQ ID NO: 23671 - RNA, 19 nt, artificial
  Oligomer
aauacugucuuuguccuuu

SEQ ID NO: 23672 - RNA, 19 nt, artificial
  Oligomer
ucuauaagaaaagcacuua

SEQ ID NO: 23673 - RNA, 19 nt, artificial
  Oligomer
agucagcuucuucuccuuc

SEQ ID NO: 23674 - RNA, 19 nt, artificial
  Oligomer
uauuagcucugaauaaagu

SEQ ID NO: 23675 - RNA, 19 nt, artificial
  Oligomer
aucuguuugcggauaggau

SEQ ID NO: 23676 - RNA, 19 nt, artificial
  Oligomer
aucgacaaaaaaaccuucu

SEQ ID NO: 23677 - RNA, 19 nt, artificial
  Oligomer
auuaaucuguaacaaaaag

SEQ ID NO: 23678 - RNA, 19 nt, artificial
  Oligomer
aagcugaggaaaacugcag

SEQ ID NO: 23679 - RNA, 19 nt, artificial
  Oligomer
uaaggaaagcacuuauuag

SEQ ID NO: 23680 - RNA, 19 nt, artificial
  Oligomer
ucuucauuagaggaaauag

SEQ ID NO: 23681 - RNA, 19 nt, artificial
  Oligomer
uacugauugguucaaaaaa

SEQ ID NO: 23682 - RNA, 19 nt, artificial
  Oligomer
ucuccacuucguauuuugu

SEQ ID NO: 23683 - RNA, 19 nt, artificial
  Oligomer
aagaucaaguuuaguuccc

SEQ ID NO: 23684 - RNA, 19 nt, artificial
  Oligomer
agauucaccgguuuuccau

SEQ ID NO: 23685 - RNA, 19 nt, artificial
  Oligomer
uacagcucuauacaagcaa

SEQ ID NO: 23686 - RNA, 19 nt, artificial
  Oligomer
aucaucccuaagaucaagu

SEQ ID NO: 23687 - RNA, 19 nt, artificial
  Oligomer
uaagcccagauucaccggu

SEQ ID NO: 23688 - RNA, 19 nt, artificial
  Oligomer
uccaggaaaugcauugguu

SEQ ID NO: 23689 - RNA, 19 nt, artificial
  Oligomer
aaagagcugagcugcuacg

SEQ ID NO: 23690 - RNA, 19 nt, artificial
  Oligomer
uaaucugaacaagaauggg

SEQ ID NO: 23691 - RNA, 19 nt, artificial
  Oligomer
cuucuucuccuucaguuuc

SEQ ID NO: 23692 - RNA, 19 nt, artificial
  Oligomer
ugagucugaacucuuacau

SEQ ID NO: 23693 - RNA, 19 nt, artificial
  Oligomer
agugaguuaaguuguacag

SEQ ID NO: 23694 - RNA, 19 nt, artificial
  Oligomer
cuuuguccuuugaucacac

SEQ ID NO: 23695 - RNA, 19 nt, artificial
  Oligomer
auuuuagggcuaaauuuua

SEQ ID NO: 23696 - RNA, 19 nt, artificial
  Oligomer
ucuucuccuucaguuucuc

SEQ ID NO: 23697 - RNA, 19 nt, artificial
  Oligomer
accaguuuaaagaugaauu

SEQ ID NO: 23698 - RNA, 19 nt, artificial
  Oligomer
uaacagaacaaccaguuua

SEQ ID NO: 23699 - RNA, 19 nt, artificial
  Oligomer
guuuuuacccgugacacuu

SEQ ID NO: 23700 - RNA, 19 nt, artificial
  Oligomer
cuguucugcuuuacgcauc

SEQ ID NO: 23701 - RNA, 19 nt, artificial
  Oligomer
agcuaaacagaauucuuca

SEQ ID NO: 23702 - RNA, 19 nt, artificial
  Oligomer
ugcacggacauuuucaaau

SEQ ID NO: 23703 - RNA, 19 nt, artificial
  Oligomer
ugcugcuaacucacuggug

SEQ ID NO: 23704 - RNA, 19 nt, artificial
  Oligomer
aggcauauugcucagucag

SEQ ID NO: 23705 - RNA, 19 nt, artificial
  Oligomer
agcgacuaacagaacaacc

SEQ ID NO: 23706 - RNA, 19 nt, artificial
  Oligomer
auaagaaaagcacuuacua

SEQ ID NO: 23707 - RNA, 19 nt, artificial
  Oligomer
auagaaugugagucugaac

SEQ ID NO: 23708 - RNA, 19 nt, artificial
  Oligomer
uaucccauaagcccagauu

SEQ ID NO: 23709 - RNA, 19 nt, artificial
  Oligomer
uagcaaaagaucaauguaa

SEQ ID NO: 23710 - RNA, 19 nt, artificial
  Oligomer
ugcaggacucacaagggaa

SEQ ID NO: 23711 - RNA, 19 nt, artificial
  Oligomer
guaaagagggucaguauug

SEQ ID NO: 23712 - RNA, 19 nt, artificial
  Oligomer
uucuucauuagaggaaaua

SEQ ID NO: 23713 - RNA, 19 nt, artificial
  Oligomer
ucuucuuguccagcuguau

SEQ ID NO: 23714 - RNA, 19 nt, artificial
  Oligomer
aaaucuccgcaaaagcugg

SEQ ID NO: 23715 - RNA, 19 nt, artificial
  Oligomer
guucccacuaggaugaugg

SEQ ID NO: 23716 - RNA, 19 nt, artificial
  Oligomer
uauucuccaggaaaugcau

SEQ ID NO: 23717 - RNA, 19 nt, artificial
  Oligomer
auugucaaagacaguaggg

SEQ ID NO: 23718 - RNA, 19 nt, artificial
  Oligomer
agcuuaagaaaacauuucc

SEQ ID NO: 23719 - RNA, 19 nt, artificial
  Oligomer
aguuucucgaucgugucuu

SEQ ID NO: 23720 - RNA, 19 nt, artificial
  Oligomer
acagaaauuaaccuuuuag

SEQ ID NO: 23721 - RNA, 19 nt, artificial
  Oligomer
uagaguuuuuacccgugac

SEQ ID NO: 23722 - RNA, 19 nt, artificial
  Oligomer
aguauuggucaagugacag

SEQ ID NO: 23723 - RNA, 19 nt, artificial
  Oligomer
acaauguaguguaaaucuc

SEQ ID NO: 23724 - RNA, 19 nt, artificial
  Oligomer
cuucaguuucucgaucgug

SEQ ID NO: 23725 - RNA, 19 nt, artificial
  Oligomer
aaacacugucuugaggccu

SEQ ID NO: 23726 - RNA, 19 nt, artificial
  Oligomer
aauaccaaccuuucuuuca

SEQ ID NO: 23727 - RNA, 19 nt, artificial
  Oligomer
cugauaauaccaaccuuuc

SEQ ID NO: 23728 - RNA, 19 nt, artificial
  Oligomer
ucugcaacugucaauuuaa

SEQ ID NO: 23729 - RNA, 19 nt, artificial
  Oligomer
cauuuucaaaugaugcagg

SEQ ID NO: 23730 - RNA, 19 nt, artificial
  Oligomer
caaaggaacaucaauaggc

SEQ ID NO: 23731 - RNA, 19 nt, artificial
  Oligomer
aggaaaugcauugguugug

SEQ ID NO: 23732 - RNA, 19 nt, artificial
  Oligomer
aauaaggcuuuaagaaggc

SEQ ID NO: 23733 - RNA, 19 nt, artificial
  Oligomer
uuacacugagauucuuguu

SEQ ID NO: 23734 - RNA, 19 nt, artificial
  Oligomer
uuagcgacuaacagaacaa

SEQ ID NO: 23735 - RNA, 19 nt, artificial
  Oligomer
aaagcuggucagaaaacuc

SEQ ID NO: 23736 - RNA, 19 nt, artificial
  Oligomer
aaucuucuuguccagcugu

SEQ ID NO: 23737 - RNA, 19 nt, artificial
  Oligomer
ucggaucgcuucgucaaac

SEQ ID NO: 23738 - RNA, 19 nt, artificial
  Oligomer
ucagcuucuucuccuucag

SEQ ID NO: 23739 - RNA, 19 nt, artificial
  Oligomer
aaagaugaauuaaaugccc

SEQ ID NO: 23740 - RNA, 19 nt, artificial
  Oligomer
uacaagcaacgcugagacg

SEQ ID NO: 23741 - RNA, 19 nt, artificial
  Oligomer
aguuacuagaaaacuaagg

SEQ ID NO: 23742 - RNA, 19 nt, artificial
  Oligomer
acuaaucgacaaaaaaacc

SEQ ID NO: 23743 - RNA, 19 nt, artificial
  Oligomer
cauaaucuucuuguccagc

SEQ ID NO: 23744 - RNA, 19 nt, artificial
  Oligomer
auuaagucauacaugcaaa

SEQ ID NO: 23745 - RNA, 19 nt, artificial
  Oligomer
augcaaaacauaaugcuaa

SEQ ID NO: 23746 - RNA, 19 nt, artificial
  Oligomer
uuguacaauguaguguaaa

SEQ ID NO: 23747 - RNA, 19 nt, artificial
  Oligomer
ucacagacccaaaggaaca

SEQ ID NO: 23748 - RNA, 19 nt, artificial
  Oligomer
uucaccgguuuuccaucua

SEQ ID NO: 23749 - RNA, 19 nt, artificial
  Oligomer
uuccaucuaccauaacauu

SEQ ID NO: 23750 - RNA, 19 nt, artificial
  Oligomer
aggauuuauuaagucauac

SEQ ID NO: 23751 - RNA, 19 nt, artificial
  Oligomer
ucugaacucuuacauuuag

SEQ ID NO: 23752 - RNA, 19 nt, artificial
  Oligomer
cuaaguuagcgacuaacag

SEQ ID NO: 23753 - RNA, 19 nt, artificial
  Oligomer
uuuuacuaaucgacaaaaa

SEQ ID NO: 23754 - RNA, 19 nt, artificial
  Oligomer
uaagaaaagcacuuacuaa

SEQ ID NO: 23755 - RNA, 19 nt, artificial
  Oligomer
uaagaaaacauuuccugau

SEQ ID NO: 23756 - RNA, 19 nt, artificial
  Oligomer
ucaauaggcaaagcgacua

SEQ ID NO: 23757 - RNA, 19 nt, artificial
  Oligomer
gacagugucgguaaucugg

SEQ ID NO: 23758 - RNA, 19 nt, artificial
  Oligomer
ccuaagaucaaguuuaguu

SEQ ID NO: 23759 - RNA, 19 nt, artificial
  Oligomer
uacgcucacuccauuacag

SEQ ID NO: 23760 - RNA, 19 nt, artificial
  Oligomer
aucuucuuguccagcugua

SEQ ID NO: 23761 - RNA, 19 nt, artificial
  Oligomer
uaaccuuuuagaguuuuua

SEQ ID NO: 23762 - RNA, 19 nt, artificial
  Oligomer
aaaagaucaauguaaaaac

SEQ ID NO: 23763 - RNA, 19 nt, artificial
  Oligomer
ccagguauuuuacagcacc

SEQ ID NO: 23764 - RNA, 19 nt, artificial
  Oligomer
aaugaugcaggacucacaa

SEQ ID NO: 23765 - RNA, 19 nt, artificial
  Oligomer
cuuuugaaaaauaaggcuu

SEQ ID NO: 23766 - RNA, 19 nt, artificial
  Oligomer
aaagguuccaagggacagg

SEQ ID NO: 23767 - RNA, 19 nt, artificial
  Oligomer
acgggagcuuugucaauaa

SEQ ID NO: 23768 - RNA, 19 nt, artificial
  Oligomer
cgaguugcgcuucaaacaa

SEQ ID NO: 23769 - RNA, 19 nt, artificial
  Oligomer
gcugcaucccaacgacaaa

SEQ ID NO: 23770 - RNA, 19 nt, artificial
  Oligomer
ccagaaguccgcaaacaga

SEQ ID NO: 23771 - RNA, 19 nt, artificial
  Oligomer
cgaguaugucgccuauguu

SEQ ID NO: 23772 - RNA, 19 nt, artificial
  Oligomer
uaaggaucaccgcuuugaa

SEQ ID NO: 23773 - RNA, 19 nt, artificial
  Oligomer
gggaccuguuugacaugaa

SEQ ID NO: 23774 - RNA, 19 nt, artificial
  Oligomer
ggaggaguaaccugaaauu

SEQ ID NO: 23775 - RNA, 19 nt, artificial
  Oligomer
caggcagagagcuuuuuga

SEQ ID NO: 23776 - RNA, 19 nt, artificial
  Oligomer
aguugcgcuucaaacaaua

SEQ ID NO: 23777 - RNA, 19 nt, artificial
  Oligomer
cuucgaguugcgcuucaaa

SEQ ID NO: 23778 - RNA, 19 nt, artificial
  Oligomer
cagagagcuuuuugaugau

SEQ ID NO: 23779 - RNA, 19 nt, artificial
  Oligomer
aaggaucaccgcuuugaaa

SEQ ID NO: 23780 - RNA, 19 nt, artificial
  Oligomer
ccuucgaguugcgcuucaa

SEQ ID NO: 23781 - RNA, 19 nt, artificial
  Oligomer
ccgaguaugucgccuaugu

SEQ ID NO: 23782 - RNA, 19 nt, artificial
  Oligomer
agccgaguaugucgccuau

SEQ ID NO: 23783 - RNA, 19 nt, artificial
  Oligomer
gaugaucccuccuauguca

SEQ ID NO: 23784 - RNA, 19 nt, artificial
  Oligomer
gugugguucggacuaagga

SEQ ID NO: 23785 - RNA, 19 nt, artificial
  Oligomer
uggagguccuccagucaau

SEQ ID NO: 23786 - RNA, 19 nt, artificial
  Oligomer
cagaaguccgcaaacagau

SEQ ID NO: 23787 - RNA, 19 nt, artificial
  Oligomer
ccuccuaugucaacgucca

SEQ ID NO: 23788 - RNA, 19 nt, artificial
  Oligomer
agggugugguucggacuaa

SEQ ID NO: 23789 - RNA, 19 nt, artificial
  Oligomer
ugaccaucaguacuauaau

SEQ ID NO: 23790 - RNA, 19 nt, artificial
  Oligomer
ccgcagacugcaaacagau

SEQ ID NO: 23791 - RNA, 19 nt, artificial
  Oligomer
cggaaugagucucugucau

SEQ ID NO: 23792 - RNA, 19 nt, artificial
  Oligomer
cauucuggagugucccgaa

SEQ ID NO: 23793 - RNA, 19 nt, artificial
  Oligomer
gaguugcgcuucaaacaau

SEQ ID NO: 23794 - RNA, 19 nt, artificial
  Oligomer
caaucuaucucauuugcau

SEQ ID NO: 23795 - RNA, 19 nt, artificial
  Oligomer
ccugaccaucaguacuaua

SEQ ID NO: 23796 - RNA, 19 nt, artificial
  Oligomer
ugacaugaagcccuucgaa

SEQ ID NO: 23797 - RNA, 19 nt, artificial
  Oligomer
cguccagaaccuagacaag

SEQ ID NO: 23798 - RNA, 19 nt, artificial
  Oligomer
gcuaccacauggacaauca

SEQ ID NO: 23799 - RNA, 19 nt, artificial
  Oligomer
cgggagcuuugucaauaag

SEQ ID NO: 23800 - RNA, 19 nt, artificial
  Oligomer
ggaguaaccugaaauuugc

SEQ ID NO: 23801 - RNA, 19 nt, artificial
  Oligomer
ccuaugucaacguccagaa

SEQ ID NO: 23802 - RNA, 19 nt, artificial
  Oligomer
gggaggaguaaccugaaau

SEQ ID NO: 23803 - RNA, 19 nt, artificial
  Oligomer
ugugguucggacuaaggau

SEQ ID NO: 23804 - RNA, 19 nt, artificial
  Oligomer
augggaugaggaggaggaa

SEQ ID NO: 23805 - RNA, 19 nt, artificial
  Oligomer
ccuacuugguucgguacau

SEQ ID NO: 23806 - RNA, 19 nt, artificial
  Oligomer
agacaugaggcuucgggaa

SEQ ID NO: 23807 - RNA, 19 nt, artificial
  Oligomer
ucagcuaccacauggacaa

SEQ ID NO: 23808 - RNA, 19 nt, artificial
  Oligomer
cagacugcaaacagaucau

SEQ ID NO: 23809 - RNA, 19 nt, artificial
  Oligomer
uguggagcggaaacuguga

SEQ ID NO: 23810 - RNA, 19 nt, artificial
  Oligomer
ccggaaugagucucuguca

SEQ ID NO: 23811 - RNA, 19 nt, artificial
  Oligomer
cugaccaucaguacuauaa

SEQ ID NO: 23812 - RNA, 19 nt, artificial
  Oligomer
aggcagagagcuuuuugau

SEQ ID NO: 23813 - RNA, 19 nt, artificial
  Oligomer
cacgggagcuuugucaaua

SEQ ID NO: 23814 - RNA, 19 nt, artificial
  Oligomer
gcagccuaagcauuugcua

SEQ ID NO: 23815 - RNA, 19 nt, artificial
  Oligomer
gcagagagcuuuuugauga

SEQ ID NO: 23816 - RNA, 19 nt, artificial
  Oligomer
ggaccuguuugacaugaag

SEQ ID NO: 23817 - RNA, 19 nt, artificial
  Oligomer
ccaaagacccugugaauca

SEQ ID NO: 23818 - RNA, 19 nt, artificial
  Oligomer
gaaagugucagucaccuua

SEQ ID NO: 23819 - RNA, 19 nt, artificial
  Oligomer
cgcuucaaacaauaccuca

SEQ ID NO: 23820 - RNA, 19 nt, artificial
  Oligomer
gaguaaccugaaauuugcu

SEQ ID NO: 23821 - RNA, 19 nt, artificial
  Oligomer
uuuugaugaucccuccuau

SEQ ID NO: 23822 - RNA, 19 nt, artificial
  Oligomer
acaugaagcccuucgaaga

SEQ ID NO: 23823 - RNA, 19 nt, artificial
  Oligomer
ccacgggagcuuugucaau

SEQ ID NO: 23824 - RNA, 19 nt, artificial
  Oligomer
aggaggagaaagcccugua

SEQ ID NO: 23825 - RNA, 19 nt, artificial
  Oligomer
caacgacaaagucauggga

SEQ ID NO: 23826 - RNA, 19 nt, artificial
  Oligomer
ggacaugaacaagcugagu

SEQ ID NO: 23827 - RNA, 19 nt, artificial
  Oligomer
acguccagaaccuagacaa

SEQ ID NO: 23828 - RNA, 19 nt, artificial
  Oligomer
accugaaauuugcuggaau

SEQ ID NO: 23829 - RNA, 19 nt, artificial
  Oligomer
caugaacaagcugagugga

SEQ ID NO: 23830 - RNA, 19 nt, artificial
  Oligomer
agacccugugaaucagaga

SEQ ID NO: 23831 - RNA, 19 nt, artificial
  Oligomer
ccacaugcaaucuaucuca

SEQ ID NO: 23832 - RNA, 19 nt, artificial
  Oligomer
uccuccaggacaugaacaa

SEQ ID NO: 23833 - RNA, 19 nt, artificial
  Oligomer
ccaucaguacuauaaugac

SEQ ID NO: 23834 - RNA, 19 nt, artificial
  Oligomer
caccuuaucagcuaccaca

SEQ ID NO: 23835 - RNA, 19 nt, artificial
  Oligomer
ucgaguugcgcuucaaaca

SEQ ID NO: 23836 - RNA, 19 nt, artificial
  Oligomer
ggaucaccgcuuugaaagu

SEQ ID NO: 23837 - RNA, 19 nt, artificial
  Oligomer
caccgcuuugaaaguguca

SEQ ID NO: 23838 - RNA, 19 nt, artificial
  Oligomer
aggacaugaacaagcugag

SEQ ID NO: 23839 - RNA, 19 nt, artificial
  Oligomer
ccugaaauuugcuggaaug

SEQ ID NO: 23840 - RNA, 19 nt, artificial
  Oligomer
ccgcuuugaaagugucagu

SEQ ID NO: 23841 - RNA, 19 nt, artificial
  Oligomer
caccugaccaucaguacua

SEQ ID NO: 23842 - RNA, 19 nt, artificial
  Oligomer
caugaagcccuucgaagau

SEQ ID NO: 23843 - RNA, 19 nt, artificial
  Oligomer
gacuaaggaucaccgcuuu

SEQ ID NO: 23844 - RNA, 19 nt, artificial
  Oligomer
ggaugucaucagcaccauu

SEQ ID NO: 23845 - RNA, 19 nt, artificial
  Oligomer
uuuccuacuugguucggua

SEQ ID NO: 23846 - RNA, 19 nt, artificial
  Oligomer
accugaccaucaguacuau

SEQ ID NO: 23847 - RNA, 19 nt, artificial
  Oligomer
aggaagggcagcugaugau

SEQ ID NO: 23848 - RNA, 19 nt, artificial
  Oligomer
aguacaauccacuccggaa

SEQ ID NO: 23849 - RNA, 19 nt, artificial
  Oligomer
gaggaguaaccugaaauuu

SEQ ID NO: 23850 - RNA, 19 nt, artificial
  Oligomer
gcuuugaaagugucaguca

SEQ ID NO: 23851 - RNA, 19 nt, artificial
  Oligomer
agauccagaaguccgcaaa

SEQ ID NO: 23852 - RNA, 19 nt, artificial
  Oligomer
uagacaugaggcuucggga

SEQ ID NO: 23853 - RNA, 19 nt, artificial
  Oligomer
caucaguacuauaaugacu

SEQ ID NO: 23854 - RNA, 19 nt, artificial
  Oligomer
caggaugucaucagcacca

SEQ ID NO: 23855 - RNA, 19 nt, artificial
  Oligomer
caagcccaaguacaaucca

SEQ ID NO: 23856 - RNA, 19 nt, artificial
  Oligomer
gaguaugucgccuauguug

SEQ ID NO: 23857 - RNA, 19 nt, artificial
  Oligomer
cucugucaucgauggagga

SEQ ID NO: 23858 - RNA, 19 nt, artificial
  Oligomer
cuacauugccuguaggaca

SEQ ID NO: 23859 - RNA, 19 nt, artificial
  Oligomer
aaagugucagucaccuuau

SEQ ID NO: 23860 - RNA, 19 nt, artificial
  Oligomer
caugcaaucuaucucauuu

SEQ ID NO: 23861 - RNA, 19 nt, artificial
  Oligomer
cuugguucgguacaugggu

SEQ ID NO: 23862 - RNA, 19 nt, artificial
  Oligomer
agcauuugcuacuggugga

SEQ ID NO: 23863 - RNA, 19 nt, artificial
  Oligomer
ccaccugaccaucaguacu

SEQ ID NO: 23864 - RNA, 19 nt, artificial
  Oligomer
ggagcuacauugccuguag

SEQ ID NO: 23865 - RNA, 19 nt, artificial
  Oligomer
cagcuaccacauggacaau

SEQ ID NO: 23866 - RNA, 19 nt, artificial
  Oligomer
gagauccagaaguccgcaa

SEQ ID NO: 23867 - RNA, 19 nt, artificial
  Oligomer
cuaccacauggacaaucac

SEQ ID NO: 23868 - RNA, 19 nt, artificial
  Oligomer
cacaugcaaucuaucucau

SEQ ID NO: 23869 - RNA, 19 nt, artificial
  Oligomer
caggacaugaacaagcuga

SEQ ID NO: 23870 - RNA, 19 nt, artificial
  Oligomer
gcagacugcaaacagauca

SEQ ID NO: 23871 - RNA, 19 nt, artificial
  Oligomer
ucaacguccagaaccuaga

SEQ ID NO: 23872 - RNA, 19 nt, artificial
  Oligomer
gacaaucacuugcccauca

SEQ ID NO: 23873 - RNA, 19 nt, artificial
  Oligomer
cuuugaaagugucagucac

SEQ ID NO: 23874 - RNA, 19 nt, artificial
  Oligomer
ugucaacguccagaaccua

SEQ ID NO: 23875 - RNA, 19 nt, artificial
  Oligomer
ggacuaaggaucaccgcuu

SEQ ID NO: 23876 - RNA, 19 nt, artificial
  Oligomer
aggaguaaccugaaauuug

SEQ ID NO: 23877 - RNA, 19 nt, artificial
  Oligomer
caucccaacgacaaaguca

SEQ ID NO: 23878 - RNA, 19 nt, artificial
  Oligomer
ucaggaacccacccaaacu

SEQ ID NO: 23879 - RNA, 19 nt, artificial
  Oligomer
accaccacaugcaaucuau

SEQ ID NO: 23880 - RNA, 19 nt, artificial
  Oligomer
caaagacccugugaaucag

SEQ ID NO: 23881 - RNA, 19 nt, artificial
  Oligomer
ucagucaccuuaucagcua

SEQ ID NO: 23882 - RNA, 19 nt, artificial
  Oligomer
gaccaucaguacuauaaug

SEQ ID NO: 23883 - RNA, 19 nt, artificial
  Oligomer
ggagcuuugucaauaagcc

SEQ ID NO: 23884 - RNA, 19 nt, artificial
  Oligomer
aaccugaaauuugcuggaa

SEQ ID NO: 23885 - RNA, 19 nt, artificial
  Oligomer
gcaaucuaucucauuugca

SEQ ID NO: 23886 - RNA, 19 nt, artificial
  Oligomer
ccuccaggacaugaacaag

SEQ ID NO: 23887 - RNA, 19 nt, artificial
  Oligomer
caacguccagaaccuagac

SEQ ID NO: 23888 - RNA, 19 nt, artificial
  Oligomer
cgggaccuguuugacauga

SEQ ID NO: 23889 - RNA, 19 nt, artificial
  Oligomer
gugggcagccuaagcauuu

SEQ ID NO: 23890 - RNA, 19 nt, artificial
  Oligomer
uguuugacaugaagcccuu

SEQ ID NO: 23891 - RNA, 19 nt, artificial
  Oligomer
uaaccugaaauuugcugga

SEQ ID NO: 23892 - RNA, 19 nt, artificial
  Oligomer
agagcuuuuugaugauccc

SEQ ID NO: 23893 - RNA, 19 nt, artificial
  Oligomer
uccaggacaugaacaagcu

SEQ ID NO: 23894 - RNA, 19 nt, artificial
  Oligomer
ugguucggacuaaggauca

SEQ ID NO: 23895 - RNA, 19 nt, artificial
  Oligomer
ccacauggacaaucacuug

SEQ ID NO: 23896 - RNA, 19 nt, artificial
  Oligomer
uuaucagcuaccacaugga

SEQ ID NO: 23897 - RNA, 19 nt, artificial
  Oligomer
augagucucugucaucgau

SEQ ID NO: 23898 - RNA, 19 nt, artificial
  Oligomer
ucaaacaauaccucaggaa

SEQ ID NO: 23899 - RNA, 19 nt, artificial
  Oligomer
uugacaugaagcccuucga

SEQ ID NO: 23900 - RNA, 19 nt, artificial
  Oligomer
gguucggacuaaggaucac

SEQ ID NO: 23901 - RNA, 19 nt, artificial
  Oligomer
ugcgcuucaaacaauaccu

SEQ ID NO: 23902 - RNA, 19 nt, artificial
  Oligomer
aaugagucucugucaucga

SEQ ID NO: 23903 - RNA, 19 nt, artificial
  Oligomer
cgcagacugcaaacagauc

SEQ ID NO: 23904 - RNA, 19 nt, artificial
  Oligomer
gugucagucaccuuaucag

SEQ ID NO: 23905 - RNA, 19 nt, artificial
  Oligomer
aucccaacgacaaagucau

SEQ ID NO: 23906 - RNA, 19 nt, artificial
  Oligomer
ccaggacaugaacaagcug

SEQ ID NO: 23907 - RNA, 19 nt, artificial
  Oligomer
cuaaggaucaccgcuuuga

SEQ ID NO: 23908 - RNA, 19 nt, artificial
  Oligomer
gauccagaaguccgcaaac

SEQ ID NO: 23909 - RNA, 19 nt, artificial
  Oligomer
agugucagucaccuuauca

SEQ ID NO: 23910 - RNA, 19 nt, artificial
  Oligomer
cagucaccuuaucagcuac

SEQ ID NO: 23911 - RNA, 19 nt, artificial
  Oligomer
augucaacguccagaaccu

SEQ ID NO: 23912 - RNA, 19 nt, artificial
  Oligomer
agcuacauugccuguagga

SEQ ID NO: 23913 - RNA, 19 nt, artificial
  Oligomer
ccaccacaugcaaucuauc

SEQ ID NO: 23914 - RNA, 19 nt, artificial
  Oligomer
augaucccuccuaugucaa

SEQ ID NO: 23915 - RNA, 19 nt, artificial
  Oligomer
accacauggacaaucacuu

SEQ ID NO: 23916 - RNA, 19 nt, artificial
  Oligomer
ugguuccaugggaagcuga

SEQ ID NO: 23917 - RNA, 19 nt, artificial
  Oligomer
gggagcuacauugccugua

SEQ ID NO: 23918 - RNA, 19 nt, artificial
  Oligomer
uccagaaguccgcaaacag

SEQ ID NO: 23919 - RNA, 19 nt, artificial
  Oligomer
caaacaauaccucaggaac

SEQ ID NO: 23920 - RNA, 19 nt, artificial
  Oligomer
ggcagagagcuuuuugaug

SEQ ID NO: 23921 - RNA, 19 nt, artificial
  Oligomer
accuuaucagcuaccacau

SEQ ID NO: 23922 - RNA, 19 nt, artificial
  Oligomer
aagugucagucaccuuauc

SEQ ID NO: 23923 - RNA, 19 nt, artificial
  Oligomer
acaaucacuugcccaucau

SEQ ID NO: 23924 - RNA, 19 nt, artificial
  Oligomer
uggacaaucacuugcccau

SEQ ID NO: 23925 - RNA, 19 nt, artificial
  Oligomer
aaagacccugugaaucaga

SEQ ID NO: 23926 - RNA, 19 nt, artificial
  Oligomer
cuacuugguucgguacaug

SEQ ID NO: 23927 - RNA, 19 nt, artificial
  Oligomer
agcccaaguacaauccacu

SEQ ID NO: 23928 - RNA, 19 nt, artificial
  Oligomer
acaugcaaucuaucucauu

SEQ ID NO: 23929 - RNA, 19 nt, artificial
  Oligomer
cuccuaugucaacguccag

SEQ ID NO: 23930 - RNA, 19 nt, artificial
  Oligomer
auccagaaguccgcaaaca

SEQ ID NO: 23931 - RNA, 19 nt, artificial
  Oligomer
acuucaacacccggacuca

SEQ ID NO: 23932 - RNA, 19 nt, artificial
  Oligomer
gacuucuugguacgggaga

SEQ ID NO: 23933 - RNA, 19 nt, artificial
  Oligomer
guaugucgccuauguugcc

SEQ ID NO: 23934 - RNA, 19 nt, artificial
  Oligomer
aggaugucaucagcaccau

SEQ ID NO: 23935 - RNA, 19 nt, artificial
  Oligomer
caaucacucucaccgucuc

SEQ ID NO: 23936 - RNA, 19 nt, artificial
  Oligomer
cuaagcauuugcuacuggu

SEQ ID NO: 23937 - RNA, 19 nt, artificial
  Oligomer
agugggcagccuaagcauu

SEQ ID NO: 23938 - RNA, 19 nt, artificial
  Oligomer
cuaugucaacguccagaac

SEQ ID NO: 23939 - RNA, 19 nt, artificial
  Oligomer
cagccuaagcauuugcuac

SEQ ID NO: 23940 - RNA, 19 nt, artificial
  Oligomer
caccacaugcaaucuaucu

SEQ ID NO: 23941 - RNA, 19 nt, artificial
  Oligomer
gcuuuuugaugaucccucc

SEQ ID NO: 23942 - RNA, 19 nt, artificial
  Oligomer
aauccacuccggaaugagu

SEQ ID NO: 23943 - RNA, 19 nt, artificial
  Oligomer
cuucgaagaugcucuucgg

SEQ ID NO: 23944 - RNA, 19 nt, artificial
  Oligomer
uucaaacaauaccucagga

SEQ ID NO: 23945 - RNA, 19 nt, artificial
  Oligomer
guacaauccacuccggaau

SEQ ID NO: 23946 - RNA, 19 nt, artificial
  Oligomer
guccaggcagagagcuuuu

SEQ ID NO: 23947 - RNA, 19 nt, artificial
  Oligomer
gguucgguacauggguugu

SEQ ID NO: 23948 - RNA, 19 nt, artificial
  Oligomer
gcccuucgaagaugcucuu

SEQ ID NO: 23949 - RNA, 19 nt, artificial
  Oligomer
ugaaagugucagucaccuu

SEQ ID NO: 23950 - RNA, 19 nt, artificial
  Oligomer
ggugguagacaugaggcuu

SEQ ID NO: 23951 - RNA, 19 nt, artificial
  Oligomer
ugaugaucccuccuauguc

SEQ ID NO: 23952 - RNA, 19 nt, artificial
  Oligomer
gucaccuuaucagcuacca

SEQ ID NO: 23953 - RNA, 19 nt, artificial
  Oligomer
gagucucugucaucgaugg

SEQ ID NO: 23954 - RNA, 19 nt, artificial
  Oligomer
cuugggagcuacauugccu

SEQ ID NO: 23955 - RNA, 19 nt, artificial
  Oligomer
ccaggcagagagcuuuuug

SEQ ID NO: 23956 - RNA, 19 nt, artificial
  Oligomer
gagcuuuuugaugaucccu

SEQ ID NO: 23957 - RNA, 19 nt, artificial
  Oligomer
cuccuccaggacaugaaca

SEQ ID NO: 23958 - RNA, 19 nt, artificial
  Oligomer
caaucacuugcccaucauc

SEQ ID NO: 23959 - RNA, 19 nt, artificial
  Oligomer
aacccacccaaacugguca

SEQ ID NO: 23960 - RNA, 19 nt, artificial
  Oligomer
gggagcuuugucaauaagc

SEQ ID NO: 23961 - RNA, 19 nt, artificial
  Oligomer
guugcgcuucaaacaauac

SEQ ID NO: 23962 - RNA, 19 nt, artificial
  Oligomer
gcuucaaacaauaccucag

SEQ ID NO: 23963 - RNA, 19 nt, artificial
  Oligomer
uccuacuugguucgguaca

SEQ ID NO: 23964 - RNA, 19 nt, artificial
  Oligomer
gagcuacauugccuguagg

SEQ ID NO: 23965 - RNA, 19 nt, artificial
  Oligomer
acaaggaggagaaagcccu

SEQ ID NO: 23966 - RNA, 19 nt, artificial
  Oligomer
gugucuacagcaaccugug

SEQ ID NO: 23967 - RNA, 19 nt, artificial
  Oligomer
ccacuugggagcuacauug

SEQ ID NO: 23968 - RNA, 19 nt, artificial
  Oligomer
agucucugucaucgaugga

SEQ ID NO: 23969 - RNA, 19 nt, artificial
  Oligomer
aaguacaauccacuccgga

SEQ ID NO: 23970 - RNA, 19 nt, artificial
  Oligomer
agaaguccgcaaacagaug

SEQ ID NO: 23971 - RNA, 19 nt, artificial
  Oligomer
acaauaccucaggaaccca

SEQ ID NO: 23972 - RNA, 19 nt, artificial
  Oligomer
ggcagccuaagcauuugcu

SEQ ID NO: 23973 - RNA, 19 nt, artificial
  Oligomer
caaguacaauccacuccgg

SEQ ID NO: 23974 - RNA, 19 nt, artificial
  Oligomer
agcuuugucaauaagccca

SEQ ID NO: 23975 - RNA, 19 nt, artificial
  Oligomer
gucagucaccuuaucagcu

SEQ ID NO: 23976 - RNA, 19 nt, artificial
  Oligomer
acaugaacaagcugagugg

SEQ ID NO: 23977 - RNA, 19 nt, artificial
  Oligomer
gacccugugaaucagagag

SEQ ID NO: 23978 - RNA, 19 nt, artificial
  Oligomer
ccugugaaucagagagccu

SEQ ID NO: 23979 - RNA, 19 nt, artificial
  Oligomer
agccuaagcauuugcuacu

SEQ ID NO: 23980 - RNA, 19 nt, artificial
  Oligomer
uugguucgguacauggguu

SEQ ID NO: 23981 - RNA, 19 nt, artificial
  Oligomer
cauggacaaucacuugccc

SEQ ID NO: 23982 - RNA, 19 nt, artificial
  Oligomer
caauccacuccggaaugag

SEQ ID NO: 23983 - RNA, 19 nt, artificial
  Oligomer
gacaugaagcccuucgaag

SEQ ID NO: 23984 - RNA, 19 nt, artificial
  Oligomer
ccaaucacucucaccgucu

SEQ ID NO: 23985 - RNA, 19 nt, artificial
  Oligomer
aucagcuaccacauggaca

SEQ ID NO: 23986 - RNA, 19 nt, artificial
  Oligomer
cuuuuugaugaucccuccu

SEQ ID NO: 23987 - RNA, 19 nt, artificial
  Oligomer
guacuauaaugacuucccg

SEQ ID NO: 23988 - RNA, 19 nt, artificial
  Oligomer
cuccggaaugagucucugu

SEQ ID NO: 23989 - RNA, 19 nt, artificial
  Oligomer
caaccaccacaugcaaucu

SEQ ID NO: 23990 - RNA, 19 nt, artificial
  Oligomer
accaucaguacuauaauga

SEQ ID NO: 23991 - RNA, 19 nt, artificial
  Oligomer
gcgcuucaaacaauaccuc

SEQ ID NO: 23992 - RNA, 19 nt, artificial
  Oligomer
gaagcccuucgaagaugcu

SEQ ID NO: 23993 - RNA, 19 nt, artificial
  Oligomer
ggguuuccuacuugguucg

SEQ ID NO: 23994 - RNA, 19 nt, artificial
  Oligomer
cuacccugugcuccuucuu

SEQ ID NO: 23995 - RNA, 19 nt, artificial
  Oligomer
gcaucccaacgacaaaguc

SEQ ID NO: 23996 - RNA, 19 nt, artificial
  Oligomer
gcccaaguacaauccacuc

SEQ ID NO: 23997 - RNA, 19 nt, artificial
  Oligomer
gagcuuugucaauaagccc

SEQ ID NO: 23998 - RNA, 19 nt, artificial
  Oligomer
aagcccaaguacaauccac

SEQ ID NO: 23999 - RNA, 19 nt, artificial
  Oligomer
cugcaucccaacgacaaag

SEQ ID NO: 24000 - RNA, 19 nt, artificial
  Oligomer
gacugcaaacagaucaucg

SEQ ID NO: 24001 - RNA, 19 nt, artificial
  Oligomer
uuugaugaucccuccuaug

SEQ ID NO: 24002 - RNA, 19 nt, artificial
  Oligomer
aaccaccacaugcaaucua

SEQ ID NO: 24003 - RNA, 19 nt, artificial
  Oligomer
acuugguucgguacauggg

SEQ ID NO: 24004 - RNA, 19 nt, artificial
  Oligomer
cccaauccugcuaucaaug

SEQ ID NO: 24005 - RNA, 19 nt, artificial
  Oligomer
aagacccugugaaucagag

SEQ ID NO: 24006 - RNA, 19 nt, artificial
  Oligomer
ugucaucgauggaggaagg

SEQ ID NO: 24007 - RNA, 19 nt, artificial
  Oligomer
caauaccucaggaacccac

SEQ ID NO: 24008 - RNA, 19 nt, artificial
  Oligomer
ugggcagccuaagcauuug

SEQ ID NO: 24009 - RNA, 19 nt, artificial
  Oligomer
uccuaugucaacguccaga

SEQ ID NO: 24010 - RNA, 19 nt, artificial
  Oligomer
ggaaugagucucugucauc

SEQ ID NO: 24011 - RNA, 19 nt, artificial
  Oligomer
ugaucccuccuaugucaac

SEQ ID NO: 24012 - RNA, 19 nt, artificial
  Oligomer
gauagucccacuacccugu

SEQ ID NO: 24013 - RNA, 19 nt, artificial
  Oligomer
cuguuugacaugaagcccu

SEQ ID NO: 24014 - RNA, 19 nt, artificial
  Oligomer
uuuuugaugaucccuccua

SEQ ID NO: 24015 - RNA, 19 nt, artificial
  Oligomer
guuuccuacuugguucggu

SEQ ID NO: 24016 - RNA, 19 nt, artificial
  Oligomer
ccuuaucagcuaccacaug

SEQ ID NO: 24017 - RNA, 19 nt, artificial
  Oligomer
acaauccacuccggaauga

SEQ ID NO: 24018 - RNA, 19 nt, artificial
  Oligomer
gagagcuuuuugaugaucc

SEQ ID NO: 24019 - RNA, 19 nt, artificial
  Oligomer
aggaucaccgcuuugaaag

SEQ ID NO: 24020 - RNA, 19 nt, artificial
  Oligomer
ugaacaagcugaguggagg

SEQ ID NO: 24021 - RNA, 19 nt, artificial
  Oligomer
aucaguacuauaaugacuu

SEQ ID NO: 24022 - RNA, 19 nt, artificial
  Oligomer
gaaugagucucugucaucg

SEQ ID NO: 24023 - RNA, 19 nt, artificial
  Oligomer
ccaaguacaauccacuccg

SEQ ID NO: 24024 - RNA, 19 nt, artificial
  Oligomer
gucuacagcaaccugugga

SEQ ID NO: 24025 - RNA, 19 nt, artificial
  Oligomer
ggacaaucacuugcccauc

SEQ ID NO: 24026 - RNA, 19 nt, artificial
  Oligomer
cgcuuugaaagugucaguc

SEQ ID NO: 24027 - RNA, 19 nt, artificial
  Oligomer
aaacaauaccucaggaacc

SEQ ID NO: 24028 - RNA, 19 nt, artificial
  Oligomer
gcuuugucaauaagcccac

SEQ ID NO: 24029 - RNA, 19 nt, artificial
  Oligomer
auggacaaucacuugccca

SEQ ID NO: 24030 - RNA, 19 nt, artificial
  Oligomer
ugucagucaccuuaucagc

SEQ ID NO: 24031 - RNA, 19 nt, artificial
  Oligomer
aacguccagaaccuagaca

SEQ ID NO: 24032 - RNA, 19 nt, artificial
  Oligomer
gucaacguccagaaccuag

SEQ ID NO: 24033 - RNA, 19 nt, artificial
  Oligomer
cuaucucauuugcauccgg

SEQ ID NO: 24034 - RNA, 19 nt, artificial
  Oligomer
ucccaacgacaaagucaug

SEQ ID NO: 24035 - RNA, 19 nt, artificial
  Oligomer
aaucacuugcccaucaucu

SEQ ID NO: 24036 - RNA, 19 nt, artificial
  Oligomer
cccaagcccaaguacaauc

SEQ ID NO: 24037 - RNA, 19 nt, artificial
  Oligomer
ucaguacuauaaugacuuc

SEQ ID NO: 24038 - RNA, 19 nt, artificial
  Oligomer
ucaccuuaucagcuaccac

SEQ ID NO: 24039 - RNA, 19 nt, artificial
  Oligomer
uaccacauggacaaucacu

SEQ ID NO: 24040 - RNA, 19 nt, artificial
  Oligomer
acgauagucccacuacccu

SEQ ID NO: 24041 - RNA, 19 nt, artificial
  Oligomer
acuucuugguacgggagag

SEQ ID NO: 24042 - RNA, 19 nt, artificial
  Oligomer
uguccaggcagagagcuuu

SEQ ID NO: 24043 - RNA, 19 nt, artificial
  Oligomer
cugucaucgauggaggaag

SEQ ID NO: 24044 - RNA, 19 nt, artificial
  Oligomer
ccaacgacaaagucauggg

SEQ ID NO: 24045 - RNA, 19 nt, artificial
  Oligomer
gccuaagcauuugcuacug

SEQ ID NO: 24046 - RNA, 19 nt, artificial
  Oligomer
uacauugccuguaggacag

SEQ ID NO: 24047 - RNA, 19 nt, artificial
  Oligomer
cugcaaacagaucaucgcc

SEQ ID NO: 24048 - RNA, 19 nt, artificial
  Oligomer
uccagaaccuagacaaggc

SEQ ID NO: 24049 - RNA, 19 nt, artificial
  Oligomer
ugggagcuacauugccugu

SEQ ID NO: 24050 - RNA, 19 nt, artificial
  Oligomer
ugcaucccaacgacaaagu

SEQ ID NO: 24051 - RNA, 19 nt, artificial
  Oligomer
ugguagacaugaggcuucg

SEQ ID NO: 24052 - RNA, 19 nt, artificial
  Oligomer
gugguucggacuaaggauc

SEQ ID NO: 24053 - RNA, 19 nt, artificial
  Oligomer
uugaugaucccuccuaugu

SEQ ID NO: 24054 - RNA, 19 nt, artificial
  Oligomer
uucgaguugcgcuucaaac

SEQ ID NO: 24055 - RNA, 19 nt, artificial
  Oligomer
ucacuugcccaucaucucu

SEQ ID NO: 24056 - RNA, 19 nt, artificial
  Oligomer
cuucaaacaauaccucagg

SEQ ID NO: 24057 - RNA, 19 nt, artificial
  Oligomer
uugaaagugucagucaccu

SEQ ID NO: 24058 - RNA, 19 nt, artificial
  Oligomer
aguaugucgccuauguugc

SEQ ID NO: 24059 - RNA, 19 nt, artificial
  Oligomer
aucacucucaccgucucca

SEQ ID NO: 24060 - RNA, 19 nt, artificial
  Oligomer
aaccuguggagcggaaacu

SEQ ID NO: 24061 - RNA, 19 nt, artificial
  Oligomer
uacuugguucgguacaugg

SEQ ID NO: 24062 - RNA, 19 nt, artificial
  Oligomer
ucugucaucgauggaggaa

SEQ ID NO: 24063 - RNA, 19 nt, artificial
  Oligomer
aaggaggagaaagcccugu

SEQ ID NO: 24064 - RNA, 19 nt, artificial
  Oligomer
cuugcccaggaugucauca

SEQ ID NO: 24065 - RNA, 19 nt, artificial
  Oligomer
cacuccggaaugagucucu

SEQ ID NO: 24066 - RNA, 19 nt, artificial
  Oligomer
ucaccgcuuugaaaguguc

SEQ ID NO: 24067 - RNA, 19 nt, artificial
  Oligomer
ccaaccaccacaugcaauc

SEQ ID NO: 24068 - RNA, 19 nt, artificial
  Oligomer
agcccuucgaagaugcucu

SEQ ID NO: 24069 - RNA, 19 nt, artificial
  Oligomer
guucgguacauggguugug

SEQ ID NO: 24070 - RNA, 19 nt, artificial
  Oligomer
ugugaaucagagagccugc

SEQ ID NO: 24071 - RNA, 19 nt, artificial
  Oligomer
acugcaaacagaucaucgc

SEQ ID NO: 24072 - RNA, 19 nt, artificial
  Oligomer
cuccaggacaugaacaagc

SEQ ID NO: 24073 - RNA, 19 nt, artificial
  Oligomer
cugaaauuugcuggaaugc

SEQ ID NO: 24074 - RNA, 19 nt, artificial
  Oligomer
augucaucagcaccauugg

SEQ ID NO: 24075 - RNA, 19 nt, artificial
  Oligomer
accgcuuugaaagugucag

SEQ ID NO: 24076 - RNA, 19 nt, artificial
  Oligomer
gaucccuccuaugucaacg

SEQ ID NO: 24077 - RNA, 19 nt, artificial
  Oligomer
augaacaagcugaguggag

SEQ ID NO: 24078 - RNA, 19 nt, artificial
  Oligomer
ucuacagcaaccuguggag

SEQ ID NO: 24079 - RNA, 19 nt, artificial
  Oligomer
cugugaaucagagagccug

SEQ ID NO: 24080 - RNA, 19 nt, artificial
  Oligomer
gacaugaacaagcugagug

SEQ ID NO: 24081 - RNA, 19 nt, artificial
  Oligomer
acgacaaagucaugggacc

SEQ ID NO: 24082 - RNA, 19 nt, artificial
  Oligomer
cuuugucaauaagcccacg

SEQ ID NO: 24083 - RNA, 19 nt, artificial
  Oligomer
gcuacauugccuguaggac

SEQ ID NO: 24084 - RNA, 19 nt, artificial
  Oligomer
uaucagcuaccacauggac

SEQ ID NO: 24085 - RNA, 19 nt, artificial
  Oligomer
cacuugggagcuacauugc

SEQ ID NO: 24086 - RNA, 19 nt, artificial
  Oligomer
augcaaucuaucucauuug

SEQ ID NO: 24087 - RNA, 19 nt, artificial
  Oligomer
uucuugguacgggagagca

SEQ ID NO: 24088 - RNA, 19 nt, artificial
  Oligomer
uccaggcagagagcuuuuu

SEQ ID NO: 24089 - RNA, 19 nt, artificial
  Oligomer
guccagaaccuagacaagg

SEQ ID NO: 24090 - RNA, 19 nt, artificial
  Oligomer
aucccuccuaugucaacgu

SEQ ID NO: 24091 - RNA, 19 nt, artificial
  Oligomer
aucaccgcuuugaaagugu

SEQ ID NO: 24092 - RNA, 19 nt, artificial
  Oligomer
ccaagcccaaguacaaucc

SEQ ID NO: 24093 - RNA, 19 nt, artificial
  Oligomer
aaucuaucucauuugcauc

SEQ ID NO: 24094 - RNA, 19 nt, artificial
  Oligomer
uccacuccggaaugagucu

SEQ ID NO: 24095 - RNA, 19 nt, artificial
  Oligomer
aucacuugcccaucaucuc

SEQ ID NO: 24096 - RNA, 19 nt, artificial
  Oligomer
gcauuugcuacugguggac

SEQ ID NO: 24097 - RNA, 19 nt, artificial
  Oligomer
acuacccugugcuccuucu

SEQ ID NO: 24098 - RNA, 19 nt, artificial
  Oligomer
agcuuuuugaugaucccuc

SEQ ID NO: 24099 - RNA, 19 nt, artificial
  Oligomer
auucuggagugucccgaag

SEQ ID NO: 24100 - RNA, 19 nt, artificial
  Oligomer
ccaauccugcuaucaaugg

SEQ ID NO: 24101 - RNA, 19 nt, artificial
  Oligomer
ugagucucugucaucgaug

SEQ ID NO: 24102 - RNA, 19 nt, artificial
  Oligomer
acauucuggagugucccga

SEQ ID NO: 24103 - RNA, 19 nt, artificial
  Oligomer
ugcaaucuaucucauuugc

SEQ ID NO: 24104 - RNA, 19 nt, artificial
  Oligomer
accuguuugacaugaagcc

SEQ ID NO: 24105 - RNA, 19 nt, artificial
  Oligomer
ugguucgguacauggguug

SEQ ID NO: 24106 - RNA, 19 nt, artificial
  Oligomer
agagagcuuuuugaugauc

SEQ ID NO: 24107 - RNA, 19 nt, artificial
  Oligomer
ccuaagcauuugcuacugg

SEQ ID NO: 24108 - RNA, 19 nt, artificial
  Oligomer
aauaccucaggaacccacc

SEQ ID NO: 24109 - RNA, 19 nt, artificial
  Oligomer
gaccuguuugacaugaagc

SEQ ID NO: 24110 - RNA, 19 nt, artificial
  Oligomer
agacugcaaacagaucauc

SEQ ID NO: 24111 - RNA, 19 nt, artificial
  Oligomer
acuaaggaucaccgcuuug

SEQ ID NO: 24112 - RNA, 19 nt, artificial
  Oligomer
gugguagacaugaggcuuc

SEQ ID NO: 24113 - RNA, 19 nt, artificial
  Oligomer
accacaugcaaucuaucuc

SEQ ID NO: 24114 - RNA, 19 nt, artificial
  Oligomer
ccuucgaagaugcucuucg

SEQ ID NO: 24115 - RNA, 19 nt, artificial
  Oligomer
guuugacaugaagcccuuc

SEQ ID NO: 24116 - RNA, 19 nt, artificial
  Oligomer
aacaauaccucaggaaccc

SEQ ID NO: 24117 - RNA, 19 nt, artificial
  Oligomer
acauggacaaucacuugcc

SEQ ID NO: 24118 - RNA, 19 nt, artificial
  Oligomer
uuccuacuugguucgguac

SEQ ID NO: 24119 - RNA, 19 nt, artificial
  Oligomer
cuuaucagcuaccacaugg

SEQ ID NO: 24120 - RNA, 19 nt, artificial
  Oligomer
acuccggaaugagucucug

SEQ ID NO: 24121 - RNA, 19 nt, artificial
  Oligomer
cacuugcccaucaucucug

SEQ ID NO: 24122 - RNA, 19 nt, artificial
  Oligomer
uugggagcuacauugccug

SEQ ID NO: 24123 - RNA, 19 nt, artificial
  Oligomer
ugucuacagcaaccugugg

SEQ ID NO: 24124 - RNA, 19 nt, artificial
  Oligomer
uugcccaggaugucaucag

SEQ ID NO: 24125 - RNA, 19 nt, artificial
  Oligomer
aucucauuugcauccggcg

SEQ ID NO: 24126 - RNA, 19 nt, artificial
  Oligomer
uugcgcuucaaacaauacc

SEQ ID NO: 24127 - RNA, 19 nt, artificial
  Oligomer
uuugaaagugucagucacc

SEQ ID NO: 24128 - RNA, 19 nt, artificial
  Oligomer
gaugucaucagcaccauug

SEQ ID NO: 24129 - RNA, 19 nt, artificial
  Oligomer
uaagcauuugcuacuggug

SEQ ID NO: 24130 - RNA, 19 nt, artificial
  Oligomer
ugaaauuugcuggaaugcc

SEQ ID NO: 24131 - RNA, 19 nt, artificial
  Oligomer
guaaccugaaauuugcugg

SEQ ID NO: 24132 - RNA, 19 nt, artificial
  Oligomer
uucggacuaaggaucaccg

SEQ ID NO: 24133 - RNA, 19 nt, artificial
  Oligomer
ccuguuugacaugaagccc

SEQ ID NO: 24134 - RNA, 19 nt, artificial
  Oligomer
gaucaccgcuuugaaagug

SEQ ID NO: 24135 - RNA, 19 nt, artificial
  Oligomer
aguacuauaaugacuuccc

SEQ ID NO: 24136 - RNA, 19 nt, artificial
  Oligomer
aagcauuugcuacuggugg

SEQ ID NO: 24137 - RNA, 19 nt, artificial
  Oligomer
uugucaauaagcccacgcg

SEQ ID NO: 24138 - RNA, 19 nt, artificial
  Oligomer
cacauggacaaucacuugc

SEQ ID NO: 24139 - RNA, 19 nt, artificial
  Oligomer
aacgacaaagucaugggac

SEQ ID NO: 24140 - RNA, 19 nt, artificial
  Oligomer
ugaagcccuucgaagaugc

SEQ ID NO: 24141 - RNA, 19 nt, artificial
  Oligomer
ucgaagaugcucuucgggu

SEQ ID NO: 24142 - RNA, 19 nt, artificial
  Oligomer
gucucugucaucgauggag

SEQ ID NO: 24143 - RNA, 19 nt, artificial
  Oligomer
auugccuguaggacagccu

SEQ ID NO: 24144 - RNA, 19 nt, artificial
  Oligomer
aguaaccugaaauuugcug

SEQ ID NO: 24145 - RNA, 19 nt, artificial
  Oligomer
guucggacuaaggaucacc

SEQ ID NO: 24146 - RNA, 19 nt, artificial
  Oligomer
uccggaaugagucucuguc

SEQ ID NO: 24147 - RNA, 19 nt, artificial
  Oligomer
uuugcuacugguggacccu

SEQ ID NO: 24148 - RNA, 19 nt, artificial
  Oligomer
gguuuccuacuugguucgg

SEQ ID NO: 24149 - RNA, 19 nt, artificial
  Oligomer
ucucugucaucgauggagg

SEQ ID NO: 24150 - RNA, 19 nt, artificial
  Oligomer
acuugggagcuacauugcc

SEQ ID NO: 24151 - RNA, 19 nt, artificial
  Oligomer
acuugcccaucaucucugc

SEQ ID NO: 24152 - RNA, 19 nt, artificial
  Oligomer
acccugugaaucagagagc

SEQ ID NO: 24153 - RNA, 19 nt, artificial
  Oligomer
gaaguccgcaaacagaugc

SEQ ID NO: 24154 - RNA, 19 nt, artificial
  Oligomer
auuugcuacugguggaccc

SEQ ID NO: 24155 - RNA, 19 nt, artificial
  Oligomer
ucccuccuaugucaacguc

SEQ ID NO: 24156 - RNA, 19 nt, artificial
  Oligomer
caguacuauaaugacuucc

SEQ ID NO: 24157 - RNA, 19 nt, artificial
  Oligomer
aaucacucucaccgucucc

SEQ ID NO: 24158 - RNA, 19 nt, artificial
  Oligomer
uacaauccacuccggaaug

SEQ ID NO: 24159 - RNA, 19 nt, artificial
  Oligomer
aaguccgcaaacagaugcc

SEQ ID NO: 24160 - RNA, 19 nt, artificial
  Oligomer
cccaaguacaauccacucc

SEQ ID NO: 24161 - RNA, 19 nt, artificial
  Oligomer
uaucucauuugcauccggc

SEQ ID NO: 24162 - RNA, 19 nt, artificial
  Oligomer
uacccugugcuccuucuuc

SEQ ID NO: 24163 - RNA, 19 nt, artificial
  Oligomer
cccaacgacaaagucaugg

SEQ ID NO: 24164 - RNA, 19 nt, artificial
  Oligomer
uacuauaaugacuucccgg

SEQ ID NO: 24165 - RNA, 19 nt, artificial
  Oligomer
auccacuccggaaugaguc

SEQ ID NO: 24166 - RNA, 19 nt, artificial
  Oligomer
agucaccuuaucagcuacc

SEQ ID NO: 24167 - RNA, 19 nt, artificial
  Oligomer
agcuaccacauggacaauc

SEQ ID NO: 24168 - RNA, 19 nt, artificial
  Oligomer
uucgaagaugcucuucggg

SEQ ID NO: 24169 - RNA, 19 nt, artificial
  Oligomer
augaagcccuucgaagaug

SEQ ID NO: 24170 - RNA, 19 nt, artificial
  Oligomer
uaugucaacguccagaacc

SEQ ID NO: 24171 - RNA, 19 nt, artificial
  Oligomer
acauugccuguaggacagc

SEQ ID NO: 24172 - RNA, 19 nt, artificial
  Oligomer
cauuugcuacugguggacc

SEQ ID NO: 24173 - RNA, 19 nt, artificial
  Oligomer
cccuucgaagaugcucuuc

SEQ ID NO: 24174 - RNA, 19 nt, artificial
  Oligomer
ucuaucucauuugcauccg

SEQ ID NO: 24175 - RNA, 19 nt, artificial
  Oligomer
acuauaaugacuucccggg

SEQ ID NO: 24176 - RNA, 19 nt, artificial
  Oligomer
auagucccacuacccugug

SEQ ID NO: 24177 - RNA, 19 nt, artificial
  Oligomer
aagcccuucgaagaugcuc

SEQ ID NO: 24178 - RNA, 19 nt, artificial
  Oligomer
uuugacaugaagcccuucg

SEQ ID NO: 24179 - RNA, 19 nt, artificial
  Oligomer
aucuaucucauuugcaucc

SEQ ID NO: 24180 - RNA, 19 nt, Artificial
  Oligomer
uuugucaauaagcccacgc

SEQ ID NO: 24181 - RNA, 19 nt, artificial
  Oligomer
uuauugacaaagcucccgu

SEQ ID NO: 24182 - RNA, 19 nt, artificial
  Oligomer
uuguuugaagcgcaacucg

SEQ ID NO: 24183 - RNA, 19 nt, artificial
  Oligomer
uuugucguugggaugcagc

SEQ ID NO: 24184 - RNA, 19 nt, artificial
  Oligomer
ucuguuugcggacuucugg

SEQ ID NO: 24185 - RNA, 19 nt, artificial
  Oligomer
aacauaggcgacauacucg

SEQ ID NO: 24186 - RNA, 19 nt, artificial
  Oligomer
uucaaagcggugauccuua

SEQ ID NO: 24187 - RNA, 19 nt, artificial
  Oligomer
uucaugucaaacagguccc

SEQ ID NO: 24188 - RNA, 19 nt, artificial
  Oligomer
aauuucagguuacuccucc

SEQ ID NO: 24189 - RNA, 19 nt, artificial
  Oligomer
ucaaaaagcucucugccug

SEQ ID NO: 24190 - RNA, 19 nt, artificial
  Oligomer
uauuguuugaagcgcaacu

SEQ ID NO: 24191 - RNA, 19 nt, artificial
  Oligomer
uuugaagcgcaacucgaag

SEQ ID NO: 24192 - RNA, 19 nt, artificial
  Oligomer
aucaucaaaaagcucucug

SEQ ID NO: 24193 - RNA, 19 nt, artificial
  Oligomer
uuucaaagcggugauccuu

SEQ ID NO: 24194 - RNA, 19 nt, artificial
  Oligomer
uugaagcgcaacucgaagg

SEQ ID NO: 24195 - RNA, 19 nt, artificial
  Oligomer
acauaggcgacauacucgg

SEQ ID NO: 24196 - RNA, 19 nt, artificial
  Oligomer
auaggcgacauacucggcu

SEQ ID NO: 24197 - RNA, 19 nt, artificial
  Oligomer
ugacauaggagggaucauc

SEQ ID NO: 24198 - RNA, 19 nt, artificial
  Oligomer
uccuuaguccgaaccacac

SEQ ID NO: 24199 - RNA, 19 nt, artificial
  Oligomer
auugacuggaggaccucca

SEQ ID NO: 24200 - RNA, 19 nt, artificial
  Oligomer
aucuguuugcggacuucug

SEQ ID NO: 24201 - RNA, 19 nt, artificial
  Oligomer
uggacguugacauaggagg

SEQ ID NO: 24202 - RNA, 19 nt, artificial
  Oligomer
uuaguccgaaccacacccu

SEQ ID NO: 24203 - RNA, 19 nt, artificial
  Oligomer
auuauaguacugaugguca

SEQ ID NO: 24204 - RNA, 19 nt, artificial
  Oligomer
aucuguuugcagucugcgg

SEQ ID NO: 24205 - RNA, 19 nt, artificial
  Oligomer
augacagagacucauuccg

SEQ ID NO: 24206 - RNA, 19 nt, artificial
  Oligomer
uucgggacacuccagaaug

SEQ ID NO: 24207 - RNA, 19 nt, artificial
  Oligomer
auuguuugaagcgcaacuc

SEQ ID NO: 24208 - RNA, 19 nt, artificial
  Oligomer
augcaaaugagauagauug

SEQ ID NO: 24209 - RNA, 19 nt, artificial
  Oligomer
uauaguacugauggucagg

SEQ ID NO: 24210 - RNA, 19 nt, artificial
  Oligomer
uucgaagggcuucauguca

SEQ ID NO: 24211 - RNA, 19 nt, artificial
  Oligomer
cuugucuagguucuggacg

SEQ ID NO: 24212 - RNA, 19 nt, artificial
  Oligomer
ugauuguccaugugguagc

SEQ ID NO: 24213 - RNA, 19 nt, artificial
  Oligomer
cuuauugacaaagcucccg

SEQ ID NO: 24214 - RNA, 19 nt, artificial
  Oligomer
gcaaauuucagguuacucc

SEQ ID NO: 24215 - RNA, 19 nt, artificial
  Oligomer
uucuggacguugacauagg

SEQ ID NO: 24216 - RNA, 19 nt, artificial
  Oligomer
auuucagguuacuccuccc

SEQ ID NO: 24217 - RNA, 19 nt, artificial
  Oligomer
auccuuaguccgaaccaca

SEQ ID NO: 24218 - RNA, 19 nt, artificial
  Oligomer
uuccuccuccucaucccau

SEQ ID NO: 24219 - RNA, 19 nt, artificial
  Oligomer
auguaccgaaccaaguagg

SEQ ID NO: 24220 - RNA, 19 nt, artificial
  Oligomer
uucccgaagccucaugucu

SEQ ID NO: 24221 - RNA, 19 nt, artificial
  Oligomer
uuguccaugugguagcuga

SEQ ID NO: 24222 - RNA, 19 nt, artificial
  Oligomer
augaucuguuugcagucug

SEQ ID NO: 24223 - RNA, 19 nt, artificial
  Oligomer
ucacaguuuccgcuccaca

SEQ ID NO: 24224 - RNA, 19 nt, artificial
  Oligomer
ugacagagacucauuccgg

SEQ ID NO: 24225 - RNA, 19 nt, artificial
  Oligomer
uuauaguacugauggucag

SEQ ID NO: 24226 - RNA, 19 nt, artificial
  Oligomer
aucaaaaagcucucugccu

SEQ ID NO: 24227 - RNA, 19 nt, artificial
  Oligomer
uauugacaaagcucccgug

SEQ ID NO: 24228 - RNA, 19 nt, artificial
  Oligomer
uagcaaaugcuuaggcugc

SEQ ID NO: 24229 - RNA, 19 nt, artificial
  Oligomer
ucaucaaaaagcucucugc

SEQ ID NO: 24230 - RNA, 19 nt, artificial
  Oligomer
cuucaugucaaacaggucc

SEQ ID NO: 24231 - RNA, 19 nt, artificial
  Oligomer
ugauucacagggucuuugg

SEQ ID NO: 24232 - RNA, 19 nt, artificial
  Oligomer
uaaggugacugacacuuuc

SEQ ID NO: 24233 - RNA, 19 nt, artificial
  Oligomer
ugagguauuguuugaagcg

SEQ ID NO: 24234 - RNA, 19 nt, artificial
  Oligomer
agcaaauuucagguuacuc

SEQ ID NO: 24235 - RNA, 19 nt, artificial
  Oligomer
auaggagggaucaucaaaa

SEQ ID NO: 24236 - RNA, 19 nt, artificial
  Oligomer
ucuucgaagggcuucaugu

SEQ ID NO: 24237 - RNA, 19 nt, artificial
  Oligomer
auugacaaagcucccgugg

SEQ ID NO: 24238 - RNA, 19 nt, artificial
  Oligomer
uacagggcuuucuccuccu

SEQ ID NO: 24239 - RNA, 19 nt, artificial
  Oligomer
ucccaugacuuugucguug

SEQ ID NO: 24240 - RNA, 19 nt, artificial
  Oligomer
acucagcuuguucaugucc

SEQ ID NO: 24241 - RNA, 19 nt, artificial
  Oligomer
uugucuagguucuggacgu

SEQ ID NO: 24242 - RNA, 19 nt, artificial
  Oligomer
auuccagcaaauuucaggu

SEQ ID NO: 24243 - RNA, 19 nt, artificial
  Oligomer
uccacucagcuuguucaug

SEQ ID NO: 24244 - RNA, 19 nt, artificial
  Oligomer
ucucugauucacagggucu

SEQ ID NO: 24245 - RNA, 19 nt, artificial
  Oligomer
ugagauagauugcaugugg

SEQ ID NO: 24246 - RNA, 19 nt, artificial
  Oligomer
uuguucauguccuggagga

SEQ ID NO: 24247 - RNA, 19 nt, artificial
  Oligomer
gucauuauaguacugaugg

SEQ ID NO: 24248 - RNA, 19 nt, artificial
  Oligomer
ugugguagcugauaaggug

SEQ ID NO: 24249 - RNA, 19 nt, artificial
  Oligomer
uguuugaagcgcaacucga

SEQ ID NO: 24250 - RNA, 19 nt, artificial
  Oligomer
acuuucaaagcggugaucc

SEQ ID NO: 24251 - RNA, 19 nt, artificial
  Oligomer
ugacacuuucaaagcggug

SEQ ID NO: 24252 - RNA, 19 nt, artificial
  Oligomer
cucagcuuguucauguccu

SEQ ID NO: 24253 - RNA, 19 nt, artificial
  Oligomer
cauuccagcaaauuucagg

SEQ ID NO: 24254 - RNA, 19 nt, artificial
  Oligomer
acugacacuuucaaagcgg

SEQ ID NO: 24255 - RNA, 19 nt, artificial
  Oligomer
uaguacugauggucaggug

SEQ ID NO: 24256 - RNA, 19 nt, artificial
  Oligomer
aucuucgaagggcuucaug

SEQ ID NO: 24257 - RNA, 19 nt, artificial
  Oligomer
aaagcggugauccuuaguc

SEQ ID NO: 24258 - RNA, 19 nt, artificial
  Oligomer
aauggugcugaugacaucc

SEQ ID NO: 24259 - RNA, 19 nt, artificial
  Oligomer
uaccgaaccaaguaggaaa

SEQ ID NO: 24260 - RNA, 19 nt, artificial
  Oligomer
auaguacugauggucaggu

SEQ ID NO: 24261 - RNA, 19 nt, artificial
  Oligomer
aucaucagcugcccuuccu

SEQ ID NO: 24262 - RNA, 19 nt, artificial
  Oligomer
uuccggaguggauuguacu

SEQ ID NO: 24263 - RNA, 19 nt, artificial
  Oligomer
aaauuucagguuacuccuc

SEQ ID NO: 24264 - RNA, 19 nt, artificial
  Oligomer
ugacugacacuuucaaagc

SEQ ID NO: 24265 - RNA, 19 nt, artificial
  Oligomer
uuugcggacuucuggaucu

SEQ ID NO: 24266 - RNA, 19 nt, artificial
  Oligomer
ucccgaagccucaugucua

SEQ ID NO: 24267 - RNA, 19 nt, artificial
  Oligomer
agucauuauaguacugaug

SEQ ID NO: 24268 - RNA, 19 nt, artificial
  Oligomer
uggugcugaugacauccug

SEQ ID NO: 24269 - RNA, 19 nt, artificial
  Oligomer
uggauuguacuugggcuug

SEQ ID NO: 24270 - RNA, 19 nt, artificial
  Oligomer
caacauaggcgacauacuc

SEQ ID NO: 24271 - RNA, 19 nt, artificial
  Oligomer
uccuccaucgaugacagag

SEQ ID NO: 24272 - RNA, 19 nt, artificial
  Oligomer
uguccuacaggcaauguag

SEQ ID NO: 24273 - RNA, 19 nt, artificial
  Oligomer
auaaggugacugacacuuu

SEQ ID NO: 24274 - RNA, 19 nt, artificial
  Oligomer
aaaugagauagauugcaug

SEQ ID NO: 24275 - RNA, 19 nt, artificial
  Oligomer
acccauguaccgaaccaag

SEQ ID NO: 24276 - RNA, 19 nt, artificial
  Oligomer
uccaccaguagcaaaugcu

SEQ ID NO: 24277 - RNA, 19 nt, artificial
  Oligomer
aguacugauggucaggugg

SEQ ID NO: 24278 - RNA, 19 nt, artificial
  Oligomer
cuacaggcaauguagcucc

SEQ ID NO: 24279 - RNA, 19 nt, artificial
  Oligomer
auuguccaugugguagcug

SEQ ID NO: 24280 - RNA, 19 nt, artificial
  Oligomer
uugcggacuucuggaucuc

SEQ ID NO: 24281 - RNA, 19 nt, artificial
  Oligomer
gugauuguccaugugguag

SEQ ID NO: 24282 - RNA, 19 nt, artificial
  Oligomer
augagauagauugcaugug

SEQ ID NO: 24283 - RNA, 19 nt, artificial
  Oligomer
ucagcuuguucauguccug

SEQ ID NO: 24284 - RNA, 19 nt, artificial
  Oligomer
ugaucuguuugcagucugc

SEQ ID NO: 24285 - RNA, 19 nt, artificial
  Oligomer
ucuagguucuggacguuga

SEQ ID NO: 24286 - RNA, 19 nt, artificial
  Oligomer
ugaugggcaagugauuguc

SEQ ID NO: 24287 - RNA, 19 nt, artificial
  Oligomer
gugacugacacuuucaaag

SEQ ID NO: 24288 - RNA, 19 nt, artificial
  Oligomer
uagguucuggacguugaca

SEQ ID NO: 24289 - RNA, 19 nt, artificial
  Oligomer
aagcggugauccuuagucc

SEQ ID NO: 24290 - RNA, 19 nt, artificial
  Oligomer
caaauuucagguuacuccu

SEQ ID NO: 24291 - RNA, 19 nt, artificial
  Oligomer
ugacuuugucguugggaug

SEQ ID NO: 24292 - RNA, 19 nt, artificial
  Oligomer
aguuuggguggguuccuga

SEQ ID NO: 24293 - RNA, 19 nt, artificial
  Oligomer
auagauugcaugugguggu

SEQ ID NO: 24294 - RNA, 19 nt, artificial
  Oligomer
cugauucacagggucuuug

SEQ ID NO: 24295 - RNA, 19 nt, artificial
  Oligomer
uagcugauaaggugacuga

SEQ ID NO: 24296 - RNA, 19 nt, artificial
  Oligomer
cauuauaguacugaugguc

SEQ ID NO: 24297 - RNA, 19 nt, artificial
  Oligomer
ggcuuauugacaaagcucc

SEQ ID NO: 24298 - RNA, 19 nt, artificial
  Oligomer
uuccagcaaauuucagguu

SEQ ID NO: 24299 - RNA, 19 nt, artificial
  Oligomer
ugcaaaugagauagauugc

SEQ ID NO: 24300 - RNA, 19 nt, artificial
  Oligomer
cuuguucauguccuggagg

SEQ ID NO: 24301 - RNA, 19 nt, artificial
  Oligomer
gucuagguucuggacguug

SEQ ID NO: 24302 - RNA, 19 nt, artificial
  Oligomer
ucaugucaaacaggucccg

SEQ ID NO: 24303 - RNA, 19 nt, artificial
  Oligomer
aaaugcuuaggcugcccac

SEQ ID NO: 24304 - RNA, 19 nt, artificial
  Oligomer
aagggcuucaugucaaaca

SEQ ID NO: 24305 - RNA, 19 nt, artificial
  Oligomer
uccagcaaauuucagguua

SEQ ID NO: 24306 - RNA, 19 nt, artificial
  Oligomer
gggaucaucaaaaagcucu

SEQ ID NO: 24307 - RNA, 19 nt, artificial
  Oligomer
agcuuguucauguccugga

SEQ ID NO: 24308 - RNA, 19 nt, artificial
  Oligomer
ugauccuuaguccgaacca

SEQ ID NO: 24309 - RNA, 19 nt, artificial
  Oligomer
caagugauuguccaugugg

SEQ ID NO: 24310 - RNA, 19 nt, artificial
  Oligomer
uccaugugguagcugauaa

SEQ ID NO: 24311 - RNA, 19 nt, artificial
  Oligomer
aucgaugacagagacucau

SEQ ID NO: 24312 - RNA, 19 nt, artificial
  Oligomer
uuccugagguauuguuuga

SEQ ID NO: 24313 - RNA, 19 nt, artificial
  Oligomer
ucgaagggcuucaugucaa

SEQ ID NO: 24314 - RNA, 19 nt, artificial
  Oligomer
gugauccuuaguccgaacc

SEQ ID NO: 24315 - RNA, 19 nt, artificial
  Oligomer
agguauuguuugaagcgca

SEQ ID NO: 24316 - RNA, 19 nt, artificial
  Oligomer
ucgaugacagagacucauu

SEQ ID NO: 24317 - RNA, 19 nt, artificial
  Oligomer
gaucuguuugcagucugcg

SEQ ID NO: 24318 - RNA, 19 nt, artificial
  Oligomer
cugauaaggugacugacac

SEQ ID NO: 24319 - RNA, 19 nt, artificial
  Oligomer
augacuuugucguugggau

SEQ ID NO: 24320 - RNA, 19 nt, artificial
  Oligomer
cagcuuguucauguccugg

SEQ ID NO: 24321 - RNA, 19 nt, artificial
  Oligomer
ucaaagcggugauccuuag

SEQ ID NO: 24322 - RNA, 19 nt, artificial
  Oligomer
guuugcggacuucuggauc

SEQ ID NO: 24323 - RNA, 19 nt, artificial
  Oligomer
ugauaaggugacugacacu

SEQ ID NO: 24324 - RNA, 19 nt, artificial
  Oligomer
guagcugauaaggugacug

SEQ ID NO: 24325 - RNA, 19 nt, artificial
  Oligomer
agguucuggacguugacau

SEQ ID NO: 24326 - RNA, 19 nt, artificial
  Oligomer
uccuacaggcaauguagcu

SEQ ID NO: 24327 - RNA, 19 nt, artificial
  Oligomer
gauagauugcauguggugg

SEQ ID NO: 24328 - RNA, 19 nt, artificial
  Oligomer
uugacauaggagggaucau

SEQ ID NO: 24329 - RNA, 19 nt, artificial
  Oligomer
aagugauuguccauguggu

SEQ ID NO: 24330 - RNA, 19 nt, artificial
  Oligomer
ucagcuucccauggaacca

SEQ ID NO: 24331 - RNA, 19 nt, artificial
  Oligomer
uacaggcaauguagcuccc

SEQ ID NO: 24332 - RNA, 19 nt, artificial
  Oligomer
cuguuugcggacuucugga

SEQ ID NO: 24333 - RNA, 19 nt, artificial
  Oligomer
guuccugagguauuguuug

SEQ ID NO: 24334 - RNA, 19 nt, artificial
  Oligomer
caucaaaaagcucucugcc

SEQ ID NO: 24335 - RNA, 19 nt, artificial
  Oligomer
augugguagcugauaaggu

SEQ ID NO: 24336 - RNA, 19 nt, artificial
  Oligomer
gauaaggugacugacacuu

SEQ ID NO: 24337 - RNA, 19 nt, artificial
  Oligomer
augaugggcaagugauugu

SEQ ID NO: 24338 - RNA, 19 nt, artificial
  Oligomer
augggcaagugauugucca

SEQ ID NO: 24339 - RNA, 19 nt, artificial
  Oligomer
ucugauucacagggucuuu

SEQ ID NO: 24340 - RNA, 19 nt, artificial
  Oligomer
cauguaccgaaccaaguag

SEQ ID NO: 24341 - RNA, 19 nt, artificial
  Oligomer
aguggauuguacuugggcu

SEQ ID NO: 24342 - RNA, 19 nt, artificial
  Oligomer
aaugagauagauugcaugu

SEQ ID NO: 24343 - RNA, 19 nt, artificial
  Oligomer
cuggacguugacauaggag

SEQ ID NO: 24344 - RNA, 19 nt, artificial
  Oligomer
uguuugcggacuucuggau

SEQ ID NO: 24345 - RNA, 19 nt, artificial
  Oligomer
ugaguccggguguugaagu

SEQ ID NO: 24346 - RNA, 19 nt, artificial
  Oligomer
ucucccguaccaagaaguc

SEQ ID NO: 24347 - RNA, 19 nt, artificial
  Oligomer
ggcaacauaggcgacauac

SEQ ID NO: 24348 - RNA, 19 nt, artificial
  Oligomer
auggugcugaugacauccu

SEQ ID NO: 24349 - RNA, 19 nt, artificial
  Oligomer
gagacggugagagugauug

SEQ ID NO: 24350 - RNA, 19 nt, artificial
  Oligomer
accaguagcaaaugcuuag

SEQ ID NO: 24351 - RNA, 19 nt, artificial
  Oligomer
aaugcuuaggcugcccacu

SEQ ID NO: 24352 - RNA, 19 nt, artificial
  Oligomer
guucuggacguugacauag

SEQ ID NO: 24353 - RNA, 19 nt, artificial
  Oligomer
guagcaaaugcuuaggcug

SEQ ID NO: 24354 - RNA, 19 nt, artificial
  Oligomer
agauagauugcauguggug

SEQ ID NO: 24355 - RNA, 19 nt, artificial
  Oligomer
ggagggaucaucaaaaagc

SEQ ID NO: 24356 - RNA, 19 nt, artificial
  Oligomer
acucauuccggaguggauu

SEQ ID NO: 24357 - RNA, 19 nt, artificial
  Oligomer
ccgaagagcaucuucgaag

SEQ ID NO: 24358 - RNA, 19 nt, artificial
  Oligomer
uccugagguauuguuugaa

SEQ ID NO: 24359 - RNA, 19 nt, artificial
  Oligomer
auuccggaguggauuguac

SEQ ID NO: 24360 - RNA, 19 nt, artificial
  Oligomer
aaaagcucucugccuggac

SEQ ID NO: 24361 - RNA, 19 nt, artificial
  Oligomer
acaacccauguaccgaacc

SEQ ID NO: 24362 - RNA, 19 nt, artificial
  Oligomer
aagagcaucuucgaagggc

SEQ ID NO: 24363 - RNA, 19 nt, artificial
  Oligomer
aaggugacugacacuuuca

SEQ ID NO: 24364 - RNA, 19 nt, artificial
  Oligomer
aagccucaugucuaccacc

SEQ ID NO: 24365 - RNA, 19 nt, artificial
  Oligomer
gacauaggagggaucauca

SEQ ID NO: 24366 - RNA, 19 nt, artificial
  Oligomer
ugguagcugauaaggugac

SEQ ID NO: 24367 - RNA, 19 nt, artificial
  Oligomer
ccaucgaugacagagacuc

SEQ ID NO: 24368 - RNA, 19 nt, artificial
  Oligomer
aggcaauguagcucccaag

SEQ ID NO: 24369 - RNA, 19 nt, artificial
  Oligomer
caaaaagcucucugccugg

SEQ ID NO: 24370 - RNA, 19 nt, artificial
  Oligomer
agggaucaucaaaaagcuc

SEQ ID NO: 24371 - RNA, 19 nt, artificial
  Oligomer
uguucauguccuggaggag

SEQ ID NO: 24372 - RNA, 19 nt, artificial
  Oligomer
gaugaugggcaagugauug

SEQ ID NO: 24373 - RNA, 19 nt, artificial
  Oligomer
ugaccaguuuggguggguu

SEQ ID NO: 24374 - RNA, 19 nt, artificial
  Oligomer
gcuuauugacaaagcuccc

SEQ ID NO: 24375 - RNA, 19 nt, artificial
  Oligomer
guauuguuugaagcgcaac

SEQ ID NO: 24376 - RNA, 19 nt, artificial
  Oligomer
cugagguauuguuugaagc

SEQ ID NO: 24377 - RNA, 19 nt, artificial
  Oligomer
uguaccgaaccaaguagga

SEQ ID NO: 24378 - RNA, 19 nt, artificial
  Oligomer
ccuacaggcaauguagcuc

SEQ ID NO: 24379 - RNA, 19 nt, artificial
  Oligomer
agggcuuucuccuccuugu

SEQ ID NO: 24380 - RNA, 19 nt, artificial
  Oligomer
cacagguugcuguagacac

SEQ ID NO: 24381 - RNA, 19 nt, artificial
  Oligomer
caauguagcucccaagugg

SEQ ID NO: 24382 - RNA, 19 nt, artificial
  Oligomer
uccaucgaugacagagacu

SEQ ID NO: 24383 - RNA, 19 nt, artificial
  Oligomer
uccggaguggauuguacuu

SEQ ID NO: 24384 - RNA, 19 nt, artificial
  Oligomer
caucuguuugcggacuucu

SEQ ID NO: 24385 - RNA, 19 nt, artificial
  Oligomer
uggguuccugagguauugu

SEQ ID NO: 24386 - RNA, 19 nt, artificial
  Oligomer
agcaaaugcuuaggcugcc

SEQ ID NO: 24387 - RNA, 19 nt, artificial
  Oligomer
ccggaguggauuguacuug

SEQ ID NO: 24388 - RNA, 19 nt, artificial
  Oligomer
ugggcuuauugacaaagcu

SEQ ID NO: 24389 - RNA, 19 nt, artificial
  Oligomer
agcugauaaggugacugac

SEQ ID NO: 24390 - RNA, 19 nt, artificial
  Oligomer
ccacucagcuuguucaugu

SEQ ID NO: 24391 - RNA, 19 nt, artificial
  Oligomer
cucucugauucacaggguc

SEQ ID NO: 24392 - RNA, 19 nt, artificial
  Oligomer
aggcucucugauucacagg

SEQ ID NO: 24393 - RNA, 19 nt, artificial
  Oligomer
aguagcaaaugcuuaggcu

SEQ ID NO: 24394 - RNA, 19 nt, artificial
  Oligomer
aacccauguaccgaaccaa

SEQ ID NO: 24395 - RNA, 19 nt, artificial
  Oligomer
gggcaagugauuguccaug

SEQ ID NO: 24396 - RNA, 19 nt, artificial
  Oligomer
cucauuccggaguggauug

SEQ ID NO: 24397 - RNA, 19 nt, artificial
  Oligomer
cuucgaagggcuucauguc

SEQ ID NO: 24398 - RNA, 19 nt, artificial
  Oligomer
agacggugagagugauugg

SEQ ID NO: 24399 - RNA, 19 nt, artificial
  Oligomer
uguccaugugguagcugau

SEQ ID NO: 24400 - RNA, 19 nt, artificial
  Oligomer
aggagggaucaucaaaaag

SEQ ID NO: 24401 - RNA, 19 nt, artificial
  Oligomer
cgggaagucauuauaguac

SEQ ID NO: 24402 - RNA, 19 nt, artificial
  Oligomer
acagagacucauuccggag

SEQ ID NO: 24403 - RNA, 19 nt, artificial
  Oligomer
agauugcauguggugguug

SEQ ID NO: 24404 - RNA, 19 nt, artificial
  Oligomer
ucauuauaguacugauggu

SEQ ID NO: 24405 - RNA, 19 nt, artificial
  Oligomer
gagguauuguuugaagcgc

SEQ ID NO: 24406 - RNA, 19 nt, artificial
  Oligomer
agcaucuucgaagggcuuc

SEQ ID NO: 24407 - RNA, 19 nt, artificial
  Oligomer
cgaaccaaguaggaaaccc

SEQ ID NO: 24408 - RNA, 19 nt, artificial
  Oligomer
aagaaggagcacaggguag

SEQ ID NO: 24409 - RNA, 19 nt, artificial
  Oligomer
gacuuugucguugggaugc

SEQ ID NO: 24410 - RNA, 19 nt, artificial
  Oligomer
gaguggauuguacuugggc

SEQ ID NO: 24411 - RNA, 19 nt, artificial
  Oligomer
gggcuuauugacaaagcuc

SEQ ID NO: 24412 - RNA, 19 nt, artificial
  Oligomer
guggauuguacuugggcuu

SEQ ID NO: 24413 - RNA, 19 nt, artificial
  Oligomer
cuuugucguugggaugcag

SEQ ID NO: 24414 - RNA, 19 nt, artificial
  Oligomer
cgaugaucuguuugcaguc

SEQ ID NO: 24415 - RNA, 19 nt, artificial
  Oligomer
cauaggagggaucaucaaa

SEQ ID NO: 24416 - RNA, 19 nt, artificial
  Oligomer
uagauugcauguggugguu

SEQ ID NO: 24417 - RNA, 19 nt, artificial
  Oligomer
cccauguaccgaaccaagu

SEQ ID NO: 24418 - RNA, 19 nt, artificial
  Oligomer
cauugauagcaggauuggg

SEQ ID NO: 24419 - RNA, 19 nt, artificial
  Oligomer
cucugauucacagggucuu

SEQ ID NO: 24420 - RNA, 19 nt, artificial
  Oligomer
ccuuccuccaucgaugaca

SEQ ID NO: 24421 - RNA, 19 nt, artificial
  Oligomer
guggguuccugagguauug

SEQ ID NO: 24422 - RNA, 19 nt, artificial
  Oligomer
caaaugcuuaggcugccca

SEQ ID NO: 24423 - RNA, 19 nt, artificial
  Oligomer
ucuggacguugacauagga

SEQ ID NO: 24424 - RNA, 19 nt, artificial
  Oligomer
gaugacagagacucauucc

SEQ ID NO: 24425 - RNA, 19 nt, artificial
  Oligomer
guugacauaggagggauca

SEQ ID NO: 24426 - RNA, 19 nt, artificial
  Oligomer
acaggguagugggacuauc

SEQ ID NO: 24427 - RNA, 19 nt, artificial
  Oligomer
agggcuucaugucaaacag

SEQ ID NO: 24428 - RNA, 19 nt, artificial
  Oligomer
uaggagggaucaucaaaaa

SEQ ID NO: 24429 - RNA, 19 nt, artificial
  Oligomer
accgaaccaaguaggaaac

SEQ ID NO: 24430 - RNA, 19 nt, artificial
  Oligomer
caugugguagcugauaagg

SEQ ID NO: 24431 - RNA, 19 nt, artificial
  Oligomer
ucauuccggaguggauugu

SEQ ID NO: 24432 - RNA, 19 nt, artificial
  Oligomer
ggaucaucaaaaagcucuc

SEQ ID NO: 24433 - RNA, 19 nt, artificial
  Oligomer
cuuucaaagcggugauccu

SEQ ID NO: 24434 - RNA, 19 nt, artificial
  Oligomer
ccuccacucagcuuguuca

SEQ ID NO: 24435 - RNA, 19 nt, artificial
  Oligomer
aagucauuauaguacugau

SEQ ID NO: 24436 - RNA, 19 nt, artificial
  Oligomer
cgaugacagagacucauuc

SEQ ID NO: 24437 - RNA, 19 nt, artificial
  Oligomer
cggaguggauuguacuugg

SEQ ID NO: 24438 - RNA, 19 nt, artificial
  Oligomer
uccacagguugcuguagac

SEQ ID NO: 24439 - RNA, 19 nt, artificial
  Oligomer
gaugggcaagugauugucc

SEQ ID NO: 24440 - RNA, 19 nt, artificial
  Oligomer
gacugacacuuucaaagcg

SEQ ID NO: 24441 - RNA, 19 nt, artificial
  Oligomer
gguuccugagguauuguuu

SEQ ID NO: 24442 - RNA, 19 nt, artificial
  Oligomer
gugggcuuauugacaaagc

SEQ ID NO: 24443 - RNA, 19 nt, artificial
  Oligomer
ugggcaagugauuguccau

SEQ ID NO: 24444 - RNA, 19 nt, artificial
  Oligomer
gcugauaaggugacugaca

SEQ ID NO: 24445 - RNA, 19 nt, artificial
  Oligomer
ugucuagguucuggacguu

SEQ ID NO: 24446 - RNA, 19 nt, artificial
  Oligomer
cuagguucuggacguugac

SEQ ID NO: 24447 - RNA, 19 nt, artificial
  Oligomer
ccggaugcaaaugagauag

SEQ ID NO: 24448 - RNA, 19 nt, artificial
  Oligomer
caugacuuugucguuggga

SEQ ID NO: 24449 - RNA, 19 nt, artificial
  Oligomer
agaugaugggcaagugauu

SEQ ID NO: 24450 - RNA, 19 nt, artificial
  Oligomer
gauuguacuugggcuuggg

SEQ ID NO: 24451 - RNA, 19 nt, artificial
  Oligomer
gaagucauuauaguacuga

SEQ ID NO: 24452 - RNA, 19 nt, artificial
  Oligomer
gugguagcugauaagguga

SEQ ID NO: 24453 - RNA, 19 nt, artificial
  Oligomer
agugauuguccauguggua

SEQ ID NO: 24454 - RNA, 19 nt, artificial
  Oligomer
aggguagugggacuaucgu

SEQ ID NO: 24455 - RNA, 19 nt, artificial
  Oligomer
cucucccguaccaagaagu

SEQ ID NO: 24456 - RNA, 19 nt, artificial
  Oligomer
aaagcucucugccuggaca

SEQ ID NO: 24457 - RNA, 19 nt, artificial
  Oligomer
cuuccuccaucgaugacag

SEQ ID NO: 24458 - RNA, 19 nt, artificial
  Oligomer
cccaugacuuugucguugg

SEQ ID NO: 24459 - RNA, 19 nt, artificial
  Oligomer
caguagcaaaugcuuaggc

SEQ ID NO: 24460 - RNA, 19 nt, artificial
  Oligomer
cuguccuacaggcaaugua

SEQ ID NO: 24461 - RNA, 19 nt, artificial
  Oligomer
ggcgaugaucuguuugcag

SEQ ID NO: 24462 - RNA, 19 nt, artificial
  Oligomer
gccuugucuagguucugga

SEQ ID NO: 24463 - RNA, 19 nt, artificial
  Oligomer
acaggcaauguagcuccca

SEQ ID NO: 24464 - RNA, 19 nt, artificial
  Oligomer
acuuugucguugggaugca

SEQ ID NO: 24465 - RNA, 19 nt, artificial
  Oligomer
cgaagccucaugucuacca

SEQ ID NO: 24466 - RNA, 19 nt, artificial
  Oligomer
gauccuuaguccgaaccac

SEQ ID NO: 24467 - RNA, 19 nt, artificial
  Oligomer
acauaggagggaucaucaa

SEQ ID NO: 24468 - RNA, 19 nt, artificial
  Oligomer
guuugaagcgcaacucgaa

SEQ ID NO: 24469 - RNA, 19 nt, artificial
  Oligomer
agagaugaugggcaaguga

SEQ ID NO: 24470 - RNA, 19 nt, artificial
  Oligomer
ccugagguauuguuugaag

SEQ ID NO: 24471 - RNA, 19 nt, artificial
  Oligomer
aggugacugacacuuucaa

SEQ ID NO: 24472 - RNA, 19 nt, artificial
  Oligomer
gcaacauaggcgacauacu

SEQ ID NO: 24473 - RNA, 19 nt, artificial
  Oligomer
uggagacggugagagugau

SEQ ID NO: 24474 - RNA, 19 nt, artificial
  Oligomer
aguuuccgcuccacagguu

SEQ ID NO: 24475 - RNA, 19 nt, artificial
  Oligomer
ccauguaccgaaccaagua

SEQ ID NO: 24476 - RNA, 19 nt, artificial
  Oligomer
uuccuccaucgaugacaga

SEQ ID NO: 24477 - RNA, 19 nt, artificial
  Oligomer
acagggcuuucuccuccuu

SEQ ID NO: 24478 - RNA, 19 nt, artificial
  Oligomer
ugaugacauccugggcaag

SEQ ID NO: 24479 - RNA, 19 nt, artificial
  Oligomer
agagacucauuccggagug

SEQ ID NO: 24480 - RNA, 19 nt, artificial
  Oligomer
gacacuuucaaagcgguga

SEQ ID NO: 24481 - RNA, 19 nt, artificial
  Oligomer
gauugcauguggugguugg

SEQ ID NO: 24482 - RNA, 19 nt, artificial
  Oligomer
agagcaucuucgaagggcu

SEQ ID NO: 24483 - RNA, 19 nt, artificial
  Oligomer
cacaacccauguaccgaac

SEQ ID NO: 24484 - RNA, 19 nt, artificial
  Oligomer
gcaggcucucugauucaca

SEQ ID NO: 24485 - RNA, 19 nt, artificial
  Oligomer
gcgaugaucuguuugcagu

SEQ ID NO: 24486 - RNA, 19 nt, artificial
  Oligomer
gcuuguucauguccuggag

SEQ ID NO: 24487 - RNA, 19 nt, artificial
  Oligomer
gcauuccagcaaauuucag

SEQ ID NO: 24488 - RNA, 19 nt, artificial
  Oligomer
ccaauggugcugaugacau

SEQ ID NO: 24489 - RNA, 19 nt, artificial
  Oligomer
cugacacuuucaaagcggu

SEQ ID NO: 24490 - RNA, 19 nt, artificial
  Oligomer
cguugacauaggagggauc

SEQ ID NO: 24491 - RNA, 19 nt, artificial
  Oligomer
cuccacucagcuuguucau

SEQ ID NO: 24492 - RNA, 19 nt, artificial
  Oligomer
cuccacagguugcuguaga

SEQ ID NO: 24493 - RNA, 19 nt, artificial
  Oligomer
caggcucucugauucacag

SEQ ID NO: 24494 - RNA, 19 nt, artificial
  Oligomer
cacucagcuuguucauguc

SEQ ID NO: 24495 - RNA, 19 nt, artificial
  Oligomer
ggucccaugacuuugucgu

SEQ ID NO: 24496 - RNA, 19 nt, artificial
  Oligomer
cgugggcuuauugacaaag

SEQ ID NO: 24497 - RNA, 19 nt, artificial
  Oligomer
guccuacaggcaauguagc

SEQ ID NO: 24498 - RNA, 19 nt, artificial
  Oligomer
guccaugugguagcugaua

SEQ ID NO: 24499 - RNA, 19 nt, artificial
  Oligomer
gcaauguagcucccaagug

SEQ ID NO: 24500 - RNA, 19 nt, artificial
  Oligomer
caaaugagauagauugcau

SEQ ID NO: 24501 - RNA, 19 nt, artificial
  Oligomer
ugcucucccguaccaagaa

SEQ ID NO: 24502 - RNA, 19 nt, artificial
  Oligomer
aaaaagcucucugccugga

SEQ ID NO: 24503 - RNA, 19 nt, artificial
  Oligomer
ccuugucuagguucuggac

SEQ ID NO: 24504 - RNA, 19 nt, artificial
  Oligomer
acguugacauaggagggau

SEQ ID NO: 24505 - RNA, 19 nt, artificial
  Oligomer
acacuuucaaagcggugau

SEQ ID NO: 24506 - RNA, 19 nt, artificial
  Oligomer
ggauuguacuugggcuugg

SEQ ID NO: 24507 - RNA, 19 nt, artificial
  Oligomer
gaugcaaaugagauagauu

SEQ ID NO: 24508 - RNA, 19 nt, artificial
  Oligomer
agacucauuccggagugga

SEQ ID NO: 24509 - RNA, 19 nt, artificial
  Oligomer
gagaugaugggcaagugau

SEQ ID NO: 24510 - RNA, 19 nt, artificial
  Oligomer
guccaccaguagcaaaugc

SEQ ID NO: 24511 - RNA, 19 nt, artificial
  Oligomer
agaaggagcacaggguagu

SEQ ID NO: 24512 - RNA, 19 nt, artificial
  Oligomer
gagggaucaucaaaaagcu

SEQ ID NO: 24513 - RNA, 19 nt, artificial
  Oligomer
cuucgggacacuccagaau

SEQ ID NO: 24514 - RNA, 19 nt, artificial
  Oligomer
ccauugauagcaggauugg

SEQ ID NO: 24515 - RNA, 19 nt, artificial
  Oligomer
caucgaugacagagacuca

SEQ ID NO: 24516 - RNA, 19 nt, artificial
  Oligomer
ucgggacacuccagaaugu

SEQ ID NO: 24517 - RNA, 19 nt, artificial
  Oligomer
gcaaaugagauagauugca

SEQ ID NO: 24518 - RNA, 19 nt, artificial
  Oligomer
ggcuucaugucaaacaggu

SEQ ID NO: 24519 - RNA, 19 nt, artificial
  Oligomer
caacccauguaccgaacca

SEQ ID NO: 24520 - RNA, 19 nt, artificial
  Oligomer
gaucaucaaaaagcucucu

SEQ ID NO: 24521 - RNA, 19 nt, artificial
  Oligomer
ccaguagcaaaugcuuagg

SEQ ID NO: 24522 - RNA, 19 nt, artificial
  Oligomer
gguggguuccugagguauu

SEQ ID NO: 24523 - RNA, 19 nt, artificial
  Oligomer
gcuucaugucaaacagguc

SEQ ID NO: 24524 - RNA, 19 nt, artificial
  Oligomer
gaugaucuguuugcagucu

SEQ ID NO: 24525 - RNA, 19 nt, artificial
  Oligomer
caaagcggugauccuuagu

SEQ ID NO: 24526 - RNA, 19 nt, artificial
  Oligomer
gaagccucaugucuaccac

SEQ ID NO: 24527 - RNA, 19 nt, artificial
  Oligomer
gagauagauugcauguggu

SEQ ID NO: 24528 - RNA, 19 nt, artificial
  Oligomer
cgaagagcaucuucgaagg

SEQ ID NO: 24529 - RNA, 19 nt, artificial
  Oligomer
gaagggcuucaugucaaac

SEQ ID NO: 24530 - RNA, 19 nt, artificial
  Oligomer
ggguuccugagguauuguu

SEQ ID NO: 24531 - RNA, 19 nt, artificial
  Oligomer
ggcaagugauuguccaugu

SEQ ID NO: 24532 - RNA, 19 nt, artificial
  Oligomer
guaccgaaccaaguaggaa

SEQ ID NO: 24533 - RNA, 19 nt, artificial
  Oligomer
ccaugugguagcugauaag

SEQ ID NO: 24534 - RNA, 19 nt, artificial
  Oligomer
cagagacucauuccggagu

SEQ ID NO: 24535 - RNA, 19 nt, artificial
  Oligomer
cagagaugaugggcaagug

SEQ ID NO: 24536 - RNA, 19 nt, artificial
  Oligomer
caggcaauguagcucccaa

SEQ ID NO: 24537 - RNA, 19 nt, artificial
  Oligomer
ccacagguugcuguagaca

SEQ ID NO: 24538 - RNA, 19 nt, artificial
  Oligomer
cugaugacauccugggcaa

SEQ ID NO: 24539 - RNA, 19 nt, artificial
  Oligomer
cgccggaugcaaaugagau

SEQ ID NO: 24540 - RNA, 19 nt, artificial
  Oligomer
gguauuguuugaagcgcaa

SEQ ID NO: 24541 - RNA, 19 nt, artificial
  Oligomer
ggugacugacacuuucaaa

SEQ ID NO: 24542 - RNA, 19 nt, artificial
  Oligomer
caauggugcugaugacauc

SEQ ID NO: 24543 - RNA, 19 nt, artificial
  Oligomer
caccaguagcaaaugcuua

SEQ ID NO: 24544 - RNA, 19 nt, artificial
  Oligomer
ggcauuccagcaaauuuca

SEQ ID NO: 24545 - RNA, 19 nt, artificial
  Oligomer
ccagcaaauuucagguuac

SEQ ID NO: 24546 - RNA, 19 nt, artificial
  Oligomer
cggugauccuuaguccgaa

SEQ ID NO: 24547 - RNA, 19 nt, artificial
  Oligomer
gggcuucaugucaaacagg

SEQ ID NO: 24548 - RNA, 19 nt, artificial
  Oligomer
cacuuucaaagcggugauc

SEQ ID NO: 24549 - RNA, 19 nt, artificial
  Oligomer
gggaagucauuauaguacu

SEQ ID NO: 24550 - RNA, 19 nt, artificial
  Oligomer
ccaccaguagcaaaugcuu

SEQ ID NO: 24551 - RNA, 19 nt, artificial
  Oligomer
cgcgugggcuuauugacaa

SEQ ID NO: 24552 - RNA, 19 nt, artificial
  Oligomer
gcaagugauuguccaugug

SEQ ID NO: 24553 - RNA, 19 nt, artificial
  Oligomer
gucccaugacuuugucguu

SEQ ID NO: 24554 - RNA, 19 nt, artificial
  Oligomer
gcaucuucgaagggcuuca

SEQ ID NO: 24555 - RNA, 19 nt, artificial
  Oligomer
acccgaagagcaucuucga

SEQ ID NO: 24556 - RNA, 19 nt, artificial
  Oligomer
cuccaucgaugacagagac

SEQ ID NO: 24557 - RNA, 19 nt, artificial
  Oligomer
aggcuguccuacaggcaau

SEQ ID NO: 24558 - RNA, 19 nt, artificial
  Oligomer
cagcaaauuucagguuacu

SEQ ID NO: 24559 - RNA, 19 nt, artificial
  Oligomer
ggugauccuuaguccgaac

SEQ ID NO: 24560 - RNA, 19 nt, artificial
  Oligomer
gacagagacucauuccgga

SEQ ID NO: 24561 - RNA, 19 nt, artificial
  Oligomer
aggguccaccaguagcaaa

SEQ ID NO: 24562 - RNA, 19 nt, artificial
  Oligomer
ccgaaccaaguaggaaacc

SEQ ID NO: 24563 - RNA, 19 nt, artificial
  Oligomer
ccuccaucgaugacagaga

SEQ ID NO: 24564 - RNA, 19 nt, artificial
  Oligomer
ggcaauguagcucccaagu

SEQ ID NO: 24565 - RNA, 19 nt, artificial
  Oligomer
gcagagaugaugggcaagu

SEQ ID NO: 24566 - RNA, 19 nt, artificial
  Oligomer
gcucucugauucacagggu

SEQ ID NO: 24567 - RNA, 19 nt, artificial
  Oligomer
gcaucuguuugcggacuuc

SEQ ID NO: 24568 - RNA, 19 nt, artificial
  Oligomer
ggguccaccaguagcaaau

SEQ ID NO: 24569 - RNA, 19 nt, artificial
  Oligomer
gacguugacauaggaggga

SEQ ID NO: 24570 - RNA, 19 nt, artificial
  Oligomer
ggaagucauuauaguacug

SEQ ID NO: 24571 - RNA, 19 nt, artificial
  Oligomer
ggagacggugagagugauu

SEQ ID NO: 24572 - RNA, 19 nt, artificial
  Oligomer
cauuccggaguggauugua

SEQ ID NO: 24573 - RNA, 19 nt, artificial
  Oligomer
ggcaucuguuugcggacuu

SEQ ID NO: 24574 - RNA, 19 nt, artificial
  Oligomer
ggaguggauuguacuuggg

SEQ ID NO: 24575 - RNA, 19 nt, artificial
  Oligomer
gccggaugcaaaugagaua

SEQ ID NO: 24576 - RNA, 19 nt, artificial
  Oligomer
gaagaaggagcacagggua

SEQ ID NO: 24577 - RNA, 19 nt, artificial
  Oligomer
ccaugacuuugucguuggg

SEQ ID NO: 24578 - RNA, 19 nt, artificial
  Oligomer
ccgggaagucauuauagua

SEQ ID NO: 24579 - RNA, 19 nt, artificial
  Oligomer
gacucauuccggaguggau

SEQ ID NO: 24580 - RNA, 19 nt, artificial
  Oligomer
gguagcugauaaggugacu

SEQ ID NO: 24581 - RNA, 19 nt, artificial
  Oligomer
gauuguccaugugguagcu

SEQ ID NO: 24582 - RNA, 19 nt, artificial
  Oligomer
cccgaagagcaucuucgaa

SEQ ID NO: 24583 - RNA, 19 nt, artificial
  Oligomer
caucuucgaagggcuucau

SEQ ID NO: 24584 - RNA, 19 nt, artificial
  Oligomer
gguucuggacguugacaua

SEQ ID NO: 24585 - RNA, 19 nt, artificial
  Oligomer
gcuguccuacaggcaaugu

SEQ ID NO: 24586 - RNA, 19 nt, artificial
  Oligomer
gguccaccaguagcaaaug

SEQ ID NO: 24587 - RNA, 19 nt, artificial
  Oligomer
gaagagcaucuucgaaggg

SEQ ID NO: 24588 - RNA, 19 nt, artificial
  Oligomer
cggaugcaaaugagauaga

SEQ ID NO: 24589 - RNA, 19 nt, artificial
  Oligomer
cccgggaagucauuauagu

SEQ ID NO: 24590 - RNA, 19 nt, artificial
  Oligomer
cacaggguagugggacuau

SEQ ID NO: 24591 - RNA, 19 nt, artificial
  Oligomer
gagcaucuucgaagggcuu

SEQ ID NO: 24592 - RNA, 19 nt, artificial
  Oligomer
cgaagggcuucaugucaaa

SEQ ID NO: 24593 - RNA, 19 nt, artificial
  Oligomer
ggaugcaaaugagauagau

SEQ ID NO: 24594 - RNA, 19 nt, artificial
  Oligomer
gcgugggcuuauugacaaa

SEQ ID NO: 24595 - RNA, 19 nt, artificial
  Oligomer
ccaagagugugcuaaagaa

SEQ ID NO: 24596 - RNA, 19 nt, artificial
  Oligomer
agaugaugcgggagaagaa

SEQ ID NO: 24597 - RNA, 19 nt, artificial
  Oligomer
ccacgagcaucuucgagaa

SEQ ID NO: 24598 - RNA, 19 nt, artificial
  Oligomer
gauaguugguguucaaaaa

SEQ ID NO: 24599 - RNA, 19 nt, artificial
  Oligomer
gcuggaugagacuuccaaa

SEQ ID NO: 24600 - RNA, 19 nt, artificial
  Oligomer
caagcaacagguuuuauaa

SEQ ID NO: 24601 - RNA, 19 nt, artificial
  Oligomer
ggaugggagugagacagaa

SEQ ID NO: 24602 - RNA, 19 nt, artificial
  Oligomer
caaaguuccugagacuaaa

SEQ ID NO: 24603 - RNA, 19 nt, artificial
  Oligomer
ggcugauucccaaguguga

SEQ ID NO: 24604 - RNA, 19 nt, artificial
  Oligomer
gcuccaggauuuuaacaaa

SEQ ID NO: 24605 - RNA, 19 nt, artificial
  Oligomer
gaugcaagauauuuauaua

SEQ ID NO: 24606 - RNA, 19 nt, artificial
  Oligomer
caaacucacugcucaagaa

SEQ ID NO: 24607 - RNA, 19 nt, artificial
  Oligomer
ucuuuaucuugacauucaa

SEQ ID NO: 24608 - RNA, 19 nt, artificial
  Oligomer
gcauuauuuugaaugugaa

SEQ ID NO: 24609 - RNA, 19 nt, artificial
  Oligomer
aagcaagacuguugcucaa

SEQ ID NO: 24610 - RNA, 19 nt, artificial
  Oligomer
gggagaagaaggucaccau

SEQ ID NO: 24611 - RNA, 19 nt, artificial
  Oligomer
cgugaugcucaggcuugaa

SEQ ID NO: 24612 - RNA, 19 nt, artificial
  Oligomer
aggugaucgaggaguucua

SEQ ID NO: 24613 - RNA, 19 nt, artificial
  Oligomer
uuagaaacaugguuuugaa

SEQ ID NO: 24614 - RNA, 19 nt, artificial
  Oligomer
ccaucaugggcaacaagga

SEQ ID NO: 24615 - RNA, 19 nt, artificial
  Oligomer
gggagugagacagaaguaa

SEQ ID NO: 24616 - RNA, 19 nt, artificial
  Oligomer
guguccucuugcucaaaaa

SEQ ID NO: 24617 - RNA, 19 nt, artificial
  Oligomer
gacuguugcucaaaucuau

SEQ ID NO: 24618 - RNA, 19 nt, artificial
  Oligomer
cggcggaauucaaugcuga

SEQ ID NO: 24619 - RNA, 19 nt, artificial
  Oligomer
cuacaaagcuucuauccca

SEQ ID NO: 24620 - RNA, 19 nt, artificial
  Oligomer
guguauagaugcaagauau

SEQ ID NO: 24621 - RNA, 19 nt, artificial
  Oligomer
uuugguugucaauauuaaa

SEQ ID NO: 24622 - RNA, 19 nt, artificial
  Oligomer
aagagagucggcagaugau

SEQ ID NO: 24623 - RNA, 19 nt, artificial
  Oligomer
uuaccuaaacagauauaaa

SEQ ID NO: 24624 - RNA, 19 nt, artificial
  Oligomer
gacacuaaguuauaguaua

SEQ ID NO: 24625 - RNA, 19 nt, artificial
  Oligomer
ugcugagcaucaucuucau

SEQ ID NO: 24626 - RNA, 19 nt, artificial
  Oligomer
cccuggauguccuaucuga

SEQ ID NO: 24627 - RNA, 19 nt, artificial
  Oligomer
gaggaguucuacaaccaga

SEQ ID NO: 24628 - RNA, 19 nt, artificial
  Oligomer
cuccaggauuuuaacaaaa

SEQ ID NO: 24629 - RNA, 19 nt, artificial
  Oligomer
gagugagacagaaguaagu

SEQ ID NO: 24630 - RNA, 19 nt, artificial
  Oligomer
cccuguuacccagagaaua

SEQ ID NO: 24631 - RNA, 19 nt, artificial
  Oligomer
acuccaucaugggcaacaa

SEQ ID NO: 24632 - RNA, 19 nt, artificial
  Oligomer
ggcggaauucaaugcugau

SEQ ID NO: 24633 - RNA, 19 nt, artificial
  Oligomer
gaagagagucggcagauga

SEQ ID NO: 24634 - RNA, 19 nt, artificial
  Oligomer
ggagaugaaggaagagagu

SEQ ID NO: 24635 - RNA, 19 nt, artificial
  Oligomer
cugcaaacucacugcucaa

SEQ ID NO: 24636 - RNA, 19 nt, artificial
  Oligomer
aggauuuuaacaaaagcaa

SEQ ID NO: 24637 - RNA, 19 nt, artificial
  Oligomer
aacuggaccucaaauuuca

SEQ ID NO: 24638 - RNA, 19 nt, artificial
  Oligomer
auucaaugcugaugaugaa

SEQ ID NO: 24639 - RNA, 19 nt, artificial
  Oligomer
gucccuacgucuucaucau

SEQ ID NO: 24640 - RNA, 19 nt, artificial
  Oligomer
cacacuaaucgaacuauga

SEQ ID NO: 24641 - RNA, 19 nt, artificial
  Oligomer
aucgaacuaugaacuacaa

SEQ ID NO: 24642 - RNA, 19 nt, artificial
  Oligomer
cccuaaggaucucucagga

SEQ ID NO: 24643 - RNA, 19 nt, artificial
  Oligomer
gcaaugauguccagaagaa

SEQ ID NO: 24644 - RNA, 19 nt, artificial
  Oligomer
ucuccaacuggaccucaaa

SEQ ID NO: 24645 - RNA, 19 nt, artificial
  Oligomer
acacuaaucgaacuaugaa

SEQ ID NO: 24646 - RNA, 19 nt, artificial
  Oligomer
cugugggccuuuucguuaa

SEQ ID NO: 24647 - RNA, 19 nt, artificial
  Oligomer
caucuucaccuacuucaaa

SEQ ID NO: 24648 - RNA, 19 nt, artificial
  Oligomer
gcaucaacgcugucuucua

SEQ ID NO: 24649 - RNA, 19 nt, artificial
  Oligomer
ucaucuucaccuacuucaa

SEQ ID NO: 24650 - RNA, 19 nt, artificial
  Oligomer
acccaaccacucaaauuaa

SEQ ID NO: 24651 - RNA, 19 nt, artificial
  Oligomer
ggcuggaccuauguccuaa

SEQ ID NO: 24652 - RNA, 19 nt, artificial
  Oligomer
gguuuggaugggagugaga

SEQ ID NO: 24653 - RNA, 19 nt, artificial
  Oligomer
ugucaauauuaaauacaga

SEQ ID NO: 24654 - RNA, 19 nt, artificial
  Oligomer
gaaaucgcauuauuuugaa

SEQ ID NO: 24655 - RNA, 19 nt, artificial
  Oligomer
gcaagacuguugcucaaau

SEQ ID NO: 24656 - RNA, 19 nt, artificial
  Oligomer
ccuucuucacccagcuaau

SEQ ID NO: 24657 - RNA, 19 nt, artificial
  Oligomer
ccacacuauuaccaugaga

SEQ ID NO: 24658 - RNA, 19 nt, artificial
  Oligomer
uuugauaguugguguucaa

SEQ ID NO: 24659 - RNA, 19 nt, artificial
  Oligomer
uuuugguugucaauauuaa

SEQ ID NO: 24660 - RNA, 19 nt, artificial
  Oligomer
gauuuuaacaaaagcaaga

SEQ ID NO: 24661 - RNA, 19 nt, artificial
  Oligomer
cacacuauuaccaugagaa

SEQ ID NO: 24662 - RNA, 19 nt, artificial
  Oligomer
guaugugggugaaguguca

SEQ ID NO: 24663 - RNA, 19 nt, artificial
  Oligomer
uggacuccaucaugggcaa

SEQ ID NO: 24664 - RNA, 19 nt, artificial
  Oligomer
aacggcuccaggauuuuaa

SEQ ID NO: 24665 - RNA, 19 nt, artificial
  Oligomer
caggauuuuaacaaaagca

SEQ ID NO: 24666 - RNA, 19 nt, artificial
  Oligomer
gcaugugcuuccaguaugu

SEQ ID NO: 24667 - RNA, 19 nt, artificial
  Oligomer
ccuguuacccagagaauau

SEQ ID NO: 24668 - RNA, 19 nt, artificial
  Oligomer
ccaccucacuccuguuacu

SEQ ID NO: 24669 - RNA, 19 nt, artificial
  Oligomer
ugcaggagaugaaggaaga

SEQ ID NO: 24670 - RNA, 19 nt, artificial
  Oligomer
ugaucgaggaguucuacaa

SEQ ID NO: 24671 - RNA, 19 nt, artificial
  Oligomer
uguucuucaucuucaccua

SEQ ID NO: 24672 - RNA, 19 nt, artificial
  Oligomer
ccugcaggagaugaaggaa

SEQ ID NO: 24673 - RNA, 19 nt, artificial
  Oligomer
gcucaagaagacauggaga

SEQ ID NO: 24674 - RNA, 19 nt, artificial
  Oligomer
ugauaguugguguucaaaa

SEQ ID NO: 24675 - RNA, 19 nt, artificial
  Oligomer
cagacacuaaguuauagua

SEQ ID NO: 24676 - RNA, 19 nt, artificial
  Oligomer
cggcuuagacuucgacuca

SEQ ID NO: 24677 - RNA, 19 nt, artificial
  Oligomer
uaguugguguucaaaaaaa

SEQ ID NO: 24678 - RNA, 19 nt, artificial
  Oligomer
aaggcauuucuaucacaua

SEQ ID NO: 24679 - RNA, 19 nt, artificial
  Oligomer
gaagaauauucaggacuua

SEQ ID NO: 24680 - RNA, 19 nt, artificial
  Oligomer
acuggaccucaaauuucau

SEQ ID NO: 24681 - RNA, 19 nt, artificial
  Oligomer
ugggagugagacagaagua

SEQ ID NO: 24682 - RNA, 19 nt, artificial
  Oligomer
ggaugagacuuccaaaccu

SEQ ID NO: 24683 - RNA, 19 nt, artificial
  Oligomer
ggcuugaaaucgcauuauu

SEQ ID NO: 24684 - RNA, 19 nt, artificial
  Oligomer
ggaauucaaugcugaugau

SEQ ID NO: 24685 - RNA, 19 nt, artificial
  Oligomer
cccaaccacucaaauuaau

SEQ ID NO: 24686 - RNA, 19 nt, artificial
  Oligomer
ggucccuacgucuucauca

SEQ ID NO: 24687 - RNA, 19 nt, artificial
  Oligomer
guucuguucuucaucuuca

SEQ ID NO: 24688 - RNA, 19 nt, artificial
  Oligomer
ccaacuuguaaauacacca

SEQ ID NO: 24689 - RNA, 19 nt, artificial
  Oligomer
gacauucaaggcauuucua

SEQ ID NO: 24690 - RNA, 19 nt, artificial
  Oligomer
ggaguucuacaaccagaca

SEQ ID NO: 24691 - RNA, 19 nt, artificial
  Oligomer
auauauuuuugguugucaa

SEQ ID NO: 24692 - RNA, 19 nt, artificial
  Oligomer
ccuacgucuucaucaucuu

SEQ ID NO: 24693 - RNA, 19 nt, artificial
  Oligomer
caaauuucauugugggcau

SEQ ID NO: 24694 - RNA, 19 nt, artificial
  Oligomer
guuugaucccuguuaccca

SEQ ID NO: 24695 - RNA, 19 nt, artificial
  Oligomer
gcucaaaucuauucagaca

SEQ ID NO: 24696 - RNA, 19 nt, artificial
  Oligomer
cagcccuaaggaucucuca

SEQ ID NO: 24697 - RNA, 19 nt, artificial
  Oligomer
uagaaacaugguuuugaaa

SEQ ID NO: 24698 - RNA, 19 nt, artificial
  Oligomer
ggauuuuaacaaaagcaag

SEQ ID NO: 24699 - RNA, 19 nt, artificial
  Oligomer
caaugauguccagaagaau

SEQ ID NO: 24700 - RNA, 19 nt, artificial
  Oligomer
ugcucaugggcuucucgaa

SEQ ID NO: 24701 - RNA, 19 nt, artificial
  Oligomer
gguucuagucuccuuugca

SEQ ID NO: 24702 - RNA, 19 nt, artificial
  Oligomer
guugguguucaaaaaaaca

SEQ ID NO: 24703 - RNA, 19 nt, artificial
  Oligomer
aggcauuucuaucacauau

SEQ ID NO: 24704 - RNA, 19 nt, artificial
  Oligomer
ccuguuacuuaccuaaaca

SEQ ID NO: 24705 - RNA, 19 nt, artificial
  Oligomer
gcuugaaaucgcauuauuu

SEQ ID NO: 24706 - RNA, 19 nt, artificial
  Oligomer
acaacacuggagucaucaa

SEQ ID NO: 24707 - RNA, 19 nt, artificial
  Oligomer
cccagagaauauauacauu

SEQ ID NO: 24708 - RNA, 19 nt, artificial
  Oligomer
cuccuguuacuuaccuaaa

SEQ ID NO: 24709 - RNA, 19 nt, artificial
  Oligomer
gaggguaggagguuuggau

SEQ ID NO: 24710 - RNA, 19 nt, artificial
  Oligomer
cacucaaauuaaucuuucu

SEQ ID NO: 24711 - RNA, 19 nt, artificial
  Oligomer
ggcugguuuuuagaaacau

SEQ ID NO: 24712 - RNA, 19 nt, artificial
  Oligomer
gcucaugggcuucucgaaa

SEQ ID NO: 24713 - RNA, 19 nt, artificial
  Oligomer
gagacacuugccuucuuca

SEQ ID NO: 24714 - RNA, 19 nt, artificial
  Oligomer
cagaugaugcgggagaaga

SEQ ID NO: 24715 - RNA, 19 nt, artificial
  Oligomer
caggauccagucccuuaca

SEQ ID NO: 24716 - RNA, 19 nt, artificial
  Oligomer
cugggcaaguccuuugaga

SEQ ID NO: 24717 - RNA, 19 nt, artificial
  Oligomer
agcuggaugagacuuccaa

SEQ ID NO: 24718 - RNA, 19 nt, artificial
  Oligomer
cacuccuguuacuuaccua

SEQ ID NO: 24719 - RNA, 19 nt, artificial
  Oligomer
caucaacgcugucuucuau

SEQ ID NO: 24720 - RNA, 19 nt, artificial
  Oligomer
auagaugcaagauauuuau

SEQ ID NO: 24721 - RNA, 19 nt, artificial
  Oligomer
ugggcaugugcuuccagua

SEQ ID NO: 24722 - RNA, 19 nt, artificial
  Oligomer
caaggcauuucuaucacau

SEQ ID NO: 24723 - RNA, 19 nt, artificial
  Oligomer
cgcauuauuuugaauguga

SEQ ID NO: 24724 - RNA, 19 nt, artificial
  Oligomer
ggcuccaggauuuuaacaa

SEQ ID NO: 24725 - RNA, 19 nt, artificial
  Oligomer
ugaugcucaggcuugaaau

SEQ ID NO: 24726 - RNA, 19 nt, artificial
  Oligomer
cuguuacccagagaauaua

SEQ ID NO: 24727 - RNA, 19 nt, artificial
  Oligomer
acuccacgagcaucuucga

SEQ ID NO: 24728 - RNA, 19 nt, artificial
  Oligomer
uauuaaauacagacacuaa

SEQ ID NO: 24729 - RNA, 19 nt, artificial
  Oligomer
ccagcaaugauguccagaa

SEQ ID NO: 24730 - RNA, 19 nt, artificial
  Oligomer
caaagcuucuaucccagga

SEQ ID NO: 24731 - RNA, 19 nt, artificial
  Oligomer
uauagaugcaagauauuua

SEQ ID NO: 24732 - RNA, 19 nt, artificial
  Oligomer
cggcuccaggauuuuaaca

SEQ ID NO: 24733 - RNA, 19 nt, artificial
  Oligomer
caggcuugaaaucgcauua

SEQ ID NO: 24734 - RNA, 19 nt, artificial
  Oligomer
gcucaggcuugaaaucgca

SEQ ID NO: 24735 - RNA, 19 nt, artificial
  Oligomer
caguguccucuugcucaaa

SEQ ID NO: 24736 - RNA, 19 nt, artificial
  Oligomer
gcucaaaaaucuguuugau

SEQ ID NO: 24737 - RNA, 19 nt, artificial
  Oligomer
gcaacggcuuagacuucga

SEQ ID NO: 24738 - RNA, 19 nt, artificial
  Oligomer
gugaugcucaggcuugaaa

SEQ ID NO: 24739 - RNA, 19 nt, artificial
  Oligomer
cgaggaguucuacaaccag

SEQ ID NO: 24740 - RNA, 19 nt, artificial
  Oligomer
cucaaaucuauucagacaa

SEQ ID NO: 24741 - RNA, 19 nt, artificial
  Oligomer
gaucccuguuacccagaga

SEQ ID NO: 24742 - RNA, 19 nt, artificial
  Oligomer
ccuggauguccuaucugag

SEQ ID NO: 24743 - RNA, 19 nt, artificial
  Oligomer
gcuucucgaaacugggcaa

SEQ ID NO: 24744 - RNA, 19 nt, artificial
  Oligomer
ugguugucaauauuaaaua

SEQ ID NO: 24745 - RNA, 19 nt, artificial
  Oligomer
gguugucaauauuaaauac

SEQ ID NO: 24746 - RNA, 19 nt, artificial
  Oligomer
acaugguuuugaaaugcuu

SEQ ID NO: 24747 - RNA, 19 nt, artificial
  Oligomer
uaccuaaacagauauaaau

SEQ ID NO: 24748 - RNA, 19 nt, artificial
  Oligomer
ucgaacuaugaacuacaaa

SEQ ID NO: 24749 - RNA, 19 nt, artificial
  Oligomer
cauucuuuaucuugacauu

SEQ ID NO: 24750 - RNA, 19 nt, artificial
  Oligomer
gggcaugugcuuccaguau

SEQ ID NO: 24751 - RNA, 19 nt, artificial
  Oligomer
ccuuacacguaccucucau

SEQ ID NO: 24752 - RNA, 19 nt, artificial
  Oligomer
aaucgaacuaugaacuaca

SEQ ID NO: 24753 - RNA, 19 nt, artificial
  Oligomer
agaaggucaccauccugga

SEQ ID NO: 24754 - RNA, 19 nt, artificial
  Oligomer
ggagugagacagaaguaag

SEQ ID NO: 24755 - RNA, 19 nt, artificial
  Oligomer
caaccacugcaacggcuua

SEQ ID NO: 24756 - RNA, 19 nt, artificial
  Oligomer
ccugcaaacucacugcuca

SEQ ID NO: 24757 - RNA, 19 nt, artificial
  Oligomer
cuuaccuaaacagauauaa

SEQ ID NO: 24758 - RNA, 19 nt, artificial
  Oligomer
ggauguccuaucugagcau

SEQ ID NO: 24759 - RNA, 19 nt, artificial
  Oligomer
gguguucaaaaaaacacua

SEQ ID NO: 24760 - RNA, 19 nt, artificial
  Oligomer
cacuauuaccaugagaaga

SEQ ID NO: 24761 - RNA, 19 nt, artificial
  Oligomer
aaucuauucagacaagcaa

SEQ ID NO: 24762 - RNA, 19 nt, artificial
  Oligomer
ucaguguccucuugcucaa

SEQ ID NO: 24763 - RNA, 19 nt, artificial
  Oligomer
cgaacuaugaacuacaaag

SEQ ID NO: 24764 - RNA, 19 nt, artificial
  Oligomer
guuacuuaccuaaacagau

SEQ ID NO: 24765 - RNA, 19 nt, artificial
  Oligomer
agacuguugcucaaaucua

SEQ ID NO: 24766 - RNA, 19 nt, artificial
  Oligomer
gcccauguaugugggugaa

SEQ ID NO: 24767 - RNA, 19 nt, artificial
  Oligomer
uuacuuaccuaaacagaua

SEQ ID NO: 24768 - RNA, 19 nt, artificial
  Oligomer
auaguugguguucaaaaaa

SEQ ID NO: 24769 - RNA, 19 nt, artificial
  Oligomer
aaggaagagagucggcaga

SEQ ID NO: 24770 - RNA, 19 nt, artificial
  Oligomer
agaagaaggucaccauccu

SEQ ID NO: 24771 - RNA, 19 nt, artificial
  Oligomer
gagacuuccaaaccugaca

SEQ ID NO: 24772 - RNA, 19 nt, artificial
  Oligomer
uucuccaacuggaccucaa

SEQ ID NO: 24773 - RNA, 19 nt, artificial
  Oligomer
ccaacuggaccucaaauuu

SEQ ID NO: 24774 - RNA, 19 nt, artificial
  Oligomer
aaguuauaguauaucugga

SEQ ID NO: 24775 - RNA, 19 nt, artificial
  Oligomer
guuuugaaaugcuugugga

SEQ ID NO: 24776 - RNA, 19 nt, artificial
  Oligomer
acacuaaguuauaguauau

SEQ ID NO: 24777 - RNA, 19 nt, artificial
  Oligomer
cagcuggaugagacuucca

SEQ ID NO: 24778 - RNA, 19 nt, artificial
  Oligomer
gcuaaucuguagggcugga

SEQ ID NO: 24779 - RNA, 19 nt, artificial
  Oligomer
acuccuguuacuuaccuaa

SEQ ID NO: 24780 - RNA, 19 nt, artificial
  Oligomer
ggaccucaaauuucauugu

SEQ ID NO: 24781 - RNA, 19 nt, artificial
  Oligomer
uccugguucuguucuucau

SEQ ID NO: 24782 - RNA, 19 nt, artificial
  Oligomer
caaugcugaugaugaaccu

SEQ ID NO: 24783 - RNA, 19 nt, artificial
  Oligomer
cuuccaguauguggagcaa

SEQ ID NO: 24784 - RNA, 19 nt, artificial
  Oligomer
acacguaccucucaucagu

SEQ ID NO: 24785 - RNA, 19 nt, artificial
  Oligomer
aaugauguccagaagaaua

SEQ ID NO: 24786 - RNA, 19 nt, artificial
  Oligomer
gaccuauguccuaaggaca

SEQ ID NO: 24787 - RNA, 19 nt, artificial
  Oligomer
ucaucaaccgcaacgagga

SEQ ID NO: 24788 - RNA, 19 nt, artificial
  Oligomer
cagagaauauauacauucu

SEQ ID NO: 24789 - RNA, 19 nt, artificial
  Oligomer
auacagacacuaaguuaua

SEQ ID NO: 24790 - RNA, 19 nt, artificial
  Oligomer
agacaagcaacagguuuua

SEQ ID NO: 24791 - RNA, 19 nt, artificial
  Oligomer
uguggucccuacgucuuca

SEQ ID NO: 24792 - RNA, 19 nt, artificial
  Oligomer
ggagaagaaggucaccauc

SEQ ID NO: 24793 - RNA, 19 nt, artificial
  Oligomer
cccuuacacguaccucuca

SEQ ID NO: 24794 - RNA, 19 nt, artificial
  Oligomer
aagaauauucaggacuuaa

SEQ ID NO: 24795 - RNA, 19 nt, artificial
  Oligomer
ggccuucuuugaagugggu

SEQ ID NO: 24796 - RNA, 19 nt, artificial
  Oligomer
agaaggugaucgaggaguu

SEQ ID NO: 24797 - RNA, 19 nt, artificial
  Oligomer
guuacccagagaauauaua

SEQ ID NO: 24798 - RNA, 19 nt, artificial
  Oligomer
augaccugcaggagaugaa

SEQ ID NO: 24799 - RNA, 19 nt, artificial
  Oligomer
cugucgugucgcuguuugu

SEQ ID NO: 24800 - RNA, 19 nt, artificial
  Oligomer
ggucaggcuccauuaggau

SEQ ID NO: 24801 - RNA, 19 nt, artificial
  Oligomer
cgaaacugggcaaguccuu

SEQ ID NO: 24802 - RNA, 19 nt, artificial
  Oligomer
gguuuuuagaaacaugguu

SEQ ID NO: 24803 - RNA, 19 nt, artificial
  Oligomer
gugauaagacacccgagga

SEQ ID NO: 24804 - RNA, 19 nt, artificial
  Oligomer
ggaccuauguccuaaggac

SEQ ID NO: 24805 - RNA, 19 nt, artificial
  Oligomer
guaaauacaccaccucacu

SEQ ID NO: 24806 - RNA, 19 nt, artificial
  Oligomer
aaucuuucuuuaccugaga

SEQ ID NO: 24807 - RNA, 19 nt, artificial
  Oligomer
cggaauucaaugcugauga

SEQ ID NO: 24808 - RNA, 19 nt, artificial
  Oligomer
acgucuucaucaucuucac

SEQ ID NO: 24809 - RNA, 19 nt, artificial
  Oligomer
caagagugugcuaaagaag

SEQ ID NO: 24810 - RNA, 19 nt, artificial
  Oligomer
uccugcucaucaaccgcaa

SEQ ID NO: 24811 - RNA, 19 nt, artificial
  Oligomer
aguguccucuugcucaaaa

SEQ ID NO: 24812 - RNA, 19 nt, artificial
  Oligomer
caacagguuuuauaauuuu

SEQ ID NO: 24813 - RNA, 19 nt, artificial
  Oligomer
uguauagaugcaagauauu

SEQ ID NO: 24814 - RNA, 19 nt, artificial
  Oligomer
acaagcaacagguuuuaua

SEQ ID NO: 24815 - RNA, 19 nt, artificial
  Oligomer
ugcucaaaaaucuguuuga

SEQ ID NO: 24816 - RNA, 19 nt, artificial
  Oligomer
uuuggaugggagugagaca

SEQ ID NO: 24817 - RNA, 19 nt, artificial
  Oligomer
caacacuggagucaucaau

SEQ ID NO: 24818 - RNA, 19 nt, artificial
  Oligomer
gcugguuuuuagaaacaug

SEQ ID NO: 24819 - RNA, 19 nt, artificial
  Oligomer
cuccaacuggaccucaaau

SEQ ID NO: 24820 - RNA, 19 nt, artificial
  Oligomer
ugcugaugaugaaccugcu

SEQ ID NO: 24821 - RNA, 19 nt, artificial
  Oligomer
gugaucgaggaguucuaca

SEQ ID NO: 24822 - RNA, 19 nt, artificial
  Oligomer
cuaaucgaacuaugaacua

SEQ ID NO: 24823 - RNA, 19 nt, artificial
  Oligomer
gcaaacucacugcucaaga

SEQ ID NO: 24824 - RNA, 19 nt, artificial
  Oligomer
cugugcuccugguucuguu

SEQ ID NO: 24825 - RNA, 19 nt, artificial
  Oligomer
ucaccauccuggagcuguu

SEQ ID NO: 24826 - RNA, 19 nt, artificial
  Oligomer
guugcaggcuucuccaacu

SEQ ID NO: 24827 - RNA, 19 nt, artificial
  Oligomer
aaagcaagacuguugcuca

SEQ ID NO: 24828 - RNA, 19 nt, artificial
  Oligomer
gcugucuucuauuacucca

SEQ ID NO: 24829 - RNA, 19 nt, artificial
  Oligomer
aguugguguucaaaaaaac

SEQ ID NO: 24830 - RNA, 19 nt, artificial
  Oligomer
ccaggauuuuaacaaaagc

SEQ ID NO: 24831 - RNA, 19 nt, artificial
  Oligomer
aagcaacagguuuuauaau

SEQ ID NO: 24832 - RNA, 19 nt, artificial
  Oligomer
ugaaaugcuuguggauuga

SEQ ID NO: 24833 - RNA, 19 nt, artificial
  Oligomer
gccuucuucacccagcuaa

SEQ ID NO: 24834 - RNA, 19 nt, artificial
  Oligomer
accucacuccuguuacuua

SEQ ID NO: 24835 - RNA, 19 nt, artificial
  Oligomer
aguccuuugagaugcugau

SEQ ID NO: 24836 - RNA, 19 nt, artificial
  Oligomer
gcauuucuaucacauauuu

SEQ ID NO: 24837 - RNA, 19 nt, artificial
  Oligomer
ugggcaaguccuuugagau

SEQ ID NO: 24838 - RNA, 19 nt, artificial
  Oligomer
uagaugcaagauauuuaua

SEQ ID NO: 24839 - RNA, 19 nt, artificial
  Oligomer
ucuugacauucaaggcauu

SEQ ID NO: 24840 - RNA, 19 nt, artificial
  Oligomer
uggaugggagugagacaga

SEQ ID NO: 24841 - RNA, 19 nt, artificial
  Oligomer
ucuucaucuucaccuacuu

SEQ ID NO: 24842 - RNA, 19 nt, artificial
  Oligomer
ccuuugagaugcugauccu

SEQ ID NO: 24843 - RNA, 19 nt, artificial
  Oligomer
uacccagagaauauauaca

SEQ ID NO: 24844 - RNA, 19 nt, artificial
  Oligomer
agacuaagcccugucgaga

SEQ ID NO: 24845 - RNA, 19 nt, artificial
  Oligomer
caggagaugaaggaagaga

SEQ ID NO: 24846 - RNA, 19 nt, artificial
  Oligomer
ucgaggaguucuacaacca

SEQ ID NO: 24847 - RNA, 19 nt, artificial
  Oligomer
aggagaugaaggaagagag

SEQ ID NO: 24848 - RNA, 19 nt, artificial
  Oligomer
ccucacuccuguuacuuac

SEQ ID NO: 24849 - RNA, 19 nt, artificial
  Oligomer
gcuucgugcccauguaugu

SEQ ID NO: 24850 - RNA, 19 nt, artificial
  Oligomer
ucaaaguuccugagacuaa

SEQ ID NO: 24851 - RNA, 19 nt, artificial
  Oligomer
guggucccuacgucuucau

SEQ ID NO: 24852 - RNA, 19 nt, artificial
  Oligomer
agaugcaagauauuuauau

SEQ ID NO: 24853 - RNA, 19 nt, artificial
  Oligomer
agagugugcuaaagaagcu

SEQ ID NO: 24854 - RNA, 19 nt, artificial
  Oligomer
gccuuuucguuaaccgcuu

SEQ ID NO: 24855 - RNA, 19 nt, artificial
  Oligomer
gcaggagaugaaggaagag

SEQ ID NO: 24856 - RNA, 19 nt, artificial
  Oligomer
acccagagaauauauacau

SEQ ID NO: 24857 - RNA, 19 nt, artificial
  Oligomer
gcuuguggauugaggguag

SEQ ID NO: 24858 - RNA, 19 nt, artificial
  Oligomer
aggcuucgugcccauguau

SEQ ID NO: 24859 - RNA, 19 nt, artificial
  Oligomer
gagaauauauacauucuuu

SEQ ID NO: 24860 - RNA, 19 nt, artificial
  Oligomer
agcaagacuguugcucaaa

SEQ ID NO: 24861 - RNA, 19 nt, artificial
  Oligomer
cccaucucuuccuacccaa

SEQ ID NO: 24862 - RNA, 19 nt, artificial
  Oligomer
cagcaaugauguccagaag

SEQ ID NO: 24863 - RNA, 19 nt, artificial
  Oligomer
ugguuuuuagaaacauggu

SEQ ID NO: 24864 - RNA, 19 nt, artificial
  Oligomer
ucaaggcauuucuaucaca

SEQ ID NO: 24865 - RNA, 19 nt, artificial
  Oligomer
gcaacagguuuuauaauuu

SEQ ID NO: 24866 - RNA, 19 nt, artificial
  Oligomer
ccuacccaaccacucaaau

SEQ ID NO: 24867 - RNA, 19 nt, artificial
  Oligomer
ugucgcuguuuguggugga

SEQ ID NO: 24868 - RNA, 19 nt, artificial
  Oligomer
gacuuaacggcuccaggau

SEQ ID NO: 24869 - RNA, 19 nt, artificial
  Oligomer
uauuuuugguugucaauau

SEQ ID NO: 24870 - RNA, 19 nt, artificial
  Oligomer
accugcaggagaugaagga

SEQ ID NO: 24871 - RNA, 19 nt, artificial
  Oligomer
aacucacugcucaagaaga

SEQ ID NO: 24872 - RNA, 19 nt, artificial
  Oligomer
gaugaugcgggagaagaag

SEQ ID NO: 24873 - RNA, 19 nt, artificial
  Oligomer
uucuguucuucaucuucac

SEQ ID NO: 24874 - RNA, 19 nt, artificial
  Oligomer
ugacauucaaggcauuucu

SEQ ID NO: 24875 - RNA, 19 nt, artificial
  Oligomer
uaaggaucucucaggagca

SEQ ID NO: 24876 - RNA, 19 nt, artificial
  Oligomer
aaauacagacacuaaguua

SEQ ID NO: 24877 - RNA, 19 nt, artificial
  Oligomer
cacuaaucgaacuaugaac

SEQ ID NO: 24878 - RNA, 19 nt, artificial
  Oligomer
cuugaaaucgcauuauuuu

SEQ ID NO: 24879 - RNA, 19 nt, artificial
  Oligomer
cuuagacuucgacucagga

SEQ ID NO: 24880 - RNA, 19 nt, artificial
  Oligomer
uguuacuuaccuaaacaga

SEQ ID NO: 24881 - RNA, 19 nt, artificial
  Oligomer
uacccaaccacucaaauua

SEQ ID NO: 24882 - RNA, 19 nt, artificial
  Oligomer
aucccuguuacccagagaa

SEQ ID NO: 24883 - RNA, 19 nt, artificial
  Oligomer
cagacaagcaacagguuuu

SEQ ID NO: 24884 - RNA, 19 nt, artificial
  Oligomer
ugaacuacaaagcuucuau

SEQ ID NO: 24885 - RNA, 19 nt, artificial
  Oligomer
caaccacucaaauuaaucu

SEQ ID NO: 24886 - RNA, 19 nt, artificial
  Oligomer
aaaucuauucagacaagca

SEQ ID NO: 24887 - RNA, 19 nt, artificial
  Oligomer
uauacauucuuuaucuuga

SEQ ID NO: 24888 - RNA, 19 nt, artificial
  Oligomer
acggcuccaggauuuuaac

SEQ ID NO: 24889 - RNA, 19 nt, artificial
  Oligomer
gcaaguccuuugagaugcu

SEQ ID NO: 24890 - RNA, 19 nt, artificial
  Oligomer
ucgagacacuugccuucuu

SEQ ID NO: 24891 - RNA, 19 nt, artificial
  Oligomer
ugaggguaggagguuugga

SEQ ID NO: 24892 - RNA, 19 nt, artificial
  Oligomer
cgucuucaucaucuucacu

SEQ ID NO: 24893 - RNA, 19 nt, artificial
  Oligomer
ccucaaauuucauuguggg

SEQ ID NO: 24894 - RNA, 19 nt, artificial
  Oligomer
ugguucuguucuucaucuu

SEQ ID NO: 24895 - RNA, 19 nt, artificial
  Oligomer
ccugaaugguuccaugccu

SEQ ID NO: 24896 - RNA, 19 nt, artificial
  Oligomer
ccauguaugugggugaagu

SEQ ID NO: 24897 - RNA, 19 nt, artificial
  Oligomer
ccggguucuagucuccuuu

SEQ ID NO: 24898 - RNA, 19 nt, artificial
  Oligomer
acuuaccuaaacagauaua

SEQ ID NO: 24899 - RNA, 19 nt, artificial
  Oligomer
gcuacaacacuggagucau

SEQ ID NO: 24900 - RNA, 19 nt, artificial
  Oligomer
cauuauuuugaaugugaag

SEQ ID NO: 24901 - RNA, 19 nt, artificial
  Oligomer
cucaggauccagucccuua

SEQ ID NO: 24902 - RNA, 19 nt, artificial
  Oligomer
aucuguagggcuggaccua

SEQ ID NO: 24903 - RNA, 19 nt, artificial
  Oligomer
cuuccuacccaaccacuca

SEQ ID NO: 24904 - RNA, 19 nt, artificial
  Oligomer
acacuauuaccaugagaag

SEQ ID NO: 24905 - RNA, 19 nt, artificial
  Oligomer
ccagcuaaucuguagggcu

SEQ ID NO: 24906 - RNA, 19 nt, artificial
  Oligomer
ucaaccgcaacgaggagaa

SEQ ID NO: 24907 - RNA, 19 nt, artificial
  Oligomer
guaggagguuuggauggga

SEQ ID NO: 24908 - RNA, 19 nt, artificial
  Oligomer
agaagaauauucaggacuu

SEQ ID NO: 24909 - RNA, 19 nt, artificial
  Oligomer
ggcauuucuaucacauauu

SEQ ID NO: 24910 - RNA, 19 nt, artificial
  Oligomer
gauccagucccuuacacgu

SEQ ID NO: 24911 - RNA, 19 nt, artificial
  Oligomer
ugugcuuccaguaugugga

SEQ ID NO: 24912 - RNA, 19 nt, artificial
  Oligomer
ucaacgcugucuucuauua

SEQ ID NO: 24913 - RNA, 19 nt, artificial
  Oligomer
uguccagaagaauauucag

SEQ ID NO: 24914 - RNA, 19 nt, artificial
  Oligomer
uguccucuugcucaaaaau

SEQ ID NO: 24915 - RNA, 19 nt, artificial
  Oligomer
gaucgaggaguucuacaac

SEQ ID NO: 24916 - RNA, 19 nt, artificial
  Oligomer
uucuauuacuccacgagca

SEQ ID NO: 24917 - RNA, 19 nt, artificial
  Oligomer
uguuacccagagaauauau

SEQ ID NO: 24918 - RNA, 19 nt, artificial
  Oligomer
ggugaucgaggaguucuac

SEQ ID NO: 24919 - RNA, 19 nt, artificial
  Oligomer
acuaagcccugucgagaca

SEQ ID NO: 24920 - RNA, 19 nt, artificial
  Oligomer
aagugauaagacacccgag

SEQ ID NO: 24921 - RNA, 19 nt, artificial
  Oligomer
gacuuccaaaccugacaga

SEQ ID NO: 24922 - RNA, 19 nt, artificial
  Oligomer
cugucgagacacuugccuu

SEQ ID NO: 24923 - RNA, 19 nt, artificial
  Oligomer
ucccuguuacccagagaau

SEQ ID NO: 24924 - RNA, 19 nt, artificial
  Oligomer
gcuggaccuauguccuaag

SEQ ID NO: 24925 - RNA, 19 nt, artificial
  Oligomer
cuccaucaugggcaacaag

SEQ ID NO: 24926 - RNA, 19 nt, artificial
  Oligomer
gaaacaugguuuugaaaug

SEQ ID NO: 24927 - RNA, 19 nt, artificial
  Oligomer
ccuuuucguuaaccgcuuu

SEQ ID NO: 24928 - RNA, 19 nt, artificial
  Oligomer
acuuguaaauacaccaccu

SEQ ID NO: 24929 - RNA, 19 nt, artificial
  Oligomer
aacgcugucuucuauuacu

SEQ ID NO: 24930 - RNA, 19 nt, artificial
  Oligomer
cccuacgucuucaucaucu

SEQ ID NO: 24931 - RNA, 19 nt, artificial
  Oligomer
cacugcaacggcuuagacu

SEQ ID NO: 24932 - RNA, 19 nt, artificial
  Oligomer
cuacccaaccacucaaauu

SEQ ID NO: 24933 - RNA, 19 nt, artificial
  Oligomer
uugucaauauuaaauacag

SEQ ID NO: 24934 - RNA, 19 nt, artificial
  Oligomer
gacuucgacucaggaucca

SEQ ID NO: 24935 - RNA, 19 nt, artificial
  Oligomer
gucuucuauuacuccacga

SEQ ID NO: 24936 - RNA, 19 nt, artificial
  Oligomer
cugcucaagaagacaugga

SEQ ID NO: 24937 - RNA, 19 nt, artificial
  Oligomer
uguagggcuggaccuaugu

SEQ ID NO: 24938 - RNA, 19 nt, artificial
  Oligomer
aauuaaucuuucuuuaccu

SEQ ID NO: 24939 - RNA, 19 nt, artificial
  Oligomer
cucacugcucaagaagaca

SEQ ID NO: 24940 - RNA, 19 nt, artificial
  Oligomer
uaacggcuccaggauuuua

SEQ ID NO: 24941 - RNA, 19 nt, artificial
  Oligomer
cuucaaaguuccugagacu

SEQ ID NO: 24942 - RNA, 19 nt, artificial
  Oligomer
ggcuuagacuucgacucag

SEQ ID NO: 24943 - RNA, 19 nt, artificial
  Oligomer
auuucuaucacauauuuga

SEQ ID NO: 24944 - RNA, 19 nt, artificial
  Oligomer
cugcugagcaucaucuuca

SEQ ID NO: 24945 - RNA, 19 nt, artificial
  Oligomer
ccuacuucaaaguuccuga

SEQ ID NO: 24946 - RNA, 19 nt, artificial
  Oligomer
cucucaucaguguccucuu

SEQ ID NO: 24947 - RNA, 19 nt, artificial
  Oligomer
uuguaaauacaccaccuca

SEQ ID NO: 24948 - RNA, 19 nt, artificial
  Oligomer
caugguuuugaaaugcuug

SEQ ID NO: 24949 - RNA, 19 nt, artificial
  Oligomer
caguauguggagcaacugu

SEQ ID NO: 24950 - RNA, 19 nt, artificial
  Oligomer
cacccugaaugguuccaug

SEQ ID NO: 24951 - RNA, 19 nt, artificial
  Oligomer
accacugcaacggcuuaga

SEQ ID NO: 24952 - RNA, 19 nt, artificial
  Oligomer
ccaucccaugguucaucgu

SEQ ID NO: 24953 - RNA, 19 nt, artificial
  Oligomer
augagacuuccaaaccuga

SEQ ID NO: 24954 - RNA, 19 nt, artificial
  Oligomer
ucuucaucaucuucacugu

SEQ ID NO: 24955 - RNA, 19 nt, artificial
  Oligomer
gaugggagugagacagaag

SEQ ID NO: 24956 - RNA, 19 nt, artificial
  Oligomer
guucaaaaaaacacuaguu

SEQ ID NO: 24957 - RNA, 19 nt, artificial
  Oligomer
aggaagagagucggcagau

SEQ ID NO: 24958 - RNA, 19 nt, artificial
  Oligomer
uguucaaaaaaacacuagu

SEQ ID NO: 24959 - RNA, 19 nt, artificial
  Oligomer
caagacuguugcucaaauc

SEQ ID NO: 24960 - RNA, 19 nt, artificial
  Oligomer
cgagacacuugccuucuuc

SEQ ID NO: 24961 - RNA, 19 nt, artificial
  Oligomer
cugguucuguucuucaucu

SEQ ID NO: 24962 - RNA, 19 nt, artificial
  Oligomer
agcuacccuggauguccua

SEQ ID NO: 24963 - RNA, 19 nt, artificial
  Oligomer
acauucaaggcauuucuau

SEQ ID NO: 24964 - RNA, 19 nt, artificial
  Oligomer
cuuucuuuaccugagacca

SEQ ID NO: 24965 - RNA, 19 nt, artificial
  Oligomer
caccuacuucaaaguuccu

SEQ ID NO: 24966 - RNA, 19 nt, artificial
  Oligomer
agagaauauauacauucuu

SEQ ID NO: 24967 - RNA, 19 nt, artificial
  Oligomer
uugauaguugguguucaaa

SEQ ID NO: 24968 - RNA, 19 nt, artificial
  Oligomer
aauacagacacuaaguuau

SEQ ID NO: 24969 - RNA, 19 nt, artificial
  Oligomer
gagguuuggaugggaguga

SEQ ID NO: 24970 - RNA, 19 nt, artificial
  Oligomer
agacacuaaguuauaguau

SEQ ID NO: 24971 - RNA, 19 nt, artificial
  Oligomer
ucuguagggcuggaccuau

SEQ ID NO: 24972 - RNA, 19 nt, artificial
  Oligomer
aggagguuuggaugggagu

SEQ ID NO: 24973 - RNA, 19 nt, artificial
  Oligomer
aaaucuguuugaucccugu

SEQ ID NO: 24974 - RNA, 19 nt, artificial
  Oligomer
uccuacccaaccacucaaa

SEQ ID NO: 24975 - RNA, 19 nt, artificial
  Oligomer
caucaugggcaacaaggac

SEQ ID NO: 24976 - RNA, 19 nt, artificial
  Oligomer
gaguucuacaaccagacau

SEQ ID NO: 24977 - RNA, 19 nt, artificial
  Oligomer
guugucaauauuaaauaca

SEQ ID NO: 24978 - RNA, 19 nt, artificial
  Oligomer
cucugugggccuuuucguu

SEQ ID NO: 24979 - RNA, 19 nt, artificial
  Oligomer
ccagaagaauauucaggac

SEQ ID NO: 24980 - RNA, 19 nt, artificial
  Oligomer
aacugggcaaguccuuuga

SEQ ID NO: 24981 - RNA, 19 nt, artificial
  Oligomer
uccaguauguggagcaacu

SEQ ID NO: 24982 - RNA, 19 nt, artificial
  Oligomer
augggagugagacagaagu

SEQ ID NO: 24983 - RNA, 19 nt, artificial
  Oligomer
ugguguucaaaaaaacacu

SEQ ID NO: 24984 - RNA, 19 nt, artificial
  Oligomer
ugcucaagaagacauggag

SEQ ID NO: 24985 - RNA, 19 nt, artificial
  Oligomer
cuuuaucuugacauucaag

SEQ ID NO: 24986 - RNA, 19 nt, artificial
  Oligomer
aaaucgcauuauuuugaau

SEQ ID NO: 24987 - RNA, 19 nt, artificial
  Oligomer
ugauguccagaagaauauu

SEQ ID NO: 24988 - RNA, 19 nt, artificial
  Oligomer
agcaaugauguccagaaga

SEQ ID NO: 24989 - RNA, 19 nt, artificial
  Oligomer
cacuugccuucuucaccca

SEQ ID NO: 24990 - RNA, 19 nt, artificial
  Oligomer
cuccugguucuguucuuca

SEQ ID NO: 24991 - RNA, 19 nt, artificial
  Oligomer
gucccuuacacguaccucu

SEQ ID NO: 24992 - RNA, 19 nt, artificial
  Oligomer
cuacaacacuggagucauc

SEQ ID NO: 24993 - RNA, 19 nt, artificial
  Oligomer
cuggaccucaaauuucauu

SEQ ID NO: 24994 - RNA, 19 nt, artificial
  Oligomer
gcugauucccaagugugag

SEQ ID NO: 24995 - RNA, 19 nt, artificial
  Oligomer
ugaugcgggagaagaaggu

SEQ ID NO: 24996 - RNA, 19 nt, artificial
  Oligomer
ucacugucgugucgcuguu

SEQ ID NO: 24997 - RNA, 19 nt, artificial
  Oligomer
cacauauuugauaguuggu

SEQ ID NO: 24998 - RNA, 19 nt, artificial
  Oligomer
ucuauuacuccacgagcau

SEQ ID NO: 24999 - RNA, 19 nt, artificial
  Oligomer
acaccaccucacuccuguu

SEQ ID NO: 25000 - RNA, 19 nt, artificial
  Oligomer
agguuuggaugggagugag

SEQ ID NO: 25001 - RNA, 19 nt, artificial
  Oligomer
ucaaaaaaacacuaguuuu

SEQ ID NO: 25002 - RNA, 19 nt, artificial
  Oligomer
ugcugcugagcaucaucuu

SEQ ID NO: 25003 - RNA, 19 nt, artificial
  Oligomer
cuaucacauauuugauagu

SEQ ID NO: 25004 - RNA, 19 nt, artificial
  Oligomer
gggcaaguccuuugagaug

SEQ ID NO: 25005 - RNA, 19 nt, artificial
  Oligomer
acuguugcucaaaucuauu

SEQ ID NO: 25006 - RNA, 19 nt, artificial
  Oligomer
cauauuugauaguuggugu

SEQ ID NO: 25007 - RNA, 19 nt, artificial
  Oligomer
ggcuucacccugaaugguu

SEQ ID NO: 25008 - RNA, 19 nt, artificial
  Oligomer
uuucuaucacauauuugau

SEQ ID NO: 25009 - RNA, 19 nt, artificial
  Oligomer
auuuuugguugucaauauu

SEQ ID NO: 25010 - RNA, 19 nt, artificial
  Oligomer
cagcuaaucuguagggcug

SEQ ID NO: 25011 - RNA, 19 nt, artificial
  Oligomer
gaauauucaggacuuaacg

SEQ ID NO: 25012 - RNA, 19 nt, artificial
  Oligomer
uccucuugcucaaaaaucu

SEQ ID NO: 25013 - RNA, 19 nt, artificial
  Oligomer
aggaguucuacaaccagac

SEQ ID NO: 25014 - RNA, 19 nt, artificial
  Oligomer
uccagaagaauauucagga

SEQ ID NO: 25015 - RNA, 19 nt, artificial
  Oligomer
gauugaggguaggagguuu

SEQ ID NO: 25016 - RNA, 19 nt, artificial
  Oligomer
aaagugauaagacacccga

SEQ ID NO: 25017 - RNA, 19 nt, artificial
  Oligomer
ucauugugggcaugugcuu

SEQ ID NO: 25018 - RNA, 19 nt, artificial
  Oligomer
aggcuugaaaucgcauuau

SEQ ID NO: 25019 - RNA, 19 nt, artificial
  Oligomer
guauagaugcaagauauuu

SEQ ID NO: 25020 - RNA, 19 nt, artificial
  Oligomer
caaauuaaucuuucuuuac

SEQ ID NO: 25021 - RNA, 19 nt, artificial
  Oligomer
caaaagcaagacuguugcu

SEQ ID NO: 25022 - RNA, 19 nt, artificial
  Oligomer
uguaaauacaccaccucac

SEQ ID NO: 25023 - RNA, 19 nt, artificial
  Oligomer
ugaaaucgcauuauuuuga

SEQ ID NO: 25024 - RNA, 19 nt, artificial
  Oligomer
ggccuuuucguuaaccgcu

SEQ ID NO: 25025 - RNA, 19 nt, artificial
  Oligomer
uucuuuaucuugacauuca

SEQ ID NO: 25026 - RNA, 19 nt, artificial
  Oligomer
acucaugaccaucgcgcua

SEQ ID NO: 25027 - RNA, 19 nt, artificial
  Oligomer
uacccuggauguccuaucu

SEQ ID NO: 25028 - RNA, 19 nt, artificial
  Oligomer
gacaagcaacagguuuuau

SEQ ID NO: 25029 - RNA, 19 nt, artificial
  Oligomer
uauauuuuugguugucaau

SEQ ID NO: 25030 - RNA, 19 nt, artificial
  Oligomer
agaauauucaggacuuaac

SEQ ID NO: 25031 - RNA, 19 nt, artificial
  Oligomer
uggauguccuaucugagca

SEQ ID NO: 25032 - RNA, 19 nt, artificial
  Oligomer
aacuaugaacuacaaagcu

SEQ ID NO: 25033 - RNA, 19 nt, artificial
  Oligomer
uuuugaaaugcuuguggau

SEQ ID NO: 25034 - RNA, 19 nt, artificial
  Oligomer
augauguccagaagaauau

SEQ ID NO: 25035 - RNA, 19 nt, artificial
  Oligomer
gaacuacaaagcuucuauc

SEQ ID NO: 25036 - RNA, 19 nt, artificial
  Oligomer
uuccuacccaaccacucaa

SEQ ID NO: 25037 - RNA, 19 nt, artificial
  Oligomer
cauguaugugggugaagug

SEQ ID NO: 25038 - RNA, 19 nt, artificial
  Oligomer
ugaccugcaggagaugaag

SEQ ID NO: 25039 - RNA, 19 nt, artificial
  Oligomer
uugcucaaaucuauucaga

SEQ ID NO: 25040 - RNA, 19 nt, artificial
  Oligomer
agcaacagguuuuauaauu

SEQ ID NO: 25041 - RNA, 19 nt, artificial
  Oligomer
ugcuccugguucuguucuu

SEQ ID NO: 25042 - RNA, 19 nt, artificial
  Oligomer
cagucccuuacacguaccu

SEQ ID NO: 25043 - RNA, 19 nt, artificial
  Oligomer
caccaccucacuccuguua

SEQ ID NO: 25044 - RNA, 19 nt, artificial
  Oligomer
caauauuaaauacagacac

SEQ ID NO: 25045 - RNA, 19 nt, artificial
  Oligomer
agaaacaugguuuugaaau

SEQ ID NO: 25046 - RNA, 19 nt, artificial
  Oligomer
uggaccuauguccuaagga

SEQ ID NO: 25047 - RNA, 19 nt, artificial
  Oligomer
ucaucaucuucacugugcu

SEQ ID NO: 25048 - RNA, 19 nt, artificial
  Oligomer
cuuaacggcuccaggauuu

SEQ ID NO: 25049 - RNA, 19 nt, artificial
  Oligomer
cccuucccaucucuuccua

SEQ ID NO: 25050 - RNA, 19 nt, artificial
  Oligomer
agaagacauggagacuccu

SEQ ID NO: 25051 - RNA, 19 nt, artificial
  Oligomer
auguccagaagaauauuca

SEQ ID NO: 25052 - RNA, 19 nt, artificial
  Oligomer
ccuucucugugggccuuuu

SEQ ID NO: 25053 - RNA, 19 nt, artificial
  Oligomer
ugccuucuucacccagcua

SEQ ID NO: 25054 - RNA, 19 nt, artificial
  Oligomer
ucaauauuaaauacagaca

SEQ ID NO: 25055 - RNA, 19 nt, artificial
  Oligomer
auccagucccuuacacgua

SEQ ID NO: 25056 - RNA, 19 nt, artificial
  Oligomer
uugguugucaauauuaaau

SEQ ID NO: 25057 - RNA, 19 nt, artificial
  Oligomer
ggcaugugcuuccaguaug

SEQ ID NO: 25058 - RNA, 19 nt, artificial
  Oligomer
acugcaacggcuuagacuu

SEQ ID NO: 25059 - RNA, 19 nt, artificial
  Oligomer
cggguucuagucuccuuug

SEQ ID NO: 25060 - RNA, 19 nt, artificial
  Oligomer
gaccuucgaugagaucgcu

SEQ ID NO: 25061 - RNA, 19 nt, artificial
  Oligomer
auuugauaguugguguuca

SEQ ID NO: 25062 - RNA, 19 nt, artificial
  Oligomer
guuauaguauaucuggaca

SEQ ID NO: 25063 - RNA, 19 nt, artificial
  Oligomer
gaugcucaggcuugaaauc

SEQ ID NO: 25064 - RNA, 19 nt, artificial
  Oligomer
ccacucaaauuaaucuuuc

SEQ ID NO: 25065 - RNA, 19 nt, artificial
  Oligomer
caacgcugucuucuauuac

SEQ ID NO: 25066 - RNA, 19 nt, artificial
  Oligomer
uagucuccuuugcacugag

SEQ ID NO: 25067 - RNA, 19 nt, artificial
  Oligomer
aucuugacauucaaggcau

SEQ ID NO: 25068 - RNA, 19 nt, artificial
  Oligomer
augcgggagaagaagguca

SEQ ID NO: 25069 - RNA, 19 nt, artificial
  Oligomer
ucaaaucuauucagacaag

SEQ ID NO: 25070 - RNA, 19 nt, artificial
  Oligomer
cacugucgugucgcuguuu

SEQ ID NO: 25071 - RNA, 19 nt, artificial
  Oligomer
cuggaugagacuuccaaac

SEQ ID NO: 25072 - RNA, 19 nt, artificial
  Oligomer
acuaugaacuacaaagcuu

SEQ ID NO: 25073 - RNA, 19 nt, artificial
  Oligomer
uacuuaccuaaacagauau

SEQ ID NO: 25074 - RNA, 19 nt, artificial
  Oligomer
ucgugucgcuguuuguggu

SEQ ID NO: 25075 - RNA, 19 nt, artificial
  Oligomer
cuagucuccuuugcacuga

SEQ ID NO: 25076 - RNA, 19 nt, artificial
  Oligomer
gaaacugggcaaguccuuu

SEQ ID NO: 25077 - RNA, 19 nt, artificial
  Oligomer
aaucuguagggcuggaccu

SEQ ID NO: 25078 - RNA, 19 nt, artificial
  Oligomer
gaagaaggucaccauccug

SEQ ID NO: 25079 - RNA, 19 nt, artificial
  Oligomer
ugaaugguuccaugccuga

SEQ ID NO: 25080 - RNA, 19 nt, artificial
  Oligomer
cuucgacucaggauccagu

SEQ ID NO: 25081 - RNA, 19 nt, artificial
  Oligomer
agcccuaaggaucucucag

SEQ ID NO: 25082 - RNA, 19 nt, artificial
  Oligomer
cucaaauuaaucuuucuuu

SEQ ID NO: 25083 - RNA, 19 nt, artificial
  Oligomer
aucuguuugaucccuguua

SEQ ID NO: 25084 - RNA, 19 nt, artificial
  Oligomer
cauucaaggcauuucuauc

SEQ ID NO: 25085 - RNA, 19 nt, artificial
  Oligomer
uguugcucaaaucuauuca

SEQ ID NO: 25086 - RNA, 19 nt, artificial
  Oligomer
gaugagacuuccaaaccug

SEQ ID NO: 25087 - RNA, 19 nt, artificial
  Oligomer
agcuucuaucccaggaggu

SEQ ID NO: 25088 - RNA, 19 nt, artificial
  Oligomer
aauucaaugcugaugauga

SEQ ID NO: 25089 - RNA, 19 nt, artificial
  Oligomer
aauauuaaauacagacacu

SEQ ID NO: 25090 - RNA, 19 nt, artificial
  Oligomer
caaaaaaacacuaguuuug

SEQ ID NO: 25091 - RNA, 19 nt, artificial
  Oligomer
ugcucaucaaccgcaacga

SEQ ID NO: 25092 - RNA, 19 nt, artificial
  Oligomer
cacgagcaucuucgagaag

SEQ ID NO: 25093 - RNA, 19 nt, artificial
  Oligomer
uuccaaaccugacagaugu

SEQ ID NO: 25094 - RNA, 19 nt, artificial
  Oligomer
uucuaucacauauuugaua

SEQ ID NO: 25095 - RNA, 19 nt, artificial
  Oligomer
uucuuuagcacacucuugg

SEQ ID NO: 25096 - RNA, 19 nt, artificial
  Oligomer
uucuucucccgcaucaucu

SEQ ID NO: 25097 - RNA, 19 nt, artificial
  Oligomer
uucucgaagaugcucgugg

SEQ ID NO: 25098 - RNA, 19 nt, artificial
  Oligomer
uuuuugaacaccaacuauc

SEQ ID NO: 25099 - RNA, 19 nt, artificial
  Oligomer
uuuggaagucucauccagc

SEQ ID NO: 25100 - RNA, 19 nt, artificial
  Oligomer
uuauaaaaccuguugcuug

SEQ ID NO: 25101 - RNA, 19 nt, artificial
  Oligomer
uucugucucacucccaucc

SEQ ID NO: 25102 - RNA, 19 nt, artificial
  Oligomer
uuuagucucaggaacuuug

SEQ ID NO: 25103 - RNA, 19 nt, artificial
  Oligomer
ucacacuugggaaucagcc

SEQ ID NO: 25104 - RNA, 19 nt, artificial
  Oligomer
uuuguuaaaauccuggagc

SEQ ID NO: 25105 - RNA, 19 nt, artificial
  Oligomer
uauauaaauaucuugcauc

SEQ ID NO: 25106 - RNA, 19 nt, artificial
  Oligomer
uucuugagcagugaguuug

SEQ ID NO: 25107 - RNA, 19 nt, artificial
  Oligomer
uugaaugucaagauaaaga

SEQ ID NO: 25108 - RNA, 19 nt, artificial
  Oligomer
uucacauucaaaauaaugc

SEQ ID NO: 25109 - RNA, 19 nt, artificial
  Oligomer
uugagcaacagucuugcuu

SEQ ID NO: 25110 - RNA, 19 nt, artificial
  Oligomer
auggugaccuucuucuccc

SEQ ID NO: 25111 - RNA, 19 nt, artificial
  Oligomer
uucaagccugagcaucacg

SEQ ID NO: 25112 - RNA, 19 nt, artificial
  Oligomer
uagaacuccucgaucaccu

SEQ ID NO: 25113 - RNA, 19 nt, artificial
  Oligomer
uucaaaaccauguuucuaa

SEQ ID NO: 25114 - RNA, 19 nt, artificial
  Oligomer
uccuuguugcccaugaugg

SEQ ID NO: 25115 - RNA, 19 nt, artificial
  Oligomer
uuacuucugucucacuccc

SEQ ID NO: 25116 - RNA, 19 nt, artificial
  Oligomer
uuuuugagcaagaggacac

SEQ ID NO: 25117 - RNA, 19 nt, artificial
  Oligomer
auagauuugagcaacaguc

SEQ ID NO: 25118 - RNA, 19 nt, artificial
  Oligomer
ucagcauugaauuccgccg

SEQ ID NO: 25119 - RNA, 19 nt, artificial
  Oligomer
ugggauagaagcuuuguag

SEQ ID NO: 25120 - RNA, 19 nt, artificial
  Oligomer
auaucuugcaucuauacac

SEQ ID NO: 25121 - RNA, 19 nt, artificial
  Oligomer
uuuaauauugacaaccaaa

SEQ ID NO: 25122 - RNA, 19 nt, artificial
  Oligomer
aucaucugccgacucucuu

SEQ ID NO: 25123 - RNA, 19 nt, artificial
  Oligomer
uuuauaucuguuuagguaa

SEQ ID NO: 25124 - RNA, 19 nt, artificial
  Oligomer
uauacuauaacuuaguguc

SEQ ID NO: 25125 - RNA, 19 nt, artificial
  Oligomer
augaagaugaugcucagca

SEQ ID NO: 25126 - RNA, 19 nt, artificial
  Oligomer
ucagauaggacauccaggg

SEQ ID NO: 25127 - RNA, 19 nt, artificial
  Oligomer
ucugguuguagaacuccuc

SEQ ID NO: 25128 - RNA, 19 nt, artificial
  Oligomer
uuuuguuaaaauccuggag

SEQ ID NO: 25129 - RNA, 19 nt, artificial
  Oligomer
acuuacuucugucucacuc

SEQ ID NO: 25130 - RNA, 19 nt, artificial
  Oligomer
uauucucuggguaacaggg

SEQ ID NO: 25131 - RNA, 19 nt, artificial
  Oligomer
uuguugcccaugauggagu

SEQ ID NO: 25132 - RNA, 19 nt, artificial
  Oligomer
aucagcauugaauuccgcc

SEQ ID NO: 25133 - RNA, 19 nt, artificial
  Oligomer
ucaucugccgacucucuuc

SEQ ID NO: 25134 - RNA, 19 nt, artificial
  Oligomer
acucucuuccuucaucucc

SEQ ID NO: 25135 - RNA, 19 nt, artificial
  Oligomer
uugagcagugaguuugcag

SEQ ID NO: 25136 - RNA, 19 nt, artificial
  Oligomer
uugcuuuuguuaaaauccu

SEQ ID NO: 25137 - RNA, 19 nt, artificial
  Oligomer
ugaaauuugagguccaguu

SEQ ID NO: 25138 - RNA, 19 nt, artificial
  Oligomer
uucaucaucagcauugaau

SEQ ID NO: 25139 - RNA, 19 nt, artificial
  Oligomer
augaugaagacguagggac

SEQ ID NO: 25140 - RNA, 19 nt, artificial
  Oligomer
ucauaguucgauuagugug

SEQ ID NO: 25141 - RNA, 19 nt, artificial
  Oligomer
uuguaguucauaguucgau

SEQ ID NO: 25142 - RNA, 19 nt, artificial
  Oligomer
uccugagagauccuuaggg

SEQ ID NO: 25143 - RNA, 19 nt, artificial
  Oligomer
uucuucuggacaucauugc

SEQ ID NO: 25144 - RNA, 19 nt, artificial
  Oligomer
uuugagguccaguuggaga

SEQ ID NO: 25145 - RNA, 19 nt, artificial
  Oligomer
uucauaguucgauuagugu

SEQ ID NO: 25146 - RNA, 19 nt, artificial
  Oligomer
uuaacgaaaaggcccacag

SEQ ID NO: 25147 - RNA, 19 nt, artificial
  Oligomer
uuugaaguaggugaagaug

SEQ ID NO: 25148 - RNA, 19 nt, artificial
  Oligomer
uagaagacagcguugaugc

SEQ ID NO: 25149 - RNA, 19 nt, artificial
  Oligomer
uugaaguaggugaagauga

SEQ ID NO: 25150 - RNA, 19 nt, artificial
  Oligomer
uuaauuugagugguugggu

SEQ ID NO: 25151 - RNA, 19 nt, artificial
  Oligomer
uuaggacauagguccagcc

SEQ ID NO: 25152 - RNA, 19 nt, artificial
  Oligomer
ucucacucccauccaaacc

SEQ ID NO: 25153 - RNA, 19 nt, artificial
  Oligomer
ucuguauuuaauauugaca

SEQ ID NO: 25154 - RNA, 19 nt, artificial
  Oligomer
uucaaaauaaugcgauuuc

SEQ ID NO: 25155 - RNA, 19 nt, artificial
  Oligomer
auuugagcaacagucuugc

SEQ ID NO: 25156 - RNA, 19 nt, artificial
  Oligomer
auuagcugggugaagaagg

SEQ ID NO: 25157 - RNA, 19 nt, artificial
  Oligomer
ucucaugguaauagugugg

SEQ ID NO: 25158 - RNA, 19 nt, artificial
  Oligomer
uugaacaccaacuaucaaa

SEQ ID NO: 25159 - RNA, 19 nt, artificial
  Oligomer
uuaauauugacaaccaaaa

SEQ ID NO: 25160 - RNA, 19 nt, artificial
  Oligomer
ucuugcuuuuguuaaaauc

SEQ ID NO: 25161 - RNA, 19 nt, artificial
  Oligomer
uucucaugguaauagugug

SEQ ID NO: 25162 - RNA, 19 nt, artificial
  Oligomer
ugacacuucacccacauac

SEQ ID NO: 25163 - RNA, 19 nt, artificial
  Oligomer
uugcccaugauggagucca

SEQ ID NO: 25164 - RNA, 19 nt, artificial
  Oligomer
uuaaaauccuggagccguu

SEQ ID NO: 25165 - RNA, 19 nt, artificial
  Oligomer
ugcuuuuguuaaaauccug

SEQ ID NO: 25166 - RNA, 19 nt, artificial
  Oligomer
acauacuggaagcacaugc

SEQ ID NO: 25167 - RNA, 19 nt, artificial
  Oligomer
auauucucuggguaacagg

SEQ ID NO: 25168 - RNA, 19 nt, artificial
  Oligomer
aguaacaggagugaggugg

SEQ ID NO: 25169 - RNA, 19 nt, artificial
  Oligomer
ucuuccuucaucuccugca

SEQ ID NO: 25170 - RNA, 19 nt, artificial
  Oligomer
uuguagaacuccucgauca

SEQ ID NO: 25171 - RNA, 19 nt, artificial
  Oligomer
uaggugaagaugaagaaca

SEQ ID NO: 25172 - RNA, 19 nt, artificial
  Oligomer
uuccuucaucuccugcagg

SEQ ID NO: 25173 - RNA, 19 nt, artificial
  Oligomer
ucuccaugucuucuugagc

SEQ ID NO: 25174 - RNA, 19 nt, artificial
  Oligomer
uuuugaacaccaacuauca

SEQ ID NO: 25175 - RNA, 19 nt, artificial
  Oligomer
uacuauaacuuagugucug

SEQ ID NO: 25176 - RNA, 19 nt, artificial
  Oligomer
ugagucgaagucuaagccg

SEQ ID NO: 25177 - RNA, 19 nt, artificial
  Oligomer
uuuuuuugaacaccaacua

SEQ ID NO: 25178 - RNA, 19 nt, artificial
  Oligomer
uaugugauagaaaugccuu

SEQ ID NO: 25179 - RNA, 19 nt, artificial
  Oligomer
uaaguccugaauauucuuc

SEQ ID NO: 25180 - RNA, 19 nt, artificial
  Oligomer
augaaauuugagguccagu

SEQ ID NO: 25181 - RNA, 19 nt, artificial
  Oligomer
uacuucugucucacuccca

SEQ ID NO: 25182 - RNA, 19 nt, artificial
  Oligomer
agguuuggaagucucaucc

SEQ ID NO: 25183 - RNA, 19 nt, artificial
  Oligomer
aauaaugcgauuucaagcc

SEQ ID NO: 25184 - RNA, 19 nt, artificial
  Oligomer
aucaucagcauugaauucc

SEQ ID NO: 25185 - RNA, 19 nt, artificial
  Oligomer
auuaauuugagugguuggg

SEQ ID NO: 25186 - RNA, 19 nt, artificial
  Oligomer
ugaugaagacguagggacc

SEQ ID NO: 25187 - RNA, 19 nt, artificial
  Oligomer
ugaagaugaagaacagaac

SEQ ID NO: 25188 - RNA, 19 nt, artificial
  Oligomer
ugguguauuuacaaguugg

SEQ ID NO: 25189 - RNA, 19 nt, artificial
  Oligomer
uagaaaugccuugaauguc

SEQ ID NO: 25190 - RNA, 19 nt, artificial
  Oligomer
ugucugguuguagaacucc

SEQ ID NO: 25191 - RNA, 19 nt, artificial
  Oligomer
uugacaaccaaaaauauau

SEQ ID NO: 25192 - RNA, 19 nt, artificial
  Oligomer
aagaugaugaagacguagg

SEQ ID NO: 25193 - RNA, 19 nt, artificial
  Oligomer
augcccacaaugaaauuug

SEQ ID NO: 25194 - RNA, 19 nt, artificial
  Oligomer
uggguaacagggaucaaac

SEQ ID NO: 25195 - RNA, 19 nt, artificial
  Oligomer
ugucugaauagauuugagc

SEQ ID NO: 25196 - RNA, 19 nt, artificial
  Oligomer
ugagagauccuuagggcug

SEQ ID NO: 25197 - RNA, 19 nt, artificial
  Oligomer
uuucaaaaccauguuucua

SEQ ID NO: 25198 - RNA, 19 nt, artificial
  Oligomer
cuugcuuuuguuaaaaucc

SEQ ID NO: 25199 - RNA, 19 nt, artificial
  Oligomer
auucuucuggacaucauug

SEQ ID NO: 25200 - RNA, 19 nt, artificial
  Oligomer
uucgagaagcccaugagca

SEQ ID NO: 25201 - RNA, 19 nt, artificial
  Oligomer
ugcaaaggagacuagaacc

SEQ ID NO: 25202 - RNA, 19 nt, artificial
  Oligomer
uguuuuuuugaacaccaac

SEQ ID NO: 25203 - RNA, 19 nt, artificial
  Oligomer
auaugugauagaaaugccu

SEQ ID NO: 25204 - RNA, 19 nt, artificial
  Oligomer
uguuuagguaaguaacagg

SEQ ID NO: 25205 - RNA, 19 nt, artificial
  Oligomer
aaauaaugcgauuucaagc

SEQ ID NO: 25206 - RNA, 19 nt, artificial
  Oligomer
uugaugacuccaguguugu

SEQ ID NO: 25207 - RNA, 19 nt, artificial
  Oligomer
aauguauauauucucuggg

SEQ ID NO: 25208 - RNA, 19 nt, artificial
  Oligomer
uuuagguaaguaacaggag

SEQ ID NO: 25209 - RNA, 19 nt, artificial
  Oligomer
auccaaaccuccuacccuc

SEQ ID NO: 25210 - RNA, 19 nt, artificial
  Oligomer
agaaagauuaauuugagug

SEQ ID NO: 25211 - RNA, 19 nt, artificial
  Oligomer
auguuucuaaaaaccagcc

SEQ ID NO: 25212 - RNA, 19 nt, artificial
  Oligomer
uuucgagaagcccaugagc

SEQ ID NO: 25213 - RNA, 19 nt, artificial
  Oligomer
ugaagaaggcaagugucuc

SEQ ID NO: 25214 - RNA, 19 nt, artificial
  Oligomer
ucuucucccgcaucaucug

SEQ ID NO: 25215 - RNA, 19 nt, artificial
  Oligomer
uguaagggacuggauccug

SEQ ID NO: 25216 - RNA, 19 nt, artificial
  Oligomer
ucucaaaggacuugcccag

SEQ ID NO: 25217 - RNA, 19 nt, artificial
  Oligomer
uuggaagucucauccagcu

SEQ ID NO: 25218 - RNA, 19 nt, artificial
  Oligomer
uagguaaguaacaggagug

SEQ ID NO: 25219 - RNA, 19 nt, artificial
  Oligomer
auagaagacagcguugaug

SEQ ID NO: 25220 - RNA, 19 nt, artificial
  Oligomer
auaaauaucuugcaucuau

SEQ ID NO: 25221 - RNA, 19 nt, artificial
  Oligomer
uacuggaagcacaugccca

SEQ ID NO: 25222 - RNA, 19 nt, artificial
  Oligomer
augugauagaaaugccuug

SEQ ID NO: 25223 - RNA, 19 nt, artificial
  Oligomer
ucacauucaaaauaaugcg

SEQ ID NO: 25224 - RNA, 19 nt, artificial
  Oligomer
uuguuaaaauccuggagcc

SEQ ID NO: 25225 - RNA, 19 nt, artificial
  Oligomer
auuucaagccugagcauca

SEQ ID NO: 25226 - RNA, 19 nt, artificial
  Oligomer
uauauucucuggguaacag

SEQ ID NO: 25227 - RNA, 19 nt, artificial
  Oligomer
ucgaagaugcucguggagu

SEQ ID NO: 25228 - RNA, 19 nt, artificial
  Oligomer
uuagugucuguauuuaaua

SEQ ID NO: 25229 - RNA, 19 nt, artificial
  Oligomer
uucuggacaucauugcugg

SEQ ID NO: 25230 - RNA, 19 nt, artificial
  Oligomer
uccugggauagaagcuuug

SEQ ID NO: 25231 - RNA, 19 nt, artificial
  Oligomer
uaaauaucuugcaucuaua

SEQ ID NO: 25232 - RNA, 19 nt, artificial
  Oligomer
uguuaaaauccuggagccg

SEQ ID NO: 25233 - RNA, 19 nt, artificial
  Oligomer
uaaugcgauuucaagccug

SEQ ID NO: 25234 - RNA, 19 nt, artificial
  Oligomer
ugcgauuucaagccugagc

SEQ ID NO: 25235 - RNA, 19 nt, artificial
  Oligomer
uuugagcaagaggacacug

SEQ ID NO: 25236 - RNA, 19 nt, artificial
  Oligomer
aucaaacagauuuuugagc

SEQ ID NO: 25237 - RNA, 19 nt, artificial
  Oligomer
ucgaagucuaagccguugc

SEQ ID NO: 25238 - RNA, 19 nt, artificial
  Oligomer
uuucaagccugagcaucac

SEQ ID NO: 25239 - RNA, 19 nt, artificial
  Oligomer
cugguuguagaacuccucg

SEQ ID NO: 25240 - RNA, 19 nt, artificial
  Oligomer
uugucugaauagauuugag

SEQ ID NO: 25241 - RNA, 19 nt, artificial
  Oligomer
ucucuggguaacagggauc

SEQ ID NO: 25242 - RNA, 19 nt, artificial
  Oligomer
cucagauaggacauccagg

SEQ ID NO: 25243 - RNA, 19 nt, artificial
  Oligomer
uugcccaguuucgagaagc

SEQ ID NO: 25244 - RNA, 19 nt, artificial
  Oligomer
uauuuaauauugacaacca

SEQ ID NO: 25245 - RNA, 19 nt, artificial
  Oligomer
guauuuaauauugacaacc

SEQ ID NO: 25246 - RNA, 19 nt, artificial
  Oligomer
aagcauuucaaaaccaugu

SEQ ID NO: 25247 - RNA, 19 nt, artificial
  Oligomer
auuuauaucuguuuaggua

SEQ ID NO: 25248 - RNA, 19 nt, artificial
  Oligomer
uuuguaguucauaguucga

SEQ ID NO: 25249 - RNA, 19 nt, artificial
  Oligomer
aaugucaagauaaagaaug

SEQ ID NO: 25250 - RNA, 19 nt, artificial
  Oligomer
auacuggaagcacaugccc

SEQ ID NO: 25251 - RNA, 19 nt, artificial
  Oligomer
augagagguacguguaagg

SEQ ID NO: 25252 - RNA, 19 nt, artificial
  Oligomer
uguaguucauaguucgauu

SEQ ID NO: 25253 - RNA, 19 nt, artificial
  Oligomer
uccaggauggugaccuucu

SEQ ID NO: 25254 - RNA, 19 nt, artificial
  Oligomer
cuuacuucugucucacucc

SEQ ID NO: 25255 - RNA, 19 nt, artificial
  Oligomer
uaagccguugcagugguug

SEQ ID NO: 25256 - RNA, 19 nt, artificial
  Oligomer
ugagcagugaguuugcagg

SEQ ID NO: 25257 - RNA, 19 nt, artificial
  Oligomer
uuauaucuguuuagguaag

SEQ ID NO: 25258 - RNA, 19 nt, artificial
  Oligomer
augcucagauaggacaucc

SEQ ID NO: 25259 - RNA, 19 nt, artificial
  Oligomer
uaguguuuuuuugaacacc

SEQ ID NO: 25260 - RNA, 19 nt, artificial
  Oligomer
ucuucucaugguaauagug

SEQ ID NO: 25261 - RNA, 19 nt, artificial
  Oligomer
uugcuugucugaauagauu

SEQ ID NO: 25262 - RNA, 19 nt, artificial
  Oligomer
uugagcaagaggacacuga

SEQ ID NO: 25263 - RNA, 19 nt, artificial
  Oligomer
cuuuguaguucauaguucg

SEQ ID NO: 25264 - RNA, 19 nt, artificial
  Oligomer
aucuguuuagguaaguaac

SEQ ID NO: 25265 - RNA, 19 nt, artificial
  Oligomer
uagauuugagcaacagucu

SEQ ID NO: 25266 - RNA, 19 nt, artificial
  Oligomer
uucacccacauacaugggc

SEQ ID NO: 25267 - RNA, 19 nt, artificial
  Oligomer
uaucuguuuagguaaguaa

SEQ ID NO: 25268 - RNA, 19 nt, artificial
  Oligomer
uuuuuugaacaccaacuau

SEQ ID NO: 25269 - RNA, 19 nt, artificial
  Oligomer
ucugccgacucucuuccuu

SEQ ID NO: 25270 - RNA, 19 nt, artificial
  Oligomer
aggauggugaccuucuucu

SEQ ID NO: 25271 - RNA, 19 nt, artificial
  Oligomer
ugucagguuuggaagucuc

SEQ ID NO: 25272 - RNA, 19 nt, artificial
  Oligomer
uugagguccaguuggagaa

SEQ ID NO: 25273 - RNA, 19 nt, artificial
  Oligomer
aaauuugagguccaguugg

SEQ ID NO: 25274 - RNA, 19 nt, artificial
  Oligomer
uccagauauacuauaacuu

SEQ ID NO: 25275 - RNA, 19 nt, artificial
  Oligomer
uccacaagcauuucaaaac

SEQ ID NO: 25276 - RNA, 19 nt, artificial
  Oligomer
auauacuauaacuuagugu

SEQ ID NO: 25277 - RNA, 19 nt, artificial
  Oligomer
uggaagucucauccagcug

SEQ ID NO: 25278 - RNA, 19 nt, artificial
  Oligomer
uccagcccuacagauuagc

SEQ ID NO: 25279 - RNA, 19 nt, artificial
  Oligomer
uuagguaaguaacaggagu

SEQ ID NO: 25280 - RNA, 19 nt, artificial
  Oligomer
acaaugaaauuugaggucc

SEQ ID NO: 25281 - RNA, 19 nt, artificial
  Oligomer
augaagaacagaaccagga

SEQ ID NO: 25282 - RNA, 19 nt, artificial
  Oligomer
agguucaucaucagcauug

SEQ ID NO: 25283 - RNA, 19 nt, artificial
  Oligomer
uugcuccacauacuggaag

SEQ ID NO: 25284 - RNA, 19 nt, artificial
  Oligomer
acugaugagagguacgugu

SEQ ID NO: 25285 - RNA, 19 nt, artificial
  Oligomer
uauucuucuggacaucauu

SEQ ID NO: 25286 - RNA, 19 nt, artificial
  Oligomer
uguccuuaggacauagguc

SEQ ID NO: 25287 - RNA, 19 nt, artificial
  Oligomer
uccucguugcgguugauga

SEQ ID NO: 25288 - RNA, 19 nt, artificial
  Oligomer
agaauguauauauucucug

SEQ ID NO: 25289 - RNA, 19 nt, artificial
  Oligomer
uauaacuuagugucuguau

SEQ ID NO: 25290 - RNA, 19 nt, artificial
  Oligomer
uaaaaccuguugcuugucu

SEQ ID NO: 25291 - RNA, 19 nt, artificial
  Oligomer
ugaagacguagggaccaca

SEQ ID NO: 25292 - RNA, 19 nt, artificial
  Oligomer
gauggugaccuucuucucc

SEQ ID NO: 25293 - RNA, 19 nt, artificial
  Oligomer
ugagagguacguguaaggg

SEQ ID NO: 25294 - RNA, 19 nt, artificial
  Oligomer
uuaaguccugaauauucuu

SEQ ID NO: 25295 - RNA, 19 nt, artificial
  Oligomer
acccacuucaaagaaggcc

SEQ ID NO: 25296 - RNA, 19 nt, artificial
  Oligomer
aacuccucgaucaccuucu

SEQ ID NO: 25297 - RNA, 19 nt, artificial
  Oligomer
uauauauucucuggguaac

SEQ ID NO: 25298 - RNA, 19 nt, artificial
  Oligomer
uucaucuccugcaggucau

SEQ ID NO: 25299 - RNA, 19 nt, artificial
  Oligomer
acaaacagcgacacgacag

SEQ ID NO: 25300 - RNA, 19 nt, artificial
  Oligomer
auccuaauggagccugacc

SEQ ID NO: 25301 - RNA, 19 nt, artificial
  Oligomer
aaggacuugcccaguuucg

SEQ ID NO: 25302 - RNA, 19 nt, artificial
  Oligomer
aaccauguuucuaaaaacc

SEQ ID NO: 25303 - RNA, 19 nt, artificial
  Oligomer
uccucgggugucuuaucac

SEQ ID NO: 25304 - RNA, 19 nt, artificial
  Oligomer
guccuuaggacauaggucc

SEQ ID NO: 25305 - RNA, 19 nt, artificial
  Oligomer
agugaggugguguauuuac

SEQ ID NO: 25306 - RNA, 19 nt, artificial
  Oligomer
ucucagguaaagaaagauu

SEQ ID NO: 25307 - RNA, 19 nt, artificial
  Oligomer
ucaucagcauugaauuccg

SEQ ID NO: 25308 - RNA, 19 nt, artificial
  Oligomer
gugaagaugaugaagacgu

SEQ ID NO: 25309 - RNA, 19 nt, artificial
  Oligomer
cuucuuuagcacacucuug

SEQ ID NO: 25310 - RNA, 19 nt, artificial
  Oligomer
uugcgguugaugagcagga

SEQ ID NO: 25311 - RNA, 19 nt, artificial
  Oligomer
uuuugagcaagaggacacu

SEQ ID NO: 25312 - RNA, 19 nt, artificial
  Oligomer
aaaauuauaaaaccuguug

SEQ ID NO: 25313 - RNA, 19 nt, artificial
  Oligomer
aauaucuugcaucuauaca

SEQ ID NO: 25314 - RNA, 19 nt, artificial
  Oligomer
uauaaaaccuguugcuugu

SEQ ID NO: 25315 - RNA, 19 nt, artificial
  Oligomer
ucaaacagauuuuugagca

SEQ ID NO: 25316 - RNA, 19 nt, artificial
  Oligomer
ugucucacucccauccaaa

SEQ ID NO: 25317 - RNA, 19 nt, artificial
  Oligomer
auugaugacuccaguguug

SEQ ID NO: 25318 - RNA, 19 nt, artificial
  Oligomer
cauguuucuaaaaaccagc

SEQ ID NO: 25319 - RNA, 19 nt, artificial
  Oligomer
auuugagguccaguuggag

SEQ ID NO: 25320 - RNA, 19 nt, artificial
  Oligomer
agcagguucaucaucagca

SEQ ID NO: 25321 - RNA, 19 nt, artificial
  Oligomer
uguagaacuccucgaucac

SEQ ID NO: 25322 - RNA, 19 nt, artificial
  Oligomer
uaguucauaguucgauuag

SEQ ID NO: 25323 - RNA, 19 nt, artificial
  Oligomer
ucuugagcagugaguuugc

SEQ ID NO: 25324 - RNA, 19 nt, artificial
  Oligomer
aacagaaccaggagcacag

SEQ ID NO: 25325 - RNA, 19 nt, artificial
  Oligomer
aacagcuccaggaugguga

SEQ ID NO: 25326 - RNA, 19 nt, artificial
  Oligomer
aguuggagaagccugcaac

SEQ ID NO: 25327 - RNA, 19 nt, artificial
  Oligomer
ugagcaacagucuugcuuu

SEQ ID NO: 25328 - RNA, 19 nt, artificial
  Oligomer
uggaguaauagaagacagc

SEQ ID NO: 25329 - RNA, 19 nt, artificial
  Oligomer
guuuuuuugaacaccaacu

SEQ ID NO: 25330 - RNA, 19 nt, artificial
  Oligomer
gcuuuuguuaaaauccugg

SEQ ID NO: 25331 - RNA, 19 nt, artificial
  Oligomer
auuauaaaaccuguugcuu

SEQ ID NO: 25332 - RNA, 19 nt, artificial
  Oligomer
ucaauccacaagcauuuca

SEQ ID NO: 25333 - RNA, 19 nt, artificial
  Oligomer
uuagcugggugaagaaggc

SEQ ID NO: 25334 - RNA, 19 nt, artificial
  Oligomer
uaaguaacaggagugaggu

SEQ ID NO: 25335 - RNA, 19 nt, artificial
  Oligomer
aucagcaucucaaaggacu

SEQ ID NO: 25336 - RNA, 19 nt, artificial
  Oligomer
aaauaugugauagaaaugc

SEQ ID NO: 25337 - RNA, 19 nt, artificial
  Oligomer
aucucaaaggacuugccca

SEQ ID NO: 25338 - RNA, 19 nt, artificial
  Oligomer
uauaaauaucuugcaucua

SEQ ID NO: 25339 - RNA, 19 nt, artificial
  Oligomer
aaugccuugaaugucaaga

SEQ ID NO: 25340 - RNA, 19 nt, artificial
  Oligomer
ucugucucacucccaucca

SEQ ID NO: 25341 - RNA, 19 nt, artificial
  Oligomer
aaguaggugaagaugaaga

SEQ ID NO: 25342 - RNA, 19 nt, artificial
  Oligomer
aggaucagcaucucaaagg

SEQ ID NO: 25343 - RNA, 19 nt, artificial
  Oligomer
uguauauauucucugggua

SEQ ID NO: 25344 - RNA, 19 nt, artificial
  Oligomer
ucucgacagggcuuagucu

SEQ ID NO: 25345 - RNA, 19 nt, artificial
  Oligomer
ucucuuccuucaucuccug

SEQ ID NO: 25346 - RNA, 19 nt, artificial
  Oligomer
ugguuguagaacuccucga

SEQ ID NO: 25347 - RNA, 19 nt, artificial
  Oligomer
cucucuuccuucaucuccu

SEQ ID NO: 25348 - RNA, 19 nt, artificial
  Oligomer
guaaguaacaggagugagg

SEQ ID NO: 25349 - RNA, 19 nt, artificial
  Oligomer
acauacaugggcacgaagc

SEQ ID NO: 25350 - RNA, 19 nt, artificial
  Oligomer
uuagucucaggaacuuuga

SEQ ID NO: 25351 - RNA, 19 nt, artificial
  Oligomer
augaagacguagggaccac

SEQ ID NO: 25352 - RNA, 19 nt, artificial
  Oligomer
auauaaauaucuugcaucu

SEQ ID NO: 25353 - RNA, 19 nt, artificial
  Oligomer
agcuucuuuagcacacucu

SEQ ID NO: 25354 - RNA, 19 nt, artificial
  Oligomer
aagcgguuaacgaaaaggc

SEQ ID NO: 25355 - RNA, 19 nt, artificial
  Oligomer
cucuuccuucaucuccugc

SEQ ID NO: 25356 - RNA, 19 nt, artificial
  Oligomer
auguauauauucucugggu

SEQ ID NO: 25357 - RNA, 19 nt, artificial
  Oligomer
cuacccucaauccacaagc

SEQ ID NO: 25358 - RNA, 19 nt, artificial
  Oligomer
auacaugggcacgaagccu

SEQ ID NO: 25359 - RNA, 19 nt, artificial
  Oligomer
aaagaauguauauauucuc

SEQ ID NO: 25360 - RNA, 19 nt, artificial
  Oligomer
uuugagcaacagucuugcu

SEQ ID NO: 25361 - RNA, 19 nt, artificial
  Oligomer
uuggguaggaagagauggg

SEQ ID NO: 25362 - RNA, 19 nt, artificial
  Oligomer
cuucuggacaucauugcug

SEQ ID NO: 25363 - RNA, 19 nt, artificial
  Oligomer
accauguuucuaaaaacca

SEQ ID NO: 25364 - RNA, 19 nt, artificial
  Oligomer
ugugauagaaaugccuuga

SEQ ID NO: 25365 - RNA, 19 nt, artificial
  Oligomer
aaauuauaaaaccuguugc

SEQ ID NO: 25366 - RNA, 19 nt, artificial
  Oligomer
auuugagugguuggguagg

SEQ ID NO: 25367 - RNA, 19 nt, artificial
  Oligomer
uccaccacaaacagcgaca

SEQ ID NO: 25368 - RNA, 19 nt, artificial
  Oligomer
auccuggagccguuaaguc

SEQ ID NO: 25369 - RNA, 19 nt, artificial
  Oligomer
auauugacaaccaaaaaua

SEQ ID NO: 25370 - RNA, 19 nt, artificial
  Oligomer
uccuucaucuccugcaggu

SEQ ID NO: 25371 - RNA, 19 nt, artificial
  Oligomer
ucuucuugagcagugaguu

SEQ ID NO: 25372 - RNA, 19 nt, artificial
  Oligomer
cuucuucucccgcaucauc

SEQ ID NO: 25373 - RNA, 19 nt, artificial
  Oligomer
gugaagaugaagaacagaa

SEQ ID NO: 25374 - RNA, 19 nt, artificial
  Oligomer
agaaaugccuugaauguca

SEQ ID NO: 25375 - RNA, 19 nt, artificial
  Oligomer
ugcuccugagagauccuua

SEQ ID NO: 25376 - RNA, 19 nt, artificial
  Oligomer
uaacuuagugucuguauuu

SEQ ID NO: 25377 - RNA, 19 nt, artificial
  Oligomer
guucauaguucgauuagug

SEQ ID NO: 25378 - RNA, 19 nt, artificial
  Oligomer
aaaauaaugcgauuucaag

SEQ ID NO: 25379 - RNA, 19 nt, artificial
  Oligomer
uccugagucgaagucuaag

SEQ ID NO: 25380 - RNA, 19 nt, artificial
  Oligomer
ucuguuuagguaaguaaca

SEQ ID NO: 25381 - RNA, 19 nt, artificial
  Oligomer
uaauuugagugguugggua

SEQ ID NO: 25382 - RNA, 19 nt, artificial
  Oligomer
uucucuggguaacagggau

SEQ ID NO: 25383 - RNA, 19 nt, artificial
  Oligomer
aaaaccuguugcuugucug

SEQ ID NO: 25384 - RNA, 19 nt, artificial
  Oligomer
auagaagcuuuguaguuca

SEQ ID NO: 25385 - RNA, 19 nt, artificial
  Oligomer
agauuaauuugagugguug

SEQ ID NO: 25386 - RNA, 19 nt, artificial
  Oligomer
ugcuugucugaauagauuu

SEQ ID NO: 25387 - RNA, 19 nt, artificial
  Oligomer
ucaagauaaagaauguaua

SEQ ID NO: 25388 - RNA, 19 nt, artificial
  Oligomer
guuaaaauccuggagccgu

SEQ ID NO: 25389 - RNA, 19 nt, artificial
  Oligomer
agcaucucaaaggacuugc

SEQ ID NO: 25390 - RNA, 19 nt, artificial
  Oligomer
aagaaggcaagugucucga

SEQ ID NO: 25391 - RNA, 19 nt, artificial
  Oligomer
uccaaaccuccuacccuca

SEQ ID NO: 25392 - RNA, 19 nt, artificial
  Oligomer
agugaagaugaugaagacg

SEQ ID NO: 25393 - RNA, 19 nt, artificial
  Oligomer
cccacaaugaaauuugagg

SEQ ID NO: 25394 - RNA, 19 nt, artificial
  Oligomer
aagaugaagaacagaacca

SEQ ID NO: 25395 - RNA, 19 nt, artificial
  Oligomer
aggcauggaaccauucagg

SEQ ID NO: 25396 - RNA, 19 nt, artificial
  Oligomer
acuucacccacauacaugg

SEQ ID NO: 25397 - RNA, 19 nt, artificial
  Oligomer
aaaggagacuagaacccgg

SEQ ID NO: 25398 - RNA, 19 nt, artificial
  Oligomer
uauaucuguuuagguaagu

SEQ ID NO: 25399 - RNA, 19 nt, artificial
  Oligomer
augacuccaguguuguagc

SEQ ID NO: 25400 - RNA, 19 nt, artificial
  Oligomer
cuucacauucaaaauaaug

SEQ ID NO: 25401 - RNA, 19 nt, artificial
  Oligomer
uaagggacuggauccugag

SEQ ID NO: 25402 - RNA, 19 nt, artificial
  Oligomer
uagguccagcccuacagau

SEQ ID NO: 25403 - RNA, 19 nt, artificial
  Oligomer
ugagugguuggguaggaag

SEQ ID NO: 25404 - RNA, 19 nt, artificial
  Oligomer
cuucucaugguaauagugu

SEQ ID NO: 25405 - RNA, 19 nt, artificial
  Oligomer
agcccuacagauuagcugg

SEQ ID NO: 25406 - RNA, 19 nt, artificial
  Oligomer
uucuccucguugcgguuga

SEQ ID NO: 25407 - RNA, 19 nt, artificial
  Oligomer
ucccauccaaaccuccuac

SEQ ID NO: 25408 - RNA, 19 nt, artificial
  Oligomer
aaguccugaauauucuucu

SEQ ID NO: 25409 - RNA, 19 nt, artificial
  Oligomer
aauaugugauagaaaugcc

SEQ ID NO: 25410 - RNA, 19 nt, artificial
  Oligomer
acguguaagggacuggauc

SEQ ID NO: 25411 - RNA, 19 nt, artificial
  Oligomer
uccacauacuggaagcaca

SEQ ID NO: 25412 - RNA, 19 nt, artificial
  Oligomer
uaauagaagacagcguuga

SEQ ID NO: 25413 - RNA, 19 nt, artificial
  Oligomer
cugaauauucuucuggaca

SEQ ID NO: 25414 - RNA, 19 nt, artificial
  Oligomer
auuuuugagcaagaggaca

SEQ ID NO: 25415 - RNA, 19 nt, artificial
  Oligomer
guuguagaacuccucgauc

SEQ ID NO: 25416 - RNA, 19 nt, artificial
  Oligomer
ugcucguggaguaauagaa

SEQ ID NO: 25417 - RNA, 19 nt, artificial
  Oligomer
auauauucucuggguaaca

SEQ ID NO: 25418 - RNA, 19 nt, artificial
  Oligomer
guagaacuccucgaucacc

SEQ ID NO: 25419 - RNA, 19 nt, artificial
  Oligomer
ugucucgacagggcuuagu

SEQ ID NO: 25420 - RNA, 19 nt, artificial
  Oligomer
cucgggugucuuaucacuu

SEQ ID NO: 25421 - RNA, 19 nt, artificial
  Oligomer
ucugucagguuuggaaguc

SEQ ID NO: 25422 - RNA, 19 nt, artificial
  Oligomer
aaggcaagugucucgacag

SEQ ID NO: 25423 - RNA, 19 nt, artificial
  Oligomer
auucucuggguaacaggga

SEQ ID NO: 25424 - RNA, 19 nt, artificial
  Oligomer
cuuaggacauagguccagc

SEQ ID NO: 25425 - RNA, 19 nt, artificial
  Oligomer
cuuguugcccaugauggag

SEQ ID NO: 25426 - RNA, 19 nt, artificial
  Oligomer
cauuucaaaaccauguuuc

SEQ ID NO: 25427 - RNA, 19 nt, artificial
  Oligomer
aaagcgguuaacgaaaagg

SEQ ID NO: 25428 - RNA, 19 nt, artificial
  Oligomer
aggugguguauuuacaagu

SEQ ID NO: 25429 - RNA, 19 nt, artificial
  Oligomer
aguaauagaagacagcguu

SEQ ID NO: 25430 - RNA, 19 nt, artificial
  Oligomer
agaugaugaagacguaggg

SEQ ID NO: 25431 - RNA, 19 nt, artificial
  Oligomer
agucuaagccguugcagug

SEQ ID NO: 25432 - RNA, 19 nt, artificial
  Oligomer
aauuugagugguuggguag

SEQ ID NO: 25433 - RNA, 19 nt, artificial
  Oligomer
cuguauuuaauauugacaa

SEQ ID NO: 25434 - RNA, 19 nt, artificial
  Oligomer
uggauccugagucgaaguc

SEQ ID NO: 25435 - RNA, 19 nt, artificial
  Oligomer
ucguggaguaauagaagac

SEQ ID NO: 25436 - RNA, 19 nt, artificial
  Oligomer
uccaugucuucuugagcag

SEQ ID NO: 25437 - RNA, 19 nt, artificial
  Oligomer
acauagguccagcccuaca

SEQ ID NO: 25438 - RNA, 19 nt, artificial
  Oligomer
agguaaagaaagauuaauu

SEQ ID NO: 25439 - RNA, 19 nt, artificial
  Oligomer
ugucuucuugagcagugag

SEQ ID NO: 25440 - RNA, 19 nt, artificial
  Oligomer
uaaaauccuggagccguua

SEQ ID NO: 25441 - RNA, 19 nt, artificial
  Oligomer
agucucaggaacuuugaag

SEQ ID NO: 25442 - RNA, 19 nt, artificial
  Oligomer
cugagucgaagucuaagcc

SEQ ID NO: 25443 - RNA, 19 nt, artificial
  Oligomer
ucaaauaugugauagaaau

SEQ ID NO: 25444 - RNA, 19 nt, artificial
  Oligomer
ugaagaugaugcucagcag

SEQ ID NO: 25445 - RNA, 19 nt, artificial
  Oligomer
ucaggaacuuugaaguagg

SEQ ID NO: 25446 - RNA, 19 nt, artificial
  Oligomer
aagaggacacugaugagag

SEQ ID NO: 25447 - RNA, 19 nt, artificial
  Oligomer
ugaggugguguauuuacaa

SEQ ID NO: 25448 - RNA, 19 nt, artificial
  Oligomer
caagcauuucaaaaccaug

SEQ ID NO: 25449 - RNA, 19 nt, artificial
  Oligomer
acaguugcuccacauacug

SEQ ID NO: 25450 - RNA, 19 nt, artificial
  Oligomer
cauggaaccauucagggug

SEQ ID NO: 25451 - RNA, 19 nt, artificial
  Oligomer
ucuaagccguugcaguggu

SEQ ID NO: 25452 - RNA, 19 nt, artificial
  Oligomer
acgaugaaccaugggaugg

SEQ ID NO: 25453 - RNA, 19 nt, artificial
  Oligomer
ucagguuuggaagucucau

SEQ ID NO: 25454 - RNA, 19 nt, artificial
  Oligomer
acagugaagaugaugaaga

SEQ ID NO: 25455 - RNA, 19 nt, artificial
  Oligomer
cuucugucucacucccauc

SEQ ID NO: 25456 - RNA, 19 nt, artificial
  Oligomer
aacuaguguuuuuuugaac

SEQ ID NO: 25457 - RNA, 19 nt, artificial
  Oligomer
aucugccgacucucuuccu

SEQ ID NO: 25458 - RNA, 19 nt, artificial
  Oligomer
acuaguguuuuuuugaaca

SEQ ID NO: 25459 - RNA, 19 nt, artificial
  Oligomer
gauuugagcaacagucuug

SEQ ID NO: 25460 - RNA, 19 nt, artificial
  Oligomer
gaagaaggcaagugucucg

SEQ ID NO: 25461 - RNA, 19 nt, artificial
  Oligomer
agaugaagaacagaaccag

SEQ ID NO: 25462 - RNA, 19 nt, artificial
  Oligomer
uaggacauccaggguagcu

SEQ ID NO: 25463 - RNA, 19 nt, artificial
  Oligomer
auagaaaugccuugaaugu

SEQ ID NO: 25464 - RNA, 19 nt, artificial
  Oligomer
uggucucagguaaagaaag

SEQ ID NO: 25465 - RNA, 19 nt, artificial
  Oligomer
aggaacuuugaaguaggug

SEQ ID NO: 25466 - RNA, 19 nt, artificial
  Oligomer
aagaauguauauauucucu

SEQ ID NO: 25467 - RNA, 19 nt, artificial
  Oligomer
uuugaacaccaacuaucaa

SEQ ID NO: 25468 - RNA, 19 nt, artificial
  Oligomer
auaacuuagugucuguauu

SEQ ID NO: 25469 - RNA, 19 nt, artificial
  Oligomer
ucacucccauccaaaccuc

SEQ ID NO: 25470 - RNA, 19 nt, artificial
  Oligomer
auacuauaacuuagugucu

SEQ ID NO: 25471 - RNA, 19 nt, artificial
  Oligomer
auagguccagcccuacaga

SEQ ID NO: 25472 - RNA, 19 nt, artificial
  Oligomer
acucccauccaaaccuccu

SEQ ID NO: 25473 - RNA, 19 nt, artificial
  Oligomer
acagggaucaaacagauuu

SEQ ID NO: 25474 - RNA, 19 nt, artificial
  Oligomer
uuugagugguuggguagga

SEQ ID NO: 25475 - RNA, 19 nt, artificial
  Oligomer
guccuuguugcccaugaug

SEQ ID NO: 25476 - RNA, 19 nt, artificial
  Oligomer
augucugguuguagaacuc

SEQ ID NO: 25477 - RNA, 19 nt, artificial
  Oligomer
uguauuuaauauugacaac

SEQ ID NO: 25478 - RNA, 19 nt, artificial
  Oligomer
aacgaaaaggcccacagag

SEQ ID NO: 25479 - RNA, 19 nt, artificial
  Oligomer
guccugaauauucuucugg

SEQ ID NO: 25480 - RNA, 19 nt, artificial
  Oligomer
ucaaaggacuugcccaguu

SEQ ID NO: 25481 - RNA, 19 nt, artificial
  Oligomer
aguugcuccacauacugga

SEQ ID NO: 25482 - RNA, 19 nt, artificial
  Oligomer
acuucugucucacucccau

SEQ ID NO: 25483 - RNA, 19 nt, artificial
  Oligomer
aguguuuuuuugaacacca

SEQ ID NO: 25484 - RNA, 19 nt, artificial
  Oligomer
cuccaugucuucuugagca

SEQ ID NO: 25485 - RNA, 19 nt, artificial
  Oligomer
cuugaaugucaagauaaag

SEQ ID NO: 25486 - RNA, 19 nt, artificial
  Oligomer
auucaaaauaaugcgauuu

SEQ ID NO: 25487 - RNA, 19 nt, artificial
  Oligomer
aauauucuucuggacauca

SEQ ID NO: 25488 - RNA, 19 nt, artificial
  Oligomer
ucuucuggacaucauugcu

SEQ ID NO: 25489 - RNA, 19 nt, artificial
  Oligomer
ugggugaagaaggcaagug

SEQ ID NO: 25490 - RNA, 19 nt, artificial
  Oligomer
ugaagaacagaaccaggag

SEQ ID NO: 25491 - RNA, 19 nt, artificial
  Oligomer
agagguacguguaagggac

SEQ ID NO: 25492 - RNA, 19 nt, artificial
  Oligomer
gaugacuccaguguuguag

SEQ ID NO: 25493 - RNA, 19 nt, artificial
  Oligomer
aaugaaauuugagguccag

SEQ ID NO: 25494 - RNA, 19 nt, artificial
  Oligomer
cucacacuugggaaucagc

SEQ ID NO: 25495 - RNA, 19 nt, artificial
  Oligomer
accuucuucucccgcauca

SEQ ID NO: 25496 - RNA, 19 nt, artificial
  Oligomer
aacagcgacacgacaguga

SEQ ID NO: 25497 - RNA, 19 nt, artificial
  Oligomer
accaacuaucaaauaugug

SEQ ID NO: 25498 - RNA, 19 nt, artificial
  Oligomer
augcucguggaguaauaga

SEQ ID NO: 25499 - RNA, 19 nt, artificial
  Oligomer
aacaggagugagguggugu

SEQ ID NO: 25500 - RNA, 19 nt, artificial
  Oligomer
cucacucccauccaaaccu

SEQ ID NO: 25501 - RNA, 19 nt, artificial
  Oligomer
aaaacuaguguuuuuuuga

SEQ ID NO: 25502 - RNA, 19 nt, artificial
  Oligomer
aagaugaugcucagcagca

SEQ ID NO: 25503 - RNA, 19 nt, artificial
  Oligomer
acuaucaaauaugugauag

SEQ ID NO: 25504 - RNA, 19 nt, artificial
  Oligomer
caucucaaaggacuugccc

SEQ ID NO: 25505 - RNA, 19 nt, artificial
  Oligomer
aauagauuugagcaacagu

SEQ ID NO: 25506 - RNA, 19 nt, artificial
  Oligomer
acaccaacuaucaaauaug

SEQ ID NO: 25507 - RNA, 19 nt, artificial
  Oligomer
aaccauucagggugaagcc

SEQ ID NO: 25508 - RNA, 19 nt, artificial
  Oligomer
aucaaauaugugauagaaa

SEQ ID NO: 25509 - RNA, 19 nt, artificial
  Oligomer
aauauugacaaccaaaaau

SEQ ID NO: 25510 - RNA, 19 nt, artificial
  Oligomer
cagcccuacagauuagcug

SEQ ID NO: 25511 - RNA, 19 nt, artificial
  Oligomer
cguuaaguccugaauauuc

SEQ ID NO: 25512 - RNA, 19 nt, artificial
  Oligomer
agauuuuugagcaagagga

SEQ ID NO: 25513 - RNA, 19 nt, artificial
  Oligomer
gucugguuguagaacuccu

SEQ ID NO: 25514 - RNA, 19 nt, artificial
  Oligomer
uccugaauauucuucugga

SEQ ID NO: 25515 - RNA, 19 nt, artificial
  Oligomer
aaaccuccuacccucaauc

SEQ ID NO: 25516 - RNA, 19 nt, artificial
  Oligomer
ucgggugucuuaucacuuu

SEQ ID NO: 25517 - RNA, 19 nt, artificial
  Oligomer
aagcacaugcccacaauga

SEQ ID NO: 25518 - RNA, 19 nt, artificial
  Oligomer
auaaugcgauuucaagccu

SEQ ID NO: 25519 - RNA, 19 nt, artificial
  Oligomer
aaauaucuugcaucuauac

SEQ ID NO: 25520 - RNA, 19 nt, artificial
  Oligomer
guaaagaaagauuaauuug

SEQ ID NO: 25521 - RNA, 19 nt, artificial
  Oligomer
agcaacagucuugcuuuug

SEQ ID NO: 25522 - RNA, 19 nt, artificial
  Oligomer
gugaggugguguauuuaca

SEQ ID NO: 25523 - RNA, 19 nt, artificial
  Oligomer
ucaaaauaaugcgauuuca

SEQ ID NO: 25524 - RNA, 19 nt, artificial
  Oligomer
agcgguuaacgaaaaggcc

SEQ ID NO: 25525 - RNA, 19 nt, artificial
  Oligomer
ugaaugucaagauaaagaa

SEQ ID NO: 25526 - RNA, 19 nt, artificial
  Oligomer
uagcgcgauggucaugagu

SEQ ID NO: 25527 - RNA, 19 nt, artificial
  Oligomer
agauaggacauccagggua

SEQ ID NO: 25528 - RNA, 19 nt, artificial
  Oligomer
auaaaaccuguugcuuguc

SEQ ID NO: 25529 - RNA, 19 nt, artificial
  Oligomer
auugacaaccaaaaauaua

SEQ ID NO: 25530 - RNA, 19 nt, artificial
  Oligomer
guuaaguccugaauauucu

SEQ ID NO: 25531 - RNA, 19 nt, artificial
  Oligomer
ugcucagauaggacaucca

SEQ ID NO: 25532 - RNA, 19 nt, artificial
  Oligomer
agcuuuguaguucauaguu

SEQ ID NO: 25533 - RNA, 19 nt, artificial
  Oligomer
auccacaagcauuucaaaa

SEQ ID NO: 25534 - RNA, 19 nt, artificial
  Oligomer
auauucuucuggacaucau

SEQ ID NO: 25535 - RNA, 19 nt, artificial
  Oligomer
gauagaagcuuuguaguuc

SEQ ID NO: 25536 - RNA, 19 nt, artificial
  Oligomer
uugagugguuggguaggaa

SEQ ID NO: 25537 - RNA, 19 nt, artificial
  Oligomer
cacuucacccacauacaug

SEQ ID NO: 25538 - RNA, 19 nt, artificial
  Oligomer
cuucaucuccugcagguca

SEQ ID NO: 25539 - RNA, 19 nt, artificial
  Oligomer
ucugaauagauuugagcaa

SEQ ID NO: 25540 - RNA, 19 nt, artificial
  Oligomer
aauuauaaaaccuguugcu

SEQ ID NO: 25541 - RNA, 19 nt, artificial
  Oligomer
aagaacagaaccaggagca

SEQ ID NO: 25542 - RNA, 19 nt, artificial
  Oligomer
agguacguguaagggacug

SEQ ID NO: 25543 - RNA, 19 nt, artificial
  Oligomer
uaacaggagugagguggug

SEQ ID NO: 25544 - RNA, 19 nt, artificial
  Oligomer
gugucuguauuuaauauug

SEQ ID NO: 25545 - RNA, 19 nt, artificial
  Oligomer
auuucaaaaccauguuucu

SEQ ID NO: 25546 - RNA, 19 nt, artificial
  Oligomer
uccuuaggacauaggucca

SEQ ID NO: 25547 - RNA, 19 nt, artificial
  Oligomer
agcacagugaagaugauga

SEQ ID NO: 25548 - RNA, 19 nt, artificial
  Oligomer
aaauccuggagccguuaag

SEQ ID NO: 25549 - RNA, 19 nt, artificial
  Oligomer
uaggaagagaugggaaggg

SEQ ID NO: 25550 - RNA, 19 nt, artificial
  Oligomer
aggagucuccaugucuucu

SEQ ID NO: 25551 - RNA, 19 nt, artificial
  Oligomer
ugaauauucuucuggacau

SEQ ID NO: 25552 - RNA, 19 nt, artificial
  Oligomer
aaaaggcccacagagaagg

SEQ ID NO: 25553 - RNA, 19 nt, artificial
  Oligomer
uagcugggugaagaaggca

SEQ ID NO: 25554 - RNA, 19 nt, artificial
  Oligomer
ugucuguauuuaauauuga

SEQ ID NO: 25555 - RNA, 19 nt, artificial
  Oligomer
uacguguaagggacuggau

SEQ ID NO: 25556 - RNA, 19 nt, artificial
  Oligomer
auuuaauauugacaaccaa

SEQ ID NO: 25557 - RNA, 19 nt, artificial
  Oligomer
cauacuggaagcacaugcc

SEQ ID NO: 25558 - RNA, 19 nt, artificial
  Oligomer
aagucuaagccguugcagu

SEQ ID NO: 25559 - RNA, 19 nt, artificial
  Oligomer
caaaggagacuagaacccg

SEQ ID NO: 25560 - RNA, 19 nt, artificial
  Oligomer
agcgaucucaucgaagguc

SEQ ID NO: 25561 - RNA, 19 nt, artificial
  Oligomer
ugaacaccaacuaucaaau

SEQ ID NO: 25562 - RNA, 19 nt, artificial
  Oligomer
uguccagauauacuauaac

SEQ ID NO: 25563 - RNA, 19 nt, artificial
  Oligomer
gauuucaagccugagcauc

SEQ ID NO: 25564 - RNA, 19 nt, artificial
  Oligomer
gaaagauuaauuugagugg

SEQ ID NO: 25565 - RNA, 19 nt, artificial
  Oligomer
guaauagaagacagcguug

SEQ ID NO: 25566 - RNA, 19 nt, artificial
  Oligomer
cucagugcaaaggagacua

SEQ ID NO: 25567 - RNA, 19 nt, artificial
  Oligomer
augccuugaaugucaagau

SEQ ID NO: 25568 - RNA, 19 nt, artificial
  Oligomer
ugaccuucuucucccgcau

SEQ ID NO: 25569 - RNA, 19 nt, artificial
  Oligomer
cuugucugaauagauuuga

SEQ ID NO: 25570 - RNA, 19 nt, artificial
  Oligomer
aaacagcgacacgacagug

SEQ ID NO: 25571 - RNA, 19 nt, artificial
  Oligomer
guuuggaagucucauccag

SEQ ID NO: 25572 - RNA, 19 nt, artificial
  Oligomer
aagcuuuguaguucauagu

SEQ ID NO: 25573 - RNA, 19 nt, artificial
  Oligomer
auaucuguuuagguaagua

SEQ ID NO: 25574 - RNA, 19 nt, artificial
  Oligomer
accacaaacagcgacacga

SEQ ID NO: 25575 - RNA, 19 nt, artificial
  Oligomer
ucagugcaaaggagacuag

SEQ ID NO: 25576 - RNA, 19 nt, artificial
  Oligomer
aaaggacuugcccaguuuc

SEQ ID NO: 25577 - RNA, 19 nt, artificial
  Oligomer
agguccagcccuacagauu

SEQ ID NO: 25578 - RNA, 19 nt, artificial
  Oligomer
caggauggugaccuucuuc

SEQ ID NO: 25579 - RNA, 19 nt, artificial
  Oligomer
ucaggcauggaaccauuca

SEQ ID NO: 25580 - RNA, 19 nt, artificial
  Oligomer
acuggauccugagucgaag

SEQ ID NO: 25581 - RNA, 19 nt, artificial
  Oligomer
cugagagauccuuagggcu

SEQ ID NO: 25582 - RNA, 19 nt, artificial
  Oligomer
aaagaaagauuaauuugag

SEQ ID NO: 25583 - RNA, 19 nt, artificial
  Oligomer
uaacagggaucaaacagau

SEQ ID NO: 25584 - RNA, 19 nt, artificial
  Oligomer
gauagaaaugccuugaaug

SEQ ID NO: 25585 - RNA, 19 nt, artificial
  Oligomer
ugaauagauuugagcaaca

SEQ ID NO: 25586 - RNA, 19 nt, artificial
  Oligomer
cagguuuggaagucucauc

SEQ ID NO: 25587 - RNA, 19 nt, artificial
  Oligomer
accuccugggauagaagcu

SEQ ID NO: 25588 - RNA, 19 nt, artificial
  Oligomer
ucaucaucagcauugaauu

SEQ ID NO: 25589 - RNA, 19 nt, artificial
  Oligomer
agugucuguauuuaauauu

SEQ ID NO: 25590 - RNA, 19 nt, artificial
  Oligomer
caaaacuaguguuuuuuug

SEQ ID NO: 25591 - RNA, 19 nt, artificial
  Oligomer
ucguugcgguugaugagca

SEQ ID NO: 25592 - RNA, 19 nt, artificial
  Oligomer
cuucucgaagaugcucgug

SEQ ID NO: 25593 - RNA, 19 nt, artificial
  Oligomer
acaucugucagguuuggaa

SEQ ID NO: 25594 - RNA, 19 nt, artificial
  Oligomer
uaucaaauaugugauagaa

SEQ ID NO: 25595 - RNA, 19 nt, artificial
  Oligomer
ugaggaaauugcugcagaa

SEQ ID NO: 25596 - RNA, 19 nt, artificial
  Oligomer
cccuguucacauuuuuuaa

SEQ ID NO: 25597 - RNA, 19 nt, artificial
  Oligomer
caccaaagauauuaaugaa

SEQ ID NO: 25598 - RNA, 19 nt, artificial
  Oligomer
caagauuuaacacuaaaaa

SEQ ID NO: 25599 - RNA, 19 nt, artificial
  Oligomer
ggaagucaaagcaaaacaa

SEQ ID NO: 25600 - RNA, 19 nt, artificial
  Oligomer
cugcagaauuccaaaagaa

SEQ ID NO: 25601 - RNA, 19 nt, artificial
  Oligomer
gcaagauuuaacacuaaaa

SEQ ID NO: 25602 - RNA, 19 nt, artificial
  Oligomer
cgacguucucucuuucuaa

SEQ ID NO: 25603 - RNA, 19 nt, artificial
  Oligomer
caauaaguuccauguuaaa

SEQ ID NO: 25604 - RNA, 19 nt, artificial
  Oligomer
gguuaucaguuaacauuaa

SEQ ID NO: 25605 - RNA, 19 nt, artificial
  Oligomer
gaagaaaagcacuuuuuaa

SEQ ID NO: 25606 - RNA, 19 nt, artificial
  Oligomer
ccauauaucuuauguuaaa

SEQ ID NO: 25607 - RNA, 19 nt, artificial
  Oligomer
guuagaugaggaagucaaa

SEQ ID NO: 25608 - RNA, 19 nt, artificial
  Oligomer
cguggguuaucaguuaaca

SEQ ID NO: 25609 - RNA, 19 nt, artificial
  Oligomer
cagcaaaccuguuuaugca

SEQ ID NO: 25610 - RNA, 19 nt, artificial
  Oligomer
gaauuauuaugucucaaaa

SEQ ID NO: 25611 - RNA, 19 nt, artificial
  Oligomer
gcuucagacuuuuaucaaa

SEQ ID NO: 25612 - RNA, 19 nt, artificial
  Oligomer
ccagauaccuuuacaucaa

SEQ ID NO: 25613 - RNA, 19 nt, artificial
  Oligomer
ggacuucuguggaccuuau

SEQ ID NO: 25614 - RNA, 19 nt, artificial
  Oligomer
cgggcauucuuauuaguca

SEQ ID NO: 25615 - RNA, 19 nt, artificial
  Oligomer
aaaugucuauagagaaaaa

SEQ ID NO: 25616 - RNA, 19 nt, artificial
  Oligomer
gauugaucacuuuguuaaa

SEQ ID NO: 25617 - RNA, 19 nt, artificial
  Oligomer
ugaggaagucaaagcaaaa

SEQ ID NO: 25618 - RNA, 19 nt, artificial
  Oligomer
caucagaaaugucaucaaa

SEQ ID NO: 25619 - RNA, 19 nt, artificial
  Oligomer
ccaucucauauacuuauaa

SEQ ID NO: 25620 - RNA, 19 nt, artificial
  Oligomer
cccacaaucucauacucaa

SEQ ID NO: 25621 - RNA, 19 nt, artificial
  Oligomer
gacuugugcugcugaauaa

SEQ ID NO: 25622 - RNA, 19 nt, artificial
  Oligomer
gcagaauuccaaaagaaga

SEQ ID NO: 25623 - RNA, 19 nt, artificial
  Oligomer
ggaccaucucauauacuua

SEQ ID NO: 25624 - RNA, 19 nt, artificial
  Oligomer
gauuauagaguauacuaaa

SEQ ID NO: 25625 - RNA, 19 nt, artificial
  Oligomer
ggaaccgucuguuuuuaaa

SEQ ID NO: 25626 - RNA, 19 nt, artificial
  Oligomer
gcugcagaauuccaaaaga

SEQ ID NO: 25627 - RNA, 19 nt, artificial
  Oligomer
cugagugugggcuucugaa

SEQ ID NO: 25628 - RNA, 19 nt, artificial
  Oligomer
gcaauaaguuccauguuaa

SEQ ID NO: 25629 - RNA, 19 nt, artificial
  Oligomer
caguuaacauuaacaucua

SEQ ID NO: 25630 - RNA, 19 nt, artificial
  Oligomer
gagcagaaagucucuauaa

SEQ ID NO: 25631 - RNA, 19 nt, artificial
  Oligomer
cauacucaaugaacccaaa

SEQ ID NO: 25632 - RNA, 19 nt, artificial
  Oligomer
acaugaacagaaacaauaa

SEQ ID NO: 25633 - RNA, 19 nt, artificial
  Oligomer
ggcauuuuuuacuacucaa

SEQ ID NO: 25634 - RNA, 19 nt, artificial
  Oligomer
ccauguuaguagcaaacau

SEQ ID NO: 25635 - RNA, 19 nt, artificial
  Oligomer
gaagucaaagcaaaacaaa

SEQ ID NO: 25636 - RNA, 19 nt, artificial
  Oligomer
guacaaugacagaagauaa

SEQ ID NO: 25637 - RNA, 19 nt, artificial
  Oligomer
gaauaucauuaaauuggaa

SEQ ID NO: 25638 - RNA, 19 nt, artificial
  Oligomer
ggauuauagaguauacuaa

SEQ ID NO: 25639 - RNA, 19 nt, artificial
  Oligomer
cagucaauuuuacaauuau

SEQ ID NO: 25640 - RNA, 19 nt, artificial
  Oligomer
cccugcuuuuugacaugaa

SEQ ID NO: 25641 - RNA, 19 nt, artificial
  Oligomer
guggaacaaagguauugaa

SEQ ID NO: 25642 - RNA, 19 nt, artificial
  Oligomer
cuggaugaccgaaaagcua

SEQ ID NO: 25643 - RNA, 19 nt, artificial
  Oligomer
agauauuaaugaaaugaga

SEQ ID NO: 25644 - RNA, 19 nt, artificial
  Oligomer
agcugcuguagaaaugaaa

SEQ ID NO: 25645 - RNA, 19 nt, artificial
  Oligomer
gaggcaaagcacuuauuga

SEQ ID NO: 25646 - RNA, 19 nt, artificial
  Oligomer
caacuggagcacugaucaa

SEQ ID NO: 25647 - RNA, 19 nt, artificial
  Oligomer
uaaguuugaucaaaucuaa

SEQ ID NO: 25648 - RNA, 19 nt, artificial
  Oligomer
cuguauuccuuguggagaa

SEQ ID NO: 25649 - RNA, 19 nt, artificial
  Oligomer
gagaaaagaaagagaagaa

SEQ ID NO: 25650 - RNA, 19 nt, artificial
  Oligomer
cacacuuggaagaaucaaa

SEQ ID NO: 25651 - RNA, 19 nt, artificial
  Oligomer
aggcagagcugcgaauaaa

SEQ ID NO: 25652 - RNA, 19 nt, artificial
  Oligomer
gcagcugcucaacuaauca

SEQ ID NO: 25653 - RNA, 19 nt, artificial
  Oligomer
cguccugcugcuuuagcaa

SEQ ID NO: 25654 - RNA, 19 nt, artificial
  Oligomer
ugugaucaaugcaccucaa

SEQ ID NO: 25655 - RNA, 19 nt, artificial
  Oligomer
gaauuuguauuuugcuuaa

SEQ ID NO: 25656 - RNA, 19 nt, artificial
  Oligomer
ugcaagauuuaacacuaaa

SEQ ID NO: 25657 - RNA, 19 nt, artificial
  Oligomer
ggguuaucaguuaacauua

SEQ ID NO: 25658 - RNA, 19 nt, artificial
  Oligomer
gcuucugaaacuucauaaa

SEQ ID NO: 25659 - RNA, 19 nt, artificial
  Oligomer
ggcuuaucaaaaucuuuca

SEQ ID NO: 25660 - RNA, 19 nt, artificial
  Oligomer
caauuuuacaauuauggaa

SEQ ID NO: 25661 - RNA, 19 nt, artificial
  Oligomer
caucucauauacuuauaau

SEQ ID NO: 25662 - RNA, 19 nt, artificial
  Oligomer
gaucaaaucuaauguaaga

SEQ ID NO: 25663 - RNA, 19 nt, artificial
  Oligomer
ccuacauaggcaaauugga

SEQ ID NO: 25664 - RNA, 19 nt, artificial
  Oligomer
gguuucaccugaucauaua

SEQ ID NO: 25665 - RNA, 19 nt, artificial
  Oligomer
caucaaauauuaccaaaaa

SEQ ID NO: 25666 - RNA, 19 nt, artificial
  Oligomer
gaguuaugugagcaugaua

SEQ ID NO: 25667 - RNA, 19 nt, artificial
  Oligomer
uccacuggaugaccgaaaa

SEQ ID NO: 25668 - RNA, 19 nt, artificial
  Oligomer
gacuuuagcuuacagucaa

SEQ ID NO: 25669 - RNA, 19 nt, artificial
  Oligomer
ucuguauuuucauguggaa

SEQ ID NO: 25670 - RNA, 19 nt, artificial
  Oligomer
cagcacucagaaaagaaaa

SEQ ID NO: 25671 - RNA, 19 nt, artificial
  Oligomer
cggacuucuguggaccuua

SEQ ID NO: 25672 - RNA, 19 nt, artificial
  Oligomer
aagcugcuguagaaaugaa

SEQ ID NO: 25673 - RNA, 19 nt, artificial
  Oligomer
uaaugaaaugagaaaagaa

SEQ ID NO: 25674 - RNA, 19 nt, artificial
  Oligomer
gugaaauaauuaaaaacca

SEQ ID NO: 25675 - RNA, 19 nt, artificial
  Oligomer
gcaaaacaaagcuugaaaa

SEQ ID NO: 25676 - RNA, 19 nt, artificial
  Oligomer
uugcaagauuuaacacuaa

SEQ ID NO: 25677 - RNA, 19 nt, artificial
  Oligomer
gcaauuuuccggaaucaau

SEQ ID NO: 25678 - RNA, 19 nt, artificial
  Oligomer
caaaucuaauguaagaaaa

SEQ ID NO: 25679 - RNA, 19 nt, artificial
  Oligomer
ucagaaaugucaucaaaua

SEQ ID NO: 25680 - RNA, 19 nt, artificial
  Oligomer
gaccgaaaagcuaucaaca

SEQ ID NO: 25681 - RNA, 19 nt, artificial
  Oligomer
ugggacuugugcugcugaa

SEQ ID NO: 25682 - RNA, 19 nt, artificial
  Oligomer
ucagauuauuggucuugaa

SEQ ID NO: 25683 - RNA, 19 nt, artificial
  Oligomer
gcagaaagucucuauaauu

SEQ ID NO: 25684 - RNA, 19 nt, artificial
  Oligomer
gacggcugguaucagcaaa

SEQ ID NO: 25685 - RNA, 19 nt, artificial
  Oligomer
agaaaagcacuuuuuaaaa

SEQ ID NO: 25686 - RNA, 19 nt, artificial
  Oligomer
guuuguaacuuaugccuaa

SEQ ID NO: 25687 - RNA, 19 nt, artificial
  Oligomer
uaucaaaaucccuauuuaa

SEQ ID NO: 25688 - RNA, 19 nt, artificial
  Oligomer
ccuguucacauuuuuuaaa

SEQ ID NO: 25689 - RNA, 19 nt, artificial
  Oligomer
agcagaaagucucuauaau

SEQ ID NO: 25690 - RNA, 19 nt, artificial
  Oligomer
gggugcuaacguaucucua

SEQ ID NO: 25691 - RNA, 19 nt, artificial
  Oligomer
cuacauaggcaaauuggaa

SEQ ID NO: 25692 - RNA, 19 nt, artificial
  Oligomer
gcucuguucuuuauaacaa

SEQ ID NO: 25693 - RNA, 19 nt, artificial
  Oligomer
gggaaccgucuguuuuuaa

SEQ ID NO: 25694 - RNA, 19 nt, artificial
  Oligomer
uaacaagguucuucuaaaa

SEQ ID NO: 25695 - RNA, 19 nt, artificial
  Oligomer
ugguuuuugcaagauuuaa

SEQ ID NO: 25696 - RNA, 19 nt, artificial
  Oligomer
guaauuaaguaaaccaaaa

SEQ ID NO: 25697 - RNA, 19 nt, artificial
  Oligomer
ggcugaguuuuucagucaa

SEQ ID NO: 25698 - RNA, 19 nt, artificial
  Oligomer
uaggcaaauuggaaauaca

SEQ ID NO: 25699 - RNA, 19 nt, artificial
  Oligomer
accugaggaugcaacaaau

SEQ ID NO: 25700 - RNA, 19 nt, artificial
  Oligomer
accgaaaagcuaucaacaa

SEQ ID NO: 25701 - RNA, 19 nt, artificial
  Oligomer
caucaaguuagaugaggaa

SEQ ID NO: 25702 - RNA, 19 nt, artificial
  Oligomer
aggaaagucuuuugaggaa

SEQ ID NO: 25703 - RNA, 19 nt, artificial
  Oligomer
aaaaaaugucuauagagaa

SEQ ID NO: 25704 - RNA, 19 nt, artificial
  Oligomer
cuuuaagagugaaauaauu

SEQ ID NO: 25705 - RNA, 19 nt, artificial
  Oligomer
ucgucacgggcauucuuau

SEQ ID NO: 25706 - RNA, 19 nt, artificial
  Oligomer
aguuugcuuugcuuuuuaa

SEQ ID NO: 25707 - RNA, 19 nt, artificial
  Oligomer
gaaaagcacuuuuuaaaaa

SEQ ID NO: 25708 - RNA, 19 nt, artificial
  Oligomer
caucgucacgggcauucuu

SEQ ID NO: 25709 - RNA, 19 nt, artificial
  Oligomer
cgcauuguacacuaucuau

SEQ ID NO: 25710 - RNA, 19 nt, artificial
  Oligomer
caaucucauacucaaugaa

SEQ ID NO: 25711 - RNA, 19 nt, artificial
  Oligomer
auaugaugaugucaccaaa

SEQ ID NO: 25712 - RNA, 19 nt, artificial
  Oligomer
guggguuaucaguuaacau

SEQ ID NO: 25713 - RNA, 19 nt, artificial
  Oligomer
agguucuucuaaaauugaa

SEQ ID NO: 25714 - RNA, 19 nt, artificial
  Oligomer
agggcaggugguucuaaua

SEQ ID NO: 25715 - RNA, 19 nt, artificial
  Oligomer
aaugaaaugagaaaagaaa

SEQ ID NO: 25716 - RNA, 19 nt, artificial
  Oligomer
ccuccuccugcaaugcaua

SEQ ID NO: 25717 - RNA, 19 nt, artificial
  Oligomer
uaucaacaguacagaugaa

SEQ ID NO: 25718 - RNA, 19 nt, artificial
  Oligomer
cacugaucaauccuucuua

SEQ ID NO: 25719 - RNA, 19 nt, artificial
  Oligomer
gcugcauucagcaauugga

SEQ ID NO: 25720 - RNA, 19 nt, artificial
  Oligomer
gaauugacaggacucccaa

SEQ ID NO: 25721 - RNA, 19 nt, artificial
  Oligomer
ccugaggaugcaacaaaua

SEQ ID NO: 25722 - RNA, 19 nt, artificial
  Oligomer
ugucuuagcuguauacaga

SEQ ID NO: 25723 - RNA, 19 nt, artificial
  Oligomer
ggacuauauugugggcuaa

SEQ ID NO: 25724 - RNA, 19 nt, artificial
  Oligomer
gaaaugucaucaaauauua

SEQ ID NO: 25725 - RNA, 19 nt, artificial
  Oligomer
auguggaauggauuauaga

SEQ ID NO: 25726 - RNA, 19 nt, artificial
  Oligomer
ggugguucuaauauuuuua

SEQ ID NO: 25727 - RNA, 19 nt, artificial
  Oligomer
cuucagacuuuuaucaaaa

SEQ ID NO: 25728 - RNA, 19 nt, artificial
  Oligomer
aaaaaugucuauagagaaa

SEQ ID NO: 25729 - RNA, 19 nt, artificial
  Oligomer
caacuaguacaaugacaga

SEQ ID NO: 25730 - RNA, 19 nt, artificial
  Oligomer
accucaacagguaauaaua

SEQ ID NO: 25731 - RNA, 19 nt, artificial
  Oligomer
gucucaaaauaaguugaaa

SEQ ID NO: 25732 - RNA, 19 nt, artificial
  Oligomer
aagaaaagcacuuuuuaaa

SEQ ID NO: 25733 - RNA, 19 nt, artificial
  Oligomer
ugaucacuuuguuaaaaau

SEQ ID NO: 25734 - RNA, 19 nt, artificial
  Oligomer
gcugcuguagaaaugaaau

SEQ ID NO: 25735 - RNA, 19 nt, artificial
  Oligomer
accuuuacaucaaguuaga

SEQ ID NO: 25736 - RNA, 19 nt, artificial
  Oligomer
ggcaauaaguuccauguua

SEQ ID NO: 25737 - RNA, 19 nt, artificial
  Oligomer
gugggcuucugaaacuuca

SEQ ID NO: 25738 - RNA, 19 nt, artificial
  Oligomer
gguuuucacauacacucaa

SEQ ID NO: 25739 - RNA, 19 nt, artificial
  Oligomer
ccgucuguuuuuaaaugau

SEQ ID NO: 25740 - RNA, 19 nt, artificial
  Oligomer
ugaauaucauuaaauugga

SEQ ID NO: 25741 - RNA, 19 nt, artificial
  Oligomer
gaugaggaagucaaagcaa

SEQ ID NO: 25742 - RNA, 19 nt, artificial
  Oligomer
cuguaauuaaguaaaccaa

SEQ ID NO: 25743 - RNA, 19 nt, artificial
  Oligomer
uggaauggauuauagagua

SEQ ID NO: 25744 - RNA, 19 nt, artificial
  Oligomer
cuagaaaccugaggaugca

SEQ ID NO: 25745 - RNA, 19 nt, artificial
  Oligomer
ggaugaguuaugugagcau

SEQ ID NO: 25746 - RNA, 19 nt, artificial
  Oligomer
cuccugcaaugcauaacua

SEQ ID NO: 25747 - RNA, 19 nt, artificial
  Oligomer
cagaaaugucaucaaauau

SEQ ID NO: 25748 - RNA, 19 nt, artificial
  Oligomer
gaauuuucuuacccauaua

SEQ ID NO: 25749 - RNA, 19 nt, artificial
  Oligomer
gaaacuucauaaauguuca

SEQ ID NO: 25750 - RNA, 19 nt, artificial
  Oligomer
ccaaaagcugcuguagaaa

SEQ ID NO: 25751 - RNA, 19 nt, artificial
  Oligomer
ggacuugugcugcugaaua

SEQ ID NO: 25752 - RNA, 19 nt, artificial
  Oligomer
ugagcagaaagucucuaua

SEQ ID NO: 25753 - RNA, 19 nt, artificial
  Oligomer
auuccuugagcauuuuaua

SEQ ID NO: 25754 - RNA, 19 nt, artificial
  Oligomer
aagggcaggugguucuaau

SEQ ID NO: 25755 - RNA, 19 nt, artificial
  Oligomer
uaaaguuccagaaaccaaa

SEQ ID NO: 25756 - RNA, 19 nt, artificial
  Oligomer
ugaagaaaagcacuuuuua

SEQ ID NO: 25757 - RNA, 19 nt, artificial
  Oligomer
agcaauuuuccggaaucaa

SEQ ID NO: 25758 - RNA, 19 nt, artificial
  Oligomer
gggaccaucucauauacuu

SEQ ID NO: 25759 - RNA, 19 nt, artificial
  Oligomer
gcaccucaacagguaauaa

SEQ ID NO: 25760 - RNA, 19 nt, artificial
  Oligomer
cuaguacaaugacagaaga

SEQ ID NO: 25761 - RNA, 19 nt, artificial
  Oligomer
augaggaagucaaagcaaa

SEQ ID NO: 25762 - RNA, 19 nt, artificial
  Oligomer
gaaaagcuaucaacaacua

SEQ ID NO: 25763 - RNA, 19 nt, artificial
  Oligomer
caguccaaagaacaagaaa

SEQ ID NO: 25764 - RNA, 19 nt, artificial
  Oligomer
gagauuucaacauaucauu

SEQ ID NO: 25765 - RNA, 19 nt, artificial
  Oligomer
cugaauuauuaugucucaa

SEQ ID NO: 25766 - RNA, 19 nt, artificial
  Oligomer
uaggcagagcugcgaauaa

SEQ ID NO: 25767 - RNA, 19 nt, artificial
  Oligomer
cucuuuuucuguccagaaa

SEQ ID NO: 25768 - RNA, 19 nt, artificial
  Oligomer
ugagugugggcuucugaaa

SEQ ID NO: 25769 - RNA, 19 nt, artificial
  Oligomer
agagauuucaacauaucau

SEQ ID NO: 25770 - RNA, 19 nt, artificial
  Oligomer
cccagauaccuuuacauca

SEQ ID NO: 25771 - RNA, 19 nt, artificial
  Oligomer
cacgggcauucuuauuagu

SEQ ID NO: 25772 - RNA, 19 nt, artificial
  Oligomer
gaugcaacaaauauuuaua

SEQ ID NO: 25773 - RNA, 19 nt, artificial
  Oligomer
cuaccgacagccuauucua

SEQ ID NO: 25774 - RNA, 19 nt, artificial
  Oligomer
gauauuaaugaaaugagaa

SEQ ID NO: 25775 - RNA, 19 nt, artificial
  Oligomer
gcaguccaaagaacaagaa

SEQ ID NO: 25776 - RNA, 19 nt, artificial
  Oligomer
gagucagacauuugguaua

SEQ ID NO: 25777 - RNA, 19 nt, artificial
  Oligomer
cacauuuuuuaaaguucca

SEQ ID NO: 25778 - RNA, 19 nt, artificial
  Oligomer
ccuaauaaguuugaucaaa

SEQ ID NO: 25779 - RNA, 19 nt, artificial
  Oligomer
ccucaacagguaauaauau

SEQ ID NO: 25780 - RNA, 19 nt, artificial
  Oligomer
caaagaacaagaaauuguu

SEQ ID NO: 25781 - RNA, 19 nt, artificial
  Oligomer
agcguggguuaucaguuaa

SEQ ID NO: 25782 - RNA, 19 nt, artificial
  Oligomer
agaaagucucuauaauuca

SEQ ID NO: 25783 - RNA, 19 nt, artificial
  Oligomer
caaugcaccucaacaggua

SEQ ID NO: 25784 - RNA, 19 nt, artificial
  Oligomer
guaagaaaauuugaaguaa

SEQ ID NO: 25785 - RNA, 19 nt, artificial
  Oligomer
ccaaagauauuaaugaaau

SEQ ID NO: 25786 - RNA, 19 nt, artificial
  Oligomer
augacauuggugugaucaa

SEQ ID NO: 25787 - RNA, 19 nt, artificial
  Oligomer
gcuuuuuucuugaguacua

SEQ ID NO: 25788 - RNA, 19 nt, artificial
  Oligomer
acauauauguaauuuagca

SEQ ID NO: 25789 - RNA, 19 nt, artificial
  Oligomer
uuugguauauuaccucaaa

SEQ ID NO: 25790 - RNA, 19 nt, artificial
  Oligomer
acugaucaauccuucuuau

SEQ ID NO: 25791 - RNA, 19 nt, artificial
  Oligomer
cccauauaucuuauguuaa

SEQ ID NO: 25792 - RNA, 19 nt, artificial
  Oligomer
cacagguugcugaggcaaa

SEQ ID NO: 25793 - RNA, 19 nt, artificial
  Oligomer
caaacauucugucauuagu

SEQ ID NO: 25794 - RNA, 19 nt, artificial
  Oligomer
augguaagacuguaauuaa

SEQ ID NO: 25795 - RNA, 19 nt, artificial
  Oligomer
auaacaagguucuucuaaa

SEQ ID NO: 25796 - RNA, 19 nt, artificial
  Oligomer
aguuguucacauauaugua

SEQ ID NO: 25797 - RNA, 19 nt, artificial
  Oligomer
ggaugcaacaaauauuuau

SEQ ID NO: 25798 - RNA, 19 nt, artificial
  Oligomer
guuuuugcaagauuuaaca

SEQ ID NO: 25799 - RNA, 19 nt, artificial
  Oligomer
agaguauacuaaaaaaugu

SEQ ID NO: 25800 - RNA, 19 nt, artificial
  Oligomer
uagcguggguuaucaguua

SEQ ID NO: 25801 - RNA, 19 nt, artificial
  Oligomer
gagugagcagaaagucucu

SEQ ID NO: 25802 - RNA, 19 nt, artificial
  Oligomer
ggauugaucacuuuguuaa

SEQ ID NO: 25803 - RNA, 19 nt, artificial
  Oligomer
ugaagagauuucaacauau

SEQ ID NO: 25804 - RNA, 19 nt, artificial
  Oligomer
cauucuuauuagucagauu

SEQ ID NO: 25805 - RNA, 19 nt, artificial
  Oligomer
acauguuuuggguguucca

SEQ ID NO: 25806 - RNA, 19 nt, artificial
  Oligomer
cuauguuaucaacaguaca

SEQ ID NO: 25807 - RNA, 19 nt, artificial
  Oligomer
ggcaggugguucuaauauu

SEQ ID NO: 25808 - RNA, 19 nt, artificial
  Oligomer
gcuaguuuauuuuguuaca

SEQ ID NO: 25809 - RNA, 19 nt, artificial
  Oligomer
ucaucagaaaugucaucaa

SEQ ID NO: 25810 - RNA, 19 nt, artificial
  Oligomer
cauguggaauggauuauag

SEQ ID NO: 25811 - RNA, 19 nt, artificial
  Oligomer
ggaaagucuuuugaggaaa

SEQ ID NO: 25812 - RNA, 19 nt, artificial
  Oligomer
aggguuugaggauuccuga

SEQ ID NO: 25813 - RNA, 19 nt, artificial
  Oligomer
ccaacuggagcacugauca

SEQ ID NO: 25814 - RNA, 19 nt, artificial
  Oligomer
gaugauuaaacagacuuua

SEQ ID NO: 25815 - RNA, 19 nt, artificial
  Oligomer
caggccugguuccuaugua

SEQ ID NO: 25816 - RNA, 19 nt, artificial
  Oligomer
aaaauugaagagauuucaa

SEQ ID NO: 25817 - RNA, 19 nt, artificial
  Oligomer
acuaaaaaaugucuauaga

SEQ ID NO: 25818 - RNA, 19 nt, artificial
  Oligomer
gaucaauccuucuuauguu

SEQ ID NO: 25819 - RNA, 19 nt, artificial
  Oligomer
agacaacucuuccauuuau

SEQ ID NO: 25820 - RNA, 19 nt, artificial
  Oligomer
cgucacgggcauucuuauu

SEQ ID NO: 25821 - RNA, 19 nt, artificial
  Oligomer
ggcuucugaaacuucauaa

SEQ ID NO: 25822 - RNA, 19 nt, artificial
  Oligomer
cauuugcuuuguuuucuaa

SEQ ID NO: 25823 - RNA, 19 nt, artificial
  Oligomer
gaccaucucauauacuuau

SEQ ID NO: 25824 - RNA, 19 nt, artificial
  Oligomer
aguuagaugaggaagucaa

SEQ ID NO: 25825 - RNA, 19 nt, artificial
  Oligomer
aaccaaaaaggcuaguuua

SEQ ID NO: 25826 - RNA, 19 nt, artificial
  Oligomer
acgcauuguacacuaucua

SEQ ID NO: 25827 - RNA, 19 nt, artificial
  Oligomer
aguucugaugggucccaaa

SEQ ID NO: 25828 - RNA, 19 nt, artificial
  Oligomer
gauuagauucccaucaaua

SEQ ID NO: 25829 - RNA, 19 nt, artificial
  Oligomer
ggacucccaacuaguacaa

SEQ ID NO: 25830 - RNA, 19 nt, artificial
  Oligomer
cauccuucagucucugcua

SEQ ID NO: 25831 - RNA, 19 nt, artificial
  Oligomer
gccuuuacccuguucacau

SEQ ID NO: 25832 - RNA, 19 nt, artificial
  Oligomer
acaggacucccaacuagua

SEQ ID NO: 25833 - RNA, 19 nt, artificial
  Oligomer
gaaauuccuaggagcuaca

SEQ ID NO: 25834 - RNA, 19 nt, artificial
  Oligomer
gacaugaacagaaacaaua

SEQ ID NO: 25835 - RNA, 19 nt, artificial
  Oligomer
guuuucacauacacucaaa

SEQ ID NO: 25836 - RNA, 19 nt, artificial
  Oligomer
guaucagcaaaccuguuua

SEQ ID NO: 25837 - RNA, 19 nt, artificial
  Oligomer
uaaguuccauguuaaaaua

SEQ ID NO: 25838 - RNA, 19 nt, artificial
  Oligomer
aauugcugcagaauuccaa

SEQ ID NO: 25839 - RNA, 19 nt, artificial
  Oligomer
caaaauugggaccaucuca

SEQ ID NO: 25840 - RNA, 19 nt, artificial
  Oligomer
gccugguuccuauguauau

SEQ ID NO: 25841 - RNA, 19 nt, artificial
  Oligomer
ccuucuuauguuugcuuua

SEQ ID NO: 25842 - RNA, 19 nt, artificial
  Oligomer
aaagcaaaacaaagcuuga

SEQ ID NO: 25843 - RNA, 19 nt, artificial
  Oligomer
guuccagaaaccaaaggaa

SEQ ID NO: 25844 - RNA, 19 nt, artificial
  Oligomer
ucagcacucagaaaagaaa

SEQ ID NO: 25845 - RNA, 19 nt, artificial
  Oligomer
aggcuguuuucuccaccaa

SEQ ID NO: 25846 - RNA, 19 nt, artificial
  Oligomer
ccacaaucucauacucaau

SEQ ID NO: 25847 - RNA, 19 nt, artificial
  Oligomer
agacggcugguaucagcaa

SEQ ID NO: 25848 - RNA, 19 nt, artificial
  Oligomer
guaauaauaucucacuaua

SEQ ID NO: 25849 - RNA, 19 nt, artificial
  Oligomer
ccaaaugguuuuugcaaga

SEQ ID NO: 25850 - RNA, 19 nt, artificial
  Oligomer
ggaauggauuauagaguau

SEQ ID NO: 25851 - RNA, 19 nt, artificial
  Oligomer
accuguuuaugcaaccauu

SEQ ID NO: 25852 - RNA, 19 nt, artificial
  Oligomer
cagcaauuuuccggaauca

SEQ ID NO: 25853 - RNA, 19 nt, artificial
  Oligomer
ggacagccugguuuucaca

SEQ ID NO: 25854 - RNA, 19 nt, artificial
  Oligomer
gcaggugguucuaauauuu

SEQ ID NO: 25855 - RNA, 19 nt, artificial
  Oligomer
ugagaagauuagacuugga

SEQ ID NO: 25856 - RNA, 19 nt, artificial
  Oligomer
gggcuucugaaacuucaua

SEQ ID NO: 25857 - RNA, 19 nt, artificial
  Oligomer
caaucaugagucagacauu

SEQ ID NO: 25858 - RNA, 19 nt, artificial
  Oligomer
cuaaaguuguucacauaua

SEQ ID NO: 25859 - RNA, 19 nt, artificial
  Oligomer
ucauguggaauggauuaua

SEQ ID NO: 25860 - RNA, 19 nt, artificial
  Oligomer
gcgacguucucucuuucua

SEQ ID NO: 25861 - RNA, 19 nt, artificial
  Oligomer
aggcaaagcacuuauugau

SEQ ID NO: 25862 - RNA, 19 nt, artificial
  Oligomer
agguaauaauaucucacua

SEQ ID NO: 25863 - RNA, 19 nt, artificial
  Oligomer
uguaauuaaguaaaccaaa

SEQ ID NO: 25864 - RNA, 19 nt, artificial
  Oligomer
caaaaaggcuaguuuauuu

SEQ ID NO: 25865 - RNA, 19 nt, artificial
  Oligomer
gcucccauuuucuuuccua

SEQ ID NO: 25866 - RNA, 19 nt, artificial
  Oligomer
gggcauucuuauuagucag

SEQ ID NO: 25867 - RNA, 19 nt, artificial
  Oligomer
gaaagucuuuugaggaaau

SEQ ID NO: 25868 - RNA, 19 nt, artificial
  Oligomer
uuagcagggugcuaacgua

SEQ ID NO: 25869 - RNA, 19 nt, artificial
  Oligomer
aguuaacauuaacaucuau

SEQ ID NO: 25870 - RNA, 19 nt, artificial
  Oligomer
ugacauuggugugaucaau

SEQ ID NO: 25871 - RNA, 19 nt, artificial
  Oligomer
ugauuagauucccaucaau

SEQ ID NO: 25872 - RNA, 19 nt, artificial
  Oligomer
cacgcauuguacacuaucu

SEQ ID NO: 25873 - RNA, 19 nt, artificial
  Oligomer
uaaaguuguucacauauau

SEQ ID NO: 25874 - RNA, 19 nt, artificial
  Oligomer
ggaccugcucccauuuucu

SEQ ID NO: 25875 - RNA, 19 nt, artificial
  Oligomer
uccuaauaaguuugaucaa

SEQ ID NO: 25876 - RNA, 19 nt, artificial
  Oligomer
aaaauaaguugaaaaggua

SEQ ID NO: 25877 - RNA, 19 nt, artificial
  Oligomer
cuaauguaagaaaauuuga

SEQ ID NO: 25878 - RNA, 19 nt, artificial
  Oligomer
cuauuuaauuuuccuggaa

SEQ ID NO: 25879 - RNA, 19 nt, artificial
  Oligomer
uuagcaguccaaagaacaa

SEQ ID NO: 25880 - RNA, 19 nt, artificial
  Oligomer
guaggcuuaucaaaaucuu

SEQ ID NO: 25881 - RNA, 19 nt, artificial
  Oligomer
ccucaaauuccuaauaagu

SEQ ID NO: 25882 - RNA, 19 nt, artificial
  Oligomer
agcaaaacaaagcuugaaa

SEQ ID NO: 25883 - RNA, 19 nt, artificial
  Oligomer
gucuuagcuguauacagau

SEQ ID NO: 25884 - RNA, 19 nt, artificial
  Oligomer
auguaauuuagcaguccaa

SEQ ID NO: 25885 - RNA, 19 nt, artificial
  Oligomer
acaagaccuggaauugaca

SEQ ID NO: 25886 - RNA, 19 nt, artificial
  Oligomer
gcagagcugcgaauaaaca

SEQ ID NO: 25887 - RNA, 19 nt, artificial
  Oligomer
gaaugagugggauguuugu

SEQ ID NO: 25888 - RNA, 19 nt, artificial
  Oligomer
gaaaccugaggaugcaaca

SEQ ID NO: 25889 - RNA, 19 nt, artificial
  Oligomer
aauuuagcaguccaaagaa

SEQ ID NO: 25890 - RNA, 19 nt, artificial
  Oligomer
cgcugagaagauuagacuu

SEQ ID NO: 25891 - RNA, 19 nt, artificial
  Oligomer
auugcugcagaauuccaaa

SEQ ID NO: 25892 - RNA, 19 nt, artificial
  Oligomer
cacucagcuuuuuucuuga

SEQ ID NO: 25893 - RNA, 19 nt, artificial
  Oligomer
acuuauaauugcuggaaga

SEQ ID NO: 25894 - RNA, 19 nt, artificial
  Oligomer
ccauuuuaguuccuuuauu

SEQ ID NO: 25895 - RNA, 19 nt, artificial
  Oligomer
cuuugucagcuucuuugaa

SEQ ID NO: 25896 - RNA, 19 nt, artificial
  Oligomer
ugggcuucugaaacuucau

SEQ ID NO: 25897 - RNA, 19 nt, artificial
  Oligomer
gaucauauagcguggguua

SEQ ID NO: 25898 - RNA, 19 nt, artificial
  Oligomer
gaucacuuuguuaaaaaua

SEQ ID NO: 25899 - RNA, 19 nt, artificial
  Oligomer
ugacaugaacagaaacaau

SEQ ID NO: 25900 - RNA, 19 nt, artificial
  Oligomer
cauuggugugaucaaugca

SEQ ID NO: 25901 - RNA, 19 nt, artificial
  Oligomer
augucaccaaagauauuaa

SEQ ID NO: 25902 - RNA, 19 nt, artificial
  Oligomer
cacauaacuagaaaccuga

SEQ ID NO: 25903 - RNA, 19 nt, artificial
  Oligomer
augguuuuugcaagauuua

SEQ ID NO: 25904 - RNA, 19 nt, artificial
  Oligomer
uguuccuaacauaaaauaa

SEQ ID NO: 25905 - RNA, 19 nt, artificial
  Oligomer
cugaauaaguucucuugga

SEQ ID NO: 25906 - RNA, 19 nt, artificial
  Oligomer
uuugcaagauuuaacacua

SEQ ID NO: 25907 - RNA, 19 nt, artificial
  Oligomer
cuguagaaaugaaauuccu

SEQ ID NO: 25908 - RNA, 19 nt, artificial
  Oligomer
ggaaagacugauuguuuua

SEQ ID NO: 25909 - RNA, 19 nt, artificial
  Oligomer
uuugguaggcuuaucaaaa

SEQ ID NO: 25910 - RNA, 19 nt, artificial
  Oligomer
accaucucauauacuuaua

SEQ ID NO: 25911 - RNA, 19 nt, artificial
  Oligomer
ggccuuuacccuguucaca

SEQ ID NO: 25912 - RNA, 19 nt, artificial
  Oligomer
aauaauaucucacuauaga

SEQ ID NO: 25913 - RNA, 19 nt, artificial
  Oligomer
acccuguucacauuuuuua

SEQ ID NO: 25914 - RNA, 19 nt, artificial
  Oligomer
uguagaaaugaaauuccua

SEQ ID NO: 25915 - RNA, 19 nt, artificial
  Oligomer
ugaugaugucaccaaagau

SEQ ID NO: 25916 - RNA, 19 nt, artificial
  Oligomer
aggccugguuccuauguau

SEQ ID NO: 25917 - RNA, 19 nt, artificial
  Oligomer
uuuugguaggcuuaucaaa

SEQ ID NO: 25918 - RNA, 19 nt, artificial
  Oligomer
caccaauuccagcuaccga

SEQ ID NO: 25919 - RNA, 19 nt, artificial
  Oligomer
gagaaaaacuuucauuuuu

SEQ ID NO: 25920 - RNA, 19 nt, artificial
  Oligomer
ccuuuacccuguucacauu

SEQ ID NO: 25921 - RNA, 19 nt, artificial
  Oligomer
gucuguuuuuaaaugauga

SEQ ID NO: 25922 - RNA, 19 nt, artificial
  Oligomer
cccugguuuucacugucau

SEQ ID NO: 25923 - RNA, 19 nt, artificial
  Oligomer
gaggaugcaacaaauauuu

SEQ ID NO: 25924 - RNA, 19 nt, artificial
  Oligomer
cggugaaauugcuccaacc

SEQ ID NO: 25925 - RNA, 19 nt, artificial
  Oligomer
uuaugugcucucaucagaa

SEQ ID NO: 25926 - RNA, 19 nt, artificial
  Oligomer
ggccugguuccuauguaua

SEQ ID NO: 25927 - RNA, 19 nt, artificial
  Oligomer
gcugcucaacuaaucacca

SEQ ID NO: 25928 - RNA, 19 nt, artificial
  Oligomer
aauuggaccugcaauuuca

SEQ ID NO: 25929 - RNA, 19 nt, artificial
  Oligomer
accucaaauuccuaauaag

SEQ ID NO: 25930 - RNA, 19 nt, artificial
  Oligomer
cauucugucauuaguugga

SEQ ID NO: 25931 - RNA, 19 nt, artificial
  Oligomer
agaugaggaagucaaagca

SEQ ID NO: 25932 - RNA, 19 nt, artificial
  Oligomer
cauuuuauauccacaucuu

SEQ ID NO: 25933 - RNA, 19 nt, artificial
  Oligomer
gaugaugucaccaaagaua

SEQ ID NO: 25934 - RNA, 19 nt, artificial
  Oligomer
guuuauuuuguuacacuaa

SEQ ID NO: 25935 - RNA, 19 nt, artificial
  Oligomer
cuuuuugacaugaacagaa

SEQ ID NO: 25936 - RNA, 19 nt, artificial
  Oligomer
aaugagaaaagaaagagaa

SEQ ID NO: 25937 - RNA, 19 nt, artificial
  Oligomer
uuagcucuguucuuuauaa

SEQ ID NO: 25938 - RNA, 19 nt, artificial
  Oligomer
cuaucugccuuuaccuaca

SEQ ID NO: 25939 - RNA, 19 nt, artificial
  Oligomer
cuaauaaguuugaucaaau

SEQ ID NO: 25940 - RNA, 19 nt, artificial
  Oligomer
uuaucaaaaucccuauuua

SEQ ID NO: 25941 - RNA, 19 nt, artificial
  Oligomer
cucucaucagaaaugucau

SEQ ID NO: 25942 - RNA, 19 nt, artificial
  Oligomer
aaucuuucagcacucagaa

SEQ ID NO: 25943 - RNA, 19 nt, artificial
  Oligomer
guaagacuguaauuaagua

SEQ ID NO: 25944 - RNA, 19 nt, artificial
  Oligomer
aagagauuucaacauauca

SEQ ID NO: 25945 - RNA, 19 nt, artificial
  Oligomer
uuuuugacaugaacagaaa

SEQ ID NO: 25946 - RNA, 19 nt, artificial
  Oligomer
aagcaucgagugagcagaa

SEQ ID NO: 25947 - RNA, 19 nt, artificial
  Oligomer
caaacaaucaugagucaga

SEQ ID NO: 25948 - RNA, 19 nt, artificial
  Oligomer
cucaaacaaucaugaguca

SEQ ID NO: 25949 - RNA, 19 nt, artificial
  Oligomer
aagcaaaacaaagcuugaa

SEQ ID NO: 25950 - RNA, 19 nt, artificial
  Oligomer
aaauugggaccaucucaua

SEQ ID NO: 25951 - RNA, 19 nt, artificial
  Oligomer
cagaugaacugcccacaau

SEQ ID NO: 25952 - RNA, 19 nt, artificial
  Oligomer
caaugaacccaaaaccaac

SEQ ID NO: 25953 - RNA, 19 nt, artificial
  Oligomer
gcagggugcuaacguaucu

SEQ ID NO: 25954 - RNA, 19 nt, artificial
  Oligomer
acagaugaacugcccacaa

SEQ ID NO: 25955 - RNA, 19 nt, artificial
  Oligomer
gauuuaacacuaaaaaggu

SEQ ID NO: 25956 - RNA, 19 nt, artificial
  Oligomer
agaaaagaaaaccauuuua

SEQ ID NO: 25957 - RNA, 19 nt, artificial
  Oligomer
cuccuccugcaaugcauaa

SEQ ID NO: 25958 - RNA, 19 nt, artificial
  Oligomer
uaugugcucucaucagaaa

SEQ ID NO: 25959 - RNA, 19 nt, artificial
  Oligomer
aggcuaguuuauuuuguua

SEQ ID NO: 25960 - RNA, 19 nt, artificial
  Oligomer
ucucaaaauaaguugaaaa

SEQ ID NO: 25961 - RNA, 19 nt, artificial
  Oligomer
guauaucggugaaauugcu

SEQ ID NO: 25962 - RNA, 19 nt, artificial
  Oligomer
ucugaauuauuaugucuca

SEQ ID NO: 25963 - RNA, 19 nt, artificial
  Oligomer
cuauguauaucggugaaau

SEQ ID NO: 25964 - RNA, 19 nt, artificial
  Oligomer
gacguucucucuuucuaau

SEQ ID NO: 25965 - RNA, 19 nt, artificial
  Oligomer
aguuccauguuaaaauaga

SEQ ID NO: 25966 - RNA, 19 nt, artificial
  Oligomer
agggaaccgucuguuuuua

SEQ ID NO: 25967 - RNA, 19 nt, artificial
  Oligomer
ugaucaaugcaccucaaca

SEQ ID NO: 25968 - RNA, 19 nt, artificial
  Oligomer
uccuauguauaucggugaa

SEQ ID NO: 25969 - RNA, 19 nt, artificial
  Oligomer
caauagcugcauucagcaa

SEQ ID NO: 25970 - RNA, 19 nt, artificial
  Oligomer
ucaaugaacccaaaaccaa

SEQ ID NO: 25971 - RNA, 19 nt, artificial
  Oligomer
cauacacucaaacaaucau

SEQ ID NO: 25972 - RNA, 19 nt, artificial
  Oligomer
ugaggaugcaacaaauauu

SEQ ID NO: 25973 - RNA, 19 nt, artificial
  Oligomer
caaagauauuaaugaaaug

SEQ ID NO: 25974 - RNA, 19 nt, artificial
  Oligomer
cuguaaacaugguuuucac

SEQ ID NO: 25975 - RNA, 19 nt, artificial
  Oligomer
gaacagaaacaauaaggga

SEQ ID NO: 25976 - RNA, 19 nt, artificial
  Oligomer
uaaaaaaugucuauagaga

SEQ ID NO: 25977 - RNA, 19 nt, artificial
  Oligomer
ccuaguggaacaaagguau

SEQ ID NO: 25978 - RNA, 19 nt, artificial
  Oligomer
gaaccgucuguuuuuaaau

SEQ ID NO: 25979 - RNA, 19 nt, artificial
  Oligomer
gaaagucucuauaauucag

SEQ ID NO: 25980 - RNA, 19 nt, artificial
  Oligomer
aguuuauuuuguuacacua

SEQ ID NO: 25981 - RNA, 19 nt, artificial
  Oligomer
ucacauauauguaauuuag

SEQ ID NO: 25982 - RNA, 19 nt, artificial
  Oligomer
cauuuucuuuccuagugga

SEQ ID NO: 25983 - RNA, 19 nt, artificial
  Oligomer
gcaaagcacuuauugauua

SEQ ID NO: 25984 - RNA, 19 nt, artificial
  Oligomer
ggcagcugcucaacuaauc

SEQ ID NO: 25985 - RNA, 19 nt, artificial
  Oligomer
guuccuaacauaaaauaau

SEQ ID NO: 25986 - RNA, 19 nt, artificial
  Oligomer
ggcagagcugcgaauaaac

SEQ ID NO: 25987 - RNA, 19 nt, artificial
  Oligomer
gguacaauccuuugaguua

SEQ ID NO: 25988 - RNA, 19 nt, artificial
  Oligomer
ccuuuaccuacauaggcaa

SEQ ID NO: 25989 - RNA, 19 nt, artificial
  Oligomer
aaguuugaucaaaucuaau

SEQ ID NO: 25990 - RNA, 19 nt, artificial
  Oligomer
accaaagauauuaaugaaa

SEQ ID NO: 25991 - RNA, 19 nt, artificial
  Oligomer
guuguucacauauauguaa

SEQ ID NO: 25992 - RNA, 19 nt, artificial
  Oligomer
ucacauacacucaaacaau

SEQ ID NO: 25993 - RNA, 19 nt, artificial
  Oligomer
ggaauugacaggacuccca

SEQ ID NO: 25994 - RNA, 19 nt, artificial
  Oligomer
gacucagaggauaugauga

SEQ ID NO: 25995 - RNA, 19 nt, artificial
  Oligomer
ccuauuuaauuuuccugga

SEQ ID NO: 25996 - RNA, 19 nt, artificial
  Oligomer
aggugguucuaauauuuuu

SEQ ID NO: 25997 - RNA, 19 nt, artificial
  Oligomer
gacaacucuuccauuuauu

SEQ ID NO: 25998 - RNA, 19 nt, artificial
  Oligomer
gcuuacagucaauuuuaca

SEQ ID NO: 25999 - RNA, 19 nt, artificial
  Oligomer
ucauaaauguucagcuuca

SEQ ID NO: 26000 - RNA, 19 nt, artificial
  Oligomer
aauuaaaaaccacugaaca

SEQ ID NO: 26001 - RNA, 19 nt, artificial
  Oligomer
ucuuuaagagugaaauaau

SEQ ID NO: 26002 - RNA, 19 nt, artificial
  Oligomer
gaaaauuugaaguaaagga

SEQ ID NO: 26003 - RNA, 19 nt, artificial
  Oligomer
uuuauauccacaucuuuaa

SEQ ID NO: 26004 - RNA, 19 nt, artificial
  Oligomer
gaagcauaucaggacuaua

SEQ ID NO: 26005 - RNA, 19 nt, artificial
  Oligomer
gcaauagcugcauucagca

SEQ ID NO: 26006 - RNA, 19 nt, artificial
  Oligomer
aacagguaauaauaucuca

SEQ ID NO: 26007 - RNA, 19 nt, artificial
  Oligomer
aaaugagaaaagaaagaga

SEQ ID NO: 26008 - RNA, 19 nt, artificial
  Oligomer
ucagacauuugguauauua

SEQ ID NO: 26009 - RNA, 19 nt, artificial
  Oligomer
cauuuuaguuccuuuauuu

SEQ ID NO: 26010 - RNA, 19 nt, artificial
  Oligomer
gggacuugugcugcugaau

SEQ ID NO: 26011 - RNA, 19 nt, artificial
  Oligomer
caccaacuggagcacugau

SEQ ID NO: 26012 - RNA, 19 nt, artificial
  Oligomer
agcaaaccuguuuaugcaa

SEQ ID NO: 26013 - RNA, 19 nt, artificial
  Oligomer
cccaacuaguacaaugaca

SEQ ID NO: 26014 - RNA, 19 nt, artificial
  Oligomer
cucaaugaacccaaaacca

SEQ ID NO: 26015 - RNA, 19 nt, artificial
  Oligomer
cagcucuucaccaauucca

SEQ ID NO: 26016 - RNA, 19 nt, artificial
  Oligomer
acucuuuaagagugaaaua

SEQ ID NO: 26017 - RNA, 19 nt, artificial
  Oligomer
cugcucaacuaaucaccau

SEQ ID NO: 26018 - RNA, 19 nt, artificial
  Oligomer
cauuugguauauuaccuca

SEQ ID NO: 26019 - RNA, 19 nt, artificial
  Oligomer
gcugaggcaaagcacuuau

SEQ ID NO: 26020 - RNA, 19 nt, artificial
  Oligomer
ggaauuuucuuacccauau

SEQ ID NO: 26021 - RNA, 19 nt, artificial
  Oligomer
cugcuuuuugacaugaaca

SEQ ID NO: 26022 - RNA, 19 nt, artificial
  Oligomer
caauuauggaaauauaguu

SEQ ID NO: 26023 - RNA, 19 nt, artificial
  Oligomer
gaagauaaggucacuggga

SEQ ID NO: 26024 - RNA, 19 nt, artificial
  Oligomer
cgaaaagcuaucaacaacu

SEQ ID NO: 26025 - RNA, 19 nt, artificial
  Oligomer
uguaauuuagcaguccaaa

SEQ ID NO: 26026 - RNA, 19 nt, artificial
  Oligomer
ugagcauuuuauauccaca

SEQ ID NO: 26027 - RNA, 19 nt, artificial
  Oligomer
ucaacaacuauguuaucaa

SEQ ID NO: 26028 - RNA, 19 nt, artificial
  Oligomer
gugugaucaaugcaccuca

SEQ ID NO: 26029 - RNA, 19 nt, artificial
  Oligomer
agcacuuauugauuagauu

SEQ ID NO: 26030 - RNA, 19 nt, artificial
  Oligomer
ccaaaggaaagucuuuuga

SEQ ID NO: 26031 - RNA, 19 nt, artificial
  Oligomer
gaugggucccaaaagcuua

SEQ ID NO: 26032 - RNA, 19 nt, artificial
  Oligomer
aaaagaaaaccauuuuagu

SEQ ID NO: 26033 - RNA, 19 nt, artificial
  Oligomer
cuaucaacaacuauguuau

SEQ ID NO: 26034 - RNA, 19 nt, artificial
  Oligomer
aggaagucaaagcaaaaca

SEQ ID NO: 26035 - RNA, 19 nt, artificial
  Oligomer
cacaagaccuggaauugac

SEQ ID NO: 26036 - RNA, 19 nt, artificial
  Oligomer
acuggaugaccgaaaagcu

SEQ ID NO: 26037 - RNA, 19 nt, artificial
  Oligomer
ccuaggagcuacagagacu

SEQ ID NO: 26038 - RNA, 19 nt, artificial
  Oligomer
gaauggauuauagaguaua

SEQ ID NO: 26039 - RNA, 19 nt, artificial
  Oligomer
ugcuuugcuuuuuaauuga

SEQ ID NO: 26040 - RNA, 19 nt, artificial
  Oligomer
agcuucagacuuuuaucaa

SEQ ID NO: 26041 - RNA, 19 nt, artificial
  Oligomer
cuucuuauguuugcuuuaa

SEQ ID NO: 26042 - RNA, 19 nt, artificial
  Oligomer
uugguaggcuuaucaaaau

SEQ ID NO: 26043 - RNA, 19 nt, artificial
  Oligomer
acaucaaguuagaugagga

SEQ ID NO: 26044 - RNA, 19 nt, artificial
  Oligomer
cacucagaaaagaaaacca

SEQ ID NO: 26045 - RNA, 19 nt, artificial
  Oligomer
cuuuuguucuguauuuuca

SEQ ID NO: 26046 - RNA, 19 nt, artificial
  Oligomer
uaguuugcuuugcuuuuua

SEQ ID NO: 26047 - RNA, 19 nt, artificial
  Oligomer
agcuguauacagauucuag

SEQ ID NO: 26048 - RNA, 19 nt, artificial
  Oligomer
cucuguucuuuauaacaag

SEQ ID NO: 26049 - RNA, 19 nt, artificial
  Oligomer
ucagcaauuggaccugcaa

SEQ ID NO: 26050 - RNA, 19 nt, artificial
  Oligomer
uggauuauagaguauacua

SEQ ID NO: 26051 - RNA, 19 nt, artificial
  Oligomer
aaugguuuuugcaagauuu

SEQ ID NO: 26052 - RNA, 19 nt, artificial
  Oligomer
uguugauucccuucuggua

SEQ ID NO: 26053 - RNA, 19 nt, artificial
  Oligomer
agauucccaucaauauuca

SEQ ID NO: 26054 - RNA, 19 nt, artificial
  Oligomer
agcucuguucuuuauaaca

SEQ ID NO: 26055 - RNA, 19 nt, artificial
  Oligomer
cuuacagucaauuuuacaa

SEQ ID NO: 26056 - RNA, 19 nt, artificial
  Oligomer
ugaaaugagaaaagaaaga

SEQ ID NO: 26057 - RNA, 19 nt, artificial
  Oligomer
gcauaacuaggccuaggca

SEQ ID NO: 26058 - RNA, 19 nt, artificial
  Oligomer
ccugcuuuuugacaugaac

SEQ ID NO: 26059 - RNA, 19 nt, artificial
  Oligomer
caccucaacagguaauaau

SEQ ID NO: 26060 - RNA, 19 nt, artificial
  Oligomer
gguuuuugcaagauuuaac

SEQ ID NO: 26061 - RNA, 19 nt, artificial
  Oligomer
acauuugcuuuguuuucua

SEQ ID NO: 26062 - RNA, 19 nt, artificial
  Oligomer
agccugguuuucacauaca

SEQ ID NO: 26063 - RNA, 19 nt, artificial
  Oligomer
cauuuuuuaaaguuccaga

SEQ ID NO: 26064 - RNA, 19 nt, artificial
  Oligomer
ugaauuauuaugucucaaa

SEQ ID NO: 26065 - RNA, 19 nt, artificial
  Oligomer
uaccucaaauuccuaauaa

SEQ ID NO: 26066 - RNA, 19 nt, artificial
  Oligomer
gauuauuggucuugaauuu

SEQ ID NO: 26067 - RNA, 19 nt, artificial
  Oligomer
agcaguccaaagaacaaga

SEQ ID NO: 26068 - RNA, 19 nt, artificial
  Oligomer
cuucuuugucuuagcugua

SEQ ID NO: 26069 - RNA, 19 nt, artificial
  Oligomer
aggaugcaacaaauauuua

SEQ ID NO: 26070 - RNA, 19 nt, artificial
  Oligomer
aauugaagagauuucaaca

SEQ ID NO: 26071 - RNA, 19 nt, artificial
  Oligomer
gauuccuugagcauuuuau

SEQ ID NO: 26072 - RNA, 19 nt, artificial
  Oligomer
auaauuaaaaaccacugaa

SEQ ID NO: 26073 - RNA, 19 nt, artificial
  Oligomer
gcugccgcugagaagauua

SEQ ID NO: 26074 - RNA, 19 nt, artificial
  Oligomer
cagcuuugcaguuggugga

SEQ ID NO: 26075 - RNA, 19 nt, artificial
  Oligomer
gauuagacuuggacucuca

SEQ ID NO: 26076 - RNA, 19 nt, artificial
  Oligomer
ugguaagacuguaauuaag

SEQ ID NO: 26077 - RNA, 19 nt, artificial
  Oligomer
ugaguuaugugagcaugau

SEQ ID NO: 26078 - RNA, 19 nt, artificial
  Oligomer
cugaggaugcaacaaauau

SEQ ID NO: 26079 - RNA, 19 nt, artificial
  Oligomer
ccugguuuucacauacacu

SEQ ID NO: 26080 - RNA, 19 nt, artificial
  Oligomer
gggcaggugguucuaauau

SEQ ID NO: 26081 - RNA, 19 nt, artificial
  Oligomer
ugaugucaccaaagauauu

SEQ ID NO: 26082 - RNA, 19 nt, artificial
  Oligomer
caaaagcugcuguagaaau

SEQ ID NO: 26083 - RNA, 19 nt, artificial
  Oligomer
gguuuucacugucaucacu

SEQ ID NO: 26084 - RNA, 19 nt, artificial
  Oligomer
cacagaugauuaaacagac

SEQ ID NO: 26085 - RNA, 19 nt, artificial
  Oligomer
guuugcuuugcuuuuuaau

SEQ ID NO: 26086 - RNA, 19 nt, artificial
  Oligomer
ugcagaauuccaaaagaag

SEQ ID NO: 26087 - RNA, 19 nt, artificial
  Oligomer
uggguguuccacuggauga

SEQ ID NO: 26088 - RNA, 19 nt, artificial
  Oligomer
ugaaguaaaggauugauca

SEQ ID NO: 26089 - RNA, 19 nt, artificial
  Oligomer
cauauagcguggguuauca

SEQ ID NO: 26090 - RNA, 19 nt, artificial
  Oligomer
aaggauugaucacuuuguu

SEQ ID NO: 26091 - RNA, 19 nt, artificial
  Oligomer
aauuuaucuugggcaauua

SEQ ID NO: 26092 - RNA, 19 nt, artificial
  Oligomer
gaaaagacucagaggauau

SEQ ID NO: 26093 - RNA, 19 nt, artificial
  Oligomer
gcuguuuucuccaccaacu

SEQ ID NO: 26094 - RNA, 19 nt, artificial
  Oligomer
caaaauaaguugaaaaggu

SEQ ID NO: 26095 - RNA, 19 nt, artificial
  Oligomer
uucugcagcaauuuccuca

SEQ ID NO: 26096 - RNA, 19 nt, artificial
  Oligomer
uuaaaaaaugugaacaggg

SEQ ID NO: 26097 - RNA, 19 nt, artificial
  Oligomer
uucauuaauaucuuuggug

SEQ ID NO: 26098 - RNA, 19 nt, artificial
  Oligomer
uuuuuaguguuaaaucuug

SEQ ID NO: 26099 - RNA, 19 nt, artificial
  Oligomer
uuguuuugcuuugacuucc

SEQ ID NO: 26100 - RNA, 19 nt, artificial
  Oligomer
uucuuuuggaauucugcag

SEQ ID NO: 26101 - RNA, 19 nt, artificial
  Oligomer
uuuuaguguuaaaucuugc

SEQ ID NO: 26102 - RNA, 19 nt, artificial
  Oligomer
uuagaaagagagaacgucg

SEQ ID NO: 26103 - RNA, 19 nt, artificial
  Oligomer
uuuaacauggaacuuauug

SEQ ID NO: 26104 - RNA, 19 nt, artificial
  Oligomer
uuaauguuaacugauaacc

SEQ ID NO: 26105 - RNA, 19 nt, artificial
  Oligomer
uuaaaaagugcuuuucuuc

SEQ ID NO: 26106 - RNA, 19 nt, artificial
  Oligomer
uuuaacauaagauauaugg

SEQ ID NO: 26107 - RNA, 19 nt, artificial
  Oligomer
uuugacuuccucaucuaac

SEQ ID NO: 26108 - RNA, 19 nt, artificial
  Oligomer
uguuaacugauaacccacg

SEQ ID NO: 26109 - RNA, 19 nt, artificial
  Oligomer
ugcauaaacagguuugcug

SEQ ID NO: 26110 - RNA, 19 nt, artificial
  Oligomer
uuuugagacauaauaauuc

SEQ ID NO: 26111 - RNA, 19 nt, artificial
  Oligomer
uuugauaaaagucugaagc

SEQ ID NO: 26112 - RNA, 19 nt, artificial
  Oligomer
uugauguaaagguaucugg

SEQ ID NO: 26113 - RNA, 19 nt, artificial
  Oligomer
auaagguccacagaagucc

SEQ ID NO: 26114 - RNA, 19 nt, artificial
  Oligomer
ugacuaauaagaaugcccg

SEQ ID NO: 26115 - RNA, 19 nt, artificial
  Oligomer
uuuuucucuauagacauuu

SEQ ID NO: 26116 - RNA, 19 nt, artificial
  Oligomer
uuuaacaaagugaucaauc

SEQ ID NO: 26117 - RNA, 19 nt, artificial
  Oligomer
uuuugcuuugacuuccuca

SEQ ID NO: 26118 - RNA, 19 nt, artificial
  Oligomer
uuugaugacauuucugaug

SEQ ID NO: 26119 - RNA, 19 nt, artificial
  Oligomer
uuauaaguauaugagaugg

SEQ ID NO: 26120 - RNA, 19 nt, artificial
  Oligomer
uugaguaugagauuguggg

SEQ ID NO: 26121 - RNA, 19 nt, artificial
  Oligomer
uuauucagcagcacaaguc

SEQ ID NO: 26122 - RNA, 19 nt, artificial
  Oligomer
ucuucuuuuggaauucugc

SEQ ID NO: 26123 - RNA, 19 nt, artificial
  Oligomer
uaaguauaugagauggucc

SEQ ID NO: 26124 - RNA, 19 nt, artificial
  Oligomer
uuuaguauacucuauaauc

SEQ ID NO: 26125 - RNA, 19 nt, artificial
  Oligomer
uuuaaaaacagacgguucc

SEQ ID NO: 26126 - RNA, 19 nt, artificial
  Oligomer
ucuuuuggaauucugcagc

SEQ ID NO: 26127 - RNA, 19 nt, artificial
  Oligomer
uucagaagcccacacucag

SEQ ID NO: 26128 - RNA, 19 nt, artificial
  Oligomer
uuaacauggaacuuauugc

SEQ ID NO: 26129 - RNA, 19 nt, artificial
  Oligomer
uagauguuaauguuaacug

SEQ ID NO: 26130 - RNA, 19 nt, artificial
  Oligomer
uuauagagacuuucugcuc

SEQ ID NO: 26131 - RNA, 19 nt, artificial
  Oligomer
uuuggguucauugaguaug

SEQ ID NO: 26132 - RNA, 19 nt, artificial
  Oligomer
uuauuguuucuguucaugu

SEQ ID NO: 26133 - RNA, 19 nt, artificial
  Oligomer
uugaguaguaaaaaaugcc

SEQ ID NO: 26134 - RNA, 19 nt, artificial
  Oligomer
auguuugcuacuaacaugg

SEQ ID NO: 26135 - RNA, 19 nt, artificial
  Oligomer
uuuguuuugcuuugacuuc

SEQ ID NO: 26136 - RNA, 19 nt, artificial
  Oligomer
uuaucuucugucauuguac

SEQ ID NO: 26137 - RNA, 19 nt, artificial
  Oligomer
uuccaauuuaaugauauuc

SEQ ID NO: 26138 - RNA, 19 nt, artificial
  Oligomer
uuaguauacucuauaaucc

SEQ ID NO: 26139 - RNA, 19 nt, artificial
  Oligomer
auaauuguaaaauugacug

SEQ ID NO: 26140 - RNA, 19 nt, artificial
  Oligomer
uucaugucaaaaagcaggg

SEQ ID NO: 26141 - RNA, 19 nt, artificial
  Oligomer
uucaauaccuuuguuccac

SEQ ID NO: 26142 - RNA, 19 nt, artificial
  Oligomer
uagcuuuucggucauccag

SEQ ID NO: 26143 - RNA, 19 nt, artificial
  Oligomer
ucucauuucauuaauaucu

SEQ ID NO: 26144 - RNA, 19 nt, artificial
  Oligomer
uuucauuucuacagcagcu

SEQ ID NO: 26145 - RNA, 19 nt, artificial
  Oligomer
ucaauaagugcuuugccuc

SEQ ID NO: 26146 - RNA, 19 nt, artificial
  Oligomer
uugaucagugcuccaguug

SEQ ID NO: 26147 - RNA, 19 nt, artificial
  Oligomer
uuagauuugaucaaacuua

SEQ ID NO: 26148 - RNA, 19 nt, artificial
  Oligomer
uucuccacaaggaauacag

SEQ ID NO: 26149 - RNA, 19 nt, artificial
  Oligomer
uucuucucuuucuuuucuc

SEQ ID NO: 26150 - RNA, 19 nt, artificial
  Oligomer
uuugauucuuccaagugug

SEQ ID NO: 26151 - RNA, 19 nt, artificial
  Oligomer
uuuauucgcagcucugccu

SEQ ID NO: 26152 - RNA, 19 nt, artificial
  Oligomer
ugauuaguugagcagcugc

SEQ ID NO: 26153 - RNA, 19 nt, artificial
  Oligomer
uugcuaaagcagcaggacg

SEQ ID NO: 26154 - RNA, 19 nt, artificial
  Oligomer
uugaggugcauugaucaca

SEQ ID NO: 26155 - RNA, 19 nt, artificial
  Oligomer
uuaagcaaaauacaaauuc

SEQ ID NO: 26156 - RNA, 19 nt, artificial
  Oligomer
uuuaguguuaaaucuugca

SEQ ID NO: 26157 - RNA, 19 nt, artificial
  Oligomer
uaauguuaacugauaaccc

SEQ ID NO: 26158 - RNA, 19 nt, artificial
  Oligomer
uuuaugaaguuucagaagc

SEQ ID NO: 26159 - RNA, 19 nt, artificial
  Oligomer
ugaaagauuuugauaagcc

SEQ ID NO: 26160 - RNA, 19 nt, artificial
  Oligomer
uuccauaauuguaaaauug

SEQ ID NO: 26161 - RNA, 19 nt, artificial
  Oligomer
auuauaaguauaugagaug

SEQ ID NO: 26162 - RNA, 19 nt, artificial
  Oligomer
ucuuacauuagauuugauc

SEQ ID NO: 26163 - RNA, 19 nt, artificial
  Oligomer
uccaauuugccuauguagg

SEQ ID NO: 26164 - RNA, 19 nt, artificial
  Oligomer
uauaugaucaggugaaacc

SEQ ID NO: 26165 - RNA, 19 nt, artificial
  Oligomer
uuuuugguaauauuugaug

SEQ ID NO: 26166 - RNA, 19 nt, artificial
  Oligomer
uaucaugcucacauaacuc

SEQ ID NO: 26167 - RNA, 19 nt, artificial
  Oligomer
uuuucggucauccagugga

SEQ ID NO: 26168 - RNA, 19 nt, artificial
  Oligomer
uugacuguaagcuaaaguc

SEQ ID NO: 26169 - RNA, 19 nt, artificial
  Oligomer
uuccacaugaaaauacaga

SEQ ID NO: 26170 - RNA, 19 nt, artificial
  Oligomer
uuuucuuuucugagugcug

SEQ ID NO: 26171 - RNA, 19 nt, artificial
  Oligomer
uaagguccacagaaguccg

SEQ ID NO: 26172 - RNA, 19 nt, artificial
  Oligomer
uucauuucuacagcagcuu

SEQ ID NO: 26173 - RNA, 19 nt, artificial
  Oligomer
uucuuuucucauuucauua

SEQ ID NO: 26174 - RNA, 19 nt, artificial
  Oligomer
ugguuuuuaauuauuucac

SEQ ID NO: 26175 - RNA, 19 nt, artificial
  Oligomer
uuuucaagcuuuguuuugc

SEQ ID NO: 26176 - RNA, 19 nt, artificial
  Oligomer
uuaguguuaaaucuugcaa

SEQ ID NO: 26177 - RNA, 19 nt, artificial
  Oligomer
auugauuccggaaaauugc

SEQ ID NO: 26178 - RNA, 19 nt, artificial
  Oligomer
uuuucuuacauuagauuug

SEQ ID NO: 26179 - RNA, 19 nt, artificial
  Oligomer
uauuugaugacauuucuga

SEQ ID NO: 26180 - RNA, 19 nt, artificial
  Oligomer
uguugauagcuuuucgguc

SEQ ID NO: 26181 - RNA, 19 nt, artificial
  Oligomer
uucagcagcacaaguccca

SEQ ID NO: 26182 - RNA, 19 nt, artificial
  Oligomer
uucaagaccaauaaucuga

SEQ ID NO: 26183 - RNA, 19 nt, artificial
  Oligomer
aauuauagagacuuucugc

SEQ ID NO: 26184 - RNA, 19 nt, artificial
  Oligomer
uuugcugauaccagccguc

SEQ ID NO: 26185 - RNA, 19 nt, artificial
  Oligomer
uuuuaaaaagugcuuuucu

SEQ ID NO: 26186 - RNA, 19 nt, artificial
  Oligomer
uuaggcauaaguuacaaac

SEQ ID NO: 26187 - RNA, 19 nt, artificial
  Oligomer
uuaaauagggauuuugaua

SEQ ID NO: 26188 - RNA, 19 nt, artificial
  Oligomer
uuuaaaaaaugugaacagg

SEQ ID NO: 26189 - RNA, 19 nt, artificial
  Oligomer
auuauagagacuuucugcu

SEQ ID NO: 26190 - RNA, 19 nt, artificial
  Oligomer
uagagauacguuagcaccc

SEQ ID NO: 26191 - RNA, 19 nt, artificial
  Oligomer
uuccaauuugccuauguag

SEQ ID NO: 26192 - RNA, 19 nt, artificial
  Oligomer
uuguuauaaagaacagagc

SEQ ID NO: 26193 - RNA, 19 nt, artificial
  Oligomer
uuaaaaacagacgguuccc

SEQ ID NO: 26194 - RNA, 19 nt, artificial
  Oligomer
uuuuagaagaaccuuguua

SEQ ID NO: 26195 - RNA, 19 nt, artificial
  Oligomer
uuaaaucuugcaaaaacca

SEQ ID NO: 26196 - RNA, 19 nt, artificial
  Oligomer
uuuugguuuacuuaauuac

SEQ ID NO: 26197 - RNA, 19 nt, artificial
  Oligomer
uugacugaaaaacucagcc

SEQ ID NO: 26198 - RNA, 19 nt, artificial
  Oligomer
uguauuuccaauuugccua

SEQ ID NO: 26199 - RNA, 19 nt, artificial
  Oligomer
auuuguugcauccucaggu

SEQ ID NO: 26200 - RNA, 19 nt, artificial
  Oligomer
uuguugauagcuuuucggu

SEQ ID NO: 26201 - RNA, 19 nt, artificial
  Oligomer
uuccucaucuaacuugaug

SEQ ID NO: 26202 - RNA, 19 nt, artificial
  Oligomer
uuccucaaaagacuuuccu

SEQ ID NO: 26203 - RNA, 19 nt, artificial
  Oligomer
uucucuauagacauuuuuu

SEQ ID NO: 26204 - RNA, 19 nt, artificial
  Oligomer
aauuauuucacucuuaaag

SEQ ID NO: 26205 - RNA, 19 nt, artificial
  Oligomer
auaagaaugcccgugacga

SEQ ID NO: 26206 - RNA, 19 nt, artificial
  Oligomer
uuaaaaagcaaagcaaacu

SEQ ID NO: 26207 - RNA, 19 nt, artificial
  Oligomer
uuuuuaaaaagugcuuuuc

SEQ ID NO: 26208 - RNA, 19 nt, artificial
  Oligomer
aagaaugcccgugacgaug

SEQ ID NO: 26209 - RNA, 19 nt, artificial
  Oligomer
auagauaguguacaaugcg

SEQ ID NO: 26210 - RNA, 19 nt, artificial
  Oligomer
uucauugaguaugagauug

SEQ ID NO: 26211 - RNA, 19 nt, artificial
  Oligomer
uuuggugacaucaucauau

SEQ ID NO: 26212 - RNA, 19 nt, artificial
  Oligomer
auguuaacugauaacccac

SEQ ID NO: 26213 - RNA, 19 nt, artificial
  Oligomer
uucaauuuuagaagaaccu

SEQ ID NO: 26214 - RNA, 19 nt, artificial
  Oligomer
uauuagaaccaccugcccu

SEQ ID NO: 26215 - RNA, 19 nt, artificial
  Oligomer
uuucuuuucucauuucauu

SEQ ID NO: 26216 - RNA, 19 nt, artificial
  Oligomer
uaugcauugcaggaggagg

SEQ ID NO: 26217 - RNA, 19 nt, artificial
  Oligomer
uucaucuguacuguugaua

SEQ ID NO: 26218 - RNA, 19 nt, artificial
  Oligomer
uaagaaggauugaucagug

SEQ ID NO: 26219 - RNA, 19 nt, artificial
  Oligomer
uccaauugcugaaugcagc

SEQ ID NO: 26220 - RNA, 19 nt, artificial
  Oligomer
uugggaguccugucaauuc

SEQ ID NO: 26221 - RNA, 19 nt, artificial
  Oligomer
uauuuguugcauccucagg

SEQ ID NO: 26222 - RNA, 19 nt, artificial
  Oligomer
ucuguauacagcuaagaca

SEQ ID NO: 26223 - RNA, 19 nt, artificial
  Oligomer
uuagcccacaauauagucc

SEQ ID NO: 26224 - RNA, 19 nt, artificial
  Oligomer
uaauauuugaugacauuuc

SEQ ID NO: 26225 - RNA, 19 nt, artificial
  Oligomer
ucuauaauccauuccacau

SEQ ID NO: 26226 - RNA, 19 nt, artificial
  Oligomer
uaaaaauauuagaaccacc

SEQ ID NO: 26227 - RNA, 19 nt, artificial
  Oligomer
uuuugauaaaagucugaag

SEQ ID NO: 26228 - RNA, 19 nt, artificial
  Oligomer
uuucucuauagacauuuuu

SEQ ID NO: 26229 - RNA, 19 nt, artificial
  Oligomer
ucugucauuguacuaguug

SEQ ID NO: 26230 - RNA, 19 nt, artificial
  Oligomer
uauuauuaccuguugaggu

SEQ ID NO: 26231 - RNA, 19 nt, artificial
  Oligomer
uuucaacuuauuuugagac

SEQ ID NO: 26232 - RNA, 19 nt, artificial
  Oligomer
uuuaaaaagugcuuuucuu

SEQ ID NO: 26233 - RNA, 19 nt, artificial
  Oligomer
auuuuuaacaaagugauca

SEQ ID NO: 26234 - RNA, 19 nt, artificial
  Oligomer
auuucauuucuacagcagc

SEQ ID NO: 26235 - RNA, 19 nt, artificial
  Oligomer
ucuaacuugauguaaaggu

SEQ ID NO: 26236 - RNA, 19 nt, artificial
  Oligomer
uaacauggaacuuauugcc

SEQ ID NO: 26237 - RNA, 19 nt, artificial
  Oligomer
ugaaguuucagaagcccac

SEQ ID NO: 26238 - RNA, 19 nt, artificial
  Oligomer
uugaguguaugugaaaacc

SEQ ID NO: 26239 - RNA, 19 nt, artificial
  Oligomer
aucauuuaaaaacagacgg

SEQ ID NO: 26240 - RNA, 19 nt, artificial
  Oligomer
uccaauuuaaugauauuca

SEQ ID NO: 26241 - RNA, 19 nt, artificial
  Oligomer
uugcuuugacuuccucauc

SEQ ID NO: 26242 - RNA, 19 nt, artificial
  Oligomer
uugguuuacuuaauuacag

SEQ ID NO: 26243 - RNA, 19 nt, artificial
  Oligomer
uacucuauaauccauucca

SEQ ID NO: 26244 - RNA, 19 nt, artificial
  Oligomer
ugcauccucagguuucuag

SEQ ID NO: 26245 - RNA, 19 nt, artificial
  Oligomer
augcucacauaacucaucc

SEQ ID NO: 26246 - RNA, 19 nt, artificial
  Oligomer
uaguuaugcauugcaggag

SEQ ID NO: 26247 - RNA, 19 nt, artificial
  Oligomer
auauuugaugacauuucug

SEQ ID NO: 26248 - RNA, 19 nt, artificial
  Oligomer
uauauggguaagaaaauuc

SEQ ID NO: 26249 - RNA, 19 nt, artificial
  Oligomer
ugaacauuuaugaaguuuc

SEQ ID NO: 26250 - RNA, 19 nt, artificial
  Oligomer
uuucuacagcagcuuuugg

SEQ ID NO: 26251 - RNA, 19 nt, artificial
  Oligomer
uauucagcagcacaagucc

SEQ ID NO: 26252 - RNA, 19 nt, artificial
  Oligomer
uauagagacuuucugcuca

SEQ ID NO: 26253 - RNA, 19 nt, artificial
  Oligomer
uauaaaaugcucaaggaau

SEQ ID NO: 26254 - RNA, 19 nt, artificial
  Oligomer
auuagaaccaccugcccuu

SEQ ID NO: 26255 - RNA, 19 nt, artificial
  Oligomer
uuugguuucuggaacuuua

SEQ ID NO: 26256 - RNA, 19 nt, artificial
  Oligomer
uaaaaagugcuuuucuuca

SEQ ID NO: 26257 - RNA, 19 nt, artificial
  Oligomer
uugauuccggaaaauugcu

SEQ ID NO: 26258 - RNA, 19 nt, artificial
  Oligomer
aaguauaugagaugguccc

SEQ ID NO: 26259 - RNA, 19 nt, artificial
  Oligomer
uuauuaccuguugaggugc

SEQ ID NO: 26260 - RNA, 19 nt, artificial
  Oligomer
ucuucugucauuguacuag

SEQ ID NO: 26261 - RNA, 19 nt, artificial
  Oligomer
uuugcuuugacuuccucau

SEQ ID NO: 26262 - RNA, 19 nt, artificial
  Oligomer
uaguuguugauagcuuuuc

SEQ ID NO: 26263 - RNA, 19 nt, artificial
  Oligomer
uuucuuguucuuuggacug

SEQ ID NO: 26264 - RNA, 19 nt, artificial
  Oligomer
aaugauauguugaaaucuc

SEQ ID NO: 26265 - RNA, 19 nt, artificial
  Oligomer
uugagacauaauaauucag

SEQ ID NO: 26266 - RNA, 19 nt, artificial
  Oligomer
uuauucgcagcucugccua

SEQ ID NO: 26267 - RNA, 19 nt, artificial
  Oligomer
uuucuggacagaaaaagag

SEQ ID NO: 26268 - RNA, 19 nt, artificial
  Oligomer
uuucagaagcccacacuca

SEQ ID NO: 26269 - RNA, 19 nt, artificial
  Oligomer
augauauguugaaaucucu

SEQ ID NO: 26270 - RNA, 19 nt, artificial
  Oligomer
ugauguaaagguaucuggg

SEQ ID NO: 26271 - RNA, 19 nt, artificial
  Oligomer
acuaauaagaaugcccgug

SEQ ID NO: 26272 - RNA, 19 nt, artificial
  Oligomer
uauaaauauuuguugcauc

SEQ ID NO: 26273 - RNA, 19 nt, artificial
  Oligomer
uagaauaggcugucgguag

SEQ ID NO: 26274 - RNA, 19 nt, artificial
  Oligomer
uucucauuucauuaauauc

SEQ ID NO: 26275 - RNA, 19 nt, artificial
  Oligomer
uucuuguucuuuggacugc

SEQ ID NO: 26276 - RNA, 19 nt, artificial
  Oligomer
uauaccaaaugucugacuc

SEQ ID NO: 26277 - RNA, 19 nt, artificial
  Oligomer
uggaacuuuaaaaaaugug

SEQ ID NO: 26278 - RNA, 19 nt, artificial
  Oligomer
uuugaucaaacuuauuagg

SEQ ID NO: 26279 - RNA, 19 nt, artificial
  Oligomer
auauuauuaccuguugagg

SEQ ID NO: 26280 - RNA, 19 nt, artificial
  Oligomer
aacaauuucuuguucuuug

SEQ ID NO: 26281 - RNA, 19 nt, artificial
  Oligomer
uuaacugauaacccacgcu

SEQ ID NO: 26282 - RNA, 19 nt, artificial
  Oligomer
ugaauuauagagacuuucu

SEQ ID NO: 26283 - RNA, 19 nt, artificial
  Oligomer
uaccuguugaggugcauug

SEQ ID NO: 26284 - RNA, 19 nt, artificial
  Oligomer
uuacuucaaauuuucuuac

SEQ ID NO: 26285 - RNA, 19 nt, artificial
  Oligomer
auuucauuaauaucuuugg

SEQ ID NO: 26286 - RNA, 19 nt, artificial
  Oligomer
uugaucacaccaaugucau

SEQ ID NO: 26287 - RNA, 19 nt, artificial
  Oligomer
uaguacucaagaaaaaagc

SEQ ID NO: 26288 - RNA, 19 nt, artificial
  Oligomer
ugcuaaauuacauauaugu

SEQ ID NO: 26289 - RNA, 19 nt, artificial
  Oligomer
uuugagguaauauaccaaa

SEQ ID NO: 26290 - RNA, 19 nt, artificial
  Oligomer
auaagaaggauugaucagu

SEQ ID NO: 26291 - RNA, 19 nt, artificial
  Oligomer
uuaacauaagauauauggg

SEQ ID NO: 26292 - RNA, 19 nt, artificial
  Oligomer
uuugccucagcaaccugug

SEQ ID NO: 26293 - RNA, 19 nt, artificial
  Oligomer
acuaaugacagaauguuug

SEQ ID NO: 26294 - RNA, 19 nt, artificial
  Oligomer
uuaauuacagucuuaccau

SEQ ID NO: 26295 - RNA, 19 nt, artificial
  Oligomer
uuuagaagaaccuuguuau

SEQ ID NO: 26296 - RNA, 19 nt, artificial
  Oligomer
uacauauaugugaacaacu

SEQ ID NO: 26297 - RNA, 19 nt, artificial
  Oligomer
auaaauauuuguugcaucc

SEQ ID NO: 26298 - RNA, 19 nt, artificial
  Oligomer
uguuaaaucuugcaaaaac

SEQ ID NO: 26299 - RNA, 19 nt, artificial
  Oligomer
acauuuuuuaguauacucu

SEQ ID NO: 26300 - RNA, 19 nt, artificial
  Oligomer
uaacugauaacccacgcua

SEQ ID NO: 26301 - RNA, 19 nt, artificial
  Oligomer
agagacuuucugcucacuc

SEQ ID NO: 26302 - RNA, 19 nt, artificial
  Oligomer
uuaacaaagugaucaaucc

SEQ ID NO: 26303 - RNA, 19 nt, artificial
  Oligomer
auauguugaaaucucuuca

SEQ ID NO: 26304 - RNA, 19 nt, artificial
  Oligomer
aaucugacuaauaagaaug

SEQ ID NO: 26305 - RNA, 19 nt, artificial
  Oligomer
uggaacacccaaaacaugu

SEQ ID NO: 26306 - RNA, 19 nt, artificial
  Oligomer
uguacuguugauaacauag

SEQ ID NO: 26307 - RNA, 19 nt, artificial
  Oligomer
aauauuagaaccaccugcc

SEQ ID NO: 26308 - RNA, 19 nt, artificial
  Oligomer
uguaacaaaauaaacuagc

SEQ ID NO: 26309 - RNA, 19 nt, artificial
  Oligomer
uugaugacauuucugauga

SEQ ID NO: 26310 - RNA, 19 nt, artificial
  Oligomer
cuauaauccauuccacaug

SEQ ID NO: 26311 - RNA, 19 nt, artificial
  Oligomer
uuuccucaaaagacuuucc

SEQ ID NO: 26312 - RNA, 19 nt, artificial
  Oligomer
ucaggaauccucaaacccu

SEQ ID NO: 26313 - RNA, 19 nt, artificial
  Oligomer
ugaucagugcuccaguugg

SEQ ID NO: 26314 - RNA, 19 nt, artificial
  Oligomer
uaaagucuguuuaaucauc

SEQ ID NO: 26315 - RNA, 19 nt, artificial
  Oligomer
uacauaggaaccaggccug

SEQ ID NO: 26316 - RNA, 19 nt, artificial
  Oligomer
uugaaaucucuucaauuuu

SEQ ID NO: 26317 - RNA, 19 nt, artificial
  Oligomer
ucuauagacauuuuuuagu

SEQ ID NO: 26318 - RNA, 19 nt, artificial
  Oligomer
aacauaagaaggauugauc

SEQ ID NO: 26319 - RNA, 19 nt, artificial
  Oligomer
auaaauggaagaguugucu

SEQ ID NO: 26320 - RNA, 19 nt, artificial
  Oligomer
aauaagaaugcccgugacg

SEQ ID NO: 26321 - RNA, 19 nt, artificial
  Oligomer
uuaugaaguuucagaagcc

SEQ ID NO: 26322 - RNA, 19 nt, artificial
  Oligomer
uuagaaaacaaagcaaaug

SEQ ID NO: 26323 - RNA, 19 nt, artificial
  Oligomer
auaaguauaugagaugguc

SEQ ID NO: 26324 - RNA, 19 nt, artificial
  Oligomer
uugacuuccucaucuaacu

SEQ ID NO: 26325 - RNA, 19 nt, artificial
  Oligomer
uaaacuagccuuuuugguu

SEQ ID NO: 26326 - RNA, 19 nt, artificial
  Oligomer
uagauaguguacaaugcgu

SEQ ID NO: 26327 - RNA, 19 nt, artificial
  Oligomer
uuugggacccaucagaacu

SEQ ID NO: 26328 - RNA, 19 nt, artificial
  Oligomer
uauugaugggaaucuaauc

SEQ ID NO: 26329 - RNA, 19 nt, artificial
  Oligomer
uuguacuaguugggagucc

SEQ ID NO: 26330 - RNA, 19 nt, artificial
  Oligomer
uagcagagacugaaggaug

SEQ ID NO: 26331 - RNA, 19 nt, artificial
  Oligomer
augugaacaggguaaaggc

SEQ ID NO: 26332 - RNA, 19 nt, artificial
  Oligomer
uacuaguugggaguccugu

SEQ ID NO: 26333 - RNA, 19 nt, artificial
  Oligomer
uguagcuccuaggaauuuc

SEQ ID NO: 26334 - RNA, 19 nt, artificial
  Oligomer
uauuguuucuguucauguc

SEQ ID NO: 26335 - RNA, 19 nt, artificial
  Oligomer
uuugaguguaugugaaaac

SEQ ID NO: 26336 - RNA, 19 nt, artificial
  Oligomer
uaaacagguuugcugauac

SEQ ID NO: 26337 - RNA, 19 nt, artificial
  Oligomer
uauuuuaacauggaacuua

SEQ ID NO: 26338 - RNA, 19 nt, artificial
  Oligomer
uuggaauucugcagcaauu

SEQ ID NO: 26339 - RNA, 19 nt, artificial
  Oligomer
ugagauggucccaauuuug

SEQ ID NO: 26340 - RNA, 19 nt, artificial
  Oligomer
auauacauaggaaccaggc

SEQ ID NO: 26341 - RNA, 19 nt, artificial
  Oligomer
uaaagcaaacauaagaagg

SEQ ID NO: 26342 - RNA, 19 nt, artificial
  Oligomer
ucaagcuuuguuuugcuuu

SEQ ID NO: 26343 - RNA, 19 nt, artificial
  Oligomer
uuccuuugguuucuggaac

SEQ ID NO: 26344 - RNA, 19 nt, artificial
  Oligomer
uuucuuuucugagugcuga

SEQ ID NO: 26345 - RNA, 19 nt, artificial
  Oligomer
uugguggagaaaacagccu

SEQ ID NO: 26346 - RNA, 19 nt, artificial
  Oligomer
auugaguaugagauugugg

SEQ ID NO: 26347 - RNA, 19 nt, artificial
  Oligomer
uugcugauaccagccgucu

SEQ ID NO: 26348 - RNA, 19 nt, artificial
  Oligomer
uauagugagauauuauuac

SEQ ID NO: 26349 - RNA, 19 nt, artificial
  Oligomer
ucuugcaaaaaccauuugg

SEQ ID NO: 26350 - RNA, 19 nt, artificial
  Oligomer
auacucuauaauccauucc

SEQ ID NO: 26351 - RNA, 19 nt, artificial
  Oligomer
aaugguugcauaaacaggu

SEQ ID NO: 26352 - RNA, 19 nt, artificial
  Oligomer
ugauuccggaaaauugcug

SEQ ID NO: 26353 - RNA, 19 nt, artificial
  Oligomer
ugugaaaaccaggcugucc

SEQ ID NO: 26354 - RNA, 19 nt, artificial
  Oligomer
aaauauuagaaccaccugc

SEQ ID NO: 26355 - RNA, 19 nt, artificial
  Oligomer
uccaagucuaaucuucuca

SEQ ID NO: 26356 - RNA, 19 nt, artificial
  Oligomer
uaugaaguuucagaagccc

SEQ ID NO: 26357 - RNA, 19 nt, artificial
  Oligomer
aaugucugacucaugauug

SEQ ID NO: 26358 - RNA, 19 nt, artificial
  Oligomer
uauaugugaacaacuuuag

SEQ ID NO: 26359 - RNA, 19 nt, artificial
  Oligomer
uauaauccauuccacauga

SEQ ID NO: 26360 - RNA, 19 nt, artificial
  Oligomer
uagaaagagagaacgucgc

SEQ ID NO: 26361 - RNA, 19 nt, artificial
  Oligomer
aucaauaagugcuuugccu

SEQ ID NO: 26362 - RNA, 19 nt, artificial
  Oligomer
uagugagauauuauuaccu

SEQ ID NO: 26363 - RNA, 19 nt, artificial
  Oligomer
uuugguuuacuuaauuaca

SEQ ID NO: 26364 - RNA, 19 nt, artificial
  Oligomer
aaauaaacuagccuuuuug

SEQ ID NO: 26365 - RNA, 19 nt, artificial
  Oligomer
uaggaaagaaaaugggagc

SEQ ID NO: 26366 - RNA, 19 nt, artificial
  Oligomer
cugacuaauaagaaugccc

SEQ ID NO: 26367 - RNA, 19 nt, artificial
  Oligomer
auuuccucaaaagacuuuc

SEQ ID NO: 26368 - RNA, 19 nt, artificial
  Oligomer
uacguuagcacccugcuaa

SEQ ID NO: 26369 - RNA, 19 nt, artificial
  Oligomer
auagauguuaauguuaacu

SEQ ID NO: 26370 - RNA, 19 nt, artificial
  Oligomer
auugaucacaccaauguca

SEQ ID NO: 26371 - RNA, 19 nt, artificial
  Oligomer
auugaugggaaucuaauca

SEQ ID NO: 26372 - RNA, 19 nt, artificial
  Oligomer
agauaguguacaaugcgug

SEQ ID NO: 26373 - RNA, 19 nt, artificial
  Oligomer
auauaugugaacaacuuua

SEQ ID NO: 26374 - RNA, 19 nt, artificial
  Oligomer
agaaaaugggagcaggucc

SEQ ID NO: 26375 - RNA, 19 nt, artificial
  Oligomer
uugaucaaacuuauuagga

SEQ ID NO: 26376 - RNA, 19 nt, artificial
  Oligomer
uaccuuuucaacuuauuuu

SEQ ID NO: 26377 - RNA, 19 nt, artificial
  Oligomer
ucaaauuuucuuacauuag

SEQ ID NO: 26378 - RNA, 19 nt, artificial
  Oligomer
uuccaggaaaauuaaauag

SEQ ID NO: 26379 - RNA, 19 nt, artificial
  Oligomer
uuguucuuuggacugcuaa

SEQ ID NO: 26380 - RNA, 19 nt, artificial
  Oligomer
aagauuuugauaagccuac

SEQ ID NO: 26381 - RNA, 19 nt, artificial
  Oligomer
acuuauuaggaauuugagg

SEQ ID NO: 26382 - RNA, 19 nt, artificial
  Oligomer
uuucaagcuuuguuuugcu

SEQ ID NO: 26383 - RNA, 19 nt, artificial
  Oligomer
aucuguauacagcuaagac

SEQ ID NO: 26384 - RNA, 19 nt, artificial
  Oligomer
uuggacugcuaaauuacau

SEQ ID NO: 26385 - RNA, 19 nt, artificial
  Oligomer
ugucaauuccaggucuugu

SEQ ID NO: 26386 - RNA, 19 nt, artificial
  Oligomer
uguuuauucgcagcucugc

SEQ ID NO: 26387 - RNA, 19 nt, artificial
  Oligomer
acaaacaucccacucauuc

SEQ ID NO: 26388 - RNA, 19 nt, artificial
  Oligomer
uguugcauccucagguuuc

SEQ ID NO: 26389 - RNA, 19 nt, artificial
  Oligomer
uucuuuggacugcuaaauu

SEQ ID NO: 26390 - RNA, 19 nt, artificial
  Oligomer
aagucuaaucuucucagcg

SEQ ID NO: 26391 - RNA, 19 nt, artificial
  Oligomer
uuuggaauucugcagcaau

SEQ ID NO: 26392 - RNA, 19 nt, artificial
  Oligomer
ucaagaaaaaagcugagug

SEQ ID NO: 26393 - RNA, 19 nt, artificial
  Oligomer
ucuuccagcaauuauaagu

SEQ ID NO: 26394 - RNA, 19 nt, artificial
  Oligomer
aauaaaggaacuaaaaugg

SEQ ID NO: 26395 - RNA, 19 nt, artificial
  Oligomer
uucaaagaagcugacaaag

SEQ ID NO: 26396 - RNA, 19 nt, artificial
  Oligomer
augaaguuucagaagccca

SEQ ID NO: 26397 - RNA, 19 nt, artificial
  Oligomer
uaacccacgcuauaugauc

SEQ ID NO: 26398 - RNA, 19 nt, artificial
  Oligomer
uauuuuuaacaaagugauc

SEQ ID NO: 26399 - RNA, 19 nt, artificial
  Oligomer
auuguuucuguucauguca

SEQ ID NO: 26400 - RNA, 19 nt, artificial
  Oligomer
ugcauugaucacaccaaug

SEQ ID NO: 26401 - RNA, 19 nt, artificial
  Oligomer
uuaauaucuuuggugacau

SEQ ID NO: 26402 - RNA, 19 nt, artificial
  Oligomer
ucagguuucuaguuaugug

SEQ ID NO: 26403 - RNA, 19 nt, artificial
  Oligomer
uaaaucuugcaaaaaccau

SEQ ID NO: 26404 - RNA, 19 nt, artificial
  Oligomer
uuauuuuauguuaggaaca

SEQ ID NO: 26405 - RNA, 19 nt, artificial
  Oligomer
uccaagagaacuuauucag

SEQ ID NO: 26406 - RNA, 19 nt, artificial
  Oligomer
uaguguuaaaucuugcaaa

SEQ ID NO: 26407 - RNA, 19 nt, artificial
  Oligomer
aggaauuucauuucuacag

SEQ ID NO: 26408 - RNA, 19 nt, artificial
  Oligomer
uaaaacaaucagucuuucc

SEQ ID NO: 26409 - RNA, 19 nt, artificial
  Oligomer
uuuugauaagccuaccaaa

SEQ ID NO: 26410 - RNA, 19 nt, artificial
  Oligomer
uauaaguauaugagauggu

SEQ ID NO: 26411 - RNA, 19 nt, artificial
  Oligomer
ugugaacaggguaaaggcc

SEQ ID NO: 26412 - RNA, 19 nt, artificial
  Oligomer
ucuauagugagauauuauu

SEQ ID NO: 26413 - RNA, 19 nt, artificial
  Oligomer
uaaaaaaugugaacagggu

SEQ ID NO: 26414 - RNA, 19 nt, artificial
  Oligomer
uaggaauuucauuucuaca

SEQ ID NO: 26415 - RNA, 19 nt, artificial
  Oligomer
aucuuuggugacaucauca

SEQ ID NO: 26416 - RNA, 19 nt, artificial
  Oligomer
auacauaggaaccaggccu

SEQ ID NO: 26417 - RNA, 19 nt, artificial
  Oligomer
uuugauaagccuaccaaaa

SEQ ID NO: 26418 - RNA, 19 nt, artificial
  Oligomer
ucgguagcuggaauuggug

SEQ ID NO: 26419 - RNA, 19 nt, artificial
  Oligomer
aaaaaugaaaguuuuucuc

SEQ ID NO: 26420 - RNA, 19 nt, artificial
  Oligomer
aaugugaacaggguaaagg

SEQ ID NO: 26421 - RNA, 19 nt, artificial
  Oligomer
ucaucauuuaaaaacagac

SEQ ID NO: 26422 - RNA, 19 nt, artificial
  Oligomer
augacagugaaaaccaggg

SEQ ID NO: 26423 - RNA, 19 nt, artificial
  Oligomer
aaauauuuguugcauccuc

SEQ ID NO: 26424 - RNA, 19 nt, artificial
  Oligomer
gguuggagcaauuucaccg

SEQ ID NO: 26425 - RNA, 19 nt, artificial
  Oligomer
uucugaugagagcacauaa

SEQ ID NO: 26426 - RNA, 19 nt, artificial
  Oligomer
uauacauaggaaccaggcc

SEQ ID NO: 26427 - RNA, 19 nt, artificial
  Oligomer
uggugauuaguugagcagc

SEQ ID NO: 26428 - RNA, 19 nt, artificial
  Oligomer
ugaaauugcagguccaauu

SEQ ID NO: 26429 - RNA, 19 nt, artificial
  Oligomer
cuuauuaggaauuugaggu

SEQ ID NO: 26430 - RNA, 19 nt, artificial
  Oligomer
uccaacuaaugacagaaug

SEQ ID NO: 26431 - RNA, 19 nt, artificial
  Oligomer
ugcuuugacuuccucaucu

SEQ ID NO: 26432 - RNA, 19 nt, artificial
  Oligomer
aagauguggauauaaaaug

SEQ ID NO: 26433 - RNA, 19 nt, artificial
  Oligomer
uaucuuuggugacaucauc

SEQ ID NO: 26434 - RNA, 19 nt, artificial
  Oligomer
uuaguguaacaaaauaaac

SEQ ID NO: 26435 - RNA, 19 nt, artificial
  Oligomer
uucuguucaugucaaaaag

SEQ ID NO: 26436 - RNA, 19 nt, artificial
  Oligomer
uucucuuucuuuucucauu

SEQ ID NO: 26437 - RNA, 19 nt, artificial
  Oligomer
uuauaaagaacagagcuaa

SEQ ID NO: 26438 - RNA, 19 nt, artificial
  Oligomer
uguagguaaaggcagauag

SEQ ID NO: 26439 - RNA, 19 nt, artificial
  Oligomer
auuugaucaaacuuauuag

SEQ ID NO: 26440 - RNA, 19 nt, artificial
  Oligomer
uaaauagggauuuugauaa

SEQ ID NO: 26441 - RNA, 19 nt, artificial
  Oligomer
augacauuucugaugagag

SEQ ID NO: 26442 - RNA, 19 nt, artificial
  Oligomer
uucugagugcugaaagauu

SEQ ID NO: 26443 - RNA, 19 nt, artificial
  Oligomer
uacuuaauuacagucuuac

SEQ ID NO: 26444 - RNA, 19 nt, artificial
  Oligomer
ugauauguugaaaucucuu

SEQ ID NO: 26445 - RNA, 19 nt, artificial
  Oligomer
uuucuguucaugucaaaaa

SEQ ID NO: 26446 - RNA, 19 nt, artificial
  Oligomer
uucugcucacucgaugcuu

SEQ ID NO: 26447 - RNA, 19 nt, artificial
  Oligomer
ucugacucaugauuguuug

SEQ ID NO: 26448 - RNA, 19 nt, artificial
  Oligomer
ugacucaugauuguuugag

SEQ ID NO: 26449 - RNA, 19 nt, artificial
  Oligomer
uucaagcuuuguuuugcuu

SEQ ID NO: 26450 - RNA, 19 nt, artificial
  Oligomer
uaugagauggucccaauuu

SEQ ID NO: 26451 - RNA, 19 nt, artificial
  Oligomer
auugugggcaguucaucug

SEQ ID NO: 26452 - RNA, 19 nt, artificial
  Oligomer
guugguuuuggguucauug

SEQ ID NO: 26453 - RNA, 19 nt, artificial
  Oligomer
agauacguuagcacccugc

SEQ ID NO: 26454 - RNA, 19 nt, artificial
  Oligomer
uugugggcaguucaucugu

SEQ ID NO: 26455 - RNA, 19 nt, artificial
  Oligomer
accuuuuuaguguuaaauc

SEQ ID NO: 26456 - RNA, 19 nt, artificial
  Oligomer
uaaaaugguuuucuuuucu

SEQ ID NO: 26457 - RNA, 19 nt, artificial
  Oligomer
uuaugcauugcaggaggag

SEQ ID NO: 26458 - RNA, 19 nt, artificial
  Oligomer
uuucugaugagagcacaua

SEQ ID NO: 26459 - RNA, 19 nt, artificial
  Oligomer
uaacaaaauaaacuagccu

SEQ ID NO: 26460 - RNA, 19 nt, artificial
  Oligomer
uuuucaacuuauuuugaga

SEQ ID NO: 26461 - RNA, 19 nt, artificial
  Oligomer
agcaauuucaccgauauac

SEQ ID NO: 26462 - RNA, 19 nt, artificial
  Oligomer
ugagacauaauaauucaga

SEQ ID NO: 26463 - RNA, 19 nt, artificial
  Oligomer
auuucaccgauauacauag

SEQ ID NO: 26464 - RNA, 19 nt, artificial
  Oligomer
auuagaaagagagaacguc

SEQ ID NO: 26465 - RNA, 19 nt, artificial
  Oligomer
ucuauuuuaacauggaacu

SEQ ID NO: 26466 - RNA, 19 nt, artificial
  Oligomer
uaaaaacagacgguucccu

SEQ ID NO: 26467 - RNA, 19 nt, artificial
  Oligomer
uguugaggugcauugauca

SEQ ID NO: 26468 - RNA, 19 nt, artificial
  Oligomer
uucaccgauauacauagga

SEQ ID NO: 26469 - RNA, 19 nt, artificial
  Oligomer
uugcugaaugcagcuauug

SEQ ID NO: 26470 - RNA, 19 nt, artificial
  Oligomer
uugguuuuggguucauuga

SEQ ID NO: 26471 - RNA, 19 nt, artificial
  Oligomer
augauuguuugaguguaug

SEQ ID NO: 26472 - RNA, 19 nt, artificial
  Oligomer
aauauuuguugcauccuca

SEQ ID NO: 26473 - RNA, 19 nt, artificial
  Oligomer
cauuucauuaauaucuuug

SEQ ID NO: 26474 - RNA, 19 nt, artificial
  Oligomer
gugaaaaccauguuuacag

SEQ ID NO: 26475 - RNA, 19 nt, artificial
  Oligomer
ucccuuauuguuucuguuc

SEQ ID NO: 26476 - RNA, 19 nt, artificial
  Oligomer
ucucuauagacauuuuuua

SEQ ID NO: 26477 - RNA, 19 nt, artificial
  Oligomer
auaccuuuguuccacuagg

SEQ ID NO: 26478 - RNA, 19 nt, artificial
  Oligomer
auuuaaaaacagacgguuc

SEQ ID NO: 26479 - RNA, 19 nt, artificial
  Oligomer
cugaauuauagagacuuuc

SEQ ID NO: 26480 - RNA, 19 nt, artificial
  Oligomer
uaguguaacaaaauaaacu

SEQ ID NO: 26481 - RNA, 19 nt, artificial
  Oligomer
cuaaauuacauauauguga

SEQ ID NO: 26482 - RNA, 19 nt, artificial
  Oligomer
uccacuaggaaagaaaaug

SEQ ID NO: 26483 - RNA, 19 nt, artificial
  Oligomer
uaaucaauaagugcuuugc

SEQ ID NO: 26484 - RNA, 19 nt, artificial
  Oligomer
gauuaguugagcagcugcc

SEQ ID NO: 26485 - RNA, 19 nt, artificial
  Oligomer
auuauuuuauguuaggaac

SEQ ID NO: 26486 - RNA, 19 nt, artificial
  Oligomer
guuuauucgcagcucugcc

SEQ ID NO: 26487 - RNA, 19 nt, artificial
  Oligomer
uaacucaaaggauuguacc

SEQ ID NO: 26488 - RNA, 19 nt, artificial
  Oligomer
uugccuauguagguaaagg

SEQ ID NO: 26489 - RNA, 19 nt, artificial
  Oligomer
auuagauuugaucaaacuu

SEQ ID NO: 26490 - RNA, 19 nt, artificial
  Oligomer
uuucauuaauaucuuuggu

SEQ ID NO: 26491 - RNA, 19 nt, artificial
  Oligomer
uuacauauaugugaacaac

SEQ ID NO: 26492 - RNA, 19 nt, artificial
  Oligomer
auuguuugaguguauguga

SEQ ID NO: 26493 - RNA, 19 nt, artificial
  Oligomer
ugggaguccugucaauucc

SEQ ID NO: 26494 - RNA, 19 nt, artificial
  Oligomer
ucaucauauccucugaguc

SEQ ID NO: 26495 - RNA, 19 nt, artificial
  Oligomer
uccaggaaaauuaaauagg

SEQ ID NO: 26496 - RNA, 19 nt, artificial
  Oligomer
aaaaauauuagaaccaccu

SEQ ID NO: 26497 - RNA, 19 nt, artificial
  Oligomer
aauaaauggaagaguuguc

SEQ ID NO: 26498 - RNA, 19 nt, artificial
  Oligomer
uguaaaauugacuguaagc

SEQ ID NO: 26499 - RNA, 19 nt, artificial
  Oligomer
ugaagcugaacauuuauga

SEQ ID NO: 26500 - RNA, 19 nt, artificial
  Oligomer
uguucagugguuuuuaauu

SEQ ID NO: 26501 - RNA, 19 nt, artificial
  Oligomer
auuauuucacucuuaaaga

SEQ ID NO: 26502 - RNA, 19 nt, artificial
  Oligomer
uccuuuacuucaaauuuuc

SEQ ID NO: 26503 - RNA, 19 nt, artificial
  Oligomer
uuaaagauguggauauaaa

SEQ ID NO: 26504 - RNA, 19 nt, artificial
  Oligomer
uauaguccugauaugcuuc

SEQ ID NO: 26505 - RNA, 19 nt, artificial
  Oligomer
ugcugaaugcagcuauugc

SEQ ID NO: 26506 - RNA, 19 nt, artificial
  Oligomer
ugagauauuauuaccuguu

SEQ ID NO: 26507 - RNA, 19 nt, artificial
  Oligomer
ucucuuucuuuucucauuu

SEQ ID NO: 26508 - RNA, 19 nt, artificial
  Oligomer
uaauauaccaaaugucuga

SEQ ID NO: 26509 - RNA, 19 nt, artificial
  Oligomer
aaauaaaggaacuaaaaug

SEQ ID NO: 26510 - RNA, 19 nt, artificial
  Oligomer
auucagcagcacaaguccc

SEQ ID NO: 26511 - RNA, 19 nt, artificial
  Oligomer
aucagugcuccaguuggug

SEQ ID NO: 26512 - RNA, 19 nt, artificial
  Oligomer
uugcauaaacagguuugcu

SEQ ID NO: 26513 - RNA, 19 nt, artificial
  Oligomer
ugucauuguacuaguuggg

SEQ ID NO: 26514 - RNA, 19 nt, artificial
  Oligomer
ugguuuuggguucauugag

SEQ ID NO: 26515 - RNA, 19 nt, artificial
  Oligomer
uggaauuggugaagagcug

SEQ ID NO: 26516 - RNA, 19 nt, artificial
  Oligomer
uauuucacucuuaaagagu

SEQ ID NO: 26517 - RNA, 19 nt, artificial
  Oligomer
auggugauuaguugagcag

SEQ ID NO: 26518 - RNA, 19 nt, artificial
  Oligomer
ugagguaauauaccaaaug

SEQ ID NO: 26519 - RNA, 19 nt, artificial
  Oligomer
auaagugcuuugccucagc

SEQ ID NO: 26520 - RNA, 19 nt, artificial
  Oligomer
auauggguaagaaaauucc

SEQ ID NO: 26521 - RNA, 19 nt, artificial
  Oligomer
uguucaugucaaaaagcag

SEQ ID NO: 26522 - RNA, 19 nt, artificial
  Oligomer
aacuauauuuccauaauug

SEQ ID NO: 26523 - RNA, 19 nt, artificial
  Oligomer
ucccagugaccuuaucuuc

SEQ ID NO: 26524 - RNA, 19 nt, artificial
  Oligomer
aguuguugauagcuuuucg

SEQ ID NO: 26525 - RNA, 19 nt, artificial
  Oligomer
uuuggacugcuaaauuaca

SEQ ID NO: 26526 - RNA, 19 nt, artificial
  Oligomer
uguggauauaaaaugcuca

SEQ ID NO: 26527 - RNA, 19 nt, artificial
  Oligomer
uugauaacauaguuguuga

SEQ ID NO: 26528 - RNA, 19 nt, artificial
  Oligomer
ugaggugcauugaucacac

SEQ ID NO: 26529 - RNA, 19 nt, artificial
  Oligomer
aaucuaaucaauaagugcu

SEQ ID NO: 26530 - RNA, 19 nt, artificial
  Oligomer
ucaaaagacuuuccuuugg

SEQ ID NO: 26531 - RNA, 19 nt, artificial
  Oligomer
uaagcuuuugggacccauc

SEQ ID NO: 26532 - RNA, 19 nt, artificial
  Oligomer
acuaaaaugguuuucuuuu

SEQ ID NO: 26533 - RNA, 19 nt, artificial
  Oligomer
auaacauaguuguugauag

SEQ ID NO: 26534 - RNA, 19 nt, artificial
  Oligomer
uguuuugcuuugacuuccu

SEQ ID NO: 26535 - RNA, 19 nt, artificial
  Oligomer
gucaauuccaggucuugug

SEQ ID NO: 26536 - RNA, 19 nt, artificial
  Oligomer
agcuuuucggucauccagu

SEQ ID NO: 26537 - RNA, 19 nt, artificial
  Oligomer
agucucuguagcuccuagg

SEQ ID NO: 26538 - RNA, 19 nt, artificial
  Oligomer
uauacucuauaauccauuc

SEQ ID NO: 26539 - RNA, 19 nt, artificial
  Oligomer
ucaauuaaaaagcaaagca

SEQ ID NO: 26540 - RNA, 19 nt, artificial
  Oligomer
uugauaaaagucugaagcu

SEQ ID NO: 26541 - RNA, 19 nt, artificial
  Oligomer
uuaaagcaaacauaagaag

SEQ ID NO: 26542 - RNA, 19 nt, artificial
  Oligomer
auuuugauaagccuaccaa

SEQ ID NO: 26543 - RNA, 19 nt, artificial
  Oligomer
uccucaucuaacuugaugu

SEQ ID NO: 26544 - RNA, 19 nt, artificial
  Oligomer
ugguuuucuuuucugagug

SEQ ID NO: 26545 - RNA, 19 nt, artificial
  Oligomer
ugaaaauacagaacaaaag

SEQ ID NO: 26546 - RNA, 19 nt, artificial
  Oligomer
uaaaaagcaaagcaaacua

SEQ ID NO: 26547 - RNA, 19 nt, artificial
  Oligomer
cuagaaucuguauacagcu

SEQ ID NO: 26548 - RNA, 19 nt, artificial
  Oligomer
cuuguuauaaagaacagag

SEQ ID NO: 26549 - RNA, 19 nt, artificial
  Oligomer
uugcagguccaauugcuga

SEQ ID NO: 26550 - RNA, 19 nt, artificial
  Oligomer
uaguauacucuauaaucca

SEQ ID NO: 26551 - RNA, 19 nt, artificial
  Oligomer
aaaucuugcaaaaaccauu

SEQ ID NO: 26552 - RNA, 19 nt, artificial
  Oligomer
uaccagaagggaaucaaca

SEQ ID NO: 26553 - RNA, 19 nt, artificial
  Oligomer
ugaauauugaugggaaucu

SEQ ID NO: 26554 - RNA, 19 nt, artificial
  Oligomer
uguuauaaagaacagagcu

SEQ ID NO: 26555 - RNA, 19 nt, artificial
  Oligomer
uuguaaaauugacuguaag

SEQ ID NO: 26556 - RNA, 19 nt, artificial
  Oligomer
ucuuucuuuucucauuuca

SEQ ID NO: 26557 - RNA, 19 nt, artificial
  Oligomer
ugccuaggccuaguuaugc

SEQ ID NO: 26558 - RNA, 19 nt, artificial
  Oligomer
guucaugucaaaaagcagg

SEQ ID NO: 26559 - RNA, 19 nt, artificial
  Oligomer
auuauuaccuguugaggug

SEQ ID NO: 26560 - RNA, 19 nt, artificial
  Oligomer
guuaaaucuugcaaaaacc

SEQ ID NO: 26561 - RNA, 19 nt, artificial
  Oligomer
uagaaaacaaagcaaaugu

SEQ ID NO: 26562 - RNA, 19 nt, artificial
  Oligomer
uguaugugaaaaccaggcu

SEQ ID NO: 26563 - RNA, 19 nt, artificial
  Oligomer
ucuggaacuuuaaaaaaug

SEQ ID NO: 26564 - RNA, 19 nt, artificial
  Oligomer
uuugagacauaauaauuca

SEQ ID NO: 26565 - RNA, 19 nt, artificial
  Oligomer
uuauuaggaauuugaggua

SEQ ID NO: 26566 - RNA, 19 nt, artificial
  Oligomer
aaauucaagaccaauaauc

SEQ ID NO: 26567 - RNA, 19 nt, artificial
  Oligomer
ucuuguucuuuggacugcu

SEQ ID NO: 26568 - RNA, 19 nt, artificial
  Oligomer
uacagcuaagacaaagaag

SEQ ID NO: 26569 - RNA, 19 nt, artificial
  Oligomer
uaaauauuuguugcauccu

SEQ ID NO: 26570 - RNA, 19 nt, artificial
  Oligomer
uguugaaaucucuucaauu

SEQ ID NO: 26571 - RNA, 19 nt, artificial
  Oligomer
auaaaaugcucaaggaauc

SEQ ID NO: 26572 - RNA, 19 nt, artificial
  Oligomer
uucagugguuuuuaauuau

SEQ ID NO: 26573 - RNA, 19 nt, artificial
  Oligomer
uaaucuucucagcggcagc

SEQ ID NO: 26574 - RNA, 19 nt, artificial
  Oligomer
uccaccaacugcaaagcug

SEQ ID NO: 26575 - RNA, 19 nt, artificial
  Oligomer
ugagaguccaagucuaauc

SEQ ID NO: 26576 - RNA, 19 nt, artificial
  Oligomer
cuuaauuacagucuuacca

SEQ ID NO: 26577 - RNA, 19 nt, artificial
  Oligomer
aucaugcucacauaacuca

SEQ ID NO: 26578 - RNA, 19 nt, artificial
  Oligomer
auauuuguugcauccucag

SEQ ID NO: 26579 - RNA, 19 nt, artificial
  Oligomer
aguguaugugaaaaccagg

SEQ ID NO: 26580 - RNA, 19 nt, artificial
  Oligomer
auauuagaaccaccugccc

SEQ ID NO: 26581 - RNA, 19 nt, artificial
  Oligomer
aauaucuuuggugacauca

SEQ ID NO: 26582 - RNA, 19 nt, artificial
  Oligomer
auuucuacagcagcuuuug

SEQ ID NO: 26583 - RNA, 19 nt, artificial
  Oligomer
agugaugacagugaaaacc

SEQ ID NO: 26584 - RNA, 19 nt, artificial
  Oligomer
gucuguuuaaucaucugug

SEQ ID NO: 26585 - RNA, 19 nt, artificial
  Oligomer
auuaaaaagcaaagcaaac

SEQ ID NO: 26586 - RNA, 19 nt, artificial
  Oligomer
cuucuuuuggaauucugca

SEQ ID NO: 26587 - RNA, 19 nt, artificial
  Oligomer
ucauccaguggaacaccca

SEQ ID NO: 26588 - RNA, 19 nt, artificial
  Oligomer
ugaucaauccuuuacuuca

SEQ ID NO: 26589 - RNA, 19 nt, artificial
  Oligomer
ugauaacccacgcuauaug

SEQ ID NO: 26590 - RNA, 19 nt, artificial
  Oligomer
aacaaagugaucaauccuu

SEQ ID NO: 26591 - RNA, 19 nt, artificial
  Oligomer
uaauugcccaagauaaauu

SEQ ID NO: 26592 - RNA, 19 nt, artificial
  Oligomer
auauccucugagucuuuuc

SEQ ID NO: 26593 - RNA, 19 nt, artificial
  Oligomer
aguugguggagaaaacagc

SEQ ID NO: 26594 - RNA, 19 nt, artificial
  Oligomer
accuuuucaacuuauuuug

SEQ ID NO: 26595 - RNA, 19 nt, artificial
  Oligomer
ccagauuuuugcucauuaa

SEQ ID NO: 26596 - RNA, 19 nt, artificial
  Oligomer
caaggaugcagguguucaa

SEQ ID NO: 26597 - RNA, 19 nt, artificial
  Oligomer
cgguuuguuggaucuucaa

SEQ ID NO: 26598 - RNA, 19 nt, artificial
  Oligomer
caaggaugucacaagaaaa

SEQ ID NO: 26599 - RNA, 19 nt, artificial
  Oligomer
gcucauuaacagaaaagaa

SEQ ID NO: 26600 - RNA, 19 nt, artificial
  Oligomer
cuugaaucuuuccaauaaa

SEQ ID NO: 26601 - RNA, 19 nt, artificial
  Oligomer
gcaaggaugucacaagaaa

SEQ ID NO: 26602 - RNA, 19 nt, artificial
  Oligomer
acggcgucauggagaugaa

SEQ ID NO: 26603 - RNA, 19 nt, artificial
  Oligomer
cggagauuauaaauaguca

SEQ ID NO: 26604 - RNA, 19 nt, artificial
  Oligomer
gguuaaggugcaauaagaa

SEQ ID NO: 26605 - RNA, 19 nt, artificial
  Oligomer
ccaggaagcagauacauau

SEQ ID NO: 26606 - RNA, 19 nt, artificial
  Oligomer
ccuggagccuuugaauaaa

SEQ ID NO: 26607 - RNA, 19 nt, artificial
  Oligomer
cugagaaggacauuuugaa

SEQ ID NO: 26608 - RNA, 19 nt, artificial
  Oligomer
cacccaggauguaucccaa

SEQ ID NO: 26609 - RNA, 19 nt, artificial
  Oligomer
aacccaggacgcuucugaa

SEQ ID NO: 26610 - RNA, 19 nt, artificial
  Oligomer
gaaggaaauugagauuaga

SEQ ID NO: 26611 - RNA, 19 nt, artificial
  Oligomer
gagagguuauagaguagaa

SEQ ID NO: 26612 - RNA, 19 nt, artificial
  Oligomer
cuggagccuuugaauaaaa

SEQ ID NO: 26613 - RNA, 19 nt, artificial
  Oligomer
cuaggauuauuaacuaaua

SEQ ID NO: 26614 - RNA, 19 nt, artificial
  Oligomer
gccggaggguguuuaugua

SEQ ID NO: 26615 - RNA, 19 nt, artificial
  Oligomer
gguucuuuguuuuaaaaua

SEQ ID NO: 26616 - RNA, 19 nt, artificial
  Oligomer
gggauauaggagaggaaaa

SEQ ID NO: 26617 - RNA, 19 nt, artificial
  Oligomer
cuguuucuuuguuauuaaa

SEQ ID NO: 26618 - RNA, 19 nt, artificial
  Oligomer
gcgguuuguuggaucuuca

SEQ ID NO: 26619 - RNA, 19 nt, artificial
  Oligomer
ucugguucuuuguuuuaaa

SEQ ID NO: 26620 - RNA, 19 nt, artificial
  Oligomer
cugguucuuuguuuuaaaa

SEQ ID NO: 26621 - RNA, 19 nt, artificial
  Oligomer
guacguuauuguugacuua

SEQ ID NO: 26622 - RNA, 19 nt, artificial
  Oligomer
gaaggacucugcauaugau

SEQ ID NO: 26623 - RNA, 19 nt, artificial
  Oligomer
gggacuugaaucuuuccaa

SEQ ID NO: 26624 - RNA, 19 nt, artificial
  Oligomer
ggaaguacguuauuguuga

SEQ ID NO: 26625 - RNA, 19 nt, artificial
  Oligomer
ggaguccagggaagagaaa

SEQ ID NO: 26626 - RNA, 19 nt, artificial
  Oligomer
cagagaugcuguaauggua

SEQ ID NO: 26627 - RNA, 19 nt, artificial
  Oligomer
ggaggguguuuauguaaga

SEQ ID NO: 26628 - RNA, 19 nt, artificial
  Oligomer
cugagaagaucauaaagga

SEQ ID NO: 26629 - RNA, 19 nt, artificial
  Oligomer
ggagaaauguuguucauua

SEQ ID NO: 26630 - RNA, 19 nt, artificial
  Oligomer
guacguuaccucuuaacaa

SEQ ID NO: 26631 - RNA, 19 nt, artificial
  Oligomer
uggagccuuugaauaaaaa

SEQ ID NO: 26632 - RNA, 19 nt, artificial
  Oligomer
gcuccugagaagaucauaa

SEQ ID NO: 26633 - RNA, 19 nt, artificial
  Oligomer
cgugcuagagcucuuuaga

SEQ ID NO: 26634 - RNA, 19 nt, artificial
  Oligomer
cuuuguuauuaaaggauaa

SEQ ID NO: 26635 - RNA, 19 nt, artificial
  Oligomer
gaugguugauggguucuaa

SEQ ID NO: 26636 - RNA, 19 nt, artificial
  Oligomer
cguuauuguugacuuauuu

SEQ ID NO: 26637 - RNA, 19 nt, artificial
  Oligomer
ggagauuuuagguguugau

SEQ ID NO: 26638 - RNA, 19 nt, artificial
  Oligomer
cucuuuaacuucucguaaa

SEQ ID NO: 26639 - RNA, 19 nt, artificial
  Oligomer
ggaugagcuuugucuguau

SEQ ID NO: 26640 - RNA, 19 nt, artificial
  Oligomer
cgggugugguuaauacuau

SEQ ID NO: 26641 - RNA, 19 nt, artificial
  Oligomer
gguagagauucauuauuuu

SEQ ID NO: 26642 - RNA, 19 nt, artificial
  Oligomer
ccaaauaauaaaaacagaa

SEQ ID NO: 26643 - RNA, 19 nt, artificial
  Oligomer
ccagguuuagacaguauga

SEQ ID NO: 26644 - RNA, 19 nt, artificial
  Oligomer
ggagccuuugaauaaaaau

SEQ ID NO: 26645 - RNA, 19 nt, artificial
  Oligomer
ccaaauaagaaaccuaaaa

SEQ ID NO: 26646 - RNA, 19 nt, artificial
  Oligomer
cuuccauuuugcccugaaa

SEQ ID NO: 26647 - RNA, 19 nt, artificial
  Oligomer
agguuaaggugcaauaaga

SEQ ID NO: 26648 - RNA, 19 nt, artificial
  Oligomer
gaauguaugugcacuguca

SEQ ID NO: 26649 - RNA, 19 nt, artificial
  Oligomer
gagaaauguuguucauuau

SEQ ID NO: 26650 - RNA, 19 nt, artificial
  Oligomer
ggcgcaauucaaugcugau

SEQ ID NO: 26651 - RNA, 19 nt, artificial
  Oligomer
ggugcagauagaucuggaa

SEQ ID NO: 26652 - RNA, 19 nt, artificial
  Oligomer
ggagcuuuuuucuuuaaga

SEQ ID NO: 26653 - RNA, 19 nt, artificial
  Oligomer
gguucuugguagagauuca

SEQ ID NO: 26654 - RNA, 19 nt, artificial
  Oligomer
cggugcagauagaucugga

SEQ ID NO: 26655 - RNA, 19 nt, artificial
  Oligomer
cuccugagaagaucauaaa

SEQ ID NO: 26656 - RNA, 19 nt, artificial
  Oligomer
cuugaagacuugaauuaga

SEQ ID NO: 26657 - RNA, 19 nt, artificial
  Oligomer
cuuuguagccuucuuugaa

SEQ ID NO: 26658 - RNA, 19 nt, artificial
  Oligomer
uggaguccagggaagagaa

SEQ ID NO: 26659 - RNA, 19 nt, artificial
  Oligomer
gauggguucuaauuuugga

SEQ ID NO: 26660 - RNA, 19 nt, artificial
  Oligomer
gccugaggucuguacguua

SEQ ID NO: 26661 - RNA, 19 nt, artificial
  Oligomer
cauguaguaguacuugaaa

SEQ ID NO: 26662 - RNA, 19 nt, artificial
  Oligomer
gugcaaggaugucacaaga

SEQ ID NO: 26663 - RNA, 19 nt, artificial
  Oligomer
cuaaggagaccaccaccaa

SEQ ID NO: 26664 - RNA, 19 nt, artificial
  Oligomer
ggguguuuauguaagagca

SEQ ID NO: 26665 - RNA, 19 nt, artificial
  Oligomer
ucugaaugcugcuacuuaa

SEQ ID NO: 26666 - RNA, 19 nt, artificial
  Oligomer
gaggaugaauguaugugca

SEQ ID NO: 26667 - RNA, 19 nt, artificial
  Oligomer
gaaucuuuccaauaaacca

SEQ ID NO: 26668 - RNA, 19 nt, artificial
  Oligomer
ggacuugaaucuuuccaau

SEQ ID NO: 26669 - RNA, 19 nt, artificial
  Oligomer
guucauuauuggaggguaa

SEQ ID NO: 26670 - RNA, 19 nt, artificial
  Oligomer
cagggaagagaaagugauu

SEQ ID NO: 26671 - RNA, 19 nt, artificial
  Oligomer
ugaaaucuaggauuauuaa

SEQ ID NO: 26672 - RNA, 19 nt, artificial
  Oligomer
agagguuaaggugcaauaa

SEQ ID NO: 26673 - RNA, 19 nt, artificial
  Oligomer
gcgggugugguuaauacua

SEQ ID NO: 26674 - RNA, 19 nt, artificial
  Oligomer
caguaugagucaaugugca

SEQ ID NO: 26675 - RNA, 19 nt, artificial
  Oligomer
ggaugucacaagaaaagca

SEQ ID NO: 26676 - RNA, 19 nt, artificial
  Oligomer
acuugaaucuuuccaauaa

SEQ ID NO: 26677 - RNA, 19 nt, artificial
  Oligomer
gggcaucguuguuggaauu

SEQ ID NO: 26678 - RNA, 19 nt, artificial
  Oligomer
agauaauaguuuacaugua

SEQ ID NO: 26679 - RNA, 19 nt, artificial
  Oligomer
gucuguacguuaccucuua

SEQ ID NO: 26680 - RNA, 19 nt, artificial
  Oligomer
cauccuuccugcuauccua

SEQ ID NO: 26681 - RNA, 19 nt, artificial
  Oligomer
caaagaauguuuauagcaa

SEQ ID NO: 26682 - RNA, 19 nt, artificial
  Oligomer
gacuuuggauccuuccuga

SEQ ID NO: 26683 - RNA, 19 nt, artificial
  Oligomer
ccagaucuuuggucuggaa

SEQ ID NO: 26684 - RNA, 19 nt, artificial
  Oligomer
gauugugaauauuuccaua

SEQ ID NO: 26685 - RNA, 19 nt, artificial
  Oligomer
cccagauuuuugcucauua

SEQ ID NO: 26686 - RNA, 19 nt, artificial
  Oligomer
gagagguuaaggugcaaua

SEQ ID NO: 26687 - RNA, 19 nt, artificial
  Oligomer
ucuuuaacuucucguaaaa

SEQ ID NO: 26688 - RNA, 19 nt, artificial
  Oligomer
agaccaccaccaaugucua

SEQ ID NO: 26689 - RNA, 19 nt, artificial
  Oligomer
caaauuaacuugaguuuua

SEQ ID NO: 26690 - RNA, 19 nt, artificial
  Oligomer
aaagaauguuuauagcaaa

SEQ ID NO: 26691 - RNA, 19 nt, artificial
  Oligomer
ucagauggaaacucuuuaa

SEQ ID NO: 26692 - RNA, 19 nt, artificial
  Oligomer
gccuuugaauaaaaaugca

SEQ ID NO: 26693 - RNA, 19 nt, artificial
  Oligomer
cugagaagauugugaauau

SEQ ID NO: 26694 - RNA, 19 nt, artificial
  Oligomer
aagucauauaccuauauaa

SEQ ID NO: 26695 - RNA, 19 nt, artificial
  Oligomer
gcuuuuuucuuuaagauaa

SEQ ID NO: 26696 - RNA, 19 nt, artificial
  Oligomer
aggugaccuugcaacuuca

SEQ ID NO: 26697 - RNA, 19 nt, artificial
  Oligomer
auucaaugcugauugucaa

SEQ ID NO: 26698 - RNA, 19 nt, artificial
  Oligomer
caucguuguuggaauucug

SEQ ID NO: 26699 - RNA, 19 nt, artificial
  Oligomer
acauguaguaguacuugaa

SEQ ID NO: 26700 - RNA, 19 nt, artificial
  Oligomer
gaccaccaccaaugucuaa

SEQ ID NO: 26701 - RNA, 19 nt, artificial
  Oligomer
agagggagguguuuaaaga

SEQ ID NO: 26702 - RNA, 19 nt, artificial
  Oligomer
cagguuuugugcccaugua

SEQ ID NO: 26703 - RNA, 19 nt, artificial
  Oligomer
acuguuucuuuguuauuaa

SEQ ID NO: 26704 - RNA, 19 nt, artificial
  Oligomer
gauuuucuguuguauuuua

SEQ ID NO: 26705 - RNA, 19 nt, artificial
  Oligomer
agcccaucaucauuuccau

SEQ ID NO: 26706 - RNA, 19 nt, artificial
  Oligomer
cccuuugcggagauuauaa

SEQ ID NO: 26707 - RNA, 19 nt, artificial
  Oligomer
ucuguacguuaccucuuaa

SEQ ID NO: 26708 - RNA, 19 nt, artificial
  Oligomer
cgcugcucacuauuuagga

SEQ ID NO: 26709 - RNA, 19 nt, artificial
  Oligomer
caggauguaucccaagaca

SEQ ID NO: 26710 - RNA, 19 nt, artificial
  Oligomer
ggagaaaacuugcugcuga

SEQ ID NO: 26711 - RNA, 19 nt, artificial
  Oligomer
agccuucuuugaaauugga

SEQ ID NO: 26712 - RNA, 19 nt, artificial
  Oligomer
cuccgcugcucacuauuua

SEQ ID NO: 26713 - RNA, 19 nt, artificial
  Oligomer
uccaaauaagaaaccuaaa

SEQ ID NO: 26714 - RNA, 19 nt, artificial
  Oligomer
cccucacuggaugaaauaa

SEQ ID NO: 26715 - RNA, 19 nt, artificial
  Oligomer
cucacuggaugaaauaacu

SEQ ID NO: 26716 - RNA, 19 nt, artificial
  Oligomer
ccaugucacugugguccua

SEQ ID NO: 26717 - RNA, 19 nt, artificial
  Oligomer
gacuuuugaggauaucaca

SEQ ID NO: 26718 - RNA, 19 nt, artificial
  Oligomer
ggcuuuuaccuucuucaaa

SEQ ID NO: 26719 - RNA, 19 nt, artificial
  Oligomer
ccgagugaaccuaccuuca

SEQ ID NO: 26720 - RNA, 19 nt, artificial
  Oligomer
uguuguauuuuaacucaua

SEQ ID NO: 26721 - RNA, 19 nt, artificial
  Oligomer
cgauuauuaucuaaagugu

SEQ ID NO: 26722 - RNA, 19 nt, artificial
  Oligomer
gauacauaugaguguggaa

SEQ ID NO: 26723 - RNA, 19 nt, artificial
  Oligomer
caguguagcccacacuuga

SEQ ID NO: 26724 - RNA, 19 nt, artificial
  Oligomer
acucaacaggaaucuucaa

SEQ ID NO: 26725 - RNA, 19 nt, artificial
  Oligomer
ggagauuauaaauagucau

SEQ ID NO: 26726 - RNA, 19 nt, artificial
  Oligomer
ccuugggucugaagagcua

SEQ ID NO: 26727 - RNA, 19 nt, artificial
  Oligomer
ccuagaucuuucuugaaga

SEQ ID NO: 26728 - RNA, 19 nt, artificial
  Oligomer
gaugucacaagaaaagcaa

SEQ ID NO: 26729 - RNA, 19 nt, artificial
  Oligomer
ccuuugcggagauuauaaa

SEQ ID NO: 26730 - RNA, 19 nt, artificial
  Oligomer
gggucaucaaugcuccuga

SEQ ID NO: 26731 - RNA, 19 nt, artificial
  Oligomer
gagccuacguuuuuauuau

SEQ ID NO: 26732 - RNA, 19 nt, artificial
  Oligomer
agaucauaaaggaauuuau

SEQ ID NO: 26733 - RNA, 19 nt, artificial
  Oligomer
gggcauuguaguuaaugau

SEQ ID NO: 26734 - RNA, 19 nt, artificial
  Oligomer
ccggaggguguuuauguaa

SEQ ID NO: 26735 - RNA, 19 nt, artificial
  Oligomer
caucaaugcuccugagaag

SEQ ID NO: 26736 - RNA, 19 nt, artificial
  Oligomer
gagugaaccuaccuucauu

SEQ ID NO: 26737 - RNA, 19 nt, artificial
  Oligomer
ccuuccugcuauccuacaa

SEQ ID NO: 26738 - RNA, 19 nt, artificial
  Oligomer
gggcuaucuuggucuuugu

SEQ ID NO: 26739 - RNA, 19 nt, artificial
  Oligomer
caacaggaaucuucaagga

SEQ ID NO: 26740 - RNA, 19 nt, artificial
  Oligomer
ccaucacaguugcuacaau

SEQ ID NO: 26741 - RNA, 19 nt, artificial
  Oligomer
gaugaaagaugagagugca

SEQ ID NO: 26742 - RNA, 19 nt, artificial
  Oligomer
ccagggaagagaaagugau

SEQ ID NO: 26743 - RNA, 19 nt, artificial
  Oligomer
gauuauaaauagucaugau

SEQ ID NO: 26744 - RNA, 19 nt, artificial
  Oligomer
guggaaagggcaggaagaa

SEQ ID NO: 26745 - RNA, 19 nt, artificial
  Oligomer
acucauaccuuuaaaggaa

SEQ ID NO: 26746 - RNA, 19 nt, artificial
  Oligomer
ccggcuuccucauuaccuu

SEQ ID NO: 26747 - RNA, 19 nt, artificial
  Oligomer
ugagaagaucauaaaggaa

SEQ ID NO: 26748 - RNA, 19 nt, artificial
  Oligomer
cgagugaaccuaccuucau

SEQ ID NO: 26749 - RNA, 19 nt, artificial
  Oligomer
ccuugucagugacaguauu

SEQ ID NO: 26750 - RNA, 19 nt, artificial
  Oligomer
gagguuauagaguagaaga

SEQ ID NO: 26751 - RNA, 19 nt, artificial
  Oligomer
gcuccuggagccuuugaau

SEQ ID NO: 26752 - RNA, 19 nt, artificial
  Oligomer
ugggcaucguuguuggaau

SEQ ID NO: 26753 - RNA, 19 nt, artificial
  Oligomer
gcugagaaggacauuuuga

SEQ ID NO: 26754 - RNA, 19 nt, artificial
  Oligomer
caggaagaaggacucugca

SEQ ID NO: 26755 - RNA, 19 nt, artificial
  Oligomer
uagucucauuacuuuugaa

SEQ ID NO: 26756 - RNA, 19 nt, artificial
  Oligomer
gagcgauuauuaucuaaag

SEQ ID NO: 26757 - RNA, 19 nt, artificial
  Oligomer
gagaccucaucaggaugaa

SEQ ID NO: 26758 - RNA, 19 nt, artificial
  Oligomer
gguucuaauuuuggaugga

SEQ ID NO: 26759 - RNA, 19 nt, artificial
  Oligomer
uggagagguuaaggugcaa

SEQ ID NO: 26760 - RNA, 19 nt, artificial
  Oligomer
cacugagaagauugugaau

SEQ ID NO: 26761 - RNA, 19 nt, artificial
  Oligomer
cgcgggugugguuaauacu

SEQ ID NO: 26762 - RNA, 19 nt, artificial
  Oligomer
uuuguagccuucuuugaaa

SEQ ID NO: 26763 - RNA, 19 nt, artificial
  Oligomer
gcagcucucugggaucaau

SEQ ID NO: 26764 - RNA, 19 nt, artificial
  Oligomer
gaaagggcaggaagaagga

SEQ ID NO: 26765 - RNA, 19 nt, artificial
  Oligomer
agggagaaauguuguucau

SEQ ID NO: 26766 - RNA, 19 nt, artificial
  Oligomer
gauggaaacucuuuaacuu

SEQ ID NO: 26767 - RNA, 19 nt, artificial
  Oligomer
aagacauccaggagaugaa

SEQ ID NO: 26768 - RNA, 19 nt, artificial
  Oligomer
guagcuaagucgguugaaa

SEQ ID NO: 26769 - RNA, 19 nt, artificial
  Oligomer
uaauaaaaacagaaggaaa

SEQ ID NO: 26770 - RNA, 19 nt, artificial
  Oligomer
gaagaaggacucugcauau

SEQ ID NO: 26771 - RNA, 19 nt, artificial
  Oligomer
ggucaucaaugcuccugag

SEQ ID NO: 26772 - RNA, 19 nt, artificial
  Oligomer
uguaguuaaugaugguuga

SEQ ID NO: 26773 - RNA, 19 nt, artificial
  Oligomer
acagcaucgagccugcuaa

SEQ ID NO: 26774 - RNA, 19 nt, artificial
  Oligomer
cauccaaauaagaaaccua

SEQ ID NO: 26775 - RNA, 19 nt, artificial
  Oligomer
cuugguagagauucauuau

SEQ ID NO: 26776 - RNA, 19 nt, artificial
  Oligomer
ggagagaccucaucaggau

SEQ ID NO: 26777 - RNA, 19 nt, artificial
  Oligomer
gcaggacuuuugaggauau

SEQ ID NO: 26778 - RNA, 19 nt, artificial
  Oligomer
agcaagucaccgugcuaga

SEQ ID NO: 26779 - RNA, 19 nt, artificial
  Oligomer
uaguuuacauguaguagua

SEQ ID NO: 26780 - RNA, 19 nt, artificial
  Oligomer
cugagcgauuauuaucuaa

SEQ ID NO: 26781 - RNA, 19 nt, artificial
  Oligomer
guguugauuuucuguugua

SEQ ID NO: 26782 - RNA, 19 nt, artificial
  Oligomer
cguaaaagucauauaccua

SEQ ID NO: 26783 - RNA, 19 nt, artificial
  Oligomer
ggaagcagauacauaugag

SEQ ID NO: 26784 - RNA, 19 nt, artificial
  Oligomer
ccuugcaacuucaugucaa

SEQ ID NO: 26785 - RNA, 19 nt, artificial
  Oligomer
cgcucaugacuguuucuuu

SEQ ID NO: 26786 - RNA, 19 nt, artificial
  Oligomer
ggaagaaggacucugcaua

SEQ ID NO: 26787 - RNA, 19 nt, artificial
  Oligomer
gcaaacuuggaauuuguaa

SEQ ID NO: 26788 - RNA, 19 nt, artificial
  Oligomer
cuuugacggacaagggaaa

SEQ ID NO: 26789 - RNA, 19 nt, artificial
  Oligomer
aggacauuuugaagguuuu

SEQ ID NO: 26790 - RNA, 19 nt, artificial
  Oligomer
gaagagaaagugauuucua

SEQ ID NO: 26791 - RNA, 19 nt, artificial
  Oligomer
ucaucaaugcuccugagaa

SEQ ID NO: 26792 - RNA, 19 nt, artificial
  Oligomer
ccuucagauggaaacucuu

SEQ ID NO: 26793 - RNA, 19 nt, artificial
  Oligomer
cccaggauguaucccaaga

SEQ ID NO: 26794 - RNA, 19 nt, artificial
  Oligomer
gaaauaacuccuucuugua

SEQ ID NO: 26795 - RNA, 19 nt, artificial
  Oligomer
gauuuuagguguugauuuu

SEQ ID NO: 26796 - RNA, 19 nt, artificial
  Oligomer
caguauuuugguucuuagu

SEQ ID NO: 26797 - RNA, 19 nt, artificial
  Oligomer
cuuggaauuuguaaccuca

SEQ ID NO: 26798 - RNA, 19 nt, artificial
  Oligomer
auuagagggagguguuuaa

SEQ ID NO: 26799 - RNA, 19 nt, artificial
  Oligomer
aagugugcuuuagcuugaa

SEQ ID NO: 26800 - RNA, 19 nt, artificial
  Oligomer
uuugcucauuaacagaaaa

SEQ ID NO: 26801 - RNA, 19 nt, artificial
  Oligomer
ugggcauuguaguuaauga

SEQ ID NO: 26802 - RNA, 19 nt, artificial
  Oligomer
gugugcuuuagcuugaaaa

SEQ ID NO: 26803 - RNA, 19 nt, artificial
  Oligomer
agagaugcuguaaugguaa

SEQ ID NO: 26804 - RNA, 19 nt, artificial
  Oligomer
gacuuaccaggaagcagau

SEQ ID NO: 26805 - RNA, 19 nt, artificial
  Oligomer
agaagaucauaaaggaauu

SEQ ID NO: 26806 - RNA, 19 nt, artificial
  Oligomer
ccugaaagucccagauuuu

SEQ ID NO: 26807 - RNA, 19 nt, artificial
  Oligomer
cagugacaguauuuugguu

SEQ ID NO: 26808 - RNA, 19 nt, artificial
  Oligomer
ccugaggacguggagaaaa

SEQ ID NO: 26809 - RNA, 19 nt, artificial
  Oligomer
gaagcagauacauaugagu

SEQ ID NO: 26810 - RNA, 19 nt, artificial
  Oligomer
gguggaaguacguuauugu

SEQ ID NO: 26811 - RNA, 19 nt, artificial
  Oligomer
ccucccuuggguucugaua

SEQ ID NO: 26812 - RNA, 19 nt, artificial
  Oligomer
ggagccuacguuuuuauua

SEQ ID NO: 26813 - RNA, 19 nt, artificial
  Oligomer
cacccuuugcggagauuau

SEQ ID NO: 26814 - RNA, 19 nt, artificial
  Oligomer
accaggaagcagauacaua

SEQ ID NO: 26815 - RNA, 19 nt, artificial
  Oligomer
cuuccugcuauccuacaaa

SEQ ID NO: 26816 - RNA, 19 nt, artificial
  Oligomer
aggcgcaauucaaugcuga

SEQ ID NO: 26817 - RNA, 19 nt, artificial
  Oligomer
cccugaaagucccagauuu

SEQ ID NO: 26818 - RNA, 19 nt, artificial
  Oligomer
cgguugaaaugcugauccu

SEQ ID NO: 26819 - RNA, 19 nt, artificial
  Oligomer
ccaggagaugaaagaugag

SEQ ID NO: 26820 - RNA, 19 nt, artificial
  Oligomer
gggugugguuaauacuauc

SEQ ID NO: 26821 - RNA, 19 nt, artificial
  Oligomer
gagcuuuuuucuuuaagau

SEQ ID NO: 26822 - RNA, 19 nt, artificial
  Oligomer
gagaaagugauuucuagaa

SEQ ID NO: 26823 - RNA, 19 nt, artificial
  Oligomer
ggagaugaaagaugagagu

SEQ ID NO: 26824 - RNA, 19 nt, artificial
  Oligomer
ggguucugauauugccgca

SEQ ID NO: 26825 - RNA, 19 nt, artificial
  Oligomer
acagaaaagaagaggagaa

SEQ ID NO: 26826 - RNA, 19 nt, artificial
  Oligomer
gucauauaccuauauaaua

SEQ ID NO: 26827 - RNA, 19 nt, artificial
  Oligomer
ccgacagcccaucaucauu

SEQ ID NO: 26828 - RNA, 19 nt, artificial
  Oligomer
aaucuaggauuauuaacua

SEQ ID NO: 26829 - RNA, 19 nt, artificial
  Oligomer
ggcuaucuuggucuuugua

SEQ ID NO: 26830 - RNA, 19 nt, artificial
  Oligomer
cucugguucuuuguuuuaa

SEQ ID NO: 26831 - RNA, 19 nt, artificial
  Oligomer
accucagacuuaccaggaa

SEQ ID NO: 26832 - RNA, 19 nt, artificial
  Oligomer
cuggguggaaguacguuau

SEQ ID NO: 26833 - RNA, 19 nt, artificial
  Oligomer
gagucaaugugcaguguag

SEQ ID NO: 26834 - RNA, 19 nt, artificial
  Oligomer
gaauguuuauagcaaacuu

SEQ ID NO: 26835 - RNA, 19 nt, artificial
  Oligomer
guuuauagcaaacuuggaa

SEQ ID NO: 26836 - RNA, 19 nt, artificial
  Oligomer
gcuacugauuuccuuugga

SEQ ID NO: 26837 - RNA, 19 nt, artificial
  Oligomer
aaagaagaggagaaugcua

SEQ ID NO: 26838 - RNA, 19 nt, artificial
  Oligomer
gcuguaaugguaagacuuu

SEQ ID NO: 26839 - RNA, 19 nt, artificial
  Oligomer
ccaauaaaccagguuuaga

SEQ ID NO: 26840 - RNA, 19 nt, artificial
  Oligomer
ccaccaaugucuaagucgu

SEQ ID NO: 26841 - RNA, 19 nt, artificial
  Oligomer
uucuauuacucaacaggaa

SEQ ID NO: 26842 - RNA, 19 nt, artificial
  Oligomer
caaagugcagcccuuccau

SEQ ID NO: 26843 - RNA, 19 nt, artificial
  Oligomer
uaguaguacuugaaaucua

SEQ ID NO: 26844 - RNA, 19 nt, artificial
  Oligomer
ucauaaaggaauuuaucaa

SEQ ID NO: 26845 - RNA, 19 nt, artificial
  Oligomer
agacauccaggagaugaaa

SEQ ID NO: 26846 - RNA, 19 nt, artificial
  Oligomer
agaaagugauuucuagaaa

SEQ ID NO: 26847 - RNA, 19 nt, artificial
  Oligomer
cuacaaucggcucuuucca

SEQ ID NO: 26848 - RNA, 19 nt, artificial
  Oligomer
uuuccauauggauuuucua

SEQ ID NO: 26849 - RNA, 19 nt, artificial
  Oligomer
ggagaggauuuuuuucuga

SEQ ID NO: 26850 - RNA, 19 nt, artificial
  Oligomer
uguuuauagcaaacuugga

SEQ ID NO: 26851 - RNA, 19 nt, artificial
  Oligomer
gguuuguuggaucuucaau

SEQ ID NO: 26852 - RNA, 19 nt, artificial
  Oligomer
ggaugcagguguucaagag

SEQ ID NO: 26853 - RNA, 19 nt, artificial
  Oligomer
gaaaaagcuguuucuggaa

SEQ ID NO: 26854 - RNA, 19 nt, artificial
  Oligomer
gcauaugauaggccuugga

SEQ ID NO: 26855 - RNA, 19 nt, artificial
  Oligomer
uaaaaauucugaauguaca

SEQ ID NO: 26856 - RNA, 19 nt, artificial
  Oligomer
ccuuccauuuugcccugaa

SEQ ID NO: 26857 - RNA, 19 nt, artificial
  Oligomer
uuuugcucauuaacagaaa

SEQ ID NO: 26858 - RNA, 19 nt, artificial
  Oligomer
uaaggagaccaccaccaau

SEQ ID NO: 26859 - RNA, 19 nt, artificial
  Oligomer
cacuguaguuucucuauuu

SEQ ID NO: 26860 - RNA, 19 nt, artificial
  Oligomer
auccaaauaagaaaccuaa

SEQ ID NO: 26861 - RNA, 19 nt, artificial
  Oligomer
ccauguacauuggagagau

SEQ ID NO: 26862 - RNA, 19 nt, artificial
  Oligomer
aaagagagguuauagagua

SEQ ID NO: 26863 - RNA, 19 nt, artificial
  Oligomer
aggagauuuuagguguuga

SEQ ID NO: 26864 - RNA, 19 nt, artificial
  Oligomer
agcaaacuuggaauuugua

SEQ ID NO: 26865 - RNA, 19 nt, artificial
  Oligomer
uccugaggacguggagaaa

SEQ ID NO: 26866 - RNA, 19 nt, artificial
  Oligomer
gaagccggaggguguuuau

SEQ ID NO: 26867 - RNA, 19 nt, artificial
  Oligomer
acguuauuguugacuuauu

SEQ ID NO: 26868 - RNA, 19 nt, artificial
  Oligomer
augaaagaugagagugcaa

SEQ ID NO: 26869 - RNA, 19 nt, artificial
  Oligomer
uucugauauugccgcacua

SEQ ID NO: 26870 - RNA, 19 nt, artificial
  Oligomer
caagugugcuuuagcuuga

SEQ ID NO: 26871 - RNA, 19 nt, artificial
  Oligomer
uccuggagccuuugaauaa

SEQ ID NO: 26872 - RNA, 19 nt, artificial
  Oligomer
gugaauauuuccauaugga

SEQ ID NO: 26873 - RNA, 19 nt, artificial
  Oligomer
agagaaagugauuucuaga

SEQ ID NO: 26874 - RNA, 19 nt, artificial
  Oligomer
aaggauaacuauaauggga

SEQ ID NO: 26875 - RNA, 19 nt, artificial
  Oligomer
ugcucauuaacagaaaaga

SEQ ID NO: 26876 - RNA, 19 nt, artificial
  Oligomer
gagaaaacuugcugcugag

SEQ ID NO: 26877 - RNA, 19 nt, artificial
  Oligomer
gcuucugaaugcugcuacu

SEQ ID NO: 26878 - RNA, 19 nt, artificial
  Oligomer
ccaucaucauuuccauugu

SEQ ID NO: 26879 - RNA, 19 nt, artificial
  Oligomer
agucaugaucccagcgaga

SEQ ID NO: 26880 - RNA, 19 nt, artificial
  Oligomer
caaauaagaaaccuaaaau

SEQ ID NO: 26881 - RNA, 19 nt, artificial
  Oligomer
gacuguuucuuuguuauua

SEQ ID NO: 26882 - RNA, 19 nt, artificial
  Oligomer
uguucaagagcccaucuau

SEQ ID NO: 26883 - RNA, 19 nt, artificial
  Oligomer
caugacuguuucuuuguua

SEQ ID NO: 26884 - RNA, 19 nt, artificial
  Oligomer
uauaggagaggaaaaguaa

SEQ ID NO: 26885 - RNA, 19 nt, artificial
  Oligomer
agauuuuugcucauuaaca

SEQ ID NO: 26886 - RNA, 19 nt, artificial
  Oligomer
ccacacuugagaggaugaa

SEQ ID NO: 26887 - RNA, 19 nt, artificial
  Oligomer
ggaauuuaucaauaaaacu

SEQ ID NO: 26888 - RNA, 19 nt, artificial
  Oligomer
gcaccuuccucacuuccau

SEQ ID NO: 26889 - RNA, 19 nt, artificial
  Oligomer
uaccgacagcccaucauca

SEQ ID NO: 26890 - RNA, 19 nt, artificial
  Oligomer
acugugguccuaugccgaa

SEQ ID NO: 26891 - RNA, 19 nt, artificial
  Oligomer
gguuuugugcccauguaca

SEQ ID NO: 26892 - RNA, 19 nt, artificial
  Oligomer
gguuauagaguagaagauu

SEQ ID NO: 26893 - RNA, 19 nt, artificial
  Oligomer
uaaugguaagacuuuggau

SEQ ID NO: 26894 - RNA, 19 nt, artificial
  Oligomer
ugcaaggaugucacaagaa

SEQ ID NO: 26895 - RNA, 19 nt, artificial
  Oligomer
gcgucauggagaugaacag

SEQ ID NO: 26896 - RNA, 19 nt, artificial
  Oligomer
cuguuguauuuuaacucau

SEQ ID NO: 26897 - RNA, 19 nt, artificial
  Oligomer
agaggaaaaguaaggugca

SEQ ID NO: 26898 - RNA, 19 nt, artificial
  Oligomer
uauggauuuucuauuguua

SEQ ID NO: 26899 - RNA, 19 nt, artificial
  Oligomer
ugcggagauuauaaauagu

SEQ ID NO: 26900 - RNA, 19 nt, artificial
  Oligomer
gacucuucgucaaccgcuu

SEQ ID NO: 26901 - RNA, 19 nt, artificial
  Oligomer
caggaagcagauacauaug

SEQ ID NO: 26902 - RNA, 19 nt, artificial
  Oligomer
gaggagaaugcuaagcaga

SEQ ID NO: 26903 - RNA, 19 nt, artificial
  Oligomer
ggguaugaucggcuccuuu

SEQ ID NO: 26904 - RNA, 19 nt, artificial
  Oligomer
uuaccaggaagcagauaca

SEQ ID NO: 26905 - RNA, 19 nt, artificial
  Oligomer
guaaugguaagacuuugga

SEQ ID NO: 26906 - RNA, 19 nt, artificial
  Oligomer
cuucaaggaugcagguguu

SEQ ID NO: 26907 - RNA, 19 nt, artificial
  Oligomer
uacucaacaggaaucuuca

SEQ ID NO: 26908 - RNA, 19 nt, artificial
  Oligomer
aagaagaggagaaugcuaa

SEQ ID NO: 26909 - RNA, 19 nt, artificial
  Oligomer
agucgguugaaaugcugau

SEQ ID NO: 26910 - RNA, 19 nt, artificial
  Oligomer
gacuugaaucuuuccaaua

SEQ ID NO: 26911 - RNA, 19 nt, artificial
  Oligomer
ucacugagaagauugugaa

SEQ ID NO: 26912 - RNA, 19 nt, artificial
  Oligomer
aggagaaugcuaagcagau

SEQ ID NO: 26913 - RNA, 19 nt, artificial
  Oligomer
gagugcaaggaugucacaa

SEQ ID NO: 26914 - RNA, 19 nt, artificial
  Oligomer
aaagcaagucaccgugcua

SEQ ID NO: 26915 - RNA, 19 nt, artificial
  Oligomer
caucaggaugaacccagga

SEQ ID NO: 26916 - RNA, 19 nt, artificial
  Oligomer
uaucacacgggccuuugaa

SEQ ID NO: 26917 - RNA, 19 nt, artificial
  Oligomer
gacaguauuuugguucuua

SEQ ID NO: 26918 - RNA, 19 nt, artificial
  Oligomer
gaaagugauuucuagaaag

SEQ ID NO: 26919 - RNA, 19 nt, artificial
  Oligomer
agacuugaauuagauuaca

SEQ ID NO: 26920 - RNA, 19 nt, artificial
  Oligomer
agucauauaccuauauaau

SEQ ID NO: 26921 - RNA, 19 nt, artificial
  Oligomer
uguucuuuaggagauuuua

SEQ ID NO: 26922 - RNA, 19 nt, artificial
  Oligomer
uagcuaagucgguugaaau

SEQ ID NO: 26923 - RNA, 19 nt, artificial
  Oligomer
caauaagaauuuagggaga

SEQ ID NO: 26924 - RNA, 19 nt, artificial
  Oligomer
guggaaguacguuauuguu

SEQ ID NO: 26925 - RNA, 19 nt, artificial
  Oligomer
agagugcaaggaugucaca

SEQ ID NO: 26926 - RNA, 19 nt, artificial
  Oligomer
aaugcuccugagaagauca

SEQ ID NO: 26927 - RNA, 19 nt, artificial
  Oligomer
agaggagaaugcuaagcag

SEQ ID NO: 26928 - RNA, 19 nt, artificial
  Oligomer
ugcuccuggagccuuugaa

SEQ ID NO: 26929 - RNA, 19 nt, artificial
  Oligomer
cauuauuuuuccacuuugu

SEQ ID NO: 26930 - RNA, 19 nt, artificial
  Oligomer
agacuuaccaggaagcaga

SEQ ID NO: 26931 - RNA, 19 nt, artificial
  Oligomer
gauuuuugcucauuaacag

SEQ ID NO: 26932 - RNA, 19 nt, artificial
  Oligomer
ugcugauugucaaccuguu

SEQ ID NO: 26933 - RNA, 19 nt, artificial
  Oligomer
aacucauaccuuuaaagga

SEQ ID NO: 26934 - RNA, 19 nt, artificial
  Oligomer
ccaacuuccuagucggauu

SEQ ID NO: 26935 - RNA, 19 nt, artificial
  Oligomer
cuggagagguuaaggugca

SEQ ID NO: 26936 - RNA, 19 nt, artificial
  Oligomer
aaggcugcgguuuguugga

SEQ ID NO: 26937 - RNA, 19 nt, artificial
  Oligomer
gucccagauuuuugcucau

SEQ ID NO: 26938 - RNA, 19 nt, artificial
  Oligomer
ucauuaacagaaaagaaga

SEQ ID NO: 26939 - RNA, 19 nt, artificial
  Oligomer
ucccauuucucacugagaa

SEQ ID NO: 26940 - RNA, 19 nt, artificial
  Oligomer
gaaaacuugcugcugagaa

SEQ ID NO: 26941 - RNA, 19 nt, artificial
  Oligomer
cagaaaagaagaggagaau

SEQ ID NO: 26942 - RNA, 19 nt, artificial
  Oligomer
ggcgucauggagaugaaca

SEQ ID NO: 26943 - RNA, 19 nt, artificial
  Oligomer
gguugauggguucuaauuu

SEQ ID NO: 26944 - RNA, 19 nt, artificial
  Oligomer
aacuaauaugggcauugua

SEQ ID NO: 26945 - RNA, 19 nt, artificial
  Oligomer
gaauuuagggagaaauguu

SEQ ID NO: 26946 - RNA, 19 nt, artificial
  Oligomer
aguaguacuugaaaucuag

SEQ ID NO: 26947 - RNA, 19 nt, artificial
  Oligomer
uccaggagaugaaagauga

SEQ ID NO: 26948 - RNA, 19 nt, artificial
  Oligomer
accgacagcccaucaucau

SEQ ID NO: 26949 - RNA, 19 nt, artificial
  Oligomer
agugugcuuuagcuugaaa

SEQ ID NO: 26950 - RNA, 19 nt, artificial
  Oligomer
gcuuuuuguuccacgcuca

SEQ ID NO: 26951 - RNA, 19 nt, artificial
  Oligomer
auauaauaaagcuacugau

SEQ ID NO: 26952 - RNA, 19 nt, artificial
  Oligomer
uguuauuaaaggauaacua

SEQ ID NO: 26953 - RNA, 19 nt, artificial
  Oligomer
ggagaugaacagcaucgag

SEQ ID NO: 26954 - RNA, 19 nt, artificial
  Oligomer
acucuuuaacuucucguaa

SEQ ID NO: 26955 - RNA, 19 nt, artificial
  Oligomer
cugcuacuggguuuuacca

SEQ ID NO: 26956 - RNA, 19 nt, artificial
  Oligomer
aggaagcagauacauauga

SEQ ID NO: 26957 - RNA, 19 nt, artificial
  Oligomer
guucuauuacucaacagga

SEQ ID NO: 26958 - RNA, 19 nt, artificial
  Oligomer
caauuucuguccuucagau

SEQ ID NO: 26959 - RNA, 19 nt, artificial
  Oligomer
cugugguccuaugccgaau

SEQ ID NO: 26960 - RNA, 19 nt, artificial
  Oligomer
cuacuuaauuccuuucuca

SEQ ID NO: 26961 - RNA, 19 nt, artificial
  Oligomer
aaggacucugcauaugaua

SEQ ID NO: 26962 - RNA, 19 nt, artificial
  Oligomer
ugcuguaaugguaagacuu

SEQ ID NO: 26963 - RNA, 19 nt, artificial
  Oligomer
caaugugcaguguagccca

SEQ ID NO: 26964 - RNA, 19 nt, artificial
  Oligomer
agguuauagaguagaagau

SEQ ID NO: 26965 - RNA, 19 nt, artificial
  Oligomer
ccuauauaauaaagcuacu

SEQ ID NO: 26966 - RNA, 19 nt, artificial
  Oligomer
ccaccaccaaugucuaagu

SEQ ID NO: 26967 - RNA, 19 nt, artificial
  Oligomer
auaugggcauuguaguuaa

SEQ ID NO: 26968 - RNA, 19 nt, artificial
  Oligomer
agcuaucaagugugcuuua

SEQ ID NO: 26969 - RNA, 19 nt, artificial
  Oligomer
aucuaggauuauuaacuaa

SEQ ID NO: 26970 - RNA, 19 nt, artificial
  Oligomer
aaaccagguuuagacagua

SEQ ID NO: 26971 - RNA, 19 nt, artificial
  Oligomer
gaaccuaccuucauuucag

SEQ ID NO: 26972 - RNA, 19 nt, artificial
  Oligomer
ggacauccucuucugcuua

SEQ ID NO: 26973 - RNA, 19 nt, artificial
  Oligomer
cgcuugcguaugucuguua

SEQ ID NO: 26974 - RNA, 19 nt, artificial
  Oligomer
ggcugaaaaagcuguuucu

SEQ ID NO: 26975 - RNA, 19 nt, artificial
  Oligomer
cggacucugcacagguuuu

SEQ ID NO: 26976 - RNA, 19 nt, artificial
  Oligomer
gagguuaaggugcaauaag

SEQ ID NO: 26977 - RNA, 19 nt, artificial
  Oligomer
agaaggacucugcauauga

SEQ ID NO: 26978 - RNA, 19 nt, artificial
  Oligomer
ugaaaaggugaccuugcaa

SEQ ID NO: 26979 - RNA, 19 nt, artificial
  Oligomer
acauuuugaagguuuuguu

SEQ ID NO: 26980 - RNA, 19 nt, artificial
  Oligomer
cuccuggagccuuugaaua

SEQ ID NO: 26981 - RNA, 19 nt, artificial
  Oligomer
ugaaaaagcuguuucugga

SEQ ID NO: 26982 - RNA, 19 nt, artificial
  Oligomer
gggaugagcuuugucugua

SEQ ID NO: 26983 - RNA, 19 nt, artificial
  Oligomer
ucucauuacuuuugaagua

SEQ ID NO: 26984 - RNA, 19 nt, artificial
  Oligomer
uagcaaacuuggaauuugu

SEQ ID NO: 26985 - RNA, 19 nt, artificial
  Oligomer
ggaugaaauaacuccuucu

SEQ ID NO: 26986 - RNA, 19 nt, artificial
  Oligomer
caagggagagaccucauca

SEQ ID NO: 26987 - RNA, 19 nt, artificial
  Oligomer
cucuauuucugguggaaag

SEQ ID NO: 26988 - RNA, 19 nt, artificial
  Oligomer
uggagaugaacagcaucga

SEQ ID NO: 26989 - RNA, 19 nt, artificial
  Oligomer
cugaggacguggagaaaac

SEQ ID NO: 26990 - RNA, 19 nt, artificial
  Oligomer
cauuguaguuaaugauggu

SEQ ID NO: 26991 - RNA, 19 nt, artificial
  Oligomer
gagggagguguuuaaagag

SEQ ID NO: 26992 - RNA, 19 nt, artificial
  Oligomer
cucauuacuuuugaaguaa

SEQ ID NO: 26993 - RNA, 19 nt, artificial
  Oligomer
uagaagauuugaugcugga

SEQ ID NO: 26994 - RNA, 19 nt, artificial
  Oligomer
aggagaccaccaccaaugu

SEQ ID NO: 26995 - RNA, 19 nt, artificial
  Oligomer
cagauagaucuggaaagga

SEQ ID NO: 26996 - RNA, 19 nt, artificial
  Oligomer
cugaaugcugcuacuuaau

SEQ ID NO: 26997 - RNA, 19 nt, artificial
  Oligomer
gagauucauuauuuuucca

SEQ ID NO: 26998 - RNA, 19 nt, artificial
  Oligomer
gcaauucaaugcugauugu

SEQ ID NO: 26999 - RNA, 19 nt, artificial
  Oligomer
cuaagucgguugaaaugcu

SEQ ID NO: 27000 - RNA, 19 nt, artificial
  Oligomer
cuuucuugaagacuugaau

SEQ ID NO: 27001 - RNA, 19 nt, artificial
  Oligomer
acccaggacgcuucugaau

SEQ ID NO: 27002 - RNA, 19 nt, artificial
  Oligomer
gaagauuugaugcuggaga

SEQ ID NO: 27003 - RNA, 19 nt, artificial
  Oligomer
ugguagagauucauuauuu

SEQ ID NO: 27004 - RNA, 19 nt, artificial
  Oligomer
uauagaguagaagauuuga

SEQ ID NO: 27005 - RNA, 19 nt, artificial
  Oligomer
guguuuaaagagagguuau

SEQ ID NO: 27006 - RNA, 19 nt, artificial
  Oligomer
guuauuaaaggauaacuau

SEQ ID NO: 27007 - RNA, 19 nt, artificial
  Oligomer
uguugauuuucuguuguau

SEQ ID NO: 27008 - RNA, 19 nt, artificial
  Oligomer
cccuugucagugacaguau

SEQ ID NO: 27009 - RNA, 19 nt, artificial
  Oligomer
cacuugagaggaugaaugu

SEQ ID NO: 27010 - RNA, 19 nt, artificial
  Oligomer
ggucuguacguuaccucuu

SEQ ID NO: 27011 - RNA, 19 nt, artificial
  Oligomer
ggaccuccaacuuccuagu

SEQ ID NO: 27012 - RNA, 19 nt, artificial
  Oligomer
gguuaauacuaucuucacu

SEQ ID NO: 27013 - RNA, 19 nt, artificial
  Oligomer
gagagaccgagugaaccua

SEQ ID NO: 27014 - RNA, 19 nt, artificial
  Oligomer
cucauaccuuuaaaggaau

SEQ ID NO: 27015 - RNA, 19 nt, artificial
  Oligomer
acuucucguaaaagucaua

SEQ ID NO: 27016 - RNA, 19 nt, artificial
  Oligomer
gggucccauuucucacuga

SEQ ID NO: 27017 - RNA, 19 nt, artificial
  Oligomer
ugagcgauuauuaucuaaa

SEQ ID NO: 27018 - RNA, 19 nt, artificial
  Oligomer
gaagacuugaauuagauua

SEQ ID NO: 27019 - RNA, 19 nt, artificial
  Oligomer
guugauggguucuaauuuu

SEQ ID NO: 27020 - RNA, 19 nt, artificial
  Oligomer
cgacagcccaucaucauuu

SEQ ID NO: 27021 - RNA, 19 nt, artificial
  Oligomer
agaugagagugcaaggaug

SEQ ID NO: 27022 - RNA, 19 nt, artificial
  Oligomer
gcaucguuguuggaauucu

SEQ ID NO: 27023 - RNA, 19 nt, artificial
  Oligomer
ccgugcuagagcucuuuag

SEQ ID NO: 27024 - RNA, 19 nt, artificial
  Oligomer
cacgcuugcguaugucugu

SEQ ID NO: 27025 - RNA, 19 nt, artificial
  Oligomer
aggaugcagguguucaaga

SEQ ID NO: 27026 - RNA, 19 nt, artificial
  Oligomer
gguaagacuuuggauccuu

SEQ ID NO: 27027 - RNA, 19 nt, artificial
  Oligomer
cacuuugcucuggguggaa

SEQ ID NO: 27028 - RNA, 19 nt, artificial
  Oligomer
auaaaacuuugacggacaa

SEQ ID NO: 27029 - RNA, 19 nt, artificial
  Oligomer
gguucuuaguucucacugu

SEQ ID NO: 27030 - RNA, 19 nt, artificial
  Oligomer
ggugaccuugcaacuucau

SEQ ID NO: 27031 - RNA, 19 nt, artificial
  Oligomer
guuauagaguagaagauuu

SEQ ID NO: 27032 - RNA, 19 nt, artificial
  Oligomer
ggacguggagaaaacuugc

SEQ ID NO: 27033 - RNA, 19 nt, artificial
  Oligomer
uuggauggaguccagggaa

SEQ ID NO: 27034 - RNA, 19 nt, artificial
  Oligomer
caaucggcucuuuccaauu

SEQ ID NO: 27035 - RNA, 19 nt, artificial
  Oligomer
ccgcugcuacuggguuuua

SEQ ID NO: 27036 - RNA, 19 nt, artificial
  Oligomer
cgcugcuacuggguuuuac

SEQ ID NO: 27037 - RNA, 19 nt, artificial
  Oligomer
gacccagagaugcuguaau

SEQ ID NO: 27038 - RNA, 19 nt, artificial
  Oligomer
gaggguaaaugauguggug

SEQ ID NO: 27039 - RNA, 19 nt, artificial
  Oligomer
guagucucauuacuuuuga

SEQ ID NO: 27040 - RNA, 19 nt, artificial
  Oligomer
ccaacuggaccuccaacuu

SEQ ID NO: 27041 - RNA, 19 nt, artificial
  Oligomer
ccuucuucaaagucccuga

SEQ ID NO: 27042 - RNA, 19 nt, artificial
  Oligomer
ucccuuggguucugauauu

SEQ ID NO: 27043 - RNA, 19 nt, artificial
  Oligomer
ucauuacuuuugaaguaau

SEQ ID NO: 27044 - RNA, 19 nt, artificial
  Oligomer
cccaagacauccaggagau

SEQ ID NO: 27045 - RNA, 19 nt, artificial
  Oligomer
guugauuuucuguuguauu

SEQ ID NO: 27046 - RNA, 19 nt, artificial
  Oligomer
aaggugcaauaagaauuua

SEQ ID NO: 27047 - RNA, 19 nt, artificial
  Oligomer
ugaauuagauuacagcgau

SEQ ID NO: 27048 - RNA, 19 nt, artificial
  Oligomer
ggaugaauguaugugcacu

SEQ ID NO: 27049 - RNA, 19 nt, artificial
  Oligomer
auaagaauuuagggagaaa

SEQ ID NO: 27050 - RNA, 19 nt, artificial
  Oligomer
ugcuccugagaagaucaua

SEQ ID NO: 27051 - RNA, 19 nt, artificial
  Oligomer
gaaagaugagagugcaagg

SEQ ID NO: 27052 - RNA, 19 nt, artificial
  Oligomer
acuugagaggaugaaugua

SEQ ID NO: 27053 - RNA, 19 nt, artificial
  Oligomer
uuuaacucauaccuuuaaa

SEQ ID NO: 27054 - RNA, 19 nt, artificial
  Oligomer
agaagaggagaaugcuaag

SEQ ID NO: 27055 - RNA, 19 nt, artificial
  Oligomer
uguuuaaagagagguuaua

SEQ ID NO: 27056 - RNA, 19 nt, artificial
  Oligomer
uugaagacuugaauuagau

SEQ ID NO: 27057 - RNA, 19 nt, artificial
  Oligomer
gugcagauagaucuggaaa

SEQ ID NO: 27058 - RNA, 19 nt, artificial
  Oligomer
uacaaucggcucuuuccaa

SEQ ID NO: 27059 - RNA, 19 nt, artificial
  Oligomer
cauaaaggaauuuaucaau

SEQ ID NO: 27060 - RNA, 19 nt, artificial
  Oligomer
caggagaugaaagaugaga

SEQ ID NO: 27061 - RNA, 19 nt, artificial
  Oligomer
ucuuuggucuggaauucau

SEQ ID NO: 27062 - RNA, 19 nt, artificial
  Oligomer
uacguuaccucuuaacaau

SEQ ID NO: 27063 - RNA, 19 nt, artificial
  Oligomer
auugguucuugguagagau

SEQ ID NO: 27064 - RNA, 19 nt, artificial
  Oligomer
aggucuguacguuaccucu

SEQ ID NO: 27065 - RNA, 19 nt, artificial
  Oligomer
gagagugcaaggaugucac

SEQ ID NO: 27066 - RNA, 19 nt, artificial
  Oligomer
aaagucauauaccuauaua

SEQ ID NO: 27067 - RNA, 19 nt, artificial
  Oligomer
ugagaagauugugaauauu

SEQ ID NO: 27068 - RNA, 19 nt, artificial
  Oligomer
acaguauuuugguucuuag

SEQ ID NO: 27069 - RNA, 19 nt, artificial
  Oligomer
ggaggguaaaugauguggu

SEQ ID NO: 27070 - RNA, 19 nt, artificial
  Oligomer
cacacuugagaggaugaau

SEQ ID NO: 27071 - RNA, 19 nt, artificial
  Oligomer
gaggacguggagaaaacuu

SEQ ID NO: 27072 - RNA, 19 nt, artificial
  Oligomer
cuccaacuuccuagucgga

SEQ ID NO: 27073 - RNA, 19 nt, artificial
  Oligomer
gcguaugucuguuaccaug

SEQ ID NO: 27074 - RNA, 19 nt, artificial
  Oligomer
ucauggagaugaacagcau

SEQ ID NO: 27075 - RNA, 19 nt, artificial
  Oligomer
ggcaggacuuuugaggaua

SEQ ID NO: 27076 - RNA, 19 nt, artificial
  Oligomer
cucccuuggguucugauau

SEQ ID NO: 27077 - RNA, 19 nt, artificial
  Oligomer
auaucacacgggccuuuga

SEQ ID NO: 27078 - RNA, 19 nt, artificial
  Oligomer
gggagguguuuaaagagag

SEQ ID NO: 27079 - RNA, 19 nt, artificial
  Oligomer
ggucuuuguagccuucuuu

SEQ ID NO: 27080 - RNA, 19 nt, artificial
  Oligomer
uuaggagccuacguuuuua

SEQ ID NO: 27081 - RNA, 19 nt, artificial
  Oligomer
aauguuguucauuauugga

SEQ ID NO: 27082 - RNA, 19 nt, artificial
  Oligomer
gguguuuaaagagagguua

SEQ ID NO: 27083 - RNA, 19 nt, artificial
  Oligomer
aggaauuuaucaauaaaac

SEQ ID NO: 27084 - RNA, 19 nt, artificial
  Oligomer
agggagguguuuaaagaga

SEQ ID NO: 27085 - RNA, 19 nt, artificial
  Oligomer
uggucuuuguagccuucuu

SEQ ID NO: 27086 - RNA, 19 nt, artificial
  Oligomer
agcuuuuuucuuuaagaua

SEQ ID NO: 27087 - RNA, 19 nt, artificial
  Oligomer
uugaaaucuaggauuauua

SEQ ID NO: 27088 - RNA, 19 nt, artificial
  Oligomer
uagggagaaauguuguuca

SEQ ID NO: 27089 - RNA, 19 nt, artificial
  Oligomer
guaguagucucauuacuuu

SEQ ID NO: 27090 - RNA, 19 nt, artificial
  Oligomer
ccuacaaagugcagcccuu

SEQ ID NO: 27091 - RNA, 19 nt, artificial
  Oligomer
agaaggaaauugagauuag

SEQ ID NO: 27092 - RNA, 19 nt, artificial
  Oligomer
cuugaaaucuaggauuauu

SEQ ID NO: 27093 - RNA, 19 nt, artificial
  Oligomer
cggaggguguuuauguaag

SEQ ID NO: 27094 - RNA, 19 nt, artificial
  Oligomer
cagcccaucaucauuucca

SEQ ID NO: 27095 - RNA, 19 nt, artificial
  Oligomer
uuaaugagcaaaaaucugg

SEQ ID NO: 27096 - RNA, 19 nt, artificial
  Oligomer
uugaacaccugcauccuug

SEQ ID NO: 27097 - RNA, 19 nt, artificial
  Oligomer
uugaagauccaacaaaccg

SEQ ID NO: 27098 - RNA, 19 nt, artificial
  Oligomer
uuuucuugugacauccuug

SEQ ID NO: 27099 - RNA, 19 nt, artificial
  Oligomer
uucuuuucuguuaaugagc

SEQ ID NO: 27100 - RNA, 19 nt, artificial
  Oligomer
uuuauuggaaagauucaag

SEQ ID NO: 27101 - RNA, 19 nt, artificial
  Oligomer
uuucuugugacauccuugc

SEQ ID NO: 27102 - RNA, 19 nt, artificial
  Oligomer
uucaucuccaugacgccgu

SEQ ID NO: 27103 - RNA, 19 nt, artificial
  Oligomer
ugacuauuuauaaucuccg

SEQ ID NO: 27104 - RNA, 19 nt, artificial
  Oligomer
uucuuauugcaccuuaacc

SEQ ID NO: 27105 - RNA, 19 nt, artificial
  Oligomer
auauguaucugcuuccugg

SEQ ID NO: 27106 - RNA, 19 nt, artificial
  Oligomer
uuuauucaaaggcuccagg

SEQ ID NO: 27107 - RNA, 19 nt, artificial
  Oligomer
uucaaaauguccuucucag

SEQ ID NO: 27108 - RNA, 19 nt, artificial
  Oligomer
uugggauacauccugggug

SEQ ID NO: 27109 - RNA, 19 nt, artificial
  Oligomer
uucagaagcguccuggguu

SEQ ID NO: 27110 - RNA, 19 nt, artificial
  Oligomer
ucuaaucucaauuuccuuc

SEQ ID NO: 27111 - RNA, 19 nt, artificial
  Oligomer
uucuacucuauaaccucuc

SEQ ID NO: 27112 - RNA, 19 nt, artificial
  Oligomer
uuuuauucaaaggcuccag

SEQ ID NO: 27113 - RNA, 19 nt, artificial
  Oligomer
uauuaguuaauaauccuag

SEQ ID NO: 27114 - RNA, 19 nt, artificial
  Oligomer
uacauaaacacccuccggc

SEQ ID NO: 27115 - RNA, 19 nt, artificial
  Oligomer
uauuuuaaaacaaagaacc

SEQ ID NO: 27116 - RNA, 19 nt, artificial
  Oligomer
uuuuccucuccuauauccc

SEQ ID NO: 27117 - RNA, 19 nt, artificial
  Oligomer
uuuaauaacaaagaaacag

SEQ ID NO: 27118 - RNA, 19 nt, artificial
  Oligomer
ugaagauccaacaaaccgc

SEQ ID NO: 27119 - RNA, 19 nt, artificial
  Oligomer
uuuaaaacaaagaaccaga

SEQ ID NO: 27120 - RNA, 19 nt, artificial
  Oligomer
uuuuaaaacaaagaaccag

SEQ ID NO: 27121 - RNA, 19 nt, artificial
  Oligomer
uaagucaacaauaacguac

SEQ ID NO: 27122 - RNA, 19 nt, artificial
  Oligomer
aucauaugcagaguccuuc

SEQ ID NO: 27123 - RNA, 19 nt, artificial
  Oligomer
uuggaaagauucaaguccc

SEQ ID NO: 27124 - RNA, 19 nt, artificial
  Oligomer
ucaacaauaacguacuucc

SEQ ID NO: 27125 - RNA, 19 nt, artificial
  Oligomer
uuucucuucccuggacucc

SEQ ID NO: 27126 - RNA, 19 nt, artificial
  Oligomer
uaccauuacagcaucucug

SEQ ID NO: 27127 - RNA, 19 nt, artificial
  Oligomer
ucuuacauaaacacccucc

SEQ ID NO: 27128 - RNA, 19 nt, artificial
  Oligomer
uccuuuaugaucuucucag

SEQ ID NO: 27129 - RNA, 19 nt, artificial
  Oligomer
uaaugaacaacauuucucc

SEQ ID NO: 27130 - RNA, 19 nt, artificial
  Oligomer
uuguuaagagguaacguac

SEQ ID NO: 27131 - RNA, 19 nt, artificial
  Oligomer
uuuuuauucaaaggcucca

SEQ ID NO: 27132 - RNA, 19 nt, artificial
  Oligomer
uuaugaucuucucaggagc

SEQ ID NO: 27133 - RNA, 19 nt, artificial
  Oligomer
ucuaaagagcucuagcacg

SEQ ID NO: 27134 - RNA, 19 nt, artificial
  Oligomer
uuauccuuuaauaacaaag

SEQ ID NO: 27135 - RNA, 19 nt, artificial
  Oligomer
uuagaacccaucaaccauc

SEQ ID NO: 27136 - RNA, 19 nt, artificial
  Oligomer
aaauaagucaacaauaacg

SEQ ID NO: 27137 - RNA, 19 nt, artificial
  Oligomer
aucaacaccuaaaaucucc

SEQ ID NO: 27138 - RNA, 19 nt, artificial
  Oligomer
uuuacgagaaguuaaagag

SEQ ID NO: 27139 - RNA, 19 nt, artificial
  Oligomer
auacagacaaagcucaucc

SEQ ID NO: 27140 - RNA, 19 nt, artificial
  Oligomer
auaguauuaaccacacccg

SEQ ID NO: 27141 - RNA, 19 nt, artificial
  Oligomer
aaaauaaugaaucucuacc

SEQ ID NO: 27142 - RNA, 19 nt, artificial
  Oligomer
uucuguuuuuauuauuugg

SEQ ID NO: 27143 - RNA, 19 nt, artificial
  Oligomer
ucauacugucuaaaccugg

SEQ ID NO: 27144 - RNA, 19 nt, artificial
  Oligomer
auuuuuauucaaaggcucc

SEQ ID NO: 27145 - RNA, 19 nt, artificial
  Oligomer
uuuuagguuucuuauuugg

SEQ ID NO: 27146 - RNA, 19 nt, artificial
  Oligomer
uuucagggcaaaauggaag

SEQ ID NO: 27147 - RNA, 19 nt, artificial
  Oligomer
ucuuauugcaccuuaaccu

SEQ ID NO: 27148 - RNA, 19 nt, artificial
  Oligomer
ugacagugcacauacauuc

SEQ ID NO: 27149 - RNA, 19 nt, artificial
  Oligomer
auaaugaacaacauuucuc

SEQ ID NO: 27150 - RNA, 19 nt, artificial
  Oligomer
aucagcauugaauugcgcc

SEQ ID NO: 27151 - RNA, 19 nt, artificial
  Oligomer
uuccagaucuaucugcacc

SEQ ID NO: 27152 - RNA, 19 nt, artificial
  Oligomer
ucuuaaagaaaaaagcucc

SEQ ID NO: 27153 - RNA, 19 nt, artificial
  Oligomer
ugaaucucuaccaagaacc

SEQ ID NO: 27154 - RNA, 19 nt, artificial
  Oligomer
uccagaucuaucugcaccg

SEQ ID NO: 27155 - RNA, 19 nt, artificial
  Oligomer
uuuaugaucuucucaggag

SEQ ID NO: 27156 - RNA, 19 nt, artificial
  Oligomer
ucuaauucaagucuucaag

SEQ ID NO: 27157 - RNA, 19 nt, artificial
  Oligomer
uucaaagaaggcuacaaag

SEQ ID NO: 27158 - RNA, 19 nt, artificial
  Oligomer
uucucuucccuggacucca

SEQ ID NO: 27159 - RNA, 19 nt, artificial
  Oligomer
uccaaaauuagaacccauc

SEQ ID NO: 27160 - RNA, 19 nt, artificial
  Oligomer
uaacguacagaccucaggc

SEQ ID NO: 27161 - RNA, 19 nt, artificial
  Oligomer
uuucaaguacuacuacaug

SEQ ID NO: 27162 - RNA, 19 nt, artificial
  Oligomer
ucuugugacauccuugcac

SEQ ID NO: 27163 - RNA, 19 nt, artificial
  Oligomer
uuggugguggucuccuuag

SEQ ID NO: 27164 - RNA, 19 nt, artificial
  Oligomer
ugcucuuacauaaacaccc

SEQ ID NO: 27165 - RNA, 19 nt, artificial
  Oligomer
uuaaguagcagcauucaga

SEQ ID NO: 27166 - RNA, 19 nt, artificial
  Oligomer
ugcacauacauucauccuc

SEQ ID NO: 27167 - RNA, 19 nt, artificial
  Oligomer
ugguuuauuggaaagauuc

SEQ ID NO: 27168 - RNA, 19 nt, artificial
  Oligomer
auuggaaagauucaagucc

SEQ ID NO: 27169 - RNA, 19 nt, artificial
  Oligomer
uuacccuccaauaaugaac

SEQ ID NO: 27170 - RNA, 19 nt, artificial
  Oligomer
aaucacuuucucuucccug

SEQ ID NO: 27171 - RNA, 19 nt, artificial
  Oligomer
uuaauaauccuagauuuca

SEQ ID NO: 27172 - RNA, 19 nt, artificial
  Oligomer
uuauugcaccuuaaccucu

SEQ ID NO: 27173 - RNA, 19 nt, artificial
  Oligomer
uaguauuaaccacacccgc

SEQ ID NO: 27174 - RNA, 19 nt, artificial
  Oligomer
ugcacauugacucauacug

SEQ ID NO: 27175 - RNA, 19 nt, artificial
  Oligomer
ugcuuuucuugugacaucc

SEQ ID NO: 27176 - RNA, 19 nt, artificial
  Oligomer
uuauuggaaagauucaagu

SEQ ID NO: 27177 - RNA, 19 nt, artificial
  Oligomer
aauuccaacaacgaugccc

SEQ ID NO: 27178 - RNA, 19 nt, artificial
  Oligomer
uacauguaaacuauuaucu

SEQ ID NO: 27179 - RNA, 19 nt, artificial
  Oligomer
uaagagguaacguacagac

SEQ ID NO: 27180 - RNA, 19 nt, artificial
  Oligomer
uaggauagcaggaaggaug

SEQ ID NO: 27181 - RNA, 19 nt, artificial
  Oligomer
uugcuauaaacauucuuug

SEQ ID NO: 27182 - RNA, 19 nt, artificial
  Oligomer
ucaggaaggauccaaaguc

SEQ ID NO: 27183 - RNA, 19 nt, artificial
  Oligomer
uuccagaccaaagaucugg

SEQ ID NO: 27184 - RNA, 19 nt, artificial
  Oligomer
uauggaaauauucacaauc

SEQ ID NO: 27185 - RNA, 19 nt, artificial
  Oligomer
uaaugagcaaaaaucuggg

SEQ ID NO: 27186 - RNA, 19 nt, artificial
  Oligomer
uauugcaccuuaaccucuc

SEQ ID NO: 27187 - RNA, 19 nt, artificial
  Oligomer
uuuuacgagaaguuaaaga

SEQ ID NO: 27188 - RNA, 19 nt, artificial
  Oligomer
uagacauuggugguggucu

SEQ ID NO: 27189 - RNA, 19 nt, artificial
  Oligomer
uaaaacucaaguuaauuug

SEQ ID NO: 27190 - RNA, 19 nt, artificial
  Oligomer
uuugcuauaaacauucuuu

SEQ ID NO: 27191 - RNA, 19 nt, artificial
  Oligomer
uuaaagaguuuccaucuga

SEQ ID NO: 27192 - RNA, 19 nt, artificial
  Oligomer
ugcauuuuuauucaaaggc

SEQ ID NO: 27193 - RNA, 19 nt, artificial
  Oligomer
auauucacaaucuucucag

SEQ ID NO: 27194 - RNA, 19 nt, artificial
  Oligomer
uuauauagguauaugacuu

SEQ ID NO: 27195 - RNA, 19 nt, artificial
  Oligomer
uuaucuuaaagaaaaaagc

SEQ ID NO: 27196 - RNA, 19 nt, artificial
  Oligomer
ugaaguugcaaggucaccu

SEQ ID NO: 27197 - RNA, 19 nt, artificial
  Oligomer
uugacaaucagcauugaau

SEQ ID NO: 27198 - RNA, 19 nt, artificial
  Oligomer
cagaauuccaacaacgaug

SEQ ID NO: 27199 - RNA, 19 nt, artificial
  Oligomer
uucaaguacuacuacaugu

SEQ ID NO: 27200 - RNA, 19 nt, artificial
  Oligomer
uuagacauugguggugguc

SEQ ID NO: 27201 - RNA, 19 nt, artificial
  Oligomer
ucuuuaaacaccucccucu

SEQ ID NO: 27202 - RNA, 19 nt, artificial
  Oligomer
uacaugggcacaaaaccug

SEQ ID NO: 27203 - RNA, 19 nt, artificial
  Oligomer
uuaauaacaaagaaacagu

SEQ ID NO: 27204 - RNA, 19 nt, artificial
  Oligomer
uaaaauacaacagaaaauc

SEQ ID NO: 27205 - RNA, 19 nt, artificial
  Oligomer
auggaaaugaugaugggcu

SEQ ID NO: 27206 - RNA, 19 nt, artificial
  Oligomer
uuauaaucuccgcaaaggg

SEQ ID NO: 27207 - RNA, 19 nt, artificial
  Oligomer
uuaagagguaacguacaga

SEQ ID NO: 27208 - RNA, 19 nt, artificial
  Oligomer
uccuaaauagugagcagcg

SEQ ID NO: 27209 - RNA, 19 nt, artificial
  Oligomer
ugucuugggauacauccug

SEQ ID NO: 27210 - RNA, 19 nt, artificial
  Oligomer
ucagcagcaaguuuucucc

SEQ ID NO: 27211 - RNA, 19 nt, artificial
  Oligomer
uccaauuucaaagaaggcu

SEQ ID NO: 27212 - RNA, 19 nt, artificial
  Oligomer
uaaauagugagcagcggag

SEQ ID NO: 27213 - RNA, 19 nt, artificial
  Oligomer
uuuagguuucuuauuugga

SEQ ID NO: 27214 - RNA, 19 nt, artificial
  Oligomer
uuauuucauccagugaggg

SEQ ID NO: 27215 - RNA, 19 nt, artificial
  Oligomer
aguuauuucauccagugag

SEQ ID NO: 27216 - RNA, 19 nt, artificial
  Oligomer
uaggaccacagugacaugg

SEQ ID NO: 27217 - RNA, 19 nt, artificial
  Oligomer
ugugauauccucaaaaguc

SEQ ID NO: 27218 - RNA, 19 nt, artificial
  Oligomer
uuugaagaagguaaaagcc

SEQ ID NO: 27219 - RNA, 19 nt, artificial
  Oligomer
ugaagguagguucacucgg

SEQ ID NO: 27220 - RNA, 19 nt, artificial
  Oligomer
uaugaguuaaaauacaaca

SEQ ID NO: 27221 - RNA, 19 nt, artificial
  Oligomer
acacuuuagauaauaaucg

SEQ ID NO: 27222 - RNA, 19 nt, artificial
  Oligomer
uuccacacucauauguauc

SEQ ID NO: 27223 - RNA, 19 nt, artificial
  Oligomer
ucaagugugggcuacacug

SEQ ID NO: 27224 - RNA, 19 nt, artificial
  Oligomer
uugaagauuccuguugagu

SEQ ID NO: 27225 - RNA, 19 nt, artificial
  Oligomer
augacuauuuauaaucucc

SEQ ID NO: 27226 - RNA, 19 nt, artificial
  Oligomer
uagcucuucagacccaagg

SEQ ID NO: 27227 - RNA, 19 nt, artificial
  Oligomer
ucuucaagaaagaucuagg

SEQ ID NO: 27228 - RNA, 19 nt, artificial
  Oligomer
uugcuuuucuugugacauc

SEQ ID NO: 27229 - RNA, 19 nt, artificial
  Oligomer
uuuauaaucuccgcaaagg

SEQ ID NO: 27230 - RNA, 19 nt, artificial
  Oligomer
ucaggagcauugaugaccc

SEQ ID NO: 27231 - RNA, 19 nt, artificial
  Oligomer
auaauaaaaacguaggcuc

SEQ ID NO: 27232 - RNA, 19 nt, artificial
  Oligomer
auaaauuccuuuaugaucu

SEQ ID NO: 27233 - RNA, 19 nt, artificial
  Oligomer
aucauuaacuacaaugccc

SEQ ID NO: 27234 - RNA, 19 nt, artificial
  Oligomer
uuacauaaacacccuccgg

SEQ ID NO: 27235 - RNA, 19 nt, artificial
  Oligomer
cuucucaggagcauugaug

SEQ ID NO: 27236 - RNA, 19 nt, artificial
  Oligomer
aaugaagguagguucacuc

SEQ ID NO: 27237 - RNA, 19 nt, artificial
  Oligomer
uuguaggauagcaggaagg

SEQ ID NO: 27238 - RNA, 19 nt, artificial
  Oligomer
acaaagaccaagauagccc

SEQ ID NO: 27239 - RNA, 19 nt, artificial
  Oligomer
uccuugaagauuccuguug

SEQ ID NO: 27240 - RNA, 19 nt, artificial
  Oligomer
auuguagcaacugugaugg

SEQ ID NO: 27241 - RNA, 19 nt, artificial
  Oligomer
ugcacucucaucuuucauc

SEQ ID NO: 27242 - RNA, 19 nt, artificial
  Oligomer
aucacuuucucuucccugg

SEQ ID NO: 27243 - RNA, 19 nt, artificial
  Oligomer
aucaugacuauuuauaauc

SEQ ID NO: 27244 - RNA, 19 nt, artificial
  Oligomer
uucuuccugcccuuuccac

SEQ ID NO: 27245 - RNA, 19 nt, artificial
  Oligomer
uuccuuuaaagguaugagu

SEQ ID NO: 27246 - RNA, 19 nt, artificial
  Oligomer
aagguaaugaggaagccgg

SEQ ID NO: 27247 - RNA, 19 nt, artificial
  Oligomer
uuccuuuaugaucuucuca

SEQ ID NO: 27248 - RNA, 19 nt, artificial
  Oligomer
augaagguagguucacucg

SEQ ID NO: 27249 - RNA, 19 nt, artificial
  Oligomer
aauacugucacugacaagg

SEQ ID NO: 27250 - RNA, 19 nt, artificial
  Oligomer
ucuucuacucuauaaccuc

SEQ ID NO: 27251 - RNA, 19 nt, artificial
  Oligomer
auucaaaggcuccaggagc

SEQ ID NO: 27252 - RNA, 19 nt, artificial
  Oligomer
auuccaacaacgaugccca

SEQ ID NO: 27253 - RNA, 19 nt, artificial
  Oligomer
ucaaaauguccuucucagc

SEQ ID NO: 27254 - RNA, 19 nt, artificial
  Oligomer
ugcagaguccuucuuccug

SEQ ID NO: 27255 - RNA, 19 nt, artificial
  Oligomer
uucaaaaguaaugagacua

SEQ ID NO: 27256 - RNA, 19 nt, artificial
  Oligomer
cuuuagauaauaaucgcuc

SEQ ID NO: 27257 - RNA, 19 nt, artificial
  Oligomer
uucauccugaugaggucuc

SEQ ID NO: 27258 - RNA, 19 nt, artificial
  Oligomer
uccauccaaaauuagaacc

SEQ ID NO: 27259 - RNA, 19 nt, artificial
  Oligomer
uugcaccuuaaccucucca

SEQ ID NO: 27260 - RNA, 19 nt, artificial
  Oligomer
auucacaaucuucucagug

SEQ ID NO: 27261 - RNA, 19 nt, artificial
  Oligomer
aguauuaaccacacccgcg

SEQ ID NO: 27262 - RNA, 19 nt, artificial
  Oligomer
uuucaaagaaggcuacaaa

SEQ ID NO: 27263 - RNA, 19 nt, artificial
  Oligomer
auugaucccagagagcugc

SEQ ID NO: 27264 - RNA, 19 nt, artificial
  Oligomer
uccuucuuccugcccuuuc

SEQ ID NO: 27265 - RNA, 19 nt, artificial
  Oligomer
augaacaacauuucucccu

SEQ ID NO: 27266 - RNA, 19 nt, artificial
  Oligomer
aaguuaaagaguuuccauc

SEQ ID NO: 27267 - RNA, 19 nt, artificial
  Oligomer
uucaucuccuggaugucuu

SEQ ID NO: 27268 - RNA, 19 nt, artificial
  Oligomer
uuucaaccgacuuagcuac

SEQ ID NO: 27269 - RNA, 19 nt, artificial
  Oligomer
uuuccuucuguuuuuauua

SEQ ID NO: 27270 - RNA, 19 nt, artificial
  Oligomer
auaugcagaguccuucuuc

SEQ ID NO: 27271 - RNA, 19 nt, artificial
  Oligomer
cucaggagcauugaugacc

SEQ ID NO: 27272 - RNA, 19 nt, artificial
  Oligomer
ucaaccaucauuaacuaca

SEQ ID NO: 27273 - RNA, 19 nt, artificial
  Oligomer
uuagcaggcucgaugcugu

SEQ ID NO: 27274 - RNA, 19 nt, artificial
  Oligomer
uagguuucuuauuuggaug

SEQ ID NO: 27275 - RNA, 19 nt, artificial
  Oligomer
auaaugaaucucuaccaag

SEQ ID NO: 27276 - RNA, 19 nt, artificial
  Oligomer
auccugaugaggucucucc

SEQ ID NO: 27277 - RNA, 19 nt, artificial
  Oligomer
auauccucaaaaguccugc

SEQ ID NO: 27278 - RNA, 19 nt, artificial
  Oligomer
ucuagcacggugacuugcu

SEQ ID NO: 27279 - RNA, 19 nt, artificial
  Oligomer
uacuacuacauguaaacua

SEQ ID NO: 27280 - RNA, 19 nt, artificial
  Oligomer
uuagauaauaaucgcucag

SEQ ID NO: 27281 - RNA, 19 nt, artificial
  Oligomer
uacaacagaaaaucaacac

SEQ ID NO: 27282 - RNA, 19 nt, artificial
  Oligomer
uagguauaugacuuuuacg

SEQ ID NO: 27283 - RNA, 19 nt, artificial
  Oligomer
cucauauguaucugcuucc

SEQ ID NO: 27284 - RNA, 19 nt, artificial
  Oligomer
uugacaugaaguugcaagg

SEQ ID NO: 27285 - RNA, 19 nt, artificial
  Oligomer
aaagaaacagucaugagcg

SEQ ID NO: 27286 - RNA, 19 nt, artificial
  Oligomer
uaugcagaguccuucuucc

SEQ ID NO: 27287 - RNA, 19 nt, artificial
  Oligomer
uuacaaauuccaaguuugc

SEQ ID NO: 27288 - RNA, 19 nt, artificial
  Oligomer
uuucccuuguccgucaaag

SEQ ID NO: 27289 - RNA, 19 nt, artificial
  Oligomer
aaaaccuucaaaauguccu

SEQ ID NO: 27290 - RNA, 19 nt, artificial
  Oligomer
uagaaaucacuuucucuuc

SEQ ID NO: 27291 - RNA, 19 nt, artificial
  Oligomer
uucucaggagcauugauga

SEQ ID NO: 27292 - RNA, 19 nt, artificial
  Oligomer
aagaguuuccaucugaagg

SEQ ID NO: 27293 - RNA, 19 nt, artificial
  Oligomer
ucuugggauacauccuggg

SEQ ID NO: 27294 - RNA, 19 nt, artificial
  Oligomer
uacaagaaggaguuauuuc

SEQ ID NO: 27295 - RNA, 19 nt, artificial
  Oligomer
aaaaucaacaccuaaaauc

SEQ ID NO: 27296 - RNA, 19 nt, artificial
  Oligomer
acuaagaaccaaaauacug

SEQ ID NO: 27297 - RNA, 19 nt, artificial
  Oligomer
ugagguuacaaauuccaag

SEQ ID NO: 27298 - RNA, 19 nt, artificial
  Oligomer
uuaaacaccucccucuaau

SEQ ID NO: 27299 - RNA, 19 nt, artificial
  Oligomer
uucaagcuaaagcacacuu

SEQ ID NO: 27300 - RNA, 19 nt, artificial
  Oligomer
uuuucuguuaaugagcaaa

SEQ ID NO: 27301 - RNA, 19 nt, artificial
  Oligomer
ucauuaacuacaaugccca

SEQ ID NO: 27302 - RNA, 19 nt, artificial
  Oligomer
uuuucaagcuaaagcacac

SEQ ID NO: 27303 - RNA, 19 nt, artificial
  Oligomer
uuaccauuacagcaucucu

SEQ ID NO: 27304 - RNA, 19 nt, artificial
  Oligomer
aucugcuuccugguaaguc

SEQ ID NO: 27305 - RNA, 19 nt, artificial
  Oligomer
aauuccuuuaugaucuucu

SEQ ID NO: 27306 - RNA, 19 nt, artificial
  Oligomer
aaaaucugggacuuucagg

SEQ ID NO: 27307 - RNA, 19 nt, artificial
  Oligomer
aaccaaaauacugucacug

SEQ ID NO: 27308 - RNA, 19 nt, artificial
  Oligomer
uuuucuccacguccucagg

SEQ ID NO: 27309 - RNA, 19 nt, artificial
  Oligomer
acucauauguaucugcuuc

SEQ ID NO: 27310 - RNA, 19 nt, artificial
  Oligomer
acaauaacguacuuccacc

SEQ ID NO: 27311 - RNA, 19 nt, artificial
  Oligomer
uaucagaacccaagggagg

SEQ ID NO: 27312 - RNA, 19 nt, artificial
  Oligomer
uaauaaaaacguaggcucc

SEQ ID NO: 27313 - RNA, 19 nt, artificial
  Oligomer
auaaucuccgcaaagggug

SEQ ID NO: 27314 - RNA, 19 nt, artificial
  Oligomer
uauguaucugcuuccuggu

SEQ ID NO: 27315 - RNA, 19 nt, artificial
  Oligomer
uuuguaggauagcaggaag

SEQ ID NO: 27316 - RNA, 19 nt, artificial
  Oligomer
ucagcauugaauugcgccu

SEQ ID NO: 27317 - RNA, 19 nt, artificial
  Oligomer
aaaucugggacuuucaggg

SEQ ID NO: 27318 - RNA, 19 nt, artificial
  Oligomer
aggaucagcauuucaaccg

SEQ ID NO: 27319 - RNA, 19 nt, artificial
  Oligomer
cucaucuuucaucuccugg

SEQ ID NO: 27320 - RNA, 19 nt, artificial
  Oligomer
gauaguauuaaccacaccc

SEQ ID NO: 27321 - RNA, 19 nt, artificial
  Oligomer
aucuuaaagaaaaaagcuc

SEQ ID NO: 27322 - RNA, 19 nt, artificial
  Oligomer
uucuagaaaucacuuucuc

SEQ ID NO: 27323 - RNA, 19 nt, artificial
  Oligomer
acucucaucuuucaucucc

SEQ ID NO: 27324 - RNA, 19 nt, artificial
  Oligomer
ugcggcaauaucagaaccc

SEQ ID NO: 27325 - RNA, 19 nt, artificial
  Oligomer
uucuccucuucuuuucugu

SEQ ID NO: 27326 - RNA, 19 nt, artificial
  Oligomer
uauuauauagguauaugac

SEQ ID NO: 27327 - RNA, 19 nt, artificial
  Oligomer
aaugaugaugggcugucgg

SEQ ID NO: 27328 - RNA, 19 nt, artificial
  Oligomer
uaguuaauaauccuagauu

SEQ ID NO: 27329 - RNA, 19 nt, artificial
  Oligomer
uacaaagaccaagauagcc

SEQ ID NO: 27330 - RNA, 19 nt, artificial
  Oligomer
uuaaaacaaagaaccagag

SEQ ID NO: 27331 - RNA, 19 nt, artificial
  Oligomer
uuccugguaagucugaggu

SEQ ID NO: 27332 - RNA, 19 nt, artificial
  Oligomer
auaacguacuuccacccag

SEQ ID NO: 27333 - RNA, 19 nt, artificial
  Oligomer
cuacacugcacauugacuc

SEQ ID NO: 27334 - RNA, 19 nt, artificial
  Oligomer
aaguuugcuauaaacauuc

SEQ ID NO: 27335 - RNA, 19 nt, artificial
  Oligomer
uuccaaguuugcuauaaac

SEQ ID NO: 27336 - RNA, 19 nt, artificial
  Oligomer
uccaaaggaaaucaguagc

SEQ ID NO: 27337 - RNA, 19 nt, artificial
  Oligomer
uagcauucuccucuucuuu

SEQ ID NO: 27338 - RNA, 19 nt, artificial
  Oligomer
aaagucuuaccauuacagc

SEQ ID NO: 27339 - RNA, 19 nt, artificial
  Oligomer
ucuaaaccugguuuauugg

SEQ ID NO: 27340 - RNA, 19 nt, artificial
  Oligomer
acgacuuagacauuggugg

SEQ ID NO: 27341 - RNA, 19 nt, artificial
  Oligomer
uuccuguugaguaauagaa

SEQ ID NO: 27342 - RNA, 19 nt, artificial
  Oligomer
auggaagggcugcacuuug

SEQ ID NO: 27343 - RNA, 19 nt, artificial
  Oligomer
uagauuucaaguacuacua

SEQ ID NO: 27344 - RNA, 19 nt, artificial
  Oligomer
uugauaaauuccuuuauga

SEQ ID NO: 27345 - RNA, 19 nt, artificial
  Oligomer
uuucaucuccuggaugucu

SEQ ID NO: 27346 - RNA, 19 nt, artificial
  Oligomer
uuucuagaaaucacuuucu

SEQ ID NO: 27347 - RNA, 19 nt, artificial
  Oligomer
uggaaagagccgauuguag

SEQ ID NO: 27348 - RNA, 19 nt, artificial
  Oligomer
uagaaaauccauauggaaa

SEQ ID NO: 27349 - RNA, 19 nt, artificial
  Oligomer
ucagaaaaaaauccucucc

SEQ ID NO: 27350 - RNA, 19 nt, artificial
  Oligomer
uccaaguuugcuauaaaca

SEQ ID NO: 27351 - RNA, 19 nt, artificial
  Oligomer
auugaagauccaacaaacc

SEQ ID NO: 27352 - RNA, 19 nt, artificial
  Oligomer
cucuugaacaccugcaucc

SEQ ID NO: 27353 - RNA, 19 nt, artificial
  Oligomer
uuccagaaacagcuuuuuc

SEQ ID NO: 27354 - RNA, 19 nt, artificial
  Oligomer
uccaaggccuaucauaugc

SEQ ID NO: 27355 - RNA, 19 nt, artificial
  Oligomer
uguacauucagaauuuuua

SEQ ID NO: 27356 - RNA, 19 nt, artificial
  Oligomer
uucagggcaaaauggaagg

SEQ ID NO: 27357 - RNA, 19 nt, artificial
  Oligomer
uuucuguuaaugagcaaaa

SEQ ID NO: 27358 - RNA, 19 nt, artificial
  Oligomer
auuggugguggucuccuua

SEQ ID NO: 27359 - RNA, 19 nt, artificial
  Oligomer
aaauagagaaacuacagug

SEQ ID NO: 27360 - RNA, 19 nt, artificial
  Oligomer
uuagguuucuuauuuggau

SEQ ID NO: 27361 - RNA, 19 nt, artificial
  Oligomer
aucucuccaauguacaugg

SEQ ID NO: 27362 - RNA, 19 nt, artificial
  Oligomer
uacucuauaaccucucuuu

SEQ ID NO: 27363 - RNA, 19 nt, artificial
  Oligomer
ucaacaccuaaaaucuccu

SEQ ID NO: 27364 - RNA, 19 nt, artificial
  Oligomer
uacaaauuccaaguuugcu

SEQ ID NO: 27365 - RNA, 19 nt, artificial
  Oligomer
uuucuccacguccucagga

SEQ ID NO: 27366 - RNA, 19 nt, artificial
  Oligomer
auaaacacccuccggcuuc

SEQ ID NO: 27367 - RNA, 19 nt, artificial
  Oligomer
aauaagucaacaauaacgu

SEQ ID NO: 27368 - RNA, 19 nt, artificial
  Oligomer
uugcacucucaucuuucau

SEQ ID NO: 27369 - RNA, 19 nt, artificial
  Oligomer
uagugcggcaauaucagaa

SEQ ID NO: 27370 - RNA, 19 nt, artificial
  Oligomer
ucaagcuaaagcacacuug

SEQ ID NO: 27371 - RNA, 19 nt, artificial
  Oligomer
uuauucaaaggcuccagga

SEQ ID NO: 27372 - RNA, 19 nt, artificial
  Oligomer
uccauauggaaauauucac

SEQ ID NO: 27373 - RNA, 19 nt, artificial
  Oligomer
ucuagaaaucacuuucucu

SEQ ID NO: 27374 - RNA, 19 nt, artificial
  Oligomer
ucccauuauaguuauccuu

SEQ ID NO: 27375 - RNA, 19 nt, artificial
  Oligomer
ucuuuucuguuaaugagca

SEQ ID NO: 27376 - RNA, 19 nt, artificial
  Oligomer
cucagcagcaaguuuucuc

SEQ ID NO: 27377 - RNA, 19 nt, artificial
  Oligomer
aguagcagcauucagaagc

SEQ ID NO: 27378 - RNA, 19 nt, artificial
  Oligomer
acaauggaaaugaugaugg

SEQ ID NO: 27379 - RNA, 19 nt, artificial
  Oligomer
ucucgcugggaucaugacu

SEQ ID NO: 27380 - RNA, 19 nt, artificial
  Oligomer
auuuuagguuucuuauuug

SEQ ID NO: 27381 - RNA, 19 nt, artificial
  Oligomer
uaauaacaaagaaacaguc

SEQ ID NO: 27382 - RNA, 19 nt, artificial
  Oligomer
auagaugggcucuugaaca

SEQ ID NO: 27383 - RNA, 19 nt, artificial
  Oligomer
uaacaaagaaacagucaug

SEQ ID NO: 27384 - RNA, 19 nt, artificial
  Oligomer
uuacuuuuccucuccuaua

SEQ ID NO: 27385 - RNA, 19 nt, artificial
  Oligomer
uguuaaugagcaaaaaucu

SEQ ID NO: 27386 - RNA, 19 nt, artificial
  Oligomer
uucauccucucaagugugg

SEQ ID NO: 27387 - RNA, 19 nt, artificial
  Oligomer
aguuuuauugauaaauucc

SEQ ID NO: 27388 - RNA, 19 nt, artificial
  Oligomer
auggaagugaggaaggugc

SEQ ID NO: 27389 - RNA, 19 nt, artificial
  Oligomer
ugaugaugggcugucggua

SEQ ID NO: 27390 - RNA, 19 nt, artificial
  Oligomer
uucggcauaggaccacagu

SEQ ID NO: 27391 - RNA, 19 nt, artificial
  Oligomer
uguacaugggcacaaaacc

SEQ ID NO: 27392 - RNA, 19 nt, artificial
  Oligomer
aaucuucuacucuauaacc

SEQ ID NO: 27393 - RNA, 19 nt, artificial
  Oligomer
auccaaagucuuaccauua

SEQ ID NO: 27394 - RNA, 19 nt, artificial
  Oligomer
uucuugugacauccuugca

SEQ ID NO: 27395 - RNA, 19 nt, artificial
  Oligomer
cuguucaucuccaugacgc

SEQ ID NO: 27396 - RNA, 19 nt, artificial
  Oligomer
augaguuaaaauacaacag

SEQ ID NO: 27397 - RNA, 19 nt, artificial
  Oligomer
ugcaccuuacuuuuccucu

SEQ ID NO: 27398 - RNA, 19 nt, artificial
  Oligomer
uaacaauagaaaauccaua

SEQ ID NO: 27399 - RNA, 19 nt, artificial
  Oligomer
acuauuuauaaucuccgca

SEQ ID NO: 27400 - RNA, 19 nt, artificial
  Oligomer
aagcgguugacgaagaguc

SEQ ID NO: 27401 - RNA, 19 nt, artificial
  Oligomer
cauauguaucugcuuccug

SEQ ID NO: 27402 - RNA, 19 nt, artificial
  Oligomer
ucugcuuagcauucuccuc

SEQ ID NO: 27403 - RNA, 19 nt, artificial
  Oligomer
aaaggagccgaucauaccc

SEQ ID NO: 27404 - RNA, 19 nt, artificial
  Oligomer
uguaucugcuuccugguaa

SEQ ID NO: 27405 - RNA, 19 nt, artificial
  Oligomer
uccaaagucuuaccauuac

SEQ ID NO: 27406 - RNA, 19 nt, artificial
  Oligomer
aacaccugcauccuugaag

SEQ ID NO: 27407 - RNA, 19 nt, artificial
  Oligomer
ugaagauuccuguugagua

SEQ ID NO: 27408 - RNA, 19 nt, artificial
  Oligomer
uuagcauucuccucuucuu

SEQ ID NO: 27409 - RNA, 19 nt, artificial
  Oligomer
aucagcauuucaaccgacu

SEQ ID NO: 27410 - RNA, 19 nt, artificial
  Oligomer
uauuggaaagauucaaguc

SEQ ID NO: 27411 - RNA, 19 nt, artificial
  Oligomer
uucacaaucuucucaguga

SEQ ID NO: 27412 - RNA, 19 nt, artificial
  Oligomer
aucugcuuagcauucuccu

SEQ ID NO: 27413 - RNA, 19 nt, artificial
  Oligomer
uugugacauccuugcacuc

SEQ ID NO: 27414 - RNA, 19 nt, artificial
  Oligomer
uagcacggugacuugcuuu

SEQ ID NO: 27415 - RNA, 19 nt, artificial
  Oligomer
uccuggguucauccugaug

SEQ ID NO: 27416 - RNA, 19 nt, artificial
  Oligomer
uucaaaggcccgugugaua

SEQ ID NO: 27417 - RNA, 19 nt, artificial
  Oligomer
uaagaaccaaaauacuguc

SEQ ID NO: 27418 - RNA, 19 nt, artificial
  Oligomer
cuuucuagaaaucacuuuc

SEQ ID NO: 27419 - RNA, 19 nt, artificial
  Oligomer
uguaaucuaauucaagucu

SEQ ID NO: 27420 - RNA, 19 nt, artificial
  Oligomer
auuauauagguauaugacu

SEQ ID NO: 27421 - RNA, 19 nt, artificial
  Oligomer
uaaaaucuccuaaagaaca

SEQ ID NO: 27422 - RNA, 19 nt, artificial
  Oligomer
auuucaaccgacuuagcua

SEQ ID NO: 27423 - RNA, 19 nt, artificial
  Oligomer
ucucccuaaauucuuauug

SEQ ID NO: 27424 - RNA, 19 nt, artificial
  Oligomer
aacaauaacguacuuccac

SEQ ID NO: 27425 - RNA, 19 nt, artificial
  Oligomer
ugugacauccuugcacucu

SEQ ID NO: 27426 - RNA, 19 nt, artificial
  Oligomer
ugaucuucucaggagcauu

SEQ ID NO: 27427 - RNA, 19 nt, artificial
  Oligomer
cugcuuagcauucuccucu

SEQ ID NO: 27428 - RNA, 19 nt, artificial
  Oligomer
uucaaaggcuccaggagca

SEQ ID NO: 27429 - RNA, 19 nt, artificial
  Oligomer
acaaaguggaaaaauaaug

SEQ ID NO: 27430 - RNA, 19 nt, artificial
  Oligomer
ucugcuuccugguaagucu

SEQ ID NO: 27431 - RNA, 19 nt, artificial
  Oligomer
cuguuaaugagcaaaaauc

SEQ ID NO: 27432 - RNA, 19 nt, artificial
  Oligomer
aacagguugacaaucagca

SEQ ID NO: 27433 - RNA, 19 nt, artificial
  Oligomer
uccuuuaaagguaugaguu

SEQ ID NO: 27434 - RNA, 19 nt, artificial
  Oligomer
aauccgacuaggaaguugg

SEQ ID NO: 27435 - RNA, 19 nt, artificial
  Oligomer
ugcaccuuaaccucuccag

SEQ ID NO: 27436 - RNA, 19 nt, artificial
  Oligomer
uccaacaaaccgcagccuu

SEQ ID NO: 27437 - RNA, 19 nt, artificial
  Oligomer
augagcaaaaaucugggac

SEQ ID NO: 27438 - RNA, 19 nt, artificial
  Oligomer
ucuucuuuucuguuaauga

SEQ ID NO: 27439 - RNA, 19 nt, artificial
  Oligomer
uucucagugagaaauggga

SEQ ID NO: 27440 - RNA, 19 nt, artificial
  Oligomer
uucucagcagcaaguuuuc

SEQ ID NO: 27441 - RNA, 19 nt, artificial
  Oligomer
auucuccucuucuuuucug

SEQ ID NO: 27442 - RNA, 19 nt, artificial
  Oligomer
uguucaucuccaugacgcc

SEQ ID NO: 27443 - RNA, 19 nt, artificial
  Oligomer
aaauuagaacccaucaacc

SEQ ID NO: 27444 - RNA, 19 nt, artificial
  Oligomer
uacaaugcccauauuaguu

SEQ ID NO: 27445 - RNA, 19 nt, artificial
  Oligomer
aacauuucucccuaaauuc

SEQ ID NO: 27446 - RNA, 19 nt, artificial
  Oligomer
cuagauuucaaguacuacu

SEQ ID NO: 27447 - RNA, 19 nt, artificial
  Oligomer
ucaucuuucaucuccugga

SEQ ID NO: 27448 - RNA, 19 nt, artificial
  Oligomer
augaugaugggcugucggu

SEQ ID NO: 27449 - RNA, 19 nt, artificial
  Oligomer
uuucaagcuaaagcacacu

SEQ ID NO: 27450 - RNA, 19 nt, artificial
  Oligomer
ugagcguggaacaaaaagc

SEQ ID NO: 27451 - RNA, 19 nt, artificial
  Oligomer
aucaguagcuuuauuauau

SEQ ID NO: 27452 - RNA, 19 nt, artificial
  Oligomer
uaguuauccuuuaauaaca

SEQ ID NO: 27453 - RNA, 19 nt, artificial
  Oligomer
cucgaugcuguucaucucc

SEQ ID NO: 27454 - RNA, 19 nt, artificial
  Oligomer
uuacgagaaguuaaagagu

SEQ ID NO: 27455 - RNA, 19 nt, artificial
  Oligomer
ugguaaaacccaguagcag

SEQ ID NO: 27456 - RNA, 19 nt, artificial
  Oligomer
ucauauguaucugcuuccu

SEQ ID NO: 27457 - RNA, 19 nt, artificial
  Oligomer
uccuguugaguaauagaac

SEQ ID NO: 27458 - RNA, 19 nt, artificial
  Oligomer
aucugaaggacagaaauug

SEQ ID NO: 27459 - RNA, 19 nt, artificial
  Oligomer
auucggcauaggaccacag

SEQ ID NO: 27460 - RNA, 19 nt, artificial
  Oligomer
ugagaaaggaauuaaguag

SEQ ID NO: 27461 - RNA, 19 nt, artificial
  Oligomer
uaucauaugcagaguccuu

SEQ ID NO: 27462 - RNA, 19 nt, artificial
  Oligomer
aagucuuaccauuacagca

SEQ ID NO: 27463 - RNA, 19 nt, artificial
  Oligomer
ugggcuacacugcacauug

SEQ ID NO: 27464 - RNA, 19 nt, artificial
  Oligomer
aucuucuacucuauaaccu

SEQ ID NO: 27465 - RNA, 19 nt, artificial
  Oligomer
aguagcuuuauuauauagg

SEQ ID NO: 27466 - RNA, 19 nt, artificial
  Oligomer
acuuagacauugguggugg

SEQ ID NO: 27467 - RNA, 19 nt, artificial
  Oligomer
uuaacuacaaugcccauau

SEQ ID NO: 27468 - RNA, 19 nt, artificial
  Oligomer
uaaagcacacuugauagcu

SEQ ID NO: 27469 - RNA, 19 nt, artificial
  Oligomer
uuaguuaauaauccuagau

SEQ ID NO: 27470 - RNA, 19 nt, artificial
  Oligomer
uacugucuaaaccugguuu

SEQ ID NO: 27471 - RNA, 19 nt, artificial
  Oligomer
cugaaaugaagguagguuc

SEQ ID NO: 27472 - RNA, 19 nt, artificial
  Oligomer
uaagcagaagaggaugucc

SEQ ID NO: 27473 - RNA, 19 nt, artificial
  Oligomer
uaacagacauacgcaagcg

SEQ ID NO: 27474 - RNA, 19 nt, artificial
  Oligomer
agaaacagcuuuuucagcc

SEQ ID NO: 27475 - RNA, 19 nt, artificial
  Oligomer
aaaaccugugcagaguccg

SEQ ID NO: 27476 - RNA, 19 nt, artificial
  Oligomer
cuuauugcaccuuaaccuc

SEQ ID NO: 27477 - RNA, 19 nt, artificial
  Oligomer
ucauaugcagaguccuucu

SEQ ID NO: 27478 - RNA, 19 nt, artificial
  Oligomer
uugcaaggucaccuuuuca

SEQ ID NO: 27479 - RNA, 19 nt, artificial
  Oligomer
aacaaaaccuucaaaaugu

SEQ ID NO: 27480 - RNA, 19 nt, artificial
  Oligomer
uauucaaaggcuccaggag

SEQ ID NO: 27481 - RNA, 19 nt, artificial
  Oligomer
uccagaaacagcuuuuuca

SEQ ID NO: 27482 - RNA, 19 nt, artificial
  Oligomer
uacagacaaagcucauccc

SEQ ID NO: 27483 - RNA, 19 nt, artificial
  Oligomer
uacuucaaaaguaaugaga

SEQ ID NO: 27484 - RNA, 19 nt, artificial
  Oligomer
acaaauuccaaguuugcua

SEQ ID NO: 27485 - RNA, 19 nt, artificial
  Oligomer
agaaggaguuauuucaucc

SEQ ID NO: 27486 - RNA, 19 nt, artificial
  Oligomer
ugaugaggucucucccuug

SEQ ID NO: 27487 - RNA, 19 nt, artificial
  Oligomer
cuuuccaccagaaauagag

SEQ ID NO: 27488 - RNA, 19 nt, artificial
  Oligomer
ucgaugcuguucaucucca

SEQ ID NO: 27489 - RNA, 19 nt, artificial
  Oligomer
guuuucuccacguccucag

SEQ ID NO: 27490 - RNA, 19 nt, artificial
  Oligomer
accaucauuaacuacaaug

SEQ ID NO: 27491 - RNA, 19 nt, artificial
  Oligomer
cucuuuaaacaccucccuc

SEQ ID NO: 27492 - RNA, 19 nt, artificial
  Oligomer
uuacuucaaaaguaaugag

SEQ ID NO: 27493 - RNA, 19 nt, artificial
  Oligomer
uccagcaucaaaucuucua

SEQ ID NO: 27494 - RNA, 19 nt, artificial
  Oligomer
acauuggugguggucuccu

SEQ ID NO: 27495 - RNA, 19 nt, artificial
  Oligomer
uccuuuccagaucuaucug

SEQ ID NO: 27496 - RNA, 19 nt, artificial
  Oligomer
auuaaguagcagcauucag

SEQ ID NO: 27497 - RNA, 19 nt, artificial
  Oligomer
uggaaaaauaaugaaucuc

SEQ ID NO: 27498 - RNA, 19 nt, artificial
  Oligomer
acaaucagcauugaauugc

SEQ ID NO: 27499 - RNA, 19 nt, artificial
  Oligomer
agcauuucaaccgacuuag

SEQ ID NO: 27500 - RNA, 19 nt, artificial
  Oligomer
auucaagucuucaagaaag

SEQ ID NO: 27501 - RNA, 19 nt, artificial
  Oligomer
auucagaagcguccugggu

SEQ ID NO: 27502 - RNA, 19 nt, artificial
  Oligomer
ucuccagcaucaaaucuuc

SEQ ID NO: 27503 - RNA, 19 nt, artificial
  Oligomer
aaauaaugaaucucuacca

SEQ ID NO: 27504 - RNA, 19 nt, artificial
  Oligomer
ucaaaucuucuacucuaua

SEQ ID NO: 27505 - RNA, 19 nt, artificial
  Oligomer
auaaccucucuuuaaacac

SEQ ID NO: 27506 - RNA, 19 nt, artificial
  Oligomer
auaguuauccuuuaauaac

SEQ ID NO: 27507 - RNA, 19 nt, artificial
  Oligomer
auacaacagaaaaucaaca

SEQ ID NO: 27508 - RNA, 19 nt, artificial
  Oligomer
auacugucacugacaaggg

SEQ ID NO: 27509 - RNA, 19 nt, artificial
  Oligomer
acauucauccucucaagug

SEQ ID NO: 27510 - RNA, 19 nt, artificial
  Oligomer
aagagguaacguacagacc

SEQ ID NO: 27511 - RNA, 19 nt, artificial
  Oligomer
acuaggaaguuggaggucc

SEQ ID NO: 27512 - RNA, 19 nt, artificial
  Oligomer
agugaagauaguauuaacc

SEQ ID NO: 27513 - RNA, 19 nt, artificial
  Oligomer
uagguucacucggucucuc

SEQ ID NO: 27514 - RNA, 19 nt, artificial
  Oligomer
auuccuuuaaagguaugag

SEQ ID NO: 27515 - RNA, 19 nt, artificial
  Oligomer
uaugacuuuuacgagaagu

SEQ ID NO: 27516 - RNA, 19 nt, artificial
  Oligomer
ucagugagaaaugggaccc

SEQ ID NO: 27517 - RNA, 19 nt, artificial
  Oligomer
uuuagauaauaaucgcuca

SEQ ID NO: 27518 - RNA, 19 nt, artificial
  Oligomer
uaaucuaauucaagucuuc

SEQ ID NO: 27519 - RNA, 19 nt, artificial
  Oligomer
aaaauuagaacccaucaac

SEQ ID NO: 27520 - RNA, 19 nt, artificial
  Oligomer
aaaugaugaugggcugucg

SEQ ID NO: 27521 - RNA, 19 nt, artificial
  Oligomer
cauccuugcacucucaucu

SEQ ID NO: 27522 - RNA, 19 nt, artificial
  Oligomer
agaauuccaacaacgaugc

SEQ ID NO: 27523 - RNA, 19 nt, artificial
  Oligomer
cuaaagagcucuagcacgg

SEQ ID NO: 27524 - RNA, 19 nt, artificial
  Oligomer
acagacauacgcaagcgug

SEQ ID NO: 27525 - RNA, 19 nt, artificial
  Oligomer
ucuugaacaccugcauccu

SEQ ID NO: 27526 - RNA, 19 nt, artificial
  Oligomer
aaggauccaaagucuuacc

SEQ ID NO: 27527 - RNA, 19 nt, artificial
  Oligomer
uuccacccagagcaaagug

SEQ ID NO: 27528 - RNA, 19 nt, artificial
  Oligomer
uuguccgucaaaguuuuau

SEQ ID NO: 27529 - RNA, 19 nt, artificial
  Oligomer
acagugagaacuaagaacc

SEQ ID NO: 27530 - RNA, 19 nt, artificial
  Oligomer
augaaguugcaaggucacc

SEQ ID NO: 27531 - RNA, 19 nt, artificial
  Oligomer
aaaucuucuacucuauaac

SEQ ID NO: 27532 - RNA, 19 nt, artificial
  Oligomer
gcaaguuuucuccacgucc

SEQ ID NO: 27533 - RNA, 19 nt, artificial
  Oligomer
uucccuggacuccauccaa

SEQ ID NO: 27534 - RNA, 19 nt, artificial
  Oligomer
aauuggaaagagccgauug

SEQ ID NO: 27535 - RNA, 19 nt, artificial
  Oligomer
uaaaacccaguagcagcgg

SEQ ID NO: 27536 - RNA, 19 nt, artificial
  Oligomer
guaaaacccaguagcagcg

SEQ ID NO: 27537 - RNA, 19 nt, artificial
  Oligomer
auuacagcaucucuggguc

SEQ ID NO: 27538 - RNA, 19 nt, artificial
  Oligomer
caccacaucauuuacccuc

SEQ ID NO: 27539 - RNA, 19 nt, artificial
  Oligomer
ucaaaaguaaugagacuac

SEQ ID NO: 27540 - RNA, 19 nt, artificial
  Oligomer
aaguuggagguccaguugg

SEQ ID NO: 27541 - RNA, 19 nt, artificial
  Oligomer
ucagggacuuugaagaagg

SEQ ID NO: 27542 - RNA, 19 nt, artificial
  Oligomer
aauaucagaacccaaggga

SEQ ID NO: 27543 - RNA, 19 nt, artificial
  Oligomer
auuacuucaaaaguaauga

SEQ ID NO: 27544 - RNA, 19 nt, artificial
  Oligomer
aucuccuggaugucuuggg

SEQ ID NO: 27545 - RNA, 19 nt, artificial
  Oligomer
aauacaacagaaaaucaac

SEQ ID NO: 27546 - RNA, 19 nt, artificial
  Oligomer
uaaauucuuauugcaccuu

SEQ ID NO: 27547 - RNA, 19 nt, artificial
  Oligomer
aucgcuguaaucuaauuca

SEQ ID NO: 27548 - RNA, 19 nt, artificial
  Oligomer
agugcacauacauucaucc

SEQ ID NO: 27549 - RNA, 19 nt, artificial
  Oligomer
uuucucccuaaauucuuau

SEQ ID NO: 27550 - RNA, 19 nt, artificial
  Oligomer
uaugaucuucucaggagca

SEQ ID NO: 27551 - RNA, 19 nt, artificial
  Oligomer
ccuugcacucucaucuuuc

SEQ ID NO: 27552 - RNA, 19 nt, artificial
  Oligomer
uacauucauccucucaagu

SEQ ID NO: 27553 - RNA, 19 nt, artificial
  Oligomer
uuuaaagguaugaguuaaa

SEQ ID NO: 27554 - RNA, 19 nt, artificial
  Oligomer
cuuagcauucuccucuucu

SEQ ID NO: 27555 - RNA, 19 nt, artificial
  Oligomer
uauaaccucucuuuaaaca

SEQ ID NO: 27556 - RNA, 19 nt, artificial
  Oligomer
aucuaauucaagucuucaa

SEQ ID NO: 27557 - RNA, 19 nt, artificial
  Oligomer
uuuccagaucuaucugcac

SEQ ID NO: 27558 - RNA, 19 nt, artificial
  Oligomer
uuggaaagagccgauugua

SEQ ID NO: 27559 - RNA, 19 nt, artificial
  Oligomer
auugauaaauuccuuuaug

SEQ ID NO: 27560 - RNA, 19 nt, artificial
  Oligomer
ucucaucuuucaucuccug

SEQ ID NO: 27561 - RNA, 19 nt, artificial
  Oligomer
augaauuccagaccaaaga

SEQ ID NO: 27562 - RNA, 19 nt, artificial
  Oligomer
auuguuaagagguaacgua

SEQ ID NO: 27563 - RNA, 19 nt, artificial
  Oligomer
aucucuaccaagaaccaau

SEQ ID NO: 27564 - RNA, 19 nt, artificial
  Oligomer
agagguaacguacagaccu

SEQ ID NO: 27565 - RNA, 19 nt, artificial
  Oligomer
gugacauccuugcacucuc

SEQ ID NO: 27566 - RNA, 19 nt, artificial
  Oligomer
uauauagguauaugacuuu

SEQ ID NO: 27567 - RNA, 19 nt, artificial
  Oligomer
aauauucacaaucuucuca

SEQ ID NO: 27568 - RNA, 19 nt, artificial
  Oligomer
cuaagaaccaaaauacugu

SEQ ID NO: 27569 - RNA, 19 nt, artificial
  Oligomer
accacaucauuuacccucc

SEQ ID NO: 27570 - RNA, 19 nt, artificial
  Oligomer
auucauccucucaagugug

SEQ ID NO: 27571 - RNA, 19 nt, artificial
  Oligomer
aaguuuucuccacguccuc

SEQ ID NO: 27572 - RNA, 19 nt, artificial
  Oligomer
uccgacuaggaaguuggag

SEQ ID NO: 27573 - RNA, 19 nt, artificial
  Oligomer
caugguaacagacauacgc

SEQ ID NO: 27574 - RNA, 19 nt, artificial
  Oligomer
augcuguucaucuccauga

SEQ ID NO: 27575 - RNA, 19 nt, artificial
  Oligomer
uauccucaaaaguccugcc

SEQ ID NO: 27576 - RNA, 19 nt, artificial
  Oligomer
auaucagaacccaagggag

SEQ ID NO: 27577 - RNA, 19 nt, artificial
  Oligomer
ucaaaggcccgugugauau

SEQ ID NO: 27578 - RNA, 19 nt, artificial
  Oligomer
cucucuuuaaacaccuccc

SEQ ID NO: 27579 - RNA, 19 nt, artificial
  Oligomer
aaagaaggcuacaaagacc

SEQ ID NO: 27580 - RNA, 19 nt, artificial
  Oligomer
uaaaaacguaggcuccuaa

SEQ ID NO: 27581 - RNA, 19 nt, artificial
  Oligomer
uccaauaaugaacaacauu

SEQ ID NO: 27582 - RNA, 19 nt, artificial
  Oligomer
uaaccucucuuuaaacacc

SEQ ID NO: 27583 - RNA, 19 nt, artificial
  Oligomer
guuuuauugauaaauuccu

SEQ ID NO: 27584 - RNA, 19 nt, artificial
  Oligomer
ucucuuuaaacaccucccu

SEQ ID NO: 27585 - RNA, 19 nt, artificial
  Oligomer
aagaaggcuacaaagacca

SEQ ID NO: 27586 - RNA, 19 nt, artificial
  Oligomer
uaucuuaaagaaaaaagcu

SEQ ID NO: 27587 - RNA, 19 nt, artificial
  Oligomer
uaauaauccuagauuucaa

SEQ ID NO: 27588 - RNA, 19 nt, artificial
  Oligomer
ugaacaacauuucucccua

SEQ ID NO: 27589 - RNA, 19 nt, artificial
  Oligomer
aaaguaaugagacuacuac

SEQ ID NO: 27590 - RNA, 19 nt, artificial
  Oligomer
aagggcugcacuuuguagg

SEQ ID NO: 27591 - RNA, 19 nt, artificial
  Oligomer
cuaaucucaauuuccuucu

SEQ ID NO: 27592 - RNA, 19 nt, artificial
  Oligomer
aauaauccuagauuucaag

SEQ ID NO: 27593 - RNA, 19 nt, artificial
  Oligomer
cuuacauaaacacccuccg

SEQ ID NO: 27594 - RNA, 19 nt, Artificial
  Oligomer
uggaaaugaugaugggcug

SEQ ID NO: 27595 - RNA, 19 nt, artificial
  Oligomer
ggacaguguugaacgucaa

SEQ ID NO: 27596 - RNA, 19 nt, artificial
  Oligomer
gggcuauguuuuccaccaa

SEQ ID NO: 27597 - RNA, 19 nt, artificial
  Oligomer
ccagaaaaaggcagacuaa

SEQ ID NO: 27598 - RNA, 19 nt, artificial
  Oligomer
uaggcuagcuggaagaaaa

SEQ ID NO: 27599 - RNA, 19 nt, artificial
  Oligomer
uguggaggacaguguugaa

SEQ ID NO: 27600 - RNA, 19 nt, artificial
  Oligomer
ggagaccauugaaauagaa

SEQ ID NO: 27601 - RNA, 19 nt, artificial
  Oligomer
gugucagugugguuuauaa

SEQ ID NO: 27602 - RNA, 19 nt, artificial
  Oligomer
ggaagaggagaacauccaa

SEQ ID NO: 27603 - RNA, 19 nt, artificial
  Oligomer
gguuuauaauccuugaaua

SEQ ID NO: 27604 - RNA, 19 nt, artificial
  Oligomer
cugugguguugaagggaaa

SEQ ID NO: 27605 - RNA, 19 nt, artificial
  Oligomer
cgagcucauucgcaaugca

SEQ ID NO: 27606 - RNA, 19 nt, artificial
  Oligomer
cauggaaaaguacaugaaa

SEQ ID NO: 27607 - RNA, 19 nt, artificial
  Oligomer
cuugaauauuguuuuagaa

SEQ ID NO: 27608 - RNA, 19 nt, artificial
  Oligomer
ccaugugauugaugucuga

SEQ ID NO: 27609 - RNA, 19 nt, artificial
  Oligomer
cccuaaggagaccauugaa

SEQ ID NO: 27610 - RNA, 19 nt, artificial
  Oligomer
ccauuaguuugcuguuaau

SEQ ID NO: 27611 - RNA, 19 nt, artificial
  Oligomer
ccuugaauauuguuuuaga

SEQ ID NO: 27612 - RNA, 19 nt, artificial
  Oligomer
gaaaaaugcuacacuccaa

SEQ ID NO: 27613 - RNA, 19 nt, artificial
  Oligomer
cccugaccuccaucuucaa

SEQ ID NO: 27614 - RNA, 19 nt, artificial
  Oligomer
acaaguuccugagaagaaa

SEQ ID NO: 27615 - RNA, 19 nt, artificial
  Oligomer
guuaauuuaugcauuugaa

SEQ ID NO: 27616 - RNA, 19 nt, artificial
  Oligomer
acgccuucauggaaaagua

SEQ ID NO: 27617 - RNA, 19 nt, artificial
  Oligomer
ggcuauguuuuccaccaau

SEQ ID NO: 27618 - RNA, 19 nt, artificial
  Oligomer
gacugaggaagaggagaaa

SEQ ID NO: 27619 - RNA, 19 nt, artificial
  Oligomer
caaguuccugagaagaaaa

SEQ ID NO: 27620 - RNA, 19 nt, artificial
  Oligomer
ggcagacuaagaaucagaa

SEQ ID NO: 27621 - RNA, 19 nt, artificial
  Oligomer
gaaaaaggcagacuaagaa

SEQ ID NO: 27622 - RNA, 19 nt, artificial
  Oligomer
cacucagucacauccagaa

SEQ ID NO: 27623 - RNA, 19 nt, artificial
  Oligomer
gcaagagagcaucugagaa

SEQ ID NO: 27624 - RNA, 19 nt, artificial
  Oligomer
ccaagaucucggcagacau

SEQ ID NO: 27625 - RNA, 19 nt, artificial
  Oligomer
cgcaagagagcaucugaga

SEQ ID NO: 27626 - RNA, 19 nt, artificial
  Oligomer
aggagaccauugaaauaga

SEQ ID NO: 27627 - RNA, 19 nt, artificial
  Oligomer
cacaaguuccugagaagaa

SEQ ID NO: 27628 - RNA, 19 nt, artificial
  Oligomer
ccaagaugacugaggaaga

SEQ ID NO: 27629 - RNA, 19 nt, artificial
  Oligomer
ccauguucaucauggugau

SEQ ID NO: 27630 - RNA, 19 nt, artificial
  Oligomer
gccugaugcuaucagucau

SEQ ID NO: 27631 - RNA, 19 nt, artificial
  Oligomer
cauugugcagucagcacaa

SEQ ID NO: 27632 - RNA, 19 nt, artificial
  Oligomer
ggauguccauccuuaccuu

SEQ ID NO: 27633 - RNA, 19 nt, artificial
  Oligomer
cucguccugugguguugaa

SEQ ID NO: 27634 - RNA, 19 nt, artificial
  Oligomer
caagagagcaucugagaaa

SEQ ID NO: 27635 - RNA, 19 nt, artificial
  Oligomer
ccuuaggccugaaucugua

SEQ ID NO: 27636 - RNA, 19 nt, artificial
  Oligomer
agaggagaacauccaagaa

SEQ ID NO: 27637 - RNA, 19 nt, artificial
  Oligomer
uggguuugcuuuucacgaa

SEQ ID NO: 27638 - RNA, 19 nt, artificial
  Oligomer
ucaucucccuccucaccaa

SEQ ID NO: 27639 - RNA, 19 nt, artificial
  Oligomer
acaccaccuuucaggaaaa

SEQ ID NO: 27640 - RNA, 19 nt, artificial
  Oligomer
ccugagaagaaaaaaggaa

SEQ ID NO: 27641 - RNA, 19 nt, artificial
  Oligomer
ggaggacaguguugaacgu

SEQ ID NO: 27642 - RNA, 19 nt, artificial
  Oligomer
gggcaacucuucgauuaca

SEQ ID NO: 27643 - RNA, 19 nt, artificial
  Oligomer
cgggugucagugugguuua

SEQ ID NO: 27644 - RNA, 19 nt, artificial
  Oligomer
ggagcguauugaccuggau

SEQ ID NO: 27645 - RNA, 19 nt, artificial
  Oligomer
ccacgagcucauucgcaau

SEQ ID NO: 27646 - RNA, 19 nt, artificial
  Oligomer
ccaugcauauuuugccuga

SEQ ID NO: 27647 - RNA, 19 nt, artificial
  Oligomer
caggagagccuaugaccua

SEQ ID NO: 27648 - RNA, 19 nt, artificial
  Oligomer
cggaagaggagaacaucca

SEQ ID NO: 27649 - RNA, 19 nt, artificial
  Oligomer
cuaugacgccuucauggaa

SEQ ID NO: 27650 - RNA, 19 nt, artificial
  Oligomer
caucgccuauccaaccuua

SEQ ID NO: 27651 - RNA, 19 nt, artificial
  Oligomer
gggauuucacguaugauua

SEQ ID NO: 27652 - RNA, 19 nt, artificial
  Oligomer
gggugucagugugguuuau

SEQ ID NO: 27653 - RNA, 19 nt, artificial
  Oligomer
cagugugguuuauaauccu

SEQ ID NO: 27654 - RNA, 19 nt, artificial
  Oligomer
cagcaaagaggagcguauu

SEQ ID NO: 27655 - RNA, 19 nt, artificial
  Oligomer
ccucccucuuugcuaguaa

SEQ ID NO: 27656 - RNA, 19 nt, artificial
  Oligomer
ggaagaaaaccauuaguuu

SEQ ID NO: 27657 - RNA, 19 nt, artificial
  Oligomer
cuagcuggaagaaaaccau

SEQ ID NO: 27658 - RNA, 19 nt, artificial
  Oligomer
ccugugguguugaagggaa

SEQ ID NO: 27659 - RNA, 19 nt, artificial
  Oligomer
ccuucauggaaaaguacau

SEQ ID NO: 27660 - RNA, 19 nt, artificial
  Oligomer
gcccuaaggagaccauuga

SEQ ID NO: 27661 - RNA, 19 nt, artificial
  Oligomer
cacccaagaugacugagga

SEQ ID NO: 27662 - RNA, 19 nt, artificial
  Oligomer
ugacggacaccucugagaa

SEQ ID NO: 27663 - RNA, 19 nt, artificial
  Oligomer
cugucuuccugcuugcuau

SEQ ID NO: 27664 - RNA, 19 nt, artificial
  Oligomer
uuaguuugcuguuaauuua

SEQ ID NO: 27665 - RNA, 19 nt, artificial
  Oligomer
guggguaucuaaagcugau

SEQ ID NO: 27666 - RNA, 19 nt, artificial
  Oligomer
ugugguuuauaauccuuga

SEQ ID NO: 27667 - RNA, 19 nt, artificial
  Oligomer
agaaaaaggcagacuaaga

SEQ ID NO: 27668 - RNA, 19 nt, artificial
  Oligomer
cgugagucugucucaggua

SEQ ID NO: 27669 - RNA, 19 nt, artificial
  Oligomer
ugaucagccgcauucugua

SEQ ID NO: 27670 - RNA, 19 nt, artificial
  Oligomer
gagaccauugaaauagaaa

SEQ ID NO: 27671 - RNA, 19 nt, artificial
  Oligomer
cccucuucaccauggacau

SEQ ID NO: 27672 - RNA, 19 nt, artificial
  Oligomer
ucuccaucaucguuaucua

SEQ ID NO: 27673 - RNA, 19 nt, artificial
  Oligomer
ugcgcaacagcaaagagga

SEQ ID NO: 27674 - RNA, 19 nt, artificial
  Oligomer
agcugaugcccauguucau

SEQ ID NO: 27675 - RNA, 19 nt, artificial
  Oligomer
ccuaaggagaccauugaaa

SEQ ID NO: 27676 - RNA, 19 nt, artificial
  Oligomer
gaccauugaaauagaaaca

SEQ ID NO: 27677 - RNA, 19 nt, artificial
  Oligomer
cggacugugggcuauguuu

SEQ ID NO: 27678 - RNA, 19 nt, artificial
  Oligomer
ccaugaagaugaagaugac

SEQ ID NO: 27679 - RNA, 19 nt, artificial
  Oligomer
ggaaaaaugcuacacucca

SEQ ID NO: 27680 - RNA, 19 nt, artificial
  Oligomer
cugagaaagagcucaugau

SEQ ID NO: 27681 - RNA, 19 nt, artificial
  Oligomer
caaucgugggacuguugga

SEQ ID NO: 27682 - RNA, 19 nt, artificial
  Oligomer
caccaaacccauuccggau

SEQ ID NO: 27683 - RNA, 19 nt, artificial
  Oligomer
caccaccuuucaggaaaaa

SEQ ID NO: 27684 - RNA, 19 nt, artificial
  Oligomer
cuggguucaucuuugggau

SEQ ID NO: 27685 - RNA, 19 nt, artificial
  Oligomer
gagucugucucagguagau

SEQ ID NO: 27686 - RNA, 19 nt, artificial
  Oligomer
ccucuuugcuaguaacauu

SEQ ID NO: 27687 - RNA, 19 nt, artificial
  Oligomer
ucagucacauccagaaaaa

SEQ ID NO: 27688 - RNA, 19 nt, artificial
  Oligomer
aguuccugagaagaaaaaa

SEQ ID NO: 27689 - RNA, 19 nt, artificial
  Oligomer
caucucccuccucaccaaa

SEQ ID NO: 27690 - RNA, 19 nt, artificial
  Oligomer
ggcaacucuucgauuacau

SEQ ID NO: 27691 - RNA, 19 nt, artificial
  Oligomer
ccaucaucguuaucuacuu

SEQ ID NO: 27692 - RNA, 19 nt, artificial
  Oligomer
ucaccaaacccauuccgga

SEQ ID NO: 27693 - RNA, 19 nt, artificial
  Oligomer
gaggcuaugacgccuucau

SEQ ID NO: 27694 - RNA, 19 nt, artificial
  Oligomer
ccggaagguuguuuauccu

SEQ ID NO: 27695 - RNA, 19 nt, artificial
  Oligomer
uaaggagaccauugaaaua

SEQ ID NO: 27696 - RNA, 19 nt, artificial
  Oligomer
cuuugcuaguaacauugga

SEQ ID NO: 27697 - RNA, 19 nt, artificial
  Oligomer
cguuaucuacuucguggua

SEQ ID NO: 27698 - RNA, 19 nt, artificial
  Oligomer
uacugaguuugcuuaugga

SEQ ID NO: 27699 - RNA, 19 nt, artificial
  Oligomer
ucuucaccauggacaucua

SEQ ID NO: 27700 - RNA, 19 nt, artificial
  Oligomer
gaggccugaugcuaucagu

SEQ ID NO: 27701 - RNA, 19 nt, artificial
  Oligomer
gugguuuauaauccuugaa

SEQ ID NO: 27702 - RNA, 19 nt, artificial
  Oligomer
caggaaugaucagccgcau

SEQ ID NO: 27703 - RNA, 19 nt, artificial
  Oligomer
gcaacugucccacgauuau

SEQ ID NO: 27704 - RNA, 19 nt, artificial
  Oligomer
gucccuucagaaugugaga

SEQ ID NO: 27705 - RNA, 19 nt, artificial
  Oligomer
ccuugcagacggugaucau

SEQ ID NO: 27706 - RNA, 19 nt, artificial
  Oligomer
uguuuauccuggugcugau

SEQ ID NO: 27707 - RNA, 19 nt, artificial
  Oligomer
ccauccuuaccuuguggua

SEQ ID NO: 27708 - RNA, 19 nt, artificial
  Oligomer
caaagaggagcguauugac

SEQ ID NO: 27709 - RNA, 19 nt, artificial
  Oligomer
aggccugaaucuguauuua

SEQ ID NO: 27710 - RNA, 19 nt, artificial
  Oligomer
gacaguguugaacgucaau

SEQ ID NO: 27711 - RNA, 19 nt, artificial
  Oligomer
accuuuugcuguagauuua

SEQ ID NO: 27712 - RNA, 19 nt, artificial
  Oligomer
ccuucagaaugugagaaau

SEQ ID NO: 27713 - RNA, 19 nt, artificial
  Oligomer
ccgacuccuuccacaucuu

SEQ ID NO: 27714 - RNA, 19 nt, artificial
  Oligomer
gagaaauauugcgguacca

SEQ ID NO: 27715 - RNA, 19 nt, artificial
  Oligomer
acagcaaagaggagcguau

SEQ ID NO: 27716 - RNA, 19 nt, artificial
  Oligomer
gguacuggugcacagauca

SEQ ID NO: 27717 - RNA, 19 nt, artificial
  Oligomer
agaugacugaggaagagga

SEQ ID NO: 27718 - RNA, 19 nt, artificial
  Oligomer
gaauauuguuuuagaaacu

SEQ ID NO: 27719 - RNA, 19 nt, artificial
  Oligomer
aguccuaccuuuugcugua

SEQ ID NO: 27720 - RNA, 19 nt, artificial
  Oligomer
agaugacggacaccucuga

SEQ ID NO: 27721 - RNA, 19 nt, artificial
  Oligomer
augacgccuucauggaaaa

SEQ ID NO: 27722 - RNA, 19 nt, artificial
  Oligomer
ugaagaugaagaugacgga

SEQ ID NO: 27723 - RNA, 19 nt, artificial
  Oligomer
ccuaccuuuugcuguagau

SEQ ID NO: 27724 - RNA, 19 nt, artificial
  Oligomer
accauuaguuugcuguuaa

SEQ ID NO: 27725 - RNA, 19 nt, artificial
  Oligomer
agcuggaagaaaaccauua

SEQ ID NO: 27726 - RNA, 19 nt, artificial
  Oligomer
cugagaagaaaaaaggaau

SEQ ID NO: 27727 - RNA, 19 nt, artificial
  Oligomer
cucagucacauccagaaaa

SEQ ID NO: 27728 - RNA, 19 nt, artificial
  Oligomer
ugucccugcugcucuacau

SEQ ID NO: 27729 - RNA, 19 nt, artificial
  Oligomer
gguguugaagggaaaucag

SEQ ID NO: 27730 - RNA, 19 nt, artificial
  Oligomer
cauucgcaaugcagccgau

SEQ ID NO: 27731 - RNA, 19 nt, artificial
  Oligomer
caccaaucgugggacuguu

SEQ ID NO: 27732 - RNA, 19 nt, artificial
  Oligomer
ugggcuauguuuuccacca

SEQ ID NO: 27733 - RNA, 19 nt, artificial
  Oligomer
caagaaggcccuaaggaga

SEQ ID NO: 27734 - RNA, 19 nt, artificial
  Oligomer
cccugcugcucuacauuuu

SEQ ID NO: 27735 - RNA, 19 nt, artificial
  Oligomer
aagaaaaaaggaaucuuca

SEQ ID NO: 27736 - RNA, 19 nt, artificial
  Oligomer
cuugcuauuuucuggaaga

SEQ ID NO: 27737 - RNA, 19 nt, artificial
  Oligomer
ucacgaagugggaggcuau

SEQ ID NO: 27738 - RNA, 19 nt, artificial
  Oligomer
uccugagaagaaaaaagga

SEQ ID NO: 27739 - RNA, 19 nt, artificial
  Oligomer
ugucagugugguuuauaau

SEQ ID NO: 27740 - RNA, 19 nt, artificial
  Oligomer
cccuucagaaugugagaaa

SEQ ID NO: 27741 - RNA, 19 nt, artificial
  Oligomer
ucauggaaaaguacaugaa

SEQ ID NO: 27742 - RNA, 19 nt, artificial
  Oligomer
uauugaccuggaugcggaa

SEQ ID NO: 27743 - RNA, 19 nt, artificial
  Oligomer
aaguuccugagaagaaaaa

SEQ ID NO: 27744 - RNA, 19 nt, artificial
  Oligomer
gggacugauccuaggacuu

SEQ ID NO: 27745 - RNA, 19 nt, artificial
  Oligomer
aggcuagcuggaagaaaac

SEQ ID NO: 27746 - RNA, 19 nt, artificial
  Oligomer
cuaaggagaccauugaaau

SEQ ID NO: 27747 - RNA, 19 nt, artificial
  Oligomer
agaauaugucucacgugaa

SEQ ID NO: 27748 - RNA, 19 nt, artificial
  Oligomer
cagccgauaucuccaucau

SEQ ID NO: 27749 - RNA, 19 nt, artificial
  Oligomer
uuggaggcuuugaauggaa

SEQ ID NO: 27750 - RNA, 19 nt, artificial
  Oligomer
gguuguuuauccuggugcu

SEQ ID NO: 27751 - RNA, 19 nt, artificial
  Oligomer
ucuacuucgugguagugau

SEQ ID NO: 27752 - RNA, 19 nt, artificial
  Oligomer
ccuuagugguggagcucau

SEQ ID NO: 27753 - RNA, 19 nt, artificial
  Oligomer
ugacugaggaagaggagaa

SEQ ID NO: 27754 - RNA, 19 nt, artificial
  Oligomer
acccaagaugacugaggaa

SEQ ID NO: 27755 - RNA, 19 nt, artificial
  Oligomer
cuggguuugcuuuucacga

SEQ ID NO: 27756 - RNA, 19 nt, artificial
  Oligomer
gcuggaagaaaaccauuag

SEQ ID NO: 27757 - RNA, 19 nt, artificial
  Oligomer
cuuuguggaggacaguguu

SEQ ID NO: 27758 - RNA, 19 nt, artificial
  Oligomer
acugaguuugcuuauggaa

SEQ ID NO: 27759 - RNA, 19 nt, artificial
  Oligomer
uggaggcuuugaauggaau

SEQ ID NO: 27760 - RNA, 19 nt, artificial
  Oligomer
agagagcaucugagaaaga

SEQ ID NO: 27761 - RNA, 19 nt, artificial
  Oligomer
agaaauauugcgguaccaa

SEQ ID NO: 27762 - RNA, 19 nt, artificial
  Oligomer
ugcucuacauuuucaccaa

SEQ ID NO: 27763 - RNA, 19 nt, artificial
  Oligomer
gacugauccuaggacuucu

SEQ ID NO: 27764 - RNA, 19 nt, artificial
  Oligomer
gcuguuaauuuaugcauuu

SEQ ID NO: 27765 - RNA, 19 nt, artificial
  Oligomer
guuuauaauccuugaauau

SEQ ID NO: 27766 - RNA, 19 nt, artificial
  Oligomer
ucuggaagagagucaauga

SEQ ID NO: 27767 - RNA, 19 nt, artificial
  Oligomer
ugcccagguggauaaaugu

SEQ ID NO: 27768 - RNA, 19 nt, artificial
  Oligomer
ucaccaagaucucggcaga

SEQ ID NO: 27769 - RNA, 19 nt, artificial
  Oligomer
agacggugaucaugcuggu

SEQ ID NO: 27770 - RNA, 19 nt, artificial
  Oligomer
cugugggcuauguuuucca

SEQ ID NO: 27771 - RNA, 19 nt, artificial
  Oligomer
accaacaucgccuauccaa

SEQ ID NO: 27772 - RNA, 19 nt, artificial
  Oligomer
ggccugaugcuaucaguca

SEQ ID NO: 27773 - RNA, 19 nt, artificial
  Oligomer
ugcuuuucacgaaguggga

SEQ ID NO: 27774 - RNA, 19 nt, artificial
  Oligomer
acucagucacauccagaaa

SEQ ID NO: 27775 - RNA, 19 nt, artificial
  Oligomer
gaagguuguuuauccuggu

SEQ ID NO: 27776 - RNA, 19 nt, artificial
  Oligomer
cuaggacuucugauuggga

SEQ ID NO: 27777 - RNA, 19 nt, artificial
  Oligomer
gcuaugacgccuucaugga

SEQ ID NO: 27778 - RNA, 19 nt, artificial
  Oligomer
ccuccucaccaaacccauu

SEQ ID NO: 27779 - RNA, 19 nt, artificial
  Oligomer
ccuuccacaucuuccgaga

SEQ ID NO: 27780 - RNA, 19 nt, artificial
  Oligomer
gagaagccuuuguggagga

SEQ ID NO: 27781 - RNA, 19 nt, artificial
  Oligomer
gacucuuacucaccuuccu

SEQ ID NO: 27782 - RNA, 19 nt, artificial
  Oligomer
ccuggguucaucuuuggga

SEQ ID NO: 27783 - RNA, 19 nt, artificial
  Oligomer
gugggcaacucuucgauua

SEQ ID NO: 27784 - RNA, 19 nt, artificial
  Oligomer
cugcugcucuacauuuuca

SEQ ID NO: 27785 - RNA, 19 nt, artificial
  Oligomer
ugguguugaagggaaauca

SEQ ID NO: 27786 - RNA, 19 nt, artificial
  Oligomer
gcaaagaggagcguauuga

SEQ ID NO: 27787 - RNA, 19 nt, artificial
  Oligomer
agaucucggcagacaucuu

SEQ ID NO: 27788 - RNA, 19 nt, artificial
  Oligomer
aggacaguguugaacguca

SEQ ID NO: 27789 - RNA, 19 nt, artificial
  Oligomer
ccacucagucacauccaga

SEQ ID NO: 27790 - RNA, 19 nt, artificial
  Oligomer
guagauuccgggugucagu

SEQ ID NO: 27791 - RNA, 19 nt, artificial
  Oligomer
gaaauauugcgguaccaag

SEQ ID NO: 27792 - RNA, 19 nt, artificial
  Oligomer
aggagagccuaugaccuau

SEQ ID NO: 27793 - RNA, 19 nt, artificial
  Oligomer
ucgauuacauccaguccau

SEQ ID NO: 27794 - RNA, 19 nt, artificial
  Oligomer
uucugucccugcugcucua

SEQ ID NO: 27795 - RNA, 19 nt, artificial
  Oligomer
ucaucuuugggauguccau

SEQ ID NO: 27796 - RNA, 19 nt, artificial
  Oligomer
gcuguaccaacaucgccua

SEQ ID NO: 27797 - RNA, 19 nt, artificial
  Oligomer
gagagccuaugaccuauuu

SEQ ID NO: 27798 - RNA, 19 nt, artificial
  Oligomer
auccuugaauauuguuuua

SEQ ID NO: 27799 - RNA, 19 nt, artificial
  Oligomer
acccauuccggaugugcau

SEQ ID NO: 27800 - RNA, 19 nt, artificial
  Oligomer
cccucuuugcuaguaacau

SEQ ID NO: 27801 - RNA, 19 nt, artificial
  Oligomer
ucaucaccaucguggucau

SEQ ID NO: 27802 - RNA, 19 nt, artificial
  Oligomer
cgccuucauggaaaaguac

SEQ ID NO: 27803 - RNA, 19 nt, artificial
  Oligomer
ggugcacagaucaggucau

SEQ ID NO: 27804 - RNA, 19 nt, artificial
  Oligomer
ggacugugggcuauguuuu

SEQ ID NO: 27805 - RNA, 19 nt, artificial
  Oligomer
guauugaccuggaugcgga

SEQ ID NO: 27806 - RNA, 19 nt, artificial
  Oligomer
gccuucauggaaaaguaca

SEQ ID NO: 27807 - RNA, 19 nt, artificial
  Oligomer
gcaacaccaccuuucagga

SEQ ID NO: 27808 - RNA, 19 nt, artificial
  Oligomer
aacccauuccggaugugca

SEQ ID NO: 27809 - RNA, 19 nt, artificial
  Oligomer
gauugaugucugacgugag

SEQ ID NO: 27810 - RNA, 19 nt, artificial
  Oligomer
gcuagcuggaagaaaacca

SEQ ID NO: 27811 - RNA, 19 nt, artificial
  Oligomer
ugcuugcuauuuucuggaa

SEQ ID NO: 27812 - RNA, 19 nt, artificial
  Oligomer
ugaccuauuuugugggcua

SEQ ID NO: 27813 - RNA, 19 nt, artificial
  Oligomer
ccauuucuuucaucaccau

SEQ ID NO: 27814 - RNA, 19 nt, artificial
  Oligomer
cuucagaaugugagaaaua

SEQ ID NO: 27815 - RNA, 19 nt, artificial
  Oligomer
ggaugugcaucucuaccgu

SEQ ID NO: 27816 - RNA, 19 nt, artificial
  Oligomer
gaagaugacggacaccucu

SEQ ID NO: 27817 - RNA, 19 nt, artificial
  Oligomer
ugauccuaggacuucugau

SEQ ID NO: 27818 - RNA, 19 nt, artificial
  Oligomer
aggcagacuaagaaucaga

SEQ ID NO: 27819 - RNA, 19 nt, artificial
  Oligomer
gcggugauuuacacggaca

SEQ ID NO: 27820 - RNA, 19 nt, artificial
  Oligomer
cuggaagaaaaccauuagu

SEQ ID NO: 27821 - RNA, 19 nt, artificial
  Oligomer
uccgcaagagagcaucuga

SEQ ID NO: 27822 - RNA, 19 nt, artificial
  Oligomer
aauuauaggcuagcuggaa

SEQ ID NO: 27823 - RNA, 19 nt, artificial
  Oligomer
ccaagaauaugucucacgu

SEQ ID NO: 27824 - RNA, 19 nt, artificial
  Oligomer
uaauuauaggcuagcugga

SEQ ID NO: 27825 - RNA, 19 nt, artificial
  Oligomer
gaaucuucaggagagccua

SEQ ID NO: 27826 - RNA, 19 nt, artificial
  Oligomer
cacguaugauuacugaguu

SEQ ID NO: 27827 - RNA, 19 nt, artificial
  Oligomer
cuuuaauccugacuggguu

SEQ ID NO: 27828 - RNA, 19 nt, artificial
  Oligomer
uaccaacaucgccuaucca

SEQ ID NO: 27829 - RNA, 19 nt, artificial
  Oligomer
caucugagaaagagcucau

SEQ ID NO: 27830 - RNA, 19 nt, artificial
  Oligomer
gauccuaggacuucugauu

SEQ ID NO: 27831 - RNA, 19 nt, artificial
  Oligomer
caagaugacugaggaagag

SEQ ID NO: 27832 - RNA, 19 nt, artificial
  Oligomer
ucagaaugugagaaauauu

SEQ ID NO: 27833 - RNA, 19 nt, artificial
  Oligomer
cugcuugcuauuuucugga

SEQ ID NO: 27834 - RNA, 19 nt, artificial
  Oligomer
auaggcuagcuggaagaaa

SEQ ID NO: 27835 - RNA, 19 nt, artificial
  Oligomer
ccgauaucuccaucaucgu

SEQ ID NO: 27836 - RNA, 19 nt, artificial
  Oligomer
gacuggguuugcuuuucac

SEQ ID NO: 27837 - RNA, 19 nt, artificial
  Oligomer
ccuuuagucucguccugug

SEQ ID NO: 27838 - RNA, 19 nt, artificial
  Oligomer
ugagaaagagcucaugauu

SEQ ID NO: 27839 - RNA, 19 nt, artificial
  Oligomer
cagcaacugucccacgauu

SEQ ID NO: 27840 - RNA, 19 nt, artificial
  Oligomer
agaugaagaugacggacac

SEQ ID NO: 27841 - RNA, 19 nt, artificial
  Oligomer
cauccaagaaggcccuaag

SEQ ID NO: 27842 - RNA, 19 nt, artificial
  Oligomer
uaguuugcuguuaauuuau

SEQ ID NO: 27843 - RNA, 19 nt, artificial
  Oligomer
uccagaaaaaggcagacua

SEQ ID NO: 27844 - RNA, 19 nt, artificial
  Oligomer
ggagagccuaugaccuauu

SEQ ID NO: 27845 - RNA, 19 nt, artificial
  Oligomer
ugcuguuaauuuaugcauu

SEQ ID NO: 27846 - RNA, 19 nt, artificial
  Oligomer
caacaccaccuuucaggaa

SEQ ID NO: 27847 - RNA, 19 nt, artificial
  Oligomer
uaugacgccuucauggaaa

SEQ ID NO: 27848 - RNA, 19 nt, artificial
  Oligomer
cggugauuuacacggacac

SEQ ID NO: 27849 - RNA, 19 nt, artificial
  Oligomer
ccaacaucgccuauccaac

SEQ ID NO: 27850 - RNA, 19 nt, artificial
  Oligomer
ucgccuauccaaccuuagu

SEQ ID NO: 27851 - RNA, 19 nt, artificial
  Oligomer
ugacuggguuugcuuuuca

SEQ ID NO: 27852 - RNA, 19 nt, artificial
  Oligomer
uguuaauuuaugcauuuga

SEQ ID NO: 27853 - RNA, 19 nt, artificial
  Oligomer
aagaggagaacauccaaga

SEQ ID NO: 27854 - RNA, 19 nt, artificial
  Oligomer
gugguacuggugcacagau

SEQ ID NO: 27855 - RNA, 19 nt, artificial
  Oligomer
cgcaaugcagccgauaucu

SEQ ID NO: 27856 - RNA, 19 nt, artificial
  Oligomer
aagggaguccacucaguca

SEQ ID NO: 27857 - RNA, 19 nt, artificial
  Oligomer
ggguuugcuuuucacgaag

SEQ ID NO: 27858 - RNA, 19 nt, artificial
  Oligomer
cagaaaaaggcagacuaag

SEQ ID NO: 27859 - RNA, 19 nt, artificial
  Oligomer
ugcccauguucaucauggu

SEQ ID NO: 27860 - RNA, 19 nt, artificial
  Oligomer
uugccugaguccuaccuuu

SEQ ID NO: 27861 - RNA, 19 nt, artificial
  Oligomer
uuccggaugugcaucucua

SEQ ID NO: 27862 - RNA, 19 nt, artificial
  Oligomer
cccugguuuuggugguugu

SEQ ID NO: 27863 - RNA, 19 nt, artificial
  Oligomer
auaucuccaucaucguuau

SEQ ID NO: 27864 - RNA, 19 nt, artificial
  Oligomer
acgaagugggaggcuauga

SEQ ID NO: 27865 - RNA, 19 nt, artificial
  Oligomer
uugccggaagguuguuuau

SEQ ID NO: 27866 - RNA, 19 nt, artificial
  Oligomer
uuugcuaguaacauuggaa

SEQ ID NO: 27867 - RNA, 19 nt, artificial
  Oligomer
auauuuugccugaguccua

SEQ ID NO: 27868 - RNA, 19 nt, artificial
  Oligomer
ggugucagugugguuuaua

SEQ ID NO: 27869 - RNA, 19 nt, artificial
  Oligomer
gauuacauccaguccauca

SEQ ID NO: 27870 - RNA, 19 nt, artificial
  Oligomer
cgauaucuccaucaucguu

SEQ ID NO: 27871 - RNA, 19 nt, artificial
  Oligomer
gauuacugaguuugcuuau

SEQ ID NO: 27872 - RNA, 19 nt, artificial
  Oligomer
agccuaugaccuauuuugu

SEQ ID NO: 27873 - RNA, 19 nt, artificial
  Oligomer
gucccugcugcucuacauu

SEQ ID NO: 27874 - RNA, 19 nt, artificial
  Oligomer
cagaucaggucauugugca

SEQ ID NO: 27875 - RNA, 19 nt, artificial
  Oligomer
gcuauuuucuggaagagag

SEQ ID NO: 27876 - RNA, 19 nt, artificial
  Oligomer
uccaguccaucaccaguua

SEQ ID NO: 27877 - RNA, 19 nt, artificial
  Oligomer
guuacuugggaccacccau

SEQ ID NO: 27878 - RNA, 19 nt, artificial
  Oligomer
ccaggucuaccuuucccuu

SEQ ID NO: 27879 - RNA, 19 nt, artificial
  Oligomer
uuccaaccauagugucuga

SEQ ID NO: 27880 - RNA, 19 nt, artificial
  Oligomer
aggagcguauugaccugga

SEQ ID NO: 27881 - RNA, 19 nt, artificial
  Oligomer
gcaaucacugcccuuuaca

SEQ ID NO: 27882 - RNA, 19 nt, artificial
  Oligomer
auugggauuucacguauga

SEQ ID NO: 27883 - RNA, 19 nt, artificial
  Oligomer
cuauuuucuggaagagagu

SEQ ID NO: 27884 - RNA, 19 nt, artificial
  Oligomer
gagagcaucugagaaagag

SEQ ID NO: 27885 - RNA, 19 nt, artificial
  Oligomer
ugucgucccuucagaaugu

SEQ ID NO: 27886 - RNA, 19 nt, artificial
  Oligomer
ugugguguugaagggaaau

SEQ ID NO: 27887 - RNA, 19 nt, artificial
  Oligomer
acuucugauugggauuuca

SEQ ID NO: 27888 - RNA, 19 nt, artificial
  Oligomer
gaaugaucagccgcauucu

SEQ ID NO: 27889 - RNA, 19 nt, artificial
  Oligomer
ugcagacggugaucaugcu

SEQ ID NO: 27890 - RNA, 19 nt, artificial
  Oligomer
ugagucugucucagguaga

SEQ ID NO: 27891 - RNA, 19 nt, artificial
  Oligomer
cacaaagugggcaacucuu

SEQ ID NO: 27892 - RNA, 19 nt, artificial
  Oligomer
gcacaaagugggcaacucu

SEQ ID NO: 27893 - RNA, 19 nt, artificial
  Oligomer
ggaguccacucagucacau

SEQ ID NO: 27894 - RNA, 19 nt, artificial
  Oligomer
ugauuuacacggacaccuu

SEQ ID NO: 27895 - RNA, 19 nt, artificial
  Oligomer
caggaaaaaugcuacacuc

SEQ ID NO: 27896 - RNA, 19 nt, artificial
  Oligomer
cgucccuucagaaugugag

SEQ ID NO: 27897 - RNA, 19 nt, artificial
  Oligomer
ucuucaggagagccuauga

SEQ ID NO: 27898 - RNA, 19 nt, artificial
  Oligomer
caguguugaacgucaaugg

SEQ ID NO: 27899 - RNA, 19 nt, artificial
  Oligomer
cugauccuaggacuucuga

SEQ ID NO: 27900 - RNA, 19 nt, artificial
  Oligomer
ggccugaaucuguauuuag

SEQ ID NO: 27901 - RNA, 19 nt, artificial
  Oligomer
ugugagaaauauugcggua

SEQ ID NO: 27902 - RNA, 19 nt, artificial
  Oligomer
acaccuugcagacggugau

SEQ ID NO: 27903 - RNA, 19 nt, artificial
  Oligomer
uuugggauguccauccuua

SEQ ID NO: 27904 - RNA, 19 nt, artificial
  Oligomer
uugagacccacgagcucau

SEQ ID NO: 27905 - RNA, 19 nt, artificial
  Oligomer
augcggaagaggagaacau

SEQ ID NO: 27906 - RNA, 19 nt, artificial
  Oligomer
ccaccuuucaggaaaaaug

SEQ ID NO: 27907 - RNA, 19 nt, artificial
  Oligomer
uguggguaucuaaagcuga

SEQ ID NO: 27908 - RNA, 19 nt, artificial
  Oligomer
cagucacauccagaaaaag

SEQ ID NO: 27909 - RNA, 19 nt, artificial
  Oligomer
caaccuuagugguggagcu

SEQ ID NO: 27910 - RNA, 19 nt, artificial
  Oligomer
uggaugcggaagaggagaa

SEQ ID NO: 27911 - RNA, 19 nt, artificial
  Oligomer
agaagggaguccacucagu

SEQ ID NO: 27912 - RNA, 19 nt, artificial
  Oligomer
ugaugcccauguucaucau

SEQ ID NO: 27913 - RNA, 19 nt, artificial
  Oligomer
gcacagaucaggucauugu

SEQ ID NO: 27914 - RNA, 19 nt, artificial
  Oligomer
aaaggcagacuaagaauca

SEQ ID NO: 27915 - RNA, 19 nt, artificial
  Oligomer
caucaccaguuacuuggga

SEQ ID NO: 27916 - RNA, 19 nt, artificial
  Oligomer
gaugcggaagaggagaaca

SEQ ID NO: 27917 - RNA, 19 nt, artificial
  Oligomer
aagccuuuguggaggacag

SEQ ID NO: 27918 - RNA, 19 nt, artificial
  Oligomer
ugggauuucacguaugauu

SEQ ID NO: 27919 - RNA, 19 nt, artificial
  Oligomer
accuugugguacuggugca

SEQ ID NO: 27920 - RNA, 19 nt, artificial
  Oligomer
uuuucuggaagagagucaa

SEQ ID NO: 27921 - RNA, 19 nt, artificial
  Oligomer
ugugguacuggugcacaga

SEQ ID NO: 27922 - RNA, 19 nt, artificial
  Oligomer
ggaaugcccugguuuuggu

SEQ ID NO: 27923 - RNA, 19 nt, artificial
  Oligomer
cauccaguccaucaccagu

SEQ ID NO: 27924 - RNA, 19 nt, artificial
  Oligomer
cgccuauccaaccuuagug

SEQ ID NO: 27925 - RNA, 19 nt, artificial
  Oligomer
gaugacugaggaagaggag

SEQ ID NO: 27926 - RNA, 19 nt, artificial
  Oligomer
ugaugcuaucagucaugcu

SEQ ID NO: 27927 - RNA, 19 nt, artificial
  Oligomer
ggcaaucacugcccuuuac

SEQ ID NO: 27928 - RNA, 19 nt, artificial
  Oligomer
acgugagucugucucaggu

SEQ ID NO: 27929 - RNA, 19 nt, artificial
  Oligomer
gagcucauucgcaaugcag

SEQ ID NO: 27930 - RNA, 19 nt, artificial
  Oligomer
aucuaaagcugaugcccau

SEQ ID NO: 27931 - RNA, 19 nt, artificial
  Oligomer
gggugcacuacuuguacuu

SEQ ID NO: 27932 - RNA, 19 nt, artificial
  Oligomer
ucuacauuuucaccaagau

SEQ ID NO: 27933 - RNA, 19 nt, artificial
  Oligomer
acguaugauuacugaguuu

SEQ ID NO: 27934 - RNA, 19 nt, artificial
  Oligomer
agagccuaugaccuauuuu

SEQ ID NO: 27935 - RNA, 19 nt, artificial
  Oligomer
cugacgugagucugucuca

SEQ ID NO: 27936 - RNA, 19 nt, artificial
  Oligomer
ugaccuccaucuucaacag

SEQ ID NO: 27937 - RNA, 19 nt, artificial
  Oligomer
cuuaggccugaaucuguau

SEQ ID NO: 27938 - RNA, 19 nt, artificial
  Oligomer
gcugucuuccugcuugcua

SEQ ID NO: 27939 - RNA, 19 nt, artificial
  Oligomer
aaaaaggcagacuaagaau

SEQ ID NO: 27940 - RNA, 19 nt, artificial
  Oligomer
cacagaucaggucauugug

SEQ ID NO: 27941 - RNA, 19 nt, artificial
  Oligomer
gaauaugucucacgugaag

SEQ ID NO: 27942 - RNA, 19 nt, artificial
  Oligomer
ggaggcuuugaauggaaug

SEQ ID NO: 27943 - RNA, 19 nt, artificial
  Oligomer
uauaauccuugaauauugu

SEQ ID NO: 27944 - RNA, 19 nt, artificial
  Oligomer
auuggaggcuuugaaugga

SEQ ID NO: 27945 - RNA, 19 nt, artificial
  Oligomer
agagcucaugauugccgga

SEQ ID NO: 27946 - RNA, 19 nt, artificial
  Oligomer
aaugcagccgauaucucca

SEQ ID NO: 27947 - RNA, 19 nt, artificial
  Oligomer
cggauccaggucuaccuuu

SEQ ID NO: 27948 - RNA, 19 nt, artificial
  Oligomer
guuccugagaagaaaaaag

SEQ ID NO: 27949 - RNA, 19 nt, artificial
  Oligomer
caagaucucggcagacauc

SEQ ID NO: 27950 - RNA, 19 nt, artificial
  Oligomer
cuuccugcuugcuauuuuc

SEQ ID NO: 27951 - RNA, 19 nt, artificial
  Oligomer
ugcuauuuucuggaagaga

SEQ ID NO: 27952 - RNA, 19 nt, artificial
  Oligomer
gccuuaggccugaaucugu

SEQ ID NO: 27953 - RNA, 19 nt, artificial
  Oligomer
agcucaugcccaauggacu

SEQ ID NO: 27954 - RNA, 19 nt, artificial
  Oligomer
ucugagaagccuuugugga

SEQ ID NO: 27955 - RNA, 19 nt, artificial
  Oligomer
cucccucuuugcuaguaac

SEQ ID NO: 27956 - RNA, 19 nt, artificial
  Oligomer
aggcuaugacgccuucaug

SEQ ID NO: 27957 - RNA, 19 nt, artificial
  Oligomer
gucagcacaaagugggcaa

SEQ ID NO: 27958 - RNA, 19 nt, artificial
  Oligomer
aguccaucaccaguuacuu

SEQ ID NO: 27959 - RNA, 19 nt, artificial
  Oligomer
ugguuuauaauccuugaau

SEQ ID NO: 27960 - RNA, 19 nt, artificial
  Oligomer
uuaucuacuucgugguagu

SEQ ID NO: 27961 - RNA, 19 nt, artificial
  Oligomer
uuuugcccagguggauaaa

SEQ ID NO: 27962 - RNA, 19 nt, artificial
  Oligomer
cuggaagagagucaaugag

SEQ ID NO: 27963 - RNA, 19 nt, artificial
  Oligomer
uagcuggaagaaaaccauu

SEQ ID NO: 27964 - RNA, 19 nt, artificial
  Oligomer
aacucuucgauuacaucca

SEQ ID NO: 27965 - RNA, 19 nt, artificial
  Oligomer
aggagaacauccaagaagg

SEQ ID NO: 27966 - RNA, 19 nt, artificial
  Oligomer
uaggacuucugauugggau

SEQ ID NO: 27967 - RNA, 19 nt, artificial
  Oligomer
cuuccuuuagucucguccu

SEQ ID NO: 27968 - RNA, 19 nt, artificial
  Oligomer
auuuugcccagguggauaa

SEQ ID NO: 27969 - RNA, 19 nt, artificial
  Oligomer
gagccuaugaccuauuuug

SEQ ID NO: 27970 - RNA, 19 nt, artificial
  Oligomer
cuuucaucaccaucguggu

SEQ ID NO: 27971 - RNA, 19 nt, artificial
  Oligomer
guccacucagucacaucca

SEQ ID NO: 27972 - RNA, 19 nt, artificial
  Oligomer
ccugcuugcuauuuucugg

SEQ ID NO: 27973 - RNA, 19 nt, artificial
  Oligomer
cugauugggauuucacgua

SEQ ID NO: 27974 - RNA, 19 nt, artificial
  Oligomer
ucacauccagaaaaaggca

SEQ ID NO: 27975 - RNA, 19 nt, artificial
  Oligomer
ggucuuuaauccugacugg

SEQ ID NO: 27976 - RNA, 19 nt, artificial
  Oligomer
aagaauaugucucacguga

SEQ ID NO: 27977 - RNA, 19 nt, artificial
  Oligomer
gacugugggcuauguuuuc

SEQ ID NO: 27978 - RNA, 19 nt, artificial
  Oligomer
ccauugugcagucagcaca

SEQ ID NO: 27979 - RNA, 19 nt, artificial
  Oligomer
gcuggacucuuacucaccu

SEQ ID NO: 27980 - RNA, 19 nt, artificial
  Oligomer
aacaccaccuuucaggaaa

SEQ ID NO: 27981 - RNA, 19 nt, artificial
  Oligomer
gcaucugagaaagagcuca

SEQ ID NO: 27982 - RNA, 19 nt, artificial
  Oligomer
ccaucuguaccuacuggag

SEQ ID NO: 27983 - RNA, 19 nt, artificial
  Oligomer
cugagaagccuuuguggag

SEQ ID NO: 27984 - RNA, 19 nt, artificial
  Oligomer
guguaauuauaggcuagcu

SEQ ID NO: 27985 - RNA, 19 nt, artificial
  Oligomer
caaccauagugucugaugg

SEQ ID NO: 27986 - RNA, 19 nt, artificial
  Oligomer
gccugaaucuguauuuagc

SEQ ID NO: 27987 - RNA, 19 nt, artificial
  Oligomer
gccugaguccuaccuuuug

SEQ ID NO: 27988 - RNA, 19 nt, artificial
  Oligomer
caguccaucaccaguuacu

SEQ ID NO: 27989 - RNA, 19 nt, artificial
  Oligomer
caaucacugcccuuuacac

SEQ ID NO: 27990 - RNA, 19 nt, artificial
  Oligomer
ugugcagucagcacaaagu

SEQ ID NO: 27991 - RNA, 19 nt, artificial
  Oligomer
gcagacuaagaaucagaag

SEQ ID NO: 27992 - RNA, 19 nt, artificial
  Oligomer
gccggaagguuguuuaucc

SEQ ID NO: 27993 - RNA, 19 nt, artificial
  Oligomer
uauaggcuagcuggaagaa

SEQ ID NO: 27994 - RNA, 19 nt, artificial
  Oligomer
aguuacuugggaccaccca

SEQ ID NO: 27995 - RNA, 19 nt, artificial
  Oligomer
cugaccuccaucuucaaca

SEQ ID NO: 27996 - RNA, 19 nt, artificial
  Oligomer
aaaccauuaguuugcuguu

SEQ ID NO: 27997 - RNA, 19 nt, artificial
  Oligomer
cucuacauuuucaccaaga

SEQ ID NO: 27998 - RNA, 19 nt, artificial
  Oligomer
aaccauuaguuugcuguua

SEQ ID NO: 27999 - RNA, 19 nt, artificial
  Oligomer
gguuugcuuuucacgaagu

SEQ ID NO: 28000 - RNA, 19 nt, artificial
  Oligomer
caugcauauuuugccugag

SEQ ID NO: 28001 - RNA, 19 nt, artificial
  Oligomer
uucagaaugugagaaauau

SEQ ID NO: 28002 - RNA, 19 nt, artificial
  Oligomer
ugguuuuggugguugugcu

SEQ ID NO: 28003 - RNA, 19 nt, artificial
  Oligomer
cauuaguuugcuguuaauu

SEQ ID NO: 28004 - RNA, 19 nt, artificial
  Oligomer
ucuuacucaccuuccuuua

SEQ ID NO: 28005 - RNA, 19 nt, artificial
  Oligomer
auggaaaaguacaugaaag

SEQ ID NO: 28006 - RNA, 19 nt, artificial
  Oligomer
ugauugggauuucacguau

SEQ ID NO: 28007 - RNA, 19 nt, artificial
  Oligomer
gaagaaaaccauuaguuug

SEQ ID NO: 28008 - RNA, 19 nt, artificial
  Oligomer
agaaaaaaggaaucuucag

SEQ ID NO: 28009 - RNA, 19 nt, artificial
  Oligomer
ccuuucaggaaaaaugcua

SEQ ID NO: 28010 - RNA, 19 nt, artificial
  Oligomer
ugugauugaugucugacgu

SEQ ID NO: 28011 - RNA, 19 nt, artificial
  Oligomer
ugauugaugucugacguga

SEQ ID NO: 28012 - RNA, 19 nt, artificial
  Oligomer
agaggagcguauugaccug

SEQ ID NO: 28013 - RNA, 19 nt, artificial
  Oligomer
uugggauguccauccuuac

SEQ ID NO: 28014 - RNA, 19 nt, artificial
  Oligomer
ucccugaccuccaucuuca

SEQ ID NO: 28015 - RNA, 19 nt, artificial
  Oligomer
agugugguuuauaauccuu

SEQ ID NO: 28016 - RNA, 19 nt, artificial
  Oligomer
aaaaaaggaaucuucagga

SEQ ID NO: 28017 - RNA, 19 nt, artificial
  Oligomer
uuauaggcuagcuggaaga

SEQ ID NO: 28018 - RNA, 19 nt, artificial
  Oligomer
ugaauauuguuuuagaaac

SEQ ID NO: 28019 - RNA, 19 nt, artificial
  Oligomer
cuggacucuuacucaccuu

SEQ ID NO: 28020 - RNA, 19 nt, artificial
  Oligomer
ggagaacauccaagaaggc

SEQ ID NO: 28021 - RNA, 19 nt, artificial
  Oligomer
aauggaaugcccugguuuu

SEQ ID NO: 28022 - RNA, 19 nt, artificial
  Oligomer
ccuuuguggaggacagugu

SEQ ID NO: 28023 - RNA, 19 nt, artificial
  Oligomer
gugcaucucuaccgucugu

SEQ ID NO: 28024 - RNA, 19 nt, artificial
  Oligomer
ugauuacugaguuugcuua

SEQ ID NO: 28025 - RNA, 19 nt, artificial
  Oligomer
gugcacagaucaggucauu

SEQ ID NO: 28026 - RNA, 19 nt, artificial
  Oligomer
agguagauuccggguguca

SEQ ID NO: 28027 - RNA, 19 nt, artificial
  Oligomer
augacggacaccucugaga

SEQ ID NO: 28028 - RNA, 19 nt, artificial
  Oligomer
gaaugugagaaauauugcg

SEQ ID NO: 28029 - RNA, 19 nt, artificial
  Oligomer
gccuaugaccuauuuugug

SEQ ID NO: 28030 - RNA, 19 nt, artificial
  Oligomer
ggacuguuggaggcuucuu

SEQ ID NO: 28031 - RNA, 19 nt, artificial
  Oligomer
auugugcagucagcacaaa

SEQ ID NO: 28032 - RNA, 19 nt, artificial
  Oligomer
cugaguccuaccuuuugcu

SEQ ID NO: 28033 - RNA, 19 nt, artificial
  Oligomer
gagcaucugagaaagagcu

SEQ ID NO: 28034 - RNA, 19 nt, artificial
  Oligomer
agcaacugucccacgauua

SEQ ID NO: 28035 - RNA, 19 nt, artificial
  Oligomer
caguuguaaauuuugccca

SEQ ID NO: 28036 - RNA, 19 nt, artificial
  Oligomer
uucgcaaugcagccgauau

SEQ ID NO: 28037 - RNA, 19 nt, artificial
  Oligomer
ugucuuccugcuugcuauu

SEQ ID NO: 28038 - RNA, 19 nt, artificial
  Oligomer
aguuguaaauuuugcccag

SEQ ID NO: 28039 - RNA, 19 nt, artificial
  Oligomer
uugggauuucacguaugau

SEQ ID NO: 28040 - RNA, 19 nt, artificial
  Oligomer
uuuugcuguagauuuacca

SEQ ID NO: 28041 - RNA, 19 nt, artificial
  Oligomer
accuauuuugugggcuaga

SEQ ID NO: 28042 - RNA, 19 nt, artificial
  Oligomer
ccugcugcucuacauuuuc

SEQ ID NO: 28043 - RNA, 19 nt, artificial
  Oligomer
gggauguccauccuuaccu

SEQ ID NO: 28044 - RNA, 19 nt, artificial
  Oligomer
gcuauguuuuccaccaauc

SEQ ID NO: 28045 - RNA, 19 nt, artificial
  Oligomer
ucgucccuucagaauguga

SEQ ID NO: 28046 - RNA, 19 nt, artificial
  Oligomer
acaccucugagaagccuuu

SEQ ID NO: 28047 - RNA, 19 nt, artificial
  Oligomer
cuuaccuugugguacuggu

SEQ ID NO: 28048 - RNA, 19 nt, artificial
  Oligomer
auugaugucugacgugagu

SEQ ID NO: 28049 - RNA, 19 nt, artificial
  Oligomer
ggauccaggucuaccuuuc

SEQ ID NO: 28050 - RNA, 19 nt, artificial
  Oligomer
aggacuucugauugggauu

SEQ ID NO: 28051 - RNA, 19 nt, artificial
  Oligomer
auccaaccuuaguggugga

SEQ ID NO: 28052 - RNA, 19 nt, artificial
  Oligomer
caucguuaucuacuucgug

SEQ ID NO: 28053 - RNA, 19 nt, artificial
  Oligomer
gccucccucuuugcuagua

SEQ ID NO: 28054 - RNA, 19 nt, artificial
  Oligomer
ggauuucacguaugauuac

SEQ ID NO: 28055 - RNA, 19 nt, artificial
  Oligomer
agccuuuguggaggacagu

SEQ ID NO: 28056 - RNA, 19 nt, artificial
  Oligomer
agcucaugauugccggaag

SEQ ID NO: 28057 - RNA, 19 nt, artificial
  Oligomer
aagagagcaucugagaaag

SEQ ID NO: 28058 - RNA, 19 nt, artificial
  Oligomer
aauccuugaauauuguuuu

SEQ ID NO: 28059 - RNA, 19 nt, artificial
  Oligomer
agaagaaaaaaggaaucuu

SEQ ID NO: 28060 - RNA, 19 nt, artificial
  Oligomer
gacaccucugagaagccuu

SEQ ID NO: 28061 - RNA, 19 nt, artificial
  Oligomer
gaagccuuuguggaggaca

SEQ ID NO: 28062 - RNA, 19 nt, artificial
  Oligomer
cucugagaagccuuugugg

SEQ ID NO: 28063 - RNA, 19 nt, artificial
  Oligomer
ccugaugcuaucagucaug

SEQ ID NO: 28064 - RNA, 19 nt, artificial
  Oligomer
gauuggagccucccucuuu

SEQ ID NO: 28065 - RNA, 19 nt, artificial
  Oligomer
uguucaucauggugaugcc

SEQ ID NO: 28066 - RNA, 19 nt, artificial
  Oligomer
caugauugccggaagguug

SEQ ID NO: 28067 - RNA, 19 nt, artificial
  Oligomer
gcagccgauaucuccauca

SEQ ID NO: 28068 - RNA, 19 nt, artificial
  Oligomer
aguaccugaggaagcgguu

SEQ ID NO: 28069 - RNA, 19 nt, artificial
  Oligomer
aagcugaugcccauguuca

SEQ ID NO: 28070 - RNA, 19 nt, artificial
  Oligomer
cuuugggauguccauccuu

SEQ ID NO: 28071 - RNA, 19 nt, artificial
  Oligomer
agaccauugaaauagaaac

SEQ ID NO: 28072 - RNA, 19 nt, artificial
  Oligomer
ugccugaguccuaccuuuu

SEQ ID NO: 28073 - RNA, 19 nt, artificial
  Oligomer
aagugggcaacucuucgau

SEQ ID NO: 28074 - RNA, 19 nt, artificial
  Oligomer
ucugagaaagagcucauga

SEQ ID NO: 28075 - RNA, 19 nt, artificial
  Oligomer
acauccaagaaggcccuaa

SEQ ID NO: 28076 - RNA, 19 nt, artificial
  Oligomer
auuaguuugcuguuaauuu

SEQ ID NO: 28077 - RNA, 19 nt, artificial
  Oligomer
cuuccacaucuuccgagau

SEQ ID NO: 28078 - RNA, 19 nt, artificial
  Oligomer
cagaaugugagaaauauug

SEQ ID NO: 28079 - RNA, 19 nt, artificial
  Oligomer
ucucguccugugguguuga

SEQ ID NO: 28080 - RNA, 19 nt, artificial
  Oligomer
accucugagaagccuuugu

SEQ ID NO: 28081 - RNA, 19 nt, artificial
  Oligomer
uauuuugugggcuagagca

SEQ ID NO: 28082 - RNA, 19 nt, artificial
  Oligomer
gaacauccaagaaggcccu

SEQ ID NO: 28083 - RNA, 19 nt, artificial
  Oligomer
gcaacucuucgauuacauc

SEQ ID NO: 28084 - RNA, 19 nt, artificial
  Oligomer
cuauguuuuccaccaaucg

SEQ ID NO: 28085 - RNA, 19 nt, artificial
  Oligomer
gauugggauuucacguaug

SEQ ID NO: 28086 - RNA, 19 nt, artificial
  Oligomer
ucaccaucguggucaucuc

SEQ ID NO: 28087 - RNA, 19 nt, artificial
  Oligomer
cauuccaaccauagugucu

SEQ ID NO: 28088 - RNA, 19 nt, artificial
  Oligomer
cacagaaaaaauugccugu

SEQ ID NO: 28089 - RNA, 19 nt, artificial
  Oligomer
cuaccuuuugcuguagauu

SEQ ID NO: 28090 - RNA, 19 nt, artificial
  Oligomer
agaaaaccauuaguuugcu

SEQ ID NO: 28091 - RNA, 19 nt, artificial
  Oligomer
accaagaucucggcagaca

SEQ ID NO: 28092 - RNA, 19 nt, artificial
  Oligomer
ggaagagagucaaugagcc

SEQ ID NO: 28093 - RNA, 19 nt, artificial
  Oligomer
uaaauuuugcccaggugga

SEQ ID NO: 28094 - RNA, 19 nt, artificial
  Oligomer
auugccggaagguuguuua

SEQ ID NO: 28095 - RNA, 19 nt, artificial
  Oligomer
uugacguucaacacugucc

SEQ ID NO: 28096 - RNA, 19 nt, artificial
  Oligomer
uugguggaaaacauagccc

SEQ ID NO: 28097 - RNA, 19 nt, artificial
  Oligomer
uuagucugccuuuuucugg

SEQ ID NO: 28098 - RNA, 19 nt, artificial
  Oligomer
uuuucuuccagcuagccua

SEQ ID NO: 28099 - RNA, 19 nt, artificial
  Oligomer
uucaacacuguccuccaca

SEQ ID NO: 28100 - RNA, 19 nt, artificial
  Oligomer
uucuauuucaauggucucc

SEQ ID NO: 28101 - RNA, 19 nt, artificial
  Oligomer
uuauaaaccacacugacac

SEQ ID NO: 28102 - RNA, 19 nt, artificial
  Oligomer
uuggauguucuccucuucc

SEQ ID NO: 28103 - RNA, 19 nt, artificial
  Oligomer
uauucaaggauuauaaacc

SEQ ID NO: 28104 - RNA, 19 nt, artificial
  Oligomer
uuucccuucaacaccacag

SEQ ID NO: 28105 - RNA, 19 nt, artificial
  Oligomer
ugcauugcgaaugagcucg

SEQ ID NO: 28106 - RNA, 19 nt, artificial
  Oligomer
uuucauguacuuuuccaug

SEQ ID NO: 28107 - RNA, 19 nt, artificial
  Oligomer
uucuaaaacaauauucaag

SEQ ID NO: 28108 - RNA, 19 nt, artificial
  Oligomer
ucagacaucaaucacaugg

SEQ ID NO: 28109 - RNA, 19 nt, artificial
  Oligomer
uucaauggucuccuuaggg

SEQ ID NO: 28110 - RNA, 19 nt, artificial
  Oligomer
auuaacagcaaacuaaugg

SEQ ID NO: 28111 - RNA, 19 nt, artificial
  Oligomer
ucuaaaacaauauucaagg

SEQ ID NO: 28112 - RNA, 19 nt, artificial
  Oligomer
uuggaguguagcauuuuuc

SEQ ID NO: 28113 - RNA, 19 nt, artificial
  Oligomer
uugaagauggaggucaggg

SEQ ID NO: 28114 - RNA, 19 nt, artificial
  Oligomer
uuucuucucaggaacuugu

SEQ ID NO: 28115 - RNA, 19 nt, artificial
  Oligomer
uucaaaugcauaaauuaac

SEQ ID NO: 28116 - RNA, 19 nt, artificial
  Oligomer
uacuuuuccaugaaggcgu

SEQ ID NO: 28117 - RNA, 19 nt, artificial
  Oligomer
auugguggaaaacauagcc

SEQ ID NO: 28118 - RNA, 19 nt, artificial
  Oligomer
uuucuccucuuccucaguc

SEQ ID NO: 28119 - RNA, 19 nt, artificial
  Oligomer
uuuucuucucaggaacuug

SEQ ID NO: 28120 - RNA, 19 nt, artificial
  Oligomer
uucugauucuuagucugcc

SEQ ID NO: 28121 - RNA, 19 nt, artificial
  Oligomer
uucuuagucugccuuuuuc

SEQ ID NO: 28122 - RNA, 19 nt, artificial
  Oligomer
uucuggaugugacugagug

SEQ ID NO: 28123 - RNA, 19 nt, artificial
  Oligomer
uucucagaugcucucuugc

SEQ ID NO: 28124 - RNA, 19 nt, artificial
  Oligomer
augucugccgagaucuugg

SEQ ID NO: 28125 - RNA, 19 nt, artificial
  Oligomer
ucucagaugcucucuugcg

SEQ ID NO: 28126 - RNA, 19 nt, artificial
  Oligomer
ucuauuucaauggucuccu

SEQ ID NO: 28127 - RNA, 19 nt, artificial
  Oligomer
uucuucucaggaacuugug

SEQ ID NO: 28128 - RNA, 19 nt, artificial
  Oligomer
ucuuccucagucaucuugg

SEQ ID NO: 28129 - RNA, 19 nt, artificial
  Oligomer
aucaccaugaugaacaugg

SEQ ID NO: 28130 - RNA, 19 nt, artificial
  Oligomer
augacugauagcaucaggc

SEQ ID NO: 28131 - RNA, 19 nt, artificial
  Oligomer
uugugcugacugcacaaug

SEQ ID NO: 28132 - RNA, 19 nt, artificial
  Oligomer
aagguaaggauggacaucc

SEQ ID NO: 28133 - RNA, 19 nt, artificial
  Oligomer
uucaacaccacaggacgag

SEQ ID NO: 28134 - RNA, 19 nt, artificial
  Oligomer
uuucucagaugcucucuug

SEQ ID NO: 28135 - RNA, 19 nt, artificial
  Oligomer
uacagauucaggccuaagg

SEQ ID NO: 28136 - RNA, 19 nt, artificial
  Oligomer
uucuuggauguucuccucu

SEQ ID NO: 28137 - RNA, 19 nt, artificial
  Oligomer
uucgugaaaagcaaaccca

SEQ ID NO: 28138 - RNA, 19 nt, artificial
  Oligomer
uuggugaggagggagauga

SEQ ID NO: 28139 - RNA, 19 nt, artificial
  Oligomer
uuuuccugaaagguggugu

SEQ ID NO: 28140 - RNA, 19 nt, artificial
  Oligomer
uuccuuuuuucuucucagg

SEQ ID NO: 28141 - RNA, 19 nt, artificial
  Oligomer
acguucaacacuguccucc

SEQ ID NO: 28142 - RNA, 19 nt, artificial
  Oligomer
uguaaucgaagaguugccc

SEQ ID NO: 28143 - RNA, 19 nt, artificial
  Oligomer
uaaaccacacugacacccg

SEQ ID NO: 28144 - RNA, 19 nt, artificial
  Oligomer
auccaggucaauacgcucc

SEQ ID NO: 28145 - RNA, 19 nt, artificial
  Oligomer
auugcgaaugagcucgugg

SEQ ID NO: 28146 - RNA, 19 nt, artificial
  Oligomer
ucaggcaaaauaugcaugg

SEQ ID NO: 28147 - RNA, 19 nt, artificial
  Oligomer
uaggucauaggcucuccug

SEQ ID NO: 28148 - RNA, 19 nt, artificial
  Oligomer
uggauguucuccucuuccg

SEQ ID NO: 28149 - RNA, 19 nt, artificial
  Oligomer
uuccaugaaggcgucauag

SEQ ID NO: 28150 - RNA, 19 nt, artificial
  Oligomer
uaagguuggauaggcgaug

SEQ ID NO: 28151 - RNA, 19 nt, artificial
  Oligomer
uaaucauacgugaaauccc

SEQ ID NO: 28152 - RNA, 19 nt, artificial
  Oligomer
auaaaccacacugacaccc

SEQ ID NO: 28153 - RNA, 19 nt, artificial
  Oligomer
aggauuauaaaccacacug

SEQ ID NO: 28154 - RNA, 19 nt, artificial
  Oligomer
aauacgcuccucuuugcug

SEQ ID NO: 28155 - RNA, 19 nt, artificial
  Oligomer
uuacuagcaaagagggagg

SEQ ID NO: 28156 - RNA, 19 nt, artificial
  Oligomer
aaacuaaugguuuucuucc

SEQ ID NO: 28157 - RNA, 19 nt, artificial
  Oligomer
augguuuucuuccagcuag

SEQ ID NO: 28158 - RNA, 19 nt, artificial
  Oligomer
uucccuucaacaccacagg

SEQ ID NO: 28159 - RNA, 19 nt, artificial
  Oligomer
auguacuuuuccaugaagg

SEQ ID NO: 28160 - RNA, 19 nt, artificial
  Oligomer
ucaauggucuccuuagggc

SEQ ID NO: 28161 - RNA, 19 nt, artificial
  Oligomer
uccucagucaucuugggug

SEQ ID NO: 28162 - RNA, 19 nt, artificial
  Oligomer
uucucagagguguccguca

SEQ ID NO: 28163 - RNA, 19 nt, artificial
  Oligomer
auagcaagcaggaagacag

SEQ ID NO: 28164 - RNA, 19 nt, artificial
  Oligomer
uaaauuaacagcaaacuaa

SEQ ID NO: 28165 - RNA, 19 nt, artificial
  Oligomer
aucagcuuuagauacccac

SEQ ID NO: 28166 - RNA, 19 nt, artificial
  Oligomer
ucaaggauuauaaaccaca

SEQ ID NO: 28167 - RNA, 19 nt, artificial
  Oligomer
ucuuagucugccuuuuucu

SEQ ID NO: 28168 - RNA, 19 nt, artificial
  Oligomer
uaccugagacagacucacg

SEQ ID NO: 28169 - RNA, 19 nt, artificial
  Oligomer
uacagaaugcggcugauca

SEQ ID NO: 28170 - RNA, 19 nt, artificial
  Oligomer
uuucuauuucaauggucuc

SEQ ID NO: 28171 - RNA, 19 nt, artificial
  Oligomer
auguccauggugaagaggg

SEQ ID NO: 28172 - RNA, 19 nt, artificial
  Oligomer
uagauaacgaugauggaga

SEQ ID NO: 28173 - RNA, 19 nt, artificial
  Oligomer
uccucuuugcuguugcgca

SEQ ID NO: 28174 - RNA, 19 nt, artificial
  Oligomer
augaacaugggcaucagcu

SEQ ID NO: 28175 - RNA, 19 nt, artificial
  Oligomer
uuucaauggucuccuuagg

SEQ ID NO: 28176 - RNA, 19 nt, artificial
  Oligomer
uguuucuauuucaaugguc

SEQ ID NO: 28177 - RNA, 19 nt, artificial
  Oligomer
aaacauagcccacaguccg

SEQ ID NO: 28178 - RNA, 19 nt, artificial
  Oligomer
gucaucuucaucuucaugg

SEQ ID NO: 28179 - RNA, 19 nt, artificial
  Oligomer
uggaguguagcauuuuucc

SEQ ID NO: 28180 - RNA, 19 nt, artificial
  Oligomer
aucaugagcucuuucucag

SEQ ID NO: 28181 - RNA, 19 nt, artificial
  Oligomer
uccaacagucccacgauug

SEQ ID NO: 28182 - RNA, 19 nt, artificial
  Oligomer
auccggaauggguuuggug

SEQ ID NO: 28183 - RNA, 19 nt, artificial
  Oligomer
uuuuuccugaaagguggug

SEQ ID NO: 28184 - RNA, 19 nt, artificial
  Oligomer
aucccaaagaugaacccag

SEQ ID NO: 28185 - RNA, 19 nt, artificial
  Oligomer
aucuaccugagacagacuc

SEQ ID NO: 28186 - RNA, 19 nt, artificial
  Oligomer
aauguuacuagcaaagagg

SEQ ID NO: 28187 - RNA, 19 nt, artificial
  Oligomer
uuuuucuggaugugacuga

SEQ ID NO: 28188 - RNA, 19 nt, artificial
  Oligomer
uuuuuucuucucaggaacu

SEQ ID NO: 28189 - RNA, 19 nt, artificial
  Oligomer
uuuggugaggagggagaug

SEQ ID NO: 28190 - RNA, 19 nt, artificial
  Oligomer
auguaaucgaagaguugcc

SEQ ID NO: 28191 - RNA, 19 nt, artificial
  Oligomer
aaguagauaacgaugaugg

SEQ ID NO: 28192 - RNA, 19 nt, artificial
  Oligomer
uccggaauggguuugguga

SEQ ID NO: 28193 - RNA, 19 nt, artificial
  Oligomer
augaaggcgucauagccuc

SEQ ID NO: 28194 - RNA, 19 nt, artificial
  Oligomer
aggauaaacaaccuuccgg

SEQ ID NO: 28195 - RNA, 19 nt, artificial
  Oligomer
uauuucaauggucuccuua

SEQ ID NO: 28196 - RNA, 19 nt, artificial
  Oligomer
uccaauguuacuagcaaag

SEQ ID NO: 28197 - RNA, 19 nt, artificial
  Oligomer
uaccacgaaguagauaacg

SEQ ID NO: 28198 - RNA, 19 nt, artificial
  Oligomer
uccauaagcaaacucagua

SEQ ID NO: 28199 - RNA, 19 nt, artificial
  Oligomer
uagauguccauggugaaga

SEQ ID NO: 28200 - RNA, 19 nt, artificial
  Oligomer
acugauagcaucaggccuc

SEQ ID NO: 28201 - RNA, 19 nt, artificial
  Oligomer
uucaaggauuauaaaccac

SEQ ID NO: 28202 - RNA, 19 nt, artificial
  Oligomer
augcggcugaucauuccug

SEQ ID NO: 28203 - RNA, 19 nt, artificial
  Oligomer
auaaucgugggacaguugc

SEQ ID NO: 28204 - RNA, 19 nt, artificial
  Oligomer
ucucacauucugaagggac

SEQ ID NO: 28205 - RNA, 19 nt, artificial
  Oligomer
augaucaccgucugcaagg

SEQ ID NO: 28206 - RNA, 19 nt, artificial
  Oligomer
aucagcaccaggauaaaca

SEQ ID NO: 28207 - RNA, 19 nt, artificial
  Oligomer
uaccacaagguaaggaugg

SEQ ID NO: 28208 - RNA, 19 nt, artificial
  Oligomer
gucaauacgcuccucuuug

SEQ ID NO: 28209 - RNA, 19 nt, artificial
  Oligomer
uaaauacagauucaggccu

SEQ ID NO: 28210 - RNA, 19 nt, artificial
  Oligomer
auugacguucaacacuguc

SEQ ID NO: 28211 - RNA, 19 nt, artificial
  Oligomer
uaaaucuacagcaaaaggu

SEQ ID NO: 28212 - RNA, 19 nt, artificial
  Oligomer
auuucucacauucugaagg

SEQ ID NO: 28213 - RNA, 19 nt, artificial
  Oligomer
aagauguggaaggagucgg

SEQ ID NO: 28214 - RNA, 19 nt, artificial
  Oligomer
ugguaccgcaauauuucuc

SEQ ID NO: 28215 - RNA, 19 nt, artificial
  Oligomer
auacgcuccucuuugcugu

SEQ ID NO: 28216 - RNA, 19 nt, artificial
  Oligomer
ugaucugugcaccaguacc

SEQ ID NO: 28217 - RNA, 19 nt, artificial
  Oligomer
uccucuuccucagucaucu

SEQ ID NO: 28218 - RNA, 19 nt, artificial
  Oligomer
aguuucuaaaacaauauuc

SEQ ID NO: 28219 - RNA, 19 nt, artificial
  Oligomer
uacagcaaaagguaggacu

SEQ ID NO: 28220 - RNA, 19 nt, artificial
  Oligomer
ucagagguguccgucaucu

SEQ ID NO: 28221 - RNA, 19 nt, artificial
  Oligomer
uuuuccaugaaggcgucau

SEQ ID NO: 28222 - RNA, 19 nt, artificial
  Oligomer
uccgucaucuucaucuuca

SEQ ID NO: 28223 - RNA, 19 nt, artificial
  Oligomer
aucuacagcaaaagguagg

SEQ ID NO: 28224 - RNA, 19 nt, artificial
  Oligomer
uuaacagcaaacuaauggu

SEQ ID NO: 28225 - RNA, 19 nt, artificial
  Oligomer
uaaugguuuucuuccagcu

SEQ ID NO: 28226 - RNA, 19 nt, artificial
  Oligomer
auuccuuuuuucuucucag

SEQ ID NO: 28227 - RNA, 19 nt, artificial
  Oligomer
uuuucuggaugugacugag

SEQ ID NO: 28228 - RNA, 19 nt, artificial
  Oligomer
auguagagcagcagggaca

SEQ ID NO: 28229 - RNA, 19 nt, artificial
  Oligomer
cugauuucccuucaacacc

SEQ ID NO: 28230 - RNA, 19 nt, artificial
  Oligomer
aucggcugcauugcgaaug

SEQ ID NO: 28231 - RNA, 19 nt, artificial
  Oligomer
aacagucccacgauuggug

SEQ ID NO: 28232 - RNA, 19 nt, artificial
  Oligomer
ugguggaaaacauagccca

SEQ ID NO: 28233 - RNA, 19 nt, artificial
  Oligomer
ucuccuuagggccuucuug

SEQ ID NO: 28234 - RNA, 19 nt, artificial
  Oligomer
aaaauguagagcagcaggg

SEQ ID NO: 28235 - RNA, 19 nt, artificial
  Oligomer
ugaagauuccuuuuuucuu

SEQ ID NO: 28236 - RNA, 19 nt, artificial
  Oligomer
ucuuccagaaaauagcaag

SEQ ID NO: 28237 - RNA, 19 nt, artificial
  Oligomer
auagccucccacuucguga

SEQ ID NO: 28238 - RNA, 19 nt, artificial
  Oligomer
uccuuuuuucuucucagga

SEQ ID NO: 28239 - RNA, 19 nt, artificial
  Oligomer
auuauaaaccacacugaca

SEQ ID NO: 28240 - RNA, 19 nt, artificial
  Oligomer
uuucucacauucugaaggg

SEQ ID NO: 28241 - RNA, 19 nt, artificial
  Oligomer
uucauguacuuuuccauga

SEQ ID NO: 28242 - RNA, 19 nt, artificial
  Oligomer
uuccgcauccaggucaaua

SEQ ID NO: 28243 - RNA, 19 nt, artificial
  Oligomer
uuuuucuucucaggaacuu

SEQ ID NO: 28244 - RNA, 19 nt, artificial
  Oligomer
aaguccuaggaucaguccc

SEQ ID NO: 28245 - RNA, 19 nt, artificial
  Oligomer
guuuucuuccagcuagccu

SEQ ID NO: 28246 - RNA, 19 nt, artificial
  Oligomer
auuucaauggucuccuuag

SEQ ID NO: 28247 - RNA, 19 nt, artificial
  Oligomer
uucacgugagacauauucu

SEQ ID NO: 28248 - RNA, 19 nt, artificial
  Oligomer
augauggagauaucggcug

SEQ ID NO: 28249 - RNA, 19 nt, artificial
  Oligomer
uuccauucaaagccuccaa

SEQ ID NO: 28250 - RNA, 19 nt, artificial
  Oligomer
agcaccaggauaaacaacc

SEQ ID NO: 28251 - RNA, 19 nt, artificial
  Oligomer
aucacuaccacgaaguaga

SEQ ID NO: 28252 - RNA, 19 nt, artificial
  Oligomer
augagcuccaccacuaagg

SEQ ID NO: 28253 - RNA, 19 nt, artificial
  Oligomer
uucuccucuuccucaguca

SEQ ID NO: 28254 - RNA, 19 nt, artificial
  Oligomer
uuccucagucaucuugggu

SEQ ID NO: 28255 - RNA, 19 nt, artificial
  Oligomer
ucgugaaaagcaaacccag

SEQ ID NO: 28256 - RNA, 19 nt, artificial
  Oligomer
cuaaugguuuucuuccagc

SEQ ID NO: 28257 - RNA, 19 nt, artificial
  Oligomer
aacacuguccuccacaaag

SEQ ID NO: 28258 - RNA, 19 nt, artificial
  Oligomer
uuccauaagcaaacucagu

SEQ ID NO: 28259 - RNA, 19 nt, artificial
  Oligomer
auuccauucaaagccucca

SEQ ID NO: 28260 - RNA, 19 nt, artificial
  Oligomer
ucuuucucagaugcucucu

SEQ ID NO: 28261 - RNA, 19 nt, artificial
  Oligomer
uugguaccgcaauauuucu

SEQ ID NO: 28262 - RNA, 19 nt, artificial
  Oligomer
uuggugaaaauguagagca

SEQ ID NO: 28263 - RNA, 19 nt, artificial
  Oligomer
agaaguccuaggaucaguc

SEQ ID NO: 28264 - RNA, 19 nt, artificial
  Oligomer
aaaugcauaaauuaacagc

SEQ ID NO: 28265 - RNA, 19 nt, artificial
  Oligomer
auauucaaggauuauaaac

SEQ ID NO: 28266 - RNA, 19 nt, artificial
  Oligomer
ucauugacucucuuccaga

SEQ ID NO: 28267 - RNA, 19 nt, artificial
  Oligomer
acauuuauccaccugggca

SEQ ID NO: 28268 - RNA, 19 nt, artificial
  Oligomer
ucugccgagaucuugguga

SEQ ID NO: 28269 - RNA, 19 nt, artificial
  Oligomer
accagcaugaucaccgucu

SEQ ID NO: 28270 - RNA, 19 nt, artificial
  Oligomer
uggaaaacauagcccacag

SEQ ID NO: 28271 - RNA, 19 nt, artificial
  Oligomer
uuggauaggcgauguuggu

SEQ ID NO: 28272 - RNA, 19 nt, artificial
  Oligomer
ugacugauagcaucaggcc

SEQ ID NO: 28273 - RNA, 19 nt, artificial
  Oligomer
ucccacuucgugaaaagca

SEQ ID NO: 28274 - RNA, 19 nt, artificial
  Oligomer
uuucuggaugugacugagu

SEQ ID NO: 28275 - RNA, 19 nt, artificial
  Oligomer
accaggauaaacaaccuuc

SEQ ID NO: 28276 - RNA, 19 nt, artificial
  Oligomer
ucccaaucagaaguccuag

SEQ ID NO: 28277 - RNA, 19 nt, artificial
  Oligomer
uccaugaaggcgucauagc

SEQ ID NO: 28278 - RNA, 19 nt, artificial
  Oligomer
aauggguuuggugaggagg

SEQ ID NO: 28279 - RNA, 19 nt, artificial
  Oligomer
ucucggaagauguggaagg

SEQ ID NO: 28280 - RNA, 19 nt, artificial
  Oligomer
uccuccacaaaggcuucuc

SEQ ID NO: 28281 - RNA, 19 nt, artificial
  Oligomer
aggaaggugaguaagaguc

SEQ ID NO: 28282 - RNA, 19 nt, artificial
  Oligomer
ucccaaagaugaacccagg

SEQ ID NO: 28283 - RNA, 19 nt, artificial
  Oligomer
uaaucgaagaguugcccac

SEQ ID NO: 28284 - RNA, 19 nt, artificial
  Oligomer
ugaaaauguagagcagcag

SEQ ID NO: 28285 - RNA, 19 nt, artificial
  Oligomer
ugauuucccuucaacacca

SEQ ID NO: 28286 - RNA, 19 nt, artificial
  Oligomer
ucaauacgcuccucuuugc

SEQ ID NO: 28287 - RNA, 19 nt, artificial
  Oligomer
aagaugucugccgagaucu

SEQ ID NO: 28288 - RNA, 19 nt, artificial
  Oligomer
ugacguucaacacuguccu

SEQ ID NO: 28289 - RNA, 19 nt, artificial
  Oligomer
ucuggaugugacugagugg

SEQ ID NO: 28290 - RNA, 19 nt, artificial
  Oligomer
acugacacccggaaucuac

SEQ ID NO: 28291 - RNA, 19 nt, artificial
  Oligomer
cuugguaccgcaauauuuc

SEQ ID NO: 28292 - RNA, 19 nt, artificial
  Oligomer
auaggucauaggcucuccu

SEQ ID NO: 28293 - RNA, 19 nt, artificial
  Oligomer
auggacuggauguaaucga

SEQ ID NO: 28294 - RNA, 19 nt, artificial
  Oligomer
uagagcagcagggacagaa

SEQ ID NO: 28295 - RNA, 19 nt, artificial
  Oligomer
auggacaucccaaagauga

SEQ ID NO: 28296 - RNA, 19 nt, artificial
  Oligomer
uaggcgauguugguacagc

SEQ ID NO: 28297 - RNA, 19 nt, artificial
  Oligomer
aaauaggucauaggcucuc

SEQ ID NO: 28298 - RNA, 19 nt, artificial
  Oligomer
uaaaacaauauucaaggau

SEQ ID NO: 28299 - RNA, 19 nt, artificial
  Oligomer
augcacauccggaaugggu

SEQ ID NO: 28300 - RNA, 19 nt, artificial
  Oligomer
auguuacuagcaaagaggg

SEQ ID NO: 28301 - RNA, 19 nt, artificial
  Oligomer
augaccacgauggugauga

SEQ ID NO: 28302 - RNA, 19 nt, artificial
  Oligomer
guacuuuuccaugaaggcg

SEQ ID NO: 28303 - RNA, 19 nt, artificial
  Oligomer
augaccugaucugugcacc

SEQ ID NO: 28304 - RNA, 19 nt, artificial
  Oligomer
aaaacauagcccacagucc

SEQ ID NO: 28305 - RNA, 19 nt, artificial
  Oligomer
uccgcauccaggucaauac

SEQ ID NO: 28306 - RNA, 19 nt, artificial
  Oligomer
uguacuuuuccaugaaggc

SEQ ID NO: 28307 - RNA, 19 nt, artificial
  Oligomer
uccugaaaggugguguugc

SEQ ID NO: 28308 - RNA, 19 nt, artificial
  Oligomer
ugcacauccggaauggguu

SEQ ID NO: 28309 - RNA, 19 nt, artificial
  Oligomer
cucacgucagacaucaauc

SEQ ID NO: 28310 - RNA, 19 nt, artificial
  Oligomer
ugguuuucuuccagcuagc

SEQ ID NO: 28311 - RNA, 19 nt, artificial
  Oligomer
uuccagaaaauagcaagca

SEQ ID NO: 28312 - RNA, 19 nt, artificial
  Oligomer
uagcccacaaaauagguca

SEQ ID NO: 28313 - RNA, 19 nt, artificial
  Oligomer
auggugaugaaagaaaugg

SEQ ID NO: 28314 - RNA, 19 nt, artificial
  Oligomer
uauuucucacauucugaag

SEQ ID NO: 28315 - RNA, 19 nt, artificial
  Oligomer
acgguagagaugcacaucc

SEQ ID NO: 28316 - RNA, 19 nt, artificial
  Oligomer
agagguguccgucaucuuc

SEQ ID NO: 28317 - RNA, 19 nt, artificial
  Oligomer
aucagaaguccuaggauca

SEQ ID NO: 28318 - RNA, 19 nt, artificial
  Oligomer
ucugauucuuagucugccu

SEQ ID NO: 28319 - RNA, 19 nt, artificial
  Oligomer
uguccguguaaaucaccgc

SEQ ID NO: 28320 - RNA, 19 nt, artificial
  Oligomer
acuaaugguuuucuuccag

SEQ ID NO: 28321 - RNA, 19 nt, artificial
  Oligomer
ucagaugcucucuugcgga

SEQ ID NO: 28322 - RNA, 19 nt, artificial
  Oligomer
uuccagcuagccuauaauu

SEQ ID NO: 28323 - RNA, 19 nt, artificial
  Oligomer
acgugagacauauucuugg

SEQ ID NO: 28324 - RNA, 19 nt, artificial
  Oligomer
uccagcuagccuauaauua

SEQ ID NO: 28325 - RNA, 19 nt, artificial
  Oligomer
uaggcucuccugaagauuc

SEQ ID NO: 28326 - RNA, 19 nt, artificial
  Oligomer
aacucaguaaucauacgug

SEQ ID NO: 28327 - RNA, 19 nt, artificial
  Oligomer
aacccagucaggauuaaag

SEQ ID NO: 28328 - RNA, 19 nt, artificial
  Oligomer
uggauaggcgauguuggua

SEQ ID NO: 28329 - RNA, 19 nt, artificial
  Oligomer
augagcucuuucucagaug

SEQ ID NO: 28330 - RNA, 19 nt, artificial
  Oligomer
aaucagaaguccuaggauc

SEQ ID NO: 28331 - RNA, 19 nt, artificial
  Oligomer
cucuuccucagucaucuug

SEQ ID NO: 28332 - RNA, 19 nt, artificial
  Oligomer
aauauuucucacauucuga

SEQ ID NO: 28333 - RNA, 19 nt, artificial
  Oligomer
uccagaaaauagcaagcag

SEQ ID NO: 28334 - RNA, 19 nt, artificial
  Oligomer
uuucuuccagcuagccuau

SEQ ID NO: 28335 - RNA, 19 nt, artificial
  Oligomer
acgaugauggagauaucgg

SEQ ID NO: 28336 - RNA, 19 nt, artificial
  Oligomer
gugaaaagcaaacccaguc

SEQ ID NO: 28337 - RNA, 19 nt, artificial
  Oligomer
cacaggacgagacuaaagg

SEQ ID NO: 28338 - RNA, 19 nt, artificial
  Oligomer
aaucaugagcucuuucuca

SEQ ID NO: 28339 - RNA, 19 nt, artificial
  Oligomer
aaucgugggacaguugcug

SEQ ID NO: 28340 - RNA, 19 nt, artificial
  Oligomer
guguccgucaucuucaucu

SEQ ID NO: 28341 - RNA, 19 nt, artificial
  Oligomer
cuuagggccuucuuggaug

SEQ ID NO: 28342 - RNA, 19 nt, artificial
  Oligomer
auaaauuaacagcaaacua

SEQ ID NO: 28343 - RNA, 19 nt, artificial
  Oligomer
uagucugccuuuuucugga

SEQ ID NO: 28344 - RNA, 19 nt, artificial
  Oligomer
aauaggucauaggcucucc

SEQ ID NO: 28345 - RNA, 19 nt, artificial
  Oligomer
aaugcauaaauuaacagca

SEQ ID NO: 28346 - RNA, 19 nt, artificial
  Oligomer
uuccugaaaggugguguug

SEQ ID NO: 28347 - RNA, 19 nt, artificial
  Oligomer
uuuccaugaaggcgucaua

SEQ ID NO: 28348 - RNA, 19 nt, artificial
  Oligomer
guguccguguaaaucaccg

SEQ ID NO: 28349 - RNA, 19 nt, artificial
  Oligomer
guuggauaggcgauguugg

SEQ ID NO: 28350 - RNA, 19 nt, artificial
  Oligomer
acuaagguuggauaggcga

SEQ ID NO: 28351 - RNA, 19 nt, artificial
  Oligomer
ugaaaagcaaacccaguca

SEQ ID NO: 28352 - RNA, 19 nt, artificial
  Oligomer
ucaaaugcauaaauuaaca

SEQ ID NO: 28353 - RNA, 19 nt, artificial
  Oligomer
ucuuggauguucuccucuu

SEQ ID NO: 28354 - RNA, 19 nt, artificial
  Oligomer
aucugugcaccaguaccac

SEQ ID NO: 28355 - RNA, 19 nt, artificial
  Oligomer
agauaucggcugcauugcg

SEQ ID NO: 28356 - RNA, 19 nt, artificial
  Oligomer
ugacugaguggacucccuu

SEQ ID NO: 28357 - RNA, 19 nt, artificial
  Oligomer
cuucgugaaaagcaaaccc

SEQ ID NO: 28358 - RNA, 19 nt, artificial
  Oligomer
cuuagucugccuuuuucug

SEQ ID NO: 28359 - RNA, 19 nt, artificial
  Oligomer
accaugaugaacaugggca

SEQ ID NO: 28360 - RNA, 19 nt, artificial
  Oligomer
aaagguaggacucaggcaa

SEQ ID NO: 28361 - RNA, 19 nt, artificial
  Oligomer
uagagaugcacauccggaa

SEQ ID NO: 28362 - RNA, 19 nt, artificial
  Oligomer
acaaccaccaaaaccaggg

SEQ ID NO: 28363 - RNA, 19 nt, artificial
  Oligomer
auaacgaugauggagauau

SEQ ID NO: 28364 - RNA, 19 nt, artificial
  Oligomer
ucauagccucccacuucgu

SEQ ID NO: 28365 - RNA, 19 nt, artificial
  Oligomer
auaaacaaccuuccggcaa

SEQ ID NO: 28366 - RNA, 19 nt, artificial
  Oligomer
uuccaauguuacuagcaaa

SEQ ID NO: 28367 - RNA, 19 nt, artificial
  Oligomer
uaggacucaggcaaaauau

SEQ ID NO: 28368 - RNA, 19 nt, artificial
  Oligomer
uauaaaccacacugacacc

SEQ ID NO: 28369 - RNA, 19 nt, artificial
  Oligomer
ugauggacuggauguaauc

SEQ ID NO: 28370 - RNA, 19 nt, artificial
  Oligomer
aacgaugauggagauaucg

SEQ ID NO: 28371 - RNA, 19 nt, artificial
  Oligomer
auaagcaaacucaguaauc

SEQ ID NO: 28372 - RNA, 19 nt, artificial
  Oligomer
acaaaauaggucauaggcu

SEQ ID NO: 28373 - RNA, 19 nt, artificial
  Oligomer
aauguagagcagcagggac

SEQ ID NO: 28374 - RNA, 19 nt, artificial
  Oligomer
ugcacaaugaccugaucug

SEQ ID NO: 28375 - RNA, 19 nt, artificial
  Oligomer
cucucuuccagaaaauagc

SEQ ID NO: 28376 - RNA, 19 nt, artificial
  Oligomer
uaacuggugauggacugga

SEQ ID NO: 28377 - RNA, 19 nt, artificial
  Oligomer
auggguggucccaaguaac

SEQ ID NO: 28378 - RNA, 19 nt, artificial
  Oligomer
aagggaaagguagaccugg

SEQ ID NO: 28379 - RNA, 19 nt, artificial
  Oligomer
ucagacacuaugguuggaa

SEQ ID NO: 28380 - RNA, 19 nt, artificial
  Oligomer
uccaggucaauacgcuccu

SEQ ID NO: 28381 - RNA, 19 nt, artificial
  Oligomer
uguaaagggcagugauugc

SEQ ID NO: 28382 - RNA, 19 nt, artificial
  Oligomer
ucauacgugaaaucccaau

SEQ ID NO: 28383 - RNA, 19 nt, artificial
  Oligomer
acucucuuccagaaaauag

SEQ ID NO: 28384 - RNA, 19 nt, artificial
  Oligomer
cucuuucucagaugcucuc

SEQ ID NO: 28385 - RNA, 19 nt, artificial
  Oligomer
acauucugaagggacgaca

SEQ ID NO: 28386 - RNA, 19 nt, artificial
  Oligomer
auuucccuucaacaccaca

SEQ ID NO: 28387 - RNA, 19 nt, artificial
  Oligomer
ugaaaucccaaucagaagu

SEQ ID NO: 28388 - RNA, 19 nt, artificial
  Oligomer
agaaugcggcugaucauuc

SEQ ID NO: 28389 - RNA, 19 nt, artificial
  Oligomer
agcaugaucaccgucugca

SEQ ID NO: 28390 - RNA, 19 nt, artificial
  Oligomer
ucuaccugagacagacuca

SEQ ID NO: 28391 - RNA, 19 nt, artificial
  Oligomer
aagaguugcccacuuugug

SEQ ID NO: 28392 - RNA, 19 nt, artificial
  Oligomer
agaguugcccacuuugugc

SEQ ID NO: 28393 - RNA, 19 nt, artificial
  Oligomer
augugacugaguggacucc

SEQ ID NO: 28394 - RNA, 19 nt, artificial
  Oligomer
aagguguccguguaaauca

SEQ ID NO: 28395 - RNA, 19 nt, artificial
  Oligomer
gaguguagcauuuuuccug

SEQ ID NO: 28396 - RNA, 19 nt, artificial
  Oligomer
cucacauucugaagggacg

SEQ ID NO: 28397 - RNA, 19 nt, artificial
  Oligomer
ucauaggcucuccugaaga

SEQ ID NO: 28398 - RNA, 19 nt, artificial
  Oligomer
ccauugacguucaacacug

SEQ ID NO: 28399 - RNA, 19 nt, artificial
  Oligomer
ucagaaguccuaggaucag

SEQ ID NO: 28400 - RNA, 19 nt, artificial
  Oligomer
cuaaauacagauucaggcc

SEQ ID NO: 28401 - RNA, 19 nt, artificial
  Oligomer
uaccgcaauauuucucaca

SEQ ID NO: 28402 - RNA, 19 nt, artificial
  Oligomer
aucaccgucugcaaggugu

SEQ ID NO: 28403 - RNA, 19 nt, artificial
  Oligomer
uaaggauggacaucccaaa

SEQ ID NO: 28404 - RNA, 19 nt, artificial
  Oligomer
augagcucgugggucucaa

SEQ ID NO: 28405 - RNA, 19 nt, artificial
  Oligomer
auguucuccucuuccgcau

SEQ ID NO: 28406 - RNA, 19 nt, artificial
  Oligomer
cauuuuuccugaaaggugg

SEQ ID NO: 28407 - RNA, 19 nt, artificial
  Oligomer
ucagcuuuagauacccaca

SEQ ID NO: 28408 - RNA, 19 nt, artificial
  Oligomer
cuuuuucuggaugugacug

SEQ ID NO: 28409 - RNA, 19 nt, artificial
  Oligomer
agcuccaccacuaagguug

SEQ ID NO: 28410 - RNA, 19 nt, artificial
  Oligomer
uucuccucuuccgcaucca

SEQ ID NO: 28411 - RNA, 19 nt, artificial
  Oligomer
acugaguggacucccuucu

SEQ ID NO: 28412 - RNA, 19 nt, artificial
  Oligomer
augaugaacaugggcauca

SEQ ID NO: 28413 - RNA, 19 nt, artificial
  Oligomer
acaaugaccugaucugugc

SEQ ID NO: 28414 - RNA, 19 nt, artificial
  Oligomer
ugauucuuagucugccuuu

SEQ ID NO: 28415 - RNA, 19 nt, artificial
  Oligomer
ucccaaguaacuggugaug

SEQ ID NO: 28416 - RNA, 19 nt, artificial
  Oligomer
uguucuccucuuccgcauc

SEQ ID NO: 28417 - RNA, 19 nt, artificial
  Oligomer
cuguccuccacaaaggcuu

SEQ ID NO: 28418 - RNA, 19 nt, artificial
  Oligomer
aaucauacgugaaauccca

SEQ ID NO: 28419 - RNA, 19 nt, artificial
  Oligomer
ugcaccaguaccacaaggu

SEQ ID NO: 28420 - RNA, 19 nt, artificial
  Oligomer
uugacucucuuccagaaaa

SEQ ID NO: 28421 - RNA, 19 nt, artificial
  Oligomer
ucugugcaccaguaccaca

SEQ ID NO: 28422 - RNA, 19 nt, artificial
  Oligomer
accaaaaccagggcauucc

SEQ ID NO: 28423 - RNA, 19 nt, artificial
  Oligomer
acuggugauggacuggaug

SEQ ID NO: 28424 - RNA, 19 nt, artificial
  Oligomer
cacuaagguuggauaggcg

SEQ ID NO: 28425 - RNA, 19 nt, artificial
  Oligomer
cuccucuuccucagucauc

SEQ ID NO: 28426 - RNA, 19 nt, artificial
  Oligomer
agcaugacugauagcauca

SEQ ID NO: 28427 - RNA, 19 nt, artificial
  Oligomer
guaaagggcagugauugcc

SEQ ID NO: 28428 - RNA, 19 nt, artificial
  Oligomer
accugagacagacucacgu

SEQ ID NO: 28429 - RNA, 19 nt, artificial
  Oligomer
cugcauugcgaaugagcuc

SEQ ID NO: 28430 - RNA, 19 nt, artificial
  Oligomer
augggcaucagcuuuagau

SEQ ID NO: 28431 - RNA, 19 nt, artificial
  Oligomer
aaguacaaguagugcaccc

SEQ ID NO: 28432 - RNA, 19 nt, artificial
  Oligomer
aucuuggugaaaauguaga

SEQ ID NO: 28433 - RNA, 19 nt, artificial
  Oligomer
aaacucaguaaucauacgu

SEQ ID NO: 28434 - RNA, 19 nt, artificial
  Oligomer
aaaauaggucauaggcucu

SEQ ID NO: 28435 - RNA, 19 nt, artificial
  Oligomer
ugagacagacucacgucag

SEQ ID NO: 28436 - RNA, 19 nt, artificial
  Oligomer
cuguugaagauggagguca

SEQ ID NO: 28437 - RNA, 19 nt, artificial
  Oligomer
auacagauucaggccuaag

SEQ ID NO: 28438 - RNA, 19 nt, artificial
  Oligomer
uagcaagcaggaagacagc

SEQ ID NO: 28439 - RNA, 19 nt, artificial
  Oligomer
auucuuagucugccuuuuu

SEQ ID NO: 28440 - RNA, 19 nt, artificial
  Oligomer
cacaaugaccugaucugug

SEQ ID NO: 28441 - RNA, 19 nt, artificial
  Oligomer
cuucacgugagacauauuc

SEQ ID NO: 28442 - RNA, 19 nt, artificial
  Oligomer
cauuccauucaaagccucc

SEQ ID NO: 28443 - RNA, 19 nt, artificial
  Oligomer
acaauauucaaggauuaua

SEQ ID NO: 28444 - RNA, 19 nt, artificial
  Oligomer
uccauucaaagccuccaau

SEQ ID NO: 28445 - RNA, 19 nt, artificial
  Oligomer
uccggcaaucaugagcucu

SEQ ID NO: 28446 - RNA, 19 nt, artificial
  Oligomer
uggagauaucggcugcauu

SEQ ID NO: 28447 - RNA, 19 nt, artificial
  Oligomer
aaagguagaccuggauccg

SEQ ID NO: 28448 - RNA, 19 nt, artificial
  Oligomer
cuuuuuucuucucaggaac

SEQ ID NO: 28449 - RNA, 19 nt, artificial
  Oligomer
gaugucugccgagaucuug

SEQ ID NO: 28450 - RNA, 19 nt, artificial
  Oligomer
gaaaauagcaagcaggaag

SEQ ID NO: 28451 - RNA, 19 nt, artificial
  Oligomer
ucucuuccagaaaauagca

SEQ ID NO: 28452 - RNA, 19 nt, artificial
  Oligomer
acagauucaggccuaaggc

SEQ ID NO: 28453 - RNA, 19 nt, artificial
  Oligomer
aguccauugggcaugagcu

SEQ ID NO: 28454 - RNA, 19 nt, artificial
  Oligomer
uccacaaaggcuucucaga

SEQ ID NO: 28455 - RNA, 19 nt, artificial
  Oligomer
guuacuagcaaagagggag

SEQ ID NO: 28456 - RNA, 19 nt, artificial
  Oligomer
caugaaggcgucauagccu

SEQ ID NO: 28457 - RNA, 19 nt, artificial
  Oligomer
uugcccacuuugugcugac

SEQ ID NO: 28458 - RNA, 19 nt, artificial
  Oligomer
aaguaacuggugauggacu

SEQ ID NO: 28459 - RNA, 19 nt, artificial
  Oligomer
auucaaggauuauaaacca

SEQ ID NO: 28460 - RNA, 19 nt, artificial
  Oligomer
acuaccacgaaguagauaa

SEQ ID NO: 28461 - RNA, 19 nt, artificial
  Oligomer
uuuauccaccugggcaaaa

SEQ ID NO: 28462 - RNA, 19 nt, artificial
  Oligomer
cucauugacucucuuccag

SEQ ID NO: 28463 - RNA, 19 nt, artificial
  Oligomer
aaugguuuucuuccagcua

SEQ ID NO: 28464 - RNA, 19 nt, artificial
  Oligomer
uggauguaaucgaagaguu

SEQ ID NO: 28465 - RNA, 19 nt, artificial
  Oligomer
ccuucuuggauguucuccu

SEQ ID NO: 28466 - RNA, 19 nt, artificial
  Oligomer
aucccaaucagaaguccua

SEQ ID NO: 28467 - RNA, 19 nt, artificial
  Oligomer
aggacgagacuaaaggaag

SEQ ID NO: 28468 - RNA, 19 nt, artificial
  Oligomer
uuauccaccugggcaaaau

SEQ ID NO: 28469 - RNA, 19 nt, artificial
  Oligomer
caaaauaggucauaggcuc

SEQ ID NO: 28470 - RNA, 19 nt, artificial
  Oligomer
accacgauggugaugaaag

SEQ ID NO: 28471 - RNA, 19 nt, artificial
  Oligomer
uggaugugacugaguggac

SEQ ID NO: 28472 - RNA, 19 nt, artificial
  Oligomer
ccagaaaauagcaagcagg

SEQ ID NO: 28473 - RNA, 19 nt, artificial
  Oligomer
uacgugaaaucccaaucag

SEQ ID NO: 28474 - RNA, 19 nt, artificial
  Oligomer
ugccuuuuucuggauguga

SEQ ID NO: 28475 - RNA, 19 nt, artificial
  Oligomer
ccagucaggauuaaagacc

SEQ ID NO: 28476 - RNA, 19 nt, artificial
  Oligomer
ucacgugagacauauucuu

SEQ ID NO: 28477 - RNA, 19 nt, artificial
  Oligomer
gaaaacauagcccacaguc

SEQ ID NO: 28478 - RNA, 19 nt, artificial
  Oligomer
ugugcugacugcacaaugg

SEQ ID NO: 28479 - RNA, 19 nt, artificial
  Oligomer
aggugaguaagaguccagc

SEQ ID NO: 28480 - RNA, 19 nt, artificial
  Oligomer
uuuccugaaaggugguguu

SEQ ID NO: 28481 - RNA, 19 nt, artificial
  Oligomer
ugagcucuuucucagaugc

SEQ ID NO: 28482 - RNA, 19 nt, artificial
  Oligomer
cuccaguagguacagaugg

SEQ ID NO: 28483 - RNA, 19 nt, artificial
  Oligomer
cuccacaaaggcuucucag

SEQ ID NO: 28484 - RNA, 19 nt, artificial
  Oligomer
agcuagccuauaauuacac

SEQ ID NO: 28485 - RNA, 19 nt, artificial
  Oligomer
ccaucagacacuaugguug

SEQ ID NO: 28486 - RNA, 19 nt, artificial
  Oligomer
gcuaaauacagauucaggc

SEQ ID NO: 28487 - RNA, 19 nt, artificial
  Oligomer
caaaagguaggacucaggc

SEQ ID NO: 28488 - RNA, 19 nt, artificial
  Oligomer
aguaacuggugauggacug

SEQ ID NO: 28489 - RNA, 19 nt, artificial
  Oligomer
guguaaagggcagugauug

SEQ ID NO: 28490 - RNA, 19 nt, artificial
  Oligomer
acuuugugcugacugcaca

SEQ ID NO: 28491 - RNA, 19 nt, artificial
  Oligomer
cuucugauucuuagucugc

SEQ ID NO: 28492 - RNA, 19 nt, artificial
  Oligomer
ggauaaacaaccuuccggc

SEQ ID NO: 28493 - RNA, 19 nt, artificial
  Oligomer
uucuuccagcuagccuaua

SEQ ID NO: 28494 - RNA, 19 nt, artificial
  Oligomer
uggguggucccaaguaacu

SEQ ID NO: 28495 - RNA, 19 nt, artificial
  Oligomer
uguugaagauggaggucag

SEQ ID NO: 28496 - RNA, 19 nt, artificial
  Oligomer
aacagcaaacuaaugguuu

SEQ ID NO: 28497 - RNA, 19 nt, artificial
  Oligomer
ucuuggugaaaauguagag

SEQ ID NO: 28498 - RNA, 19 nt, artificial
  Oligomer
uaacagcaaacuaaugguu

SEQ ID NO: 28499 - RNA, 19 nt, artificial
  Oligomer
acuucgugaaaagcaaacc

SEQ ID NO: 28500 - RNA, 19 nt, artificial
  Oligomer
cucaggcaaaauaugcaug

SEQ ID NO: 28501 - RNA, 19 nt, artificial
  Oligomer
auauuucucacauucugaa

SEQ ID NO: 28502 - RNA, 19 nt, artificial
  Oligomer
agcacaaccaccaaaacca

SEQ ID NO: 28503 - RNA, 19 nt, artificial
  Oligomer
aauuaacagcaaacuaaug

SEQ ID NO: 28504 - RNA, 19 nt, artificial
  Oligomer
uaaaggaaggugaguaaga

SEQ ID NO: 28505 - RNA, 19 nt, artificial
  Oligomer
cuuucauguacuuuuccau

SEQ ID NO: 28506 - RNA, 19 nt, artificial
  Oligomer
auacgugaaaucccaauca

SEQ ID NO: 28507 - RNA, 19 nt, artificial
  Oligomer
caaacuaaugguuuucuuc

SEQ ID NO: 28508 - RNA, 19 nt, artificial
  Oligomer
cugaagauuccuuuuuucu

SEQ ID NO: 28509 - RNA, 19 nt, artificial
  Oligomer
uagcauuuuuccugaaagg

SEQ ID NO: 28510 - RNA, 19 nt, artificial
  Oligomer
acgucagacaucaaucaca

SEQ ID NO: 28511 - RNA, 19 nt, artificial
  Oligomer
ucacgucagacaucaauca

SEQ ID NO: 28512 - RNA, 19 nt, artificial
  Oligomer
caggucaauacgcuccucu

SEQ ID NO: 28513 - RNA, 19 nt, artificial
  Oligomer
guaaggauggacaucccaa

SEQ ID NO: 28514 - RNA, 19 nt, artificial
  Oligomer
ugaagauggaggucaggga

SEQ ID NO: 28515 - RNA, 19 nt, artificial
  Oligomer
aaggauuauaaaccacacu

SEQ ID NO: 28516 - RNA, 19 nt, artificial
  Oligomer
uccugaagauuccuuuuuu

SEQ ID NO: 28517 - RNA, 19 nt, artificial
  Oligomer
ucuuccagcuagccuauaa

SEQ ID NO: 28518 - RNA, 19 nt, artificial
  Oligomer
guuucuaaaacaauauuca

SEQ ID NO: 28519 - RNA, 19 nt, artificial
  Oligomer
aaggugaguaagaguccag

SEQ ID NO: 28520 - RNA, 19 nt, artificial
  Oligomer
gccuucuuggauguucucc

SEQ ID NO: 28521 - RNA, 19 nt, artificial
  Oligomer
aaaaccagggcauuccauu

SEQ ID NO: 28522 - RNA, 19 nt, artificial
  Oligomer
acacuguccuccacaaagg

SEQ ID NO: 28523 - RNA, 19 nt, artificial
  Oligomer
acagacgguagagaugcac

SEQ ID NO: 28524 - RNA, 19 nt, artificial
  Oligomer
uaagcaaacucaguaauca

SEQ ID NO: 28525 - RNA, 19 nt, artificial
  Oligomer
aaugaccugaucugugcac

SEQ ID NO: 28526 - RNA, 19 nt, artificial
  Oligomer
ugacacccggaaucuaccu

SEQ ID NO: 28527 - RNA, 19 nt, artificial
  Oligomer
ucucagagguguccgucau

SEQ ID NO: 28528 - RNA, 19 nt, artificial
  Oligomer
cgcaauauuucucacauuc

SEQ ID NO: 28529 - RNA, 19 nt, artificial
  Oligomer
cacaaaauaggucauaggc

SEQ ID NO: 28530 - RNA, 19 nt, artificial
  Oligomer
aagaagccuccaacagucc

SEQ ID NO: 28531 - RNA, 19 nt, artificial
  Oligomer
uuugugcugacugcacaau

SEQ ID NO: 28532 - RNA, 19 nt, artificial
  Oligomer
agcaaaagguaggacucag

SEQ ID NO: 28533 - RNA, 19 nt, artificial
  Oligomer
agcucuuucucagaugcuc

SEQ ID NO: 28534 - RNA, 19 nt, artificial
  Oligomer
uaaucgugggacaguugcu

SEQ ID NO: 28535 - RNA, 19 nt, artificial
  Oligomer
ugggcaaaauuuacaacug

SEQ ID NO: 28536 - RNA, 19 nt, artificial
  Oligomer
auaucggcugcauugcgaa

SEQ ID NO: 28537 - RNA, 19 nt, artificial
  Oligomer
aauagcaagcaggaagaca

SEQ ID NO: 28538 - RNA, 19 nt, artificial
  Oligomer
cugggcaaaauuuacaacu

SEQ ID NO: 28539 - RNA, 19 nt, artificial
  Oligomer
aucauacgugaaaucccaa

SEQ ID NO: 28540 - RNA, 19 nt, artificial
  Oligomer
ugguaaaucuacagcaaaa

SEQ ID NO: 28541 - RNA, 19 nt, artificial
  Oligomer
ucuagcccacaaaauaggu

SEQ ID NO: 28542 - RNA, 19 nt, artificial
  Oligomer
gaaaauguagagcagcagg

SEQ ID NO: 28543 - RNA, 19 nt, artificial
  Oligomer
agguaaggauggacauccc

SEQ ID NO: 28544 - RNA, 19 nt, artificial
  Oligomer
gauugguggaaaacauagc

SEQ ID NO: 28545 - RNA, 19 nt, artificial
  Oligomer
ucacauucugaagggacga

SEQ ID NO: 28546 - RNA, 19 nt, artificial
  Oligomer
aaaggcuucucagaggugu

SEQ ID NO: 28547 - RNA, 19 nt, artificial
  Oligomer
accaguaccacaagguaag

SEQ ID NO: 28548 - RNA, 19 nt, artificial
  Oligomer
acucacgucagacaucaau

SEQ ID NO: 28549 - RNA, 19 nt, artificial
  Oligomer
gaaagguagaccuggaucc

SEQ ID NO: 28550 - RNA, 19 nt, artificial
  Oligomer
aaucccaaucagaaguccu

SEQ ID NO: 28551 - RNA, 19 nt, artificial
  Oligomer
uccaccacuaagguuggau

SEQ ID NO: 28552 - RNA, 19 nt, artificial
  Oligomer
cacgaaguagauaacgaug

SEQ ID NO: 28553 - RNA, 19 nt, artificial
  Oligomer
uacuagcaaagagggaggc

SEQ ID NO: 28554 - RNA, 19 nt, artificial
  Oligomer
guaaucauacgugaaaucc

SEQ ID NO: 28555 - RNA, 19 nt, artificial
  Oligomer
acuguccuccacaaaggcu

SEQ ID NO: 28556 - RNA, 19 nt, artificial
  Oligomer
cuuccggcaaucaugagcu

SEQ ID NO: 28557 - RNA, 19 nt, artificial
  Oligomer
cuuucucagaugcucucuu

SEQ ID NO: 28558 - RNA, 19 nt, artificial
  Oligomer
aaaacaauauucaaggauu

SEQ ID NO: 28559 - RNA, 19 nt, artificial
  Oligomer
aagauuccuuuuuucuucu

SEQ ID NO: 28560 - RNA, 19 nt, artificial
  Oligomer
aaggcuucucagagguguc

SEQ ID NO: 28561 - RNA, 19 nt, artificial
  Oligomer
uguccuccacaaaggcuuc

SEQ ID NO: 28562 - RNA, 19 nt, artificial
  Oligomer
ccacaaaggcuucucagag

SEQ ID NO: 28563 - RNA, 19 nt, artificial
  Oligomer
caugacugauagcaucagg

SEQ ID NO: 28564 - RNA, 19 nt, artificial
  Oligomer
aaagagggaggcuccaauc

SEQ ID NO: 28565 - RNA, 19 nt, artificial
  Oligomer
ggcaucaccaugaugaaca

SEQ ID NO: 28566 - RNA, 19 nt, artificial
  Oligomer
caaccuuccggcaaucaug

SEQ ID NO: 28567 - RNA, 19 nt, artificial
  Oligomer
ugauggagauaucggcugc

SEQ ID NO: 28568 - RNA, 19 nt, artificial
  Oligomer
aaccgcuuccucagguacu

SEQ ID NO: 28569 - RNA, 19 nt, artificial
  Oligomer
ugaacaugggcaucagcuu

SEQ ID NO: 28570 - RNA, 19 nt, artificial
  Oligomer
aaggauggacaucccaaag

SEQ ID NO: 28571 - RNA, 19 nt, artificial
  Oligomer
guuucuauuucaauggucu

SEQ ID NO: 28572 - RNA, 19 nt, artificial
  Oligomer
aaaagguaggacucaggca

SEQ ID NO: 28573 - RNA, 19 nt, artificial
  Oligomer
aucgaagaguugcccacuu

SEQ ID NO: 28574 - RNA, 19 nt, artificial
  Oligomer
ucaugagcucuuucucaga

SEQ ID NO: 28575 - RNA, 19 nt, artificial
  Oligomer
uuagggccuucuuggaugu

SEQ ID NO: 28576 - RNA, 19 nt, artificial
  Oligomer
aaauuaacagcaaacuaau

SEQ ID NO: 28577 - RNA, 19 nt, artificial
  Oligomer
aucucggaagauguggaag

SEQ ID NO: 28578 - RNA, 19 nt, artificial
  Oligomer
caauauuucucacauucug

SEQ ID NO: 28579 - RNA, 19 nt, artificial
  Oligomer
ucaacaccacaggacgaga

SEQ ID NO: 28580 - RNA, 19 nt, artificial
  Oligomer
acaaaggcuucucagaggu

SEQ ID NO: 28581 - RNA, 19 nt, artificial
  Oligomer
ugcucuagcccacaaaaua

SEQ ID NO: 28582 - RNA, 19 nt, artificial
  Oligomer
agggccuucuuggauguuc

SEQ ID NO: 28583 - RNA, 19 nt, artificial
  Oligomer
gauguaaucgaagaguugc

SEQ ID NO: 28584 - RNA, 19 nt, artificial
  Oligomer
cgauugguggaaaacauag

SEQ ID NO: 28585 - RNA, 19 nt, artificial
  Oligomer
cauacgugaaaucccaauc

SEQ ID NO: 28586 - RNA, 19 nt, artificial
  Oligomer
gagaugaccacgaugguga

SEQ ID NO: 28587 - RNA, 19 nt, artificial
  Oligomer
agacacuaugguuggaaug

SEQ ID NO: 28588 - RNA, 19 nt, artificial
  Oligomer
acaggcaauuuuuucugug

SEQ ID NO: 28589 - RNA, 19 nt, artificial
  Oligomer
aaucuacagcaaaagguag

SEQ ID NO: 28590 - RNA, 19 nt, artificial
  Oligomer
agcaaacuaaugguuuucu

SEQ ID NO: 28591 - RNA, 19 nt, artificial
  Oligomer
ugucugccgagaucuuggu

SEQ ID NO: 28592 - RNA, 19 nt, artificial
  Oligomer
ggcucauugacucucuucc

SEQ ID NO: 28593 - RNA, 19 nt, artificial
  Oligomer
uccaccugggcaaaauuua

SEQ ID NO: 28594 - RNA, 19 nt, artificial
  Oligomer
uaaacaaccuuccggcaau

SEQ ID NO: 28595 - RNA, 19 nt, artificial
  Oligomer
gguugaaaaucaugcucaa

SEQ ID NO: 28596 - RNA, 19 nt, artificial
  Oligomer
ggaauuuuauugugaaaaa

SEQ ID NO: 28597 - RNA, 19 nt, artificial
  Oligomer
caacuaggcucauacucaa

SEQ ID NO: 28598 - RNA, 19 nt, artificial
  Oligomer
ggucgaauugggaauuuua

SEQ ID NO: 28599 - RNA, 19 nt, artificial
  Oligomer
gauccaggauaauuuuuaa

SEQ ID NO: 28600 - RNA, 19 nt, artificial
  Oligomer
cuuugagacuauucaucaa

SEQ ID NO: 28601 - RNA, 19 nt, artificial
  Oligomer
caagaaugaggauauagua

SEQ ID NO: 28602 - RNA, 19 nt, artificial
  Oligomer
ccaagucugugaauguaaa

SEQ ID NO: 28603 - RNA, 19 nt, artificial
  Oligomer
gaugauaaaaggagaauaa

SEQ ID NO: 28604 - RNA, 19 nt, artificial
  Oligomer
gguggagggugaguuugaa

SEQ ID NO: 28605 - RNA, 19 nt, artificial
  Oligomer
caucgguaaagcaccuaaa

SEQ ID NO: 28606 - RNA, 19 nt, artificial
  Oligomer
gauaaaaggagaauaagaa

SEQ ID NO: 28607 - RNA, 19 nt, artificial
  Oligomer
gaauguuaagaauaacuaa

SEQ ID NO: 28608 - RNA, 19 nt, artificial
  Oligomer
cccuguucaugcugagcaa

SEQ ID NO: 28609 - RNA, 19 nt, artificial
  Oligomer
gacuauucaucaagaauga

SEQ ID NO: 28610 - RNA, 19 nt, artificial
  Oligomer
gcguguuucgauacugcaa

SEQ ID NO: 28611 - RNA, 19 nt, artificial
  Oligomer
gcugaguuaugaaaagaua

SEQ ID NO: 28612 - RNA, 19 nt, artificial
  Oligomer
gaagcugauuuucaugaaa

SEQ ID NO: 28613 - RNA, 19 nt, artificial
  Oligomer
caauguuucuagagacaua

SEQ ID NO: 28614 - RNA, 19 nt, artificial
  Oligomer
cugaguuaugaaaagauaa

SEQ ID NO: 28615 - RNA, 19 nt, artificial
  Oligomer
caucaagaaugaggauaua

SEQ ID NO: 28616 - RNA, 19 nt, artificial
  Oligomer
cauggugcugggacaugaa

SEQ ID NO: 28617 - RNA, 19 nt, artificial
  Oligomer
ggauaauuuuuaaaccaau

SEQ ID NO: 28618 - RNA, 19 nt, artificial
  Oligomer
ccagaaucccugauguuaa

SEQ ID NO: 28619 - RNA, 19 nt, artificial
  Oligomer
gauugcuuuggguaauaaa

SEQ ID NO: 28620 - RNA, 19 nt, artificial
  Oligomer
agcugauuuucaugaaaau

SEQ ID NO: 28621 - RNA, 19 nt, artificial
  Oligomer
ugggaauuuuauugugaaa

SEQ ID NO: 28622 - RNA, 19 nt, artificial
  Oligomer
ggaauuggugugccuuaaa

SEQ ID NO: 28623 - RNA, 19 nt, artificial
  Oligomer
gagggcugaguuaugaaaa

SEQ ID NO: 28624 - RNA, 19 nt, artificial
  Oligomer
gaacuauccuaucccugaa

SEQ ID NO: 28625 - RNA, 19 nt, artificial
  Oligomer
gguaagauuuagaccuaaa

SEQ ID NO: 28626 - RNA, 19 nt, artificial
  Oligomer
cgggaacagucgaaaaagu

SEQ ID NO: 28627 - RNA, 19 nt, artificial
  Oligomer
ugagacuauucaucaagaa

SEQ ID NO: 28628 - RNA, 19 nt, artificial
  Oligomer
cccagaagcugauuuucau

SEQ ID NO: 28629 - RNA, 19 nt, artificial
  Oligomer
gguucugauuuucuuguaa

SEQ ID NO: 28630 - RNA, 19 nt, artificial
  Oligomer
ggagaauaagaaaaggcau

SEQ ID NO: 28631 - RNA, 19 nt, artificial
  Oligomer
gcaagaugggccgauacaa

SEQ ID NO: 28632 - RNA, 19 nt, artificial
  Oligomer
gguuauuauaaacagaaaa

SEQ ID NO: 28633 - RNA, 19 nt, artificial
  Oligomer
cccuaauguggaaaaagua

SEQ ID NO: 28634 - RNA, 19 nt, artificial
  Oligomer
ccaggaaacugcuacuugu

SEQ ID NO: 28635 - RNA, 19 nt, artificial
  Oligomer
gccgguucuauaagcacaa

SEQ ID NO: 28636 - RNA, 19 nt, artificial
  Oligomer
ggccuuugaaacauuuaaa

SEQ ID NO: 28637 - RNA, 19 nt, artificial
  Oligomer
ugguuauuauaaacagaaa

SEQ ID NO: 28638 - RNA, 19 nt, artificial
  Oligomer
agauuagcaucccauacua

SEQ ID NO: 28639 - RNA, 19 nt, artificial
  Oligomer
ggacaugaagcuucgggaa

SEQ ID NO: 28640 - RNA, 19 nt, artificial
  Oligomer
cagaaucccugauguuaau

SEQ ID NO: 28641 - RNA, 19 nt, artificial
  Oligomer
caagucugugaauguaaaa

SEQ ID NO: 28642 - RNA, 19 nt, artificial
  Oligomer
ugauaaaaggagaauaaga

SEQ ID NO: 28643 - RNA, 19 nt, artificial
  Oligomer
gcagaacuuucucuuuuga

SEQ ID NO: 28644 - RNA, 19 nt, artificial
  Oligomer
gucgaauugggaauuuuau

SEQ ID NO: 28645 - RNA, 19 nt, artificial
  Oligomer
uccgggagguggauaucaa

SEQ ID NO: 28646 - RNA, 19 nt, artificial
  Oligomer
ggcuguuuguuuugaugau

SEQ ID NO: 28647 - RNA, 19 nt, artificial
  Oligomer
uguuuguuuugaugauaaa

SEQ ID NO: 28648 - RNA, 19 nt, artificial
  Oligomer
gaguauggucgaauuggga

SEQ ID NO: 28649 - RNA, 19 nt, artificial
  Oligomer
agaagauuagcaucccaua

SEQ ID NO: 28650 - RNA, 19 nt, artificial
  Oligomer
cagaacuuucucuuuugaa

SEQ ID NO: 28651 - RNA, 19 nt, artificial
  Oligomer
aucgguaaagcaccuaaaa

SEQ ID NO: 28652 - RNA, 19 nt, artificial
  Oligomer
auaaaaggagaauaagaaa

SEQ ID NO: 28653 - RNA, 19 nt, artificial
  Oligomer
gccuuugaaacauuuaaaa

SEQ ID NO: 28654 - RNA, 19 nt, artificial
  Oligomer
gggugaguuugaagagguu

SEQ ID NO: 28655 - RNA, 19 nt, artificial
  Oligomer
caaugucaccuuugaggaa

SEQ ID NO: 28656 - RNA, 19 nt, artificial
  Oligomer
ggcugaguuaugaaaagau

SEQ ID NO: 28657 - RNA, 19 nt, artificial
  Oligomer
agcucuggaggccuuugaa

SEQ ID NO: 28658 - RNA, 19 nt, artificial
  Oligomer
ggcguguuucgauacugca

SEQ ID NO: 28659 - RNA, 19 nt, artificial
  Oligomer
ccuaauguggaaaaaguaa

SEQ ID NO: 28660 - RNA, 19 nt, artificial
  Oligomer
gggaaugagggcugaguua

SEQ ID NO: 28661 - RNA, 19 nt, artificial
  Oligomer
cuuccaguuuagaacgcaa

SEQ ID NO: 28662 - RNA, 19 nt, artificial
  Oligomer
ggugugccuuaaagauaca

SEQ ID NO: 28663 - RNA, 19 nt, artificial
  Oligomer
gggcugaguuaugaaaaga

SEQ ID NO: 28664 - RNA, 19 nt, artificial
  Oligomer
ccuggagugccuucauuga

SEQ ID NO: 28665 - RNA, 19 nt, artificial
  Oligomer
agaagcugauuuucaugaa

SEQ ID NO: 28666 - RNA, 19 nt, artificial
  Oligomer
gaacuugucuuauuuuaau

SEQ ID NO: 28667 - RNA, 19 nt, artificial
  Oligomer
ccuucauugaggaaggaaa

SEQ ID NO: 28668 - RNA, 19 nt, artificial
  Oligomer
ucuucucauuaccaguaaa

SEQ ID NO: 28669 - RNA, 19 nt, artificial
  Oligomer
gguaaagcaccuaaaacca

SEQ ID NO: 28670 - RNA, 19 nt, artificial
  Oligomer
caagaugggccgauacaau

SEQ ID NO: 28671 - RNA, 19 nt, artificial
  Oligomer
uugggaauuuuauugugaa

SEQ ID NO: 28672 - RNA, 19 nt, artificial
  Oligomer
aggauaauuuuuaaaccaa

SEQ ID NO: 28673 - RNA, 19 nt, artificial
  Oligomer
cgcaauguuucuagagaca

SEQ ID NO: 28674 - RNA, 19 nt, artificial
  Oligomer
cagcacuuccaguuuagaa

SEQ ID NO: 28675 - RNA, 19 nt, artificial
  Oligomer
ugacauagcuugagcuaua

SEQ ID NO: 28676 - RNA, 19 nt, artificial
  Oligomer
aggaauuggugugccuuaa

SEQ ID NO: 28677 - RNA, 19 nt, artificial
  Oligomer
ccagaagauuagcauccca

SEQ ID NO: 28678 - RNA, 19 nt, artificial
  Oligomer
cuguuggaaugauuucuau

SEQ ID NO: 28679 - RNA, 19 nt, artificial
  Oligomer
ccuuugaaacauuuaaaaa

SEQ ID NO: 28680 - RNA, 19 nt, artificial
  Oligomer
ugagggcugaguuaugaaa

SEQ ID NO: 28681 - RNA, 19 nt, artificial
  Oligomer
aagcugauuuucaugaaaa

SEQ ID NO: 28682 - RNA, 19 nt, artificial
  Oligomer
cugggaguauggucgaauu

SEQ ID NO: 28683 - RNA, 19 nt, artificial
  Oligomer
gaggaauuggugugccuua

SEQ ID NO: 28684 - RNA, 19 nt, artificial
  Oligomer
cuguuuguuuugaugauaa

SEQ ID NO: 28685 - RNA, 19 nt, artificial
  Oligomer
caggauaauuuuuaaacca

SEQ ID NO: 28686 - RNA, 19 nt, artificial
  Oligomer
aggagaauaagaaaaggca

SEQ ID NO: 28687 - RNA, 19 nt, artificial
  Oligomer
cucaaguaguggugacuga

SEQ ID NO: 28688 - RNA, 19 nt, artificial
  Oligomer
ugaacuugucuuauuuuaa

SEQ ID NO: 28689 - RNA, 19 nt, artificial
  Oligomer
cuucgggaacagucgaaaa

SEQ ID NO: 28690 - RNA, 19 nt, artificial
  Oligomer
guguuucgauacugcaaca

SEQ ID NO: 28691 - RNA, 19 nt, artificial
  Oligomer
gggcucugaugcagaacuu

SEQ ID NO: 28692 - RNA, 19 nt, artificial
  Oligomer
gcucuggaggccuuugaaa

SEQ ID NO: 28693 - RNA, 19 nt, artificial
  Oligomer
gggccgauacaaucuguca

SEQ ID NO: 28694 - RNA, 19 nt, artificial
  Oligomer
aggccuuugaaacauuuaa

SEQ ID NO: 28695 - RNA, 19 nt, artificial
  Oligomer
guuacaagcuuccugacaa

SEQ ID NO: 28696 - RNA, 19 nt, artificial
  Oligomer
uuggaaugauuucuaugaa

SEQ ID NO: 28697 - RNA, 19 nt, artificial
  Oligomer
gaggaugcauucuguugga

SEQ ID NO: 28698 - RNA, 19 nt, artificial
  Oligomer
cugacaaugucaccuuuga

SEQ ID NO: 28699 - RNA, 19 nt, artificial
  Oligomer
aagugggaucaucgguaaa

SEQ ID NO: 28700 - RNA, 19 nt, artificial
  Oligomer
ggauccaggauaauuuuua

SEQ ID NO: 28701 - RNA, 19 nt, artificial
  Oligomer
ugaugauaaaaggagaaua

SEQ ID NO: 28702 - RNA, 19 nt, artificial
  Oligomer
accucugccgguucuauaa

SEQ ID NO: 28703 - RNA, 19 nt, artificial
  Oligomer
aaagugggaucaucgguaa

SEQ ID NO: 28704 - RNA, 19 nt, artificial
  Oligomer
ggaggguuugguuagcuca

SEQ ID NO: 28705 - RNA, 19 nt, artificial
  Oligomer
ugguaagauuuagaccuaa

SEQ ID NO: 28706 - RNA, 19 nt, artificial
  Oligomer
ccaggaaaguagaagguca

SEQ ID NO: 28707 - RNA, 19 nt, artificial
  Oligomer
aggagagcccucaggaaau

SEQ ID NO: 28708 - RNA, 19 nt, artificial
  Oligomer
ggagugccuucauugagga

SEQ ID NO: 28709 - RNA, 19 nt, artificial
  Oligomer
cugguaagauuuagaccua

SEQ ID NO: 28710 - RNA, 19 nt, artificial
  Oligomer
ugggaucaucgguaaagca

SEQ ID NO: 28711 - RNA, 19 nt, artificial
  Oligomer
gaaugauuucuaugaacuu

SEQ ID NO: 28712 - RNA, 19 nt, artificial
  Oligomer
ccaacuugugacuuugaga

SEQ ID NO: 28713 - RNA, 19 nt, artificial
  Oligomer
cucuucucauuaccaguaa

SEQ ID NO: 28714 - RNA, 19 nt, artificial
  Oligomer
ccacagucuugggaucuca

SEQ ID NO: 28715 - RNA, 19 nt, artificial
  Oligomer
ugacuuugagacuauucau

SEQ ID NO: 28716 - RNA, 19 nt, artificial
  Oligomer
agaacuuucucuuuugaau

SEQ ID NO: 28717 - RNA, 19 nt, artificial
  Oligomer
cagugaccagaaucccuga

SEQ ID NO: 28718 - RNA, 19 nt, artificial
  Oligomer
gagacuauucaucaagaau

SEQ ID NO: 28719 - RNA, 19 nt, artificial
  Oligomer
gggaauuuuauugugaaaa

SEQ ID NO: 28720 - RNA, 19 nt, artificial
  Oligomer
aaggagagcccucaggaaa

SEQ ID NO: 28721 - RNA, 19 nt, artificial
  Oligomer
agggcugaguuaugaaaag

SEQ ID NO: 28722 - RNA, 19 nt, artificial
  Oligomer
augagggcugaguuaugaa

SEQ ID NO: 28723 - RNA, 19 nt, artificial
  Oligomer
gguuauuagacaauuccau

SEQ ID NO: 28724 - RNA, 19 nt, artificial
  Oligomer
guggguuuuuuuucuggua

SEQ ID NO: 28725 - RNA, 19 nt, artificial
  Oligomer
guuuguuuugaugauaaaa

SEQ ID NO: 28726 - RNA, 19 nt, artificial
  Oligomer
uaauguggaaaaaguaaga

SEQ ID NO: 28727 - RNA, 19 nt, artificial
  Oligomer
aaaugucaugugagguuaa

SEQ ID NO: 28728 - RNA, 19 nt, artificial
  Oligomer
cugguuauuauaaacagaa

SEQ ID NO: 28729 - RNA, 19 nt, artificial
  Oligomer
auacuagacucauacucaa

SEQ ID NO: 28730 - RNA, 19 nt, artificial
  Oligomer
gaaaagauaacuucaugaa

SEQ ID NO: 28731 - RNA, 19 nt, artificial
  Oligomer
ccaguaaaggcucuuggua

SEQ ID NO: 28732 - RNA, 19 nt, artificial
  Oligomer
gauuuagaccuaaaucgca

SEQ ID NO: 28733 - RNA, 19 nt, artificial
  Oligomer
aauuggugugccuuaaaga

SEQ ID NO: 28734 - RNA, 19 nt, artificial
  Oligomer
guucuauaagcacaaugca

SEQ ID NO: 28735 - RNA, 19 nt, artificial
  Oligomer
gagcaaaguucagcaagua

SEQ ID NO: 28736 - RNA, 19 nt, artificial
  Oligomer
ggaaacugcuacuugugga

SEQ ID NO: 28737 - RNA, 19 nt, artificial
  Oligomer
ucuuucugguuauuauaaa

SEQ ID NO: 28738 - RNA, 19 nt, artificial
  Oligomer
cgccuggagaacuauccua

SEQ ID NO: 28739 - RNA, 19 nt, artificial
  Oligomer
ccuggauccaggauaauuu

SEQ ID NO: 28740 - RNA, 19 nt, artificial
  Oligomer
gugacuuugagacuauuca

SEQ ID NO: 28741 - RNA, 19 nt, artificial
  Oligomer
caguaaaggcucuugguau

SEQ ID NO: 28742 - RNA, 19 nt, artificial
  Oligomer
aggucuugcugaggaugca

SEQ ID NO: 28743 - RNA, 19 nt, artificial
  Oligomer
ccgguucuauaagcacaau

SEQ ID NO: 28744 - RNA, 19 nt, artificial
  Oligomer
ggaguauggucgaauuggg

SEQ ID NO: 28745 - RNA, 19 nt, artificial
  Oligomer
agcaaugggagcagcucaa

SEQ ID NO: 28746 - RNA, 19 nt, artificial
  Oligomer
gaaaaugaugaauucugca

SEQ ID NO: 28747 - RNA, 19 nt, artificial
  Oligomer
gaagauugccucuucuaca

SEQ ID NO: 28748 - RNA, 19 nt, artificial
  Oligomer
uuucgaugcuugcguccaa

SEQ ID NO: 28749 - RNA, 19 nt, artificial
  Oligomer
gguuuuuuuucugguaaga

SEQ ID NO: 28750 - RNA, 19 nt, artificial
  Oligomer
caauucauugugaacagaa

SEQ ID NO: 28751 - RNA, 19 nt, artificial
  Oligomer
aguggugacugaucugucu

SEQ ID NO: 28752 - RNA, 19 nt, artificial
  Oligomer
ggaaaaaguaagaggacua

SEQ ID NO: 28753 - RNA, 19 nt, artificial
  Oligomer
cucugagaugaccaccgua

SEQ ID NO: 28754 - RNA, 19 nt, artificial
  Oligomer
uugagacuauucaucaaga

SEQ ID NO: 28755 - RNA, 19 nt, artificial
  Oligomer
cuggauccaggauaauuuu

SEQ ID NO: 28756 - RNA, 19 nt, artificial
  Oligomer
caguuuagaacgcaauguu

SEQ ID NO: 28757 - RNA, 19 nt, artificial
  Oligomer
guaagauuuagaccuaaau

SEQ ID NO: 28758 - RNA, 19 nt, artificial
  Oligomer
cucugaugcagaacuuucu

SEQ ID NO: 28759 - RNA, 19 nt, artificial
  Oligomer
aaaucaugcucaaguguga

SEQ ID NO: 28760 - RNA, 19 nt, artificial
  Oligomer
ccgagaaaaugaugaauuc

SEQ ID NO: 28761 - RNA, 19 nt, artificial
  Oligomer
cagauugcuuuggguaaua

SEQ ID NO: 28762 - RNA, 19 nt, artificial
  Oligomer
uuuugaugauaaaaggaga

SEQ ID NO: 28763 - RNA, 19 nt, artificial
  Oligomer
cugcuacccgauuguccaa

SEQ ID NO: 28764 - RNA, 19 nt, artificial
  Oligomer
cugggaugaaggcuuguca

SEQ ID NO: 28765 - RNA, 19 nt, artificial
  Oligomer
ggcucugaugcagaacuuu

SEQ ID NO: 28766 - RNA, 19 nt, artificial
  Oligomer
gcuucgggaacagucgaaa

SEQ ID NO: 28767 - RNA, 19 nt, artificial
  Oligomer
agguucugauuuucuugua

SEQ ID NO: 28768 - RNA, 19 nt, artificial
  Oligomer
ccaaaugaggucuugcuga

SEQ ID NO: 28769 - RNA, 19 nt, artificial
  Oligomer
uggguuuuuuuucugguaa

SEQ ID NO: 28770 - RNA, 19 nt, artificial
  Oligomer
aauugaugguuauuagaca

SEQ ID NO: 28771 - RNA, 19 nt, artificial
  Oligomer
gcaccuaaaaccaggugau

SEQ ID NO: 28772 - RNA, 19 nt, artificial
  Oligomer
ucaccaggcaaccaggaaa

SEQ ID NO: 28773 - RNA, 19 nt, artificial
  Oligomer
gagugccuucauugaggaa

SEQ ID NO: 28774 - RNA, 19 nt, artificial
  Oligomer
aaugucaugugagguuaaa

SEQ ID NO: 28775 - RNA, 19 nt, artificial
  Oligomer
cguccaagucugugaaugu

SEQ ID NO: 28776 - RNA, 19 nt, artificial
  Oligomer
cuaugaacuugucuuauuu

SEQ ID NO: 28777 - RNA, 19 nt, artificial
  Oligomer
gcccagaagcugauuuuca

SEQ ID NO: 28778 - RNA, 19 nt, artificial
  Oligomer
aucccauacuagacucaua

SEQ ID NO: 28779 - RNA, 19 nt, artificial
  Oligomer
ugaucugucugcuacccga

SEQ ID NO: 28780 - RNA, 19 nt, artificial
  Oligomer
cuugagcuauagccuuuaa

SEQ ID NO: 28781 - RNA, 19 nt, artificial
  Oligomer
ugugaacagaaguccuuaa

SEQ ID NO: 28782 - RNA, 19 nt, artificial
  Oligomer
uguggaaaaaguaagagga

SEQ ID NO: 28783 - RNA, 19 nt, artificial
  Oligomer
aagagguucugauuuucuu

SEQ ID NO: 28784 - RNA, 19 nt, artificial
  Oligomer
gaacagaaguccuuaagca

SEQ ID NO: 28785 - RNA, 19 nt, artificial
  Oligomer
ugguuauuagacaauucca

SEQ ID NO: 28786 - RNA, 19 nt, artificial
  Oligomer
acuugcgccuggagaacua

SEQ ID NO: 28787 - RNA, 19 nt, artificial
  Oligomer
cuucauugaggaaggaaau

SEQ ID NO: 28788 - RNA, 19 nt, artificial
  Oligomer
gaggccuuugaaacauuua

SEQ ID NO: 28789 - RNA, 19 nt, artificial
  Oligomer
uuuccuggauccaggauaa

SEQ ID NO: 28790 - RNA, 19 nt, artificial
  Oligomer
cuuccuggagugccuucau

SEQ ID NO: 28791 - RNA, 19 nt, artificial
  Oligomer
ggguuuuuuuucugguaag

SEQ ID NO: 28792 - RNA, 19 nt, artificial
  Oligomer
ucugguuauuauaaacaga

SEQ ID NO: 28793 - RNA, 19 nt, artificial
  Oligomer
aggcuugucagcacuucca

SEQ ID NO: 28794 - RNA, 19 nt, artificial
  Oligomer
gcaaaguucagcaaguaga

SEQ ID NO: 28795 - RNA, 19 nt, artificial
  Oligomer
gaauuuuauugugaaaaag

SEQ ID NO: 28796 - RNA, 19 nt, artificial
  Oligomer
cucuuuugaauguuaagaa

SEQ ID NO: 28797 - RNA, 19 nt, artificial
  Oligomer
caaucgggauggucacuuu

SEQ ID NO: 28798 - RNA, 19 nt, artificial
  Oligomer
cugauuuaguccuccagau

SEQ ID NO: 28799 - RNA, 19 nt, artificial
  Oligomer
gggcugauuuaguccucca

SEQ ID NO: 28800 - RNA, 19 nt, artificial
  Oligomer
cuuucucuuuugaauguua

SEQ ID NO: 28801 - RNA, 19 nt, artificial
  Oligomer
ucgaauugggaauuuuauu

SEQ ID NO: 28802 - RNA, 19 nt, artificial
  Oligomer
ggcaaccaggaaacugcua

SEQ ID NO: 28803 - RNA, 19 nt, artificial
  Oligomer
guuugaagagguucugauu

SEQ ID NO: 28804 - RNA, 19 nt, artificial
  Oligomer
ggagaacuauccuaucccu

SEQ ID NO: 28805 - RNA, 19 nt, artificial
  Oligomer
ggaggccuuugaaacauuu

SEQ ID NO: 28806 - RNA, 19 nt, artificial
  Oligomer
uuacaagcuuccugacaau

SEQ ID NO: 28807 - RNA, 19 nt, artificial
  Oligomer
uaaaaggagaauaagaaaa

SEQ ID NO: 28808 - RNA, 19 nt, artificial
  Oligomer
auagguuuccucuggagaa

SEQ ID NO: 28809 - RNA, 19 nt, artificial
  Oligomer
agaacgcaauguuucuaga

SEQ ID NO: 28810 - RNA, 19 nt, artificial
  Oligomer
gcuguuuguuuugaugaua

SEQ ID NO: 28811 - RNA, 19 nt, artificial
  Oligomer
auaacuucaugaagacuua

SEQ ID NO: 28812 - RNA, 19 nt, artificial
  Oligomer
agauugcuuuggguaauaa

SEQ ID NO: 28813 - RNA, 19 nt, artificial
  Oligomer
gaugcagaacuuucucuuu

SEQ ID NO: 28814 - RNA, 19 nt, artificial
  Oligomer
aaugaugaauucugcaaga

SEQ ID NO: 28815 - RNA, 19 nt, artificial
  Oligomer
ucaucgguaaagcaccuaa

SEQ ID NO: 28816 - RNA, 19 nt, artificial
  Oligomer
ggcucauacucaauugaug

SEQ ID NO: 28817 - RNA, 19 nt, artificial
  Oligomer
auuucuuucugguuauuau

SEQ ID NO: 28818 - RNA, 19 nt, artificial
  Oligomer
guccaagucugugaaugua

SEQ ID NO: 28819 - RNA, 19 nt, artificial
  Oligomer
cauacucaauugaugguua

SEQ ID NO: 28820 - RNA, 19 nt, artificial
  Oligomer
gcugauuuaguccuccaga

SEQ ID NO: 28821 - RNA, 19 nt, artificial
  Oligomer
caaaguucagcaaguagag

SEQ ID NO: 28822 - RNA, 19 nt, artificial
  Oligomer
gccuuuaauuccuuacuuu

SEQ ID NO: 28823 - RNA, 19 nt, artificial
  Oligomer
guuugguuagcucacagga

SEQ ID NO: 28824 - RNA, 19 nt, artificial
  Oligomer
caggaaaguagaaggucag

SEQ ID NO: 28825 - RNA, 19 nt, artificial
  Oligomer
ucaauugaugguuauuaga

SEQ ID NO: 28826 - RNA, 19 nt, artificial
  Oligomer
ggaugaaggcuugucagca

SEQ ID NO: 28827 - RNA, 19 nt, artificial
  Oligomer
cuccagaucuccaaggaga

SEQ ID NO: 28828 - RNA, 19 nt, artificial
  Oligomer
ggagggugaguuugaagag

SEQ ID NO: 28829 - RNA, 19 nt, artificial
  Oligomer
aguauggucgaauugggaa

SEQ ID NO: 28830 - RNA, 19 nt, artificial
  Oligomer
gugacugaucugucugcua

SEQ ID NO: 28831 - RNA, 19 nt, artificial
  Oligomer
ugcugaggaugcauucugu

SEQ ID NO: 28832 - RNA, 19 nt, artificial
  Oligomer
uugguaucuuucuguugga

SEQ ID NO: 28833 - RNA, 19 nt, artificial
  Oligomer
cccauagguuuccucugga

SEQ ID NO: 28834 - RNA, 19 nt, artificial
  Oligomer
guuggaaugauuucuauga

SEQ ID NO: 28835 - RNA, 19 nt, artificial
  Oligomer
gaaugagggcugaguuaug

SEQ ID NO: 28836 - RNA, 19 nt, artificial
  Oligomer
uagguuuccucuggagaaa

SEQ ID NO: 28837 - RNA, 19 nt, artificial
  Oligomer
gaauaacuaauacaauuca

SEQ ID NO: 28838 - RNA, 19 nt, artificial
  Oligomer
aaagauaacuucaugaaga

SEQ ID NO: 28839 - RNA, 19 nt, artificial
  Oligomer
ccucgucacccauagguuu

SEQ ID NO: 28840 - RNA, 19 nt, artificial
  Oligomer
ucaagggcguguuucgaua

SEQ ID NO: 28841 - RNA, 19 nt, artificial
  Oligomer
aggcaaccaggaaacugcu

SEQ ID NO: 28842 - RNA, 19 nt, artificial
  Oligomer
cauacuagacucauacuca

SEQ ID NO: 28843 - RNA, 19 nt, artificial
  Oligomer
gguggguuuuuuuucuggu

SEQ ID NO: 28844 - RNA, 19 nt, artificial
  Oligomer
cgagaaaaugaugaauucu

SEQ ID NO: 28845 - RNA, 19 nt, artificial
  Oligomer
agaccaggaggguuugguu

SEQ ID NO: 28846 - RNA, 19 nt, artificial
  Oligomer
aggguuugguuagcucaca

SEQ ID NO: 28847 - RNA, 19 nt, artificial
  Oligomer
cucaauugaugguuauuag

SEQ ID NO: 28848 - RNA, 19 nt, artificial
  Oligomer
agacucauacucaacucaa

SEQ ID NO: 28849 - RNA, 19 nt, artificial
  Oligomer
caaccaggaaacugcuacu

SEQ ID NO: 28850 - RNA, 19 nt, artificial
  Oligomer
aaugcagccuuuuguuaca

SEQ ID NO: 28851 - RNA, 19 nt, artificial
  Oligomer
cuugugacuuugagacuau

SEQ ID NO: 28852 - RNA, 19 nt, artificial
  Oligomer
gagguuaaaccaguuugca

SEQ ID NO: 28853 - RNA, 19 nt, artificial
  Oligomer
ggguuugguuagcucacag

SEQ ID NO: 28854 - RNA, 19 nt, artificial
  Oligomer
uaauacaauucauugugaa

SEQ ID NO: 28855 - RNA, 19 nt, artificial
  Oligomer
cuauccuaucccugaacca

SEQ ID NO: 28856 - RNA, 19 nt, artificial
  Oligomer
ugguaucuuucuguuggaa

SEQ ID NO: 28857 - RNA, 19 nt, artificial
  Oligomer
gaguuugaagagguucuga

SEQ ID NO: 28858 - RNA, 19 nt, artificial
  Oligomer
uggugugccuuaaagauac

SEQ ID NO: 28859 - RNA, 19 nt, artificial
  Oligomer
ugccgguucuauaagcaca

SEQ ID NO: 28860 - RNA, 19 nt, artificial
  Oligomer
auugaugguuauuagacaa

SEQ ID NO: 28861 - RNA, 19 nt, artificial
  Oligomer
uuucuuucugguuauuaua

SEQ ID NO: 28862 - RNA, 19 nt, artificial
  Oligomer
auuggugugccuuaaagau

SEQ ID NO: 28863 - RNA, 19 nt, artificial
  Oligomer
ugauuuucaugaaaaucug

SEQ ID NO: 28864 - RNA, 19 nt, artificial
  Oligomer
gaccaggaggguuugguua

SEQ ID NO: 28865 - RNA, 19 nt, artificial
  Oligomer
aaugggagcagcucaagua

SEQ ID NO: 28866 - RNA, 19 nt, artificial
  Oligomer
uuucgauacugcaacacgu

SEQ ID NO: 28867 - RNA, 19 nt, artificial
  Oligomer
uauucaucaagaaugagga

SEQ ID NO: 28868 - RNA, 19 nt, artificial
  Oligomer
ccuguucaugcugagcaaa

SEQ ID NO: 28869 - RNA, 19 nt, artificial
  Oligomer
aaugagggcugaguuauga

SEQ ID NO: 28870 - RNA, 19 nt, artificial
  Oligomer
aaccucugccgguucuaua

SEQ ID NO: 28871 - RNA, 19 nt, artificial
  Oligomer
uuucucuuuugaauguuaa

SEQ ID NO: 28872 - RNA, 19 nt, artificial
  Oligomer
uggucgaauugggaauuuu

SEQ ID NO: 28873 - RNA, 19 nt, artificial
  Oligomer
cagaggaauuggugugccu

SEQ ID NO: 28874 - RNA, 19 nt, artificial
  Oligomer
caagcuuccugacaauguc

SEQ ID NO: 28875 - RNA, 19 nt, artificial
  Oligomer
uaagcauggucccuuguca

SEQ ID NO: 28876 - RNA, 19 nt, artificial
  Oligomer
gauacaaucugggauaguu

SEQ ID NO: 28877 - RNA, 19 nt, artificial
  Oligomer
cgguaaagcaccuaaaacc

SEQ ID NO: 28878 - RNA, 19 nt, artificial
  Oligomer
gaucaucgguaaagcaccu

SEQ ID NO: 28879 - RNA, 19 nt, artificial
  Oligomer
gcacaaugcagccuuuugu

SEQ ID NO: 28880 - RNA, 19 nt, artificial
  Oligomer
gccuggagaacuauccuau

SEQ ID NO: 28881 - RNA, 19 nt, artificial
  Oligomer
aaaggcucuugguaucuuu

SEQ ID NO: 28882 - RNA, 19 nt, artificial
  Oligomer
aaaucuuuccucuucucau

SEQ ID NO: 28883 - RNA, 19 nt, artificial
  Oligomer
cacaaugcagccuuuuguu

SEQ ID NO: 28884 - RNA, 19 nt, artificial
  Oligomer
cagaagauuagcaucccau

SEQ ID NO: 28885 - RNA, 19 nt, artificial
  Oligomer
gacucauacucaacucaac

SEQ ID NO: 28886 - RNA, 19 nt, artificial
  Oligomer
ggguugaaaaucaugcuca

SEQ ID NO: 28887 - RNA, 19 nt, artificial
  Oligomer
gaaacauuuaaaaagggau

SEQ ID NO: 28888 - RNA, 19 nt, artificial
  Oligomer
gaauuggugugccuuaaag

SEQ ID NO: 28889 - RNA, 19 nt, artificial
  Oligomer
agaacuauccuaucccuga

SEQ ID NO: 28890 - RNA, 19 nt, artificial
  Oligomer
agguuaaaccaguuugcau

SEQ ID NO: 28891 - RNA, 19 nt, artificial
  Oligomer
cugaaccaggcccaaauga

SEQ ID NO: 28892 - RNA, 19 nt, artificial
  Oligomer
guaagaggacuacucagca

SEQ ID NO: 28893 - RNA, 19 nt, artificial
  Oligomer
cgauacaaucugucaccuu

SEQ ID NO: 28894 - RNA, 19 nt, artificial
  Oligomer
aaggcaucacuuuccugga

SEQ ID NO: 28895 - RNA, 19 nt, artificial
  Oligomer
ucgggauggucacuuugcu

SEQ ID NO: 28896 - RNA, 19 nt, artificial
  Oligomer
uguuuugaugauaaaagga

SEQ ID NO: 28897 - RNA, 19 nt, artificial
  Oligomer
aaguaguggugacugaucu

SEQ ID NO: 28898 - RNA, 19 nt, artificial
  Oligomer
cuuucuguuggaaugauuu

SEQ ID NO: 28899 - RNA, 19 nt, artificial
  Oligomer
agaccuaaaucgcaucaug

SEQ ID NO: 28900 - RNA, 19 nt, artificial
  Oligomer
acaugaagcuucgggaaca

SEQ ID NO: 28901 - RNA, 19 nt, artificial
  Oligomer
uucgggaacagucgaaaaa

SEQ ID NO: 28902 - RNA, 19 nt, artificial
  Oligomer
ggauaucaagggcguguuu

SEQ ID NO: 28903 - RNA, 19 nt, artificial
  Oligomer
ucuguuggaaugauuucua

SEQ ID NO: 28904 - RNA, 19 nt, artificial
  Oligomer
aggcucauacucaauugau

SEQ ID NO: 28905 - RNA, 19 nt, artificial
  Oligomer
cugucaccuuccaucuucu

SEQ ID NO: 28906 - RNA, 19 nt, artificial
  Oligomer
uuugaugauaaaaggagaa

SEQ ID NO: 28907 - RNA, 19 nt, artificial
  Oligomer
cuacugggaguauggucga

SEQ ID NO: 28908 - RNA, 19 nt, artificial
  Oligomer
caacucaacuaggcucaua

SEQ ID NO: 28909 - RNA, 19 nt, artificial
  Oligomer
aacgcaauguuucuagaga

SEQ ID NO: 28910 - RNA, 19 nt, artificial
  Oligomer
gaaccucugccgguucuau

SEQ ID NO: 28911 - RNA, 19 nt, artificial
  Oligomer
augaggucuugcugaggau

SEQ ID NO: 28912 - RNA, 19 nt, artificial
  Oligomer
gugugccuuaaagauacaa

SEQ ID NO: 28913 - RNA, 19 nt, artificial
  Oligomer
guauggucgaauugggaau

SEQ ID NO: 28914 - RNA, 19 nt, artificial
  Oligomer
gcuugucagcacuuccagu

SEQ ID NO: 28915 - RNA, 19 nt, artificial
  Oligomer
acuuguggaccucaccaga

SEQ ID NO: 28916 - RNA, 19 nt, artificial
  Oligomer
agcuucgggaacagucgaa

SEQ ID NO: 28917 - RNA, 19 nt, artificial
  Oligomer
ggauggucacuuugcucgu

SEQ ID NO: 28918 - RNA, 19 nt, artificial
  Oligomer
ucaaguaguggugacugau

SEQ ID NO: 28919 - RNA, 19 nt, artificial
  Oligomer
uuggugugccuuaaagaua

SEQ ID NO: 28920 - RNA, 19 nt, artificial
  Oligomer
uccaagucugugaauguaa

SEQ ID NO: 28921 - RNA, 19 nt, artificial
  Oligomer
ucaucaagaaugaggauau

SEQ ID NO: 28922 - RNA, 19 nt, artificial
  Oligomer
caugugagguuaaaccagu

SEQ ID NO: 28923 - RNA, 19 nt, artificial
  Oligomer
ugcaagaugggccgauaca

SEQ ID NO: 28924 - RNA, 19 nt, artificial
  Oligomer
aaaguaagaggacuacuca

SEQ ID NO: 28925 - RNA, 19 nt, artificial
  Oligomer
cacuuuccuggauccagga

SEQ ID NO: 28926 - RNA, 19 nt, artificial
  Oligomer
gaccagaaucccugauguu

SEQ ID NO: 28927 - RNA, 19 nt, artificial
  Oligomer
ucugcaagaugggccgaua

SEQ ID NO: 28928 - RNA, 19 nt, artificial
  Oligomer
gcccaaaugaggucuugcu

SEQ ID NO: 28929 - RNA, 19 nt, artificial
  Oligomer
ccucuucucauuaccagua

SEQ ID NO: 28930 - RNA, 19 nt, artificial
  Oligomer
auccaggauaauuuuuaaa

SEQ ID NO: 28931 - RNA, 19 nt, artificial
  Oligomer
gaguuaugaaaagauaacu

SEQ ID NO: 28932 - RNA, 19 nt, artificial
  Oligomer
gcugaggaugcauucuguu

SEQ ID NO: 28933 - RNA, 19 nt, artificial
  Oligomer
aguuuagaacgcaauguuu

SEQ ID NO: 28934 - RNA, 19 nt, artificial
  Oligomer
cccgagaaaaugaugaauu

SEQ ID NO: 28935 - RNA, 19 nt, artificial
  Oligomer
uuaugaaaagauaacuuca

SEQ ID NO: 28936 - RNA, 19 nt, artificial
  Oligomer
uaagaaaaggcaucacuuu

SEQ ID NO: 28937 - RNA, 19 nt, artificial
  Oligomer
caaugggagcagcucaagu

SEQ ID NO: 28938 - RNA, 19 nt, artificial
  Oligomer
uaugaaaagauaacuucau

SEQ ID NO: 28939 - RNA, 19 nt, artificial
  Oligomer
ucaagaaugaggauauagu

SEQ ID NO: 28940 - RNA, 19 nt, artificial
  Oligomer
ggaaugauuucuaugaacu

SEQ ID NO: 28941 - RNA, 19 nt, artificial
  Oligomer
gucaugugagguuaaacca

SEQ ID NO: 28942 - RNA, 19 nt, artificial
  Oligomer
auaagaaaaggcaucacuu

SEQ ID NO: 28943 - RNA, 19 nt, artificial
  Oligomer
acucagggucugggaugaa

SEQ ID NO: 28944 - RNA, 19 nt, artificial
  Oligomer
aguuugaagagguucugau

SEQ ID NO: 28945 - RNA, 19 nt, artificial
  Oligomer
gguuaaaccaguuugcauu

SEQ ID NO: 28946 - RNA, 19 nt, artificial
  Oligomer
uuguggaccucaccagaga

SEQ ID NO: 28947 - RNA, 19 nt, artificial
  Oligomer
cagcaaguagagcagaguu

SEQ ID NO: 28948 - RNA, 19 nt, artificial
  Oligomer
cuaauacaauucauuguga

SEQ ID NO: 28949 - RNA, 19 nt, artificial
  Oligomer
ucuuuugaauguuaagaau

SEQ ID NO: 28950 - RNA, 19 nt, artificial
  Oligomer
gugcccgauucuuucagau

SEQ ID NO: 28951 - RNA, 19 nt, artificial
  Oligomer
uugggaucucagggcacaa

SEQ ID NO: 28952 - RNA, 19 nt, artificial
  Oligomer
gcagcucaaguagugguga

SEQ ID NO: 28953 - RNA, 19 nt, artificial
  Oligomer
cacagucuugggaucucag

SEQ ID NO: 28954 - RNA, 19 nt, artificial
  Oligomer
caugaagcuucgggaacag

SEQ ID NO: 28955 - RNA, 19 nt, artificial
  Oligomer
ggaaugagggcugaguuau

SEQ ID NO: 28956 - RNA, 19 nt, artificial
  Oligomer
ugaauguuaagaauaacua

SEQ ID NO: 28957 - RNA, 19 nt, artificial
  Oligomer
ugaaaagauaacuucauga

SEQ ID NO: 28958 - RNA, 19 nt, artificial
  Oligomer
gaagagguucugauuuucu

SEQ ID NO: 28959 - RNA, 19 nt, artificial
  Oligomer
ggucuugcugaggaugcau

SEQ ID NO: 28960 - RNA, 19 nt, artificial
  Oligomer
caugacauagcuugagcua

SEQ ID NO: 28961 - RNA, 19 nt, artificial
  Oligomer
uggguuuccugguuccacu

SEQ ID NO: 28962 - RNA, 19 nt, artificial
  Oligomer
ccaacaaccuuucccuggu

SEQ ID NO: 28963 - RNA, 19 nt, artificial
  Oligomer
auuagcaucccauacuaga

SEQ ID NO: 28964 - RNA, 19 nt, artificial
  Oligomer
aaagauacaaucugggaua

SEQ ID NO: 28965 - RNA, 19 nt, artificial
  Oligomer
ccucuucuacagcuucuga

SEQ ID NO: 28966 - RNA, 19 nt, artificial
  Oligomer
uugcguccaagucugugaa

SEQ ID NO: 28967 - RNA, 19 nt, artificial
  Oligomer
uacugggaguauggucgaa

SEQ ID NO: 28968 - RNA, 19 nt, artificial
  Oligomer
cauugugaacagaaguccu

SEQ ID NO: 28969 - RNA, 19 nt, artificial
  Oligomer
augaacuugucuuauuuua

SEQ ID NO: 28970 - RNA, 19 nt, artificial
  Oligomer
ggcucuugguaucuuucug

SEQ ID NO: 28971 - RNA, 19 nt, artificial
  Oligomer
gggaacagucgaaaaagug

SEQ ID NO: 28972 - RNA, 19 nt, artificial
  Oligomer
ugaaacauuuaaaaaggga

SEQ ID NO: 28973 - RNA, 19 nt, artificial
  Oligomer
aacuaggcucauacucaau

SEQ ID NO: 28974 - RNA, 19 nt, artificial
  Oligomer
aaucuuuccucuucucauu

SEQ ID NO: 28975 - RNA, 19 nt, artificial
  Oligomer
ucuggaggccuuugaaaca

SEQ ID NO: 28976 - RNA, 19 nt, artificial
  Oligomer
augugagguuaaaccaguu

SEQ ID NO: 28977 - RNA, 19 nt, artificial
  Oligomer
cuucuacagcuucugagaa

SEQ ID NO: 28978 - RNA, 19 nt, artificial
  Oligomer
ugucagcacuuccaguuua

SEQ ID NO: 28979 - RNA, 19 nt, artificial
  Oligomer
ucaacuaggcucauacuca

SEQ ID NO: 28980 - RNA, 19 nt, artificial
  Oligomer
ggcucagauguccacuacu

SEQ ID NO: 28981 - RNA, 19 nt, artificial
  Oligomer
uuucuaugaacuugucuua

SEQ ID NO: 28982 - RNA, 19 nt, artificial
  Oligomer
caggaaacugcuacuugug

SEQ ID NO: 28983 - RNA, 19 nt, artificial
  Oligomer
gcauucuguuggaaucugu

SEQ ID NO: 28984 - RNA, 19 nt, artificial
  Oligomer
cguguuucgauacugcaac

SEQ ID NO: 28985 - RNA, 19 nt, artificial
  Oligomer
ccaggauaauuuuuaaacc

SEQ ID NO: 28986 - RNA, 19 nt, artificial
  Oligomer
uugugacuuugagacuauu

SEQ ID NO: 28987 - RNA, 19 nt, artificial
  Oligomer
aaaagugggaucaucggua

SEQ ID NO: 28988 - RNA, 19 nt, artificial
  Oligomer
ucugcuacccgauugucca

SEQ ID NO: 28989 - RNA, 19 nt, artificial
  Oligomer
uaacuucaugaagacuuaa

SEQ ID NO: 28990 - RNA, 19 nt, artificial
  Oligomer
gcugagcaaaguucagcaa

SEQ ID NO: 28991 - RNA, 19 nt, artificial
  Oligomer
uaguccuccagaucuccaa

SEQ ID NO: 28992 - RNA, 19 nt, artificial
  Oligomer
accaguaaaggcucuuggu

SEQ ID NO: 28993 - RNA, 19 nt, artificial
  Oligomer
gaagauuagcaucccauac

SEQ ID NO: 28994 - RNA, 19 nt, artificial
  Oligomer
caugcugagcaaaguucag

SEQ ID NO: 28995 - RNA, 19 nt, artificial
  Oligomer
agccuuuaauuccuuacuu

SEQ ID NO: 28996 - RNA, 19 nt, artificial
  Oligomer
agaauaagaaaaggcauca

SEQ ID NO: 28997 - RNA, 19 nt, artificial
  Oligomer
cucuggagaaagcucugga

SEQ ID NO: 28998 - RNA, 19 nt, artificial
  Oligomer
ugagcuauagccuuuaauu

SEQ ID NO: 28999 - RNA, 19 nt, artificial
  Oligomer
uaggcucauacucaauuga

SEQ ID NO: 29000 - RNA, 19 nt, artificial
  Oligomer
aauucauugugaacagaag

SEQ ID NO: 29001 - RNA, 19 nt, artificial
  Oligomer
ccauuucuuucugguuauu

SEQ ID NO: 29002 - RNA, 19 nt, artificial
  Oligomer
gaggguuugguuagcucac

SEQ ID NO: 29003 - RNA, 19 nt, artificial
  Oligomer
cuuuugaauguuaagaaua

SEQ ID NO: 29004 - RNA, 19 nt, artificial
  Oligomer
aagcaaugggagcagcuca

SEQ ID NO: 29005 - RNA, 19 nt, artificial
  Oligomer
cugguuccacugcuacuga

SEQ ID NO: 29006 - RNA, 19 nt, artificial
  Oligomer
cauagguuuccucuggaga

SEQ ID NO: 29007 - RNA, 19 nt, artificial
  Oligomer
caaaugaggucuugcugag

SEQ ID NO: 29008 - RNA, 19 nt, artificial
  Oligomer
ugugcccgauucuuucaga

SEQ ID NO: 29009 - RNA, 19 nt, artificial
  Oligomer
aagcuuccugacaauguca

SEQ ID NO: 29010 - RNA, 19 nt, artificial
  Oligomer
uuuucugguaagauuuaga

SEQ ID NO: 29011 - RNA, 19 nt, artificial
  Oligomer
gaucugucugcuacccgau

SEQ ID NO: 29012 - RNA, 19 nt, artificial
  Oligomer
aggcaucacuuuccuggau

SEQ ID NO: 29013 - RNA, 19 nt, artificial
  Oligomer
aagcuucgggaacagucga

SEQ ID NO: 29014 - RNA, 19 nt, artificial
  Oligomer
acuugugacuuugagacua

SEQ ID NO: 29015 - RNA, 19 nt, artificial
  Oligomer
ggccgauacaaucugucac

SEQ ID NO: 29016 - RNA, 19 nt, artificial
  Oligomer
uggagggugaguuugaaga

SEQ ID NO: 29017 - RNA, 19 nt, artificial
  Oligomer
cuuucugguuauuauaaac

SEQ ID NO: 29018 - RNA, 19 nt, artificial
  Oligomer
agcccaacaaccuuucccu

SEQ ID NO: 29019 - RNA, 19 nt, artificial
  Oligomer
gucgaaaaagugggaucau

SEQ ID NO: 29020 - RNA, 19 nt, artificial
  Oligomer
ugcagaacuuucucuuuug

SEQ ID NO: 29021 - RNA, 19 nt, artificial
  Oligomer
cagcucaaguaguggugac

SEQ ID NO: 29022 - RNA, 19 nt, artificial
  Oligomer
agccuuuuguuacaagcuu

SEQ ID NO: 29023 - RNA, 19 nt, artificial
  Oligomer
ggaugcauucuguuggaau

SEQ ID NO: 29024 - RNA, 19 nt, artificial
  Oligomer
gaaaaggcaucacuuuccu

SEQ ID NO: 29025 - RNA, 19 nt, artificial
  Oligomer
cgaaaaagugggaucaucg

SEQ ID NO: 29026 - RNA, 19 nt, artificial
  Oligomer
gcuugagcuauagccuuua

SEQ ID NO: 29027 - RNA, 19 nt, artificial
  Oligomer
acuuugagacuauucauca

SEQ ID NO: 29028 - RNA, 19 nt, artificial
  Oligomer
auacucaauugaugguuau

SEQ ID NO: 29029 - RNA, 19 nt, artificial
  Oligomer
ugagcaaaguucagcaagu

SEQ ID NO: 29030 - RNA, 19 nt, artificial
  Oligomer
ugacaaugucaccuuugag

SEQ ID NO: 29031 - RNA, 19 nt, artificial
  Oligomer
acucagcacuguuugaaga

SEQ ID NO: 29032 - RNA, 19 nt, artificial
  Oligomer
ugaccuugugcccgauucu

SEQ ID NO: 29033 - RNA, 19 nt, artificial
  Oligomer
auacaaucugggauaguuu

SEQ ID NO: 29034 - RNA, 19 nt, artificial
  Oligomer
gugaguuugaagagguucu

SEQ ID NO: 29035 - RNA, 19 nt, artificial
  Oligomer
cagaagcugauuuucauga

SEQ ID NO: 29036 - RNA, 19 nt, artificial
  Oligomer
aaugguggguuuuuuuucu

SEQ ID NO: 29037 - RNA, 19 nt, artificial
  Oligomer
cagccuuuuguuacaagcu

SEQ ID NO: 29038 - RNA, 19 nt, artificial
  Oligomer
gugggaucaucgguaaagc

SEQ ID NO: 29039 - RNA, 19 nt, artificial
  Oligomer
ccuggagaacuauccuauc

SEQ ID NO: 29040 - RNA, 19 nt, artificial
  Oligomer
uccauuucuuucugguuau

SEQ ID NO: 29041 - RNA, 19 nt, artificial
  Oligomer
caaguagagcagaguuugg

SEQ ID NO: 29042 - RNA, 19 nt, artificial
  Oligomer
aaguccuuaagcagaggaa

SEQ ID NO: 29043 - RNA, 19 nt, artificial
  Oligomer
cuuucagauugcuuugggu

SEQ ID NO: 29044 - RNA, 19 nt, artificial
  Oligomer
ggaucaucgguaaagcacc

SEQ ID NO: 29045 - RNA, 19 nt, artificial
  Oligomer
cgaauugggaauuuuauug

SEQ ID NO: 29046 - RNA, 19 nt, artificial
  Oligomer
ggcugauuuaguccuccag

SEQ ID NO: 29047 - RNA, 19 nt, artificial
  Oligomer
gaugaaggcuugucagcac

SEQ ID NO: 29048 - RNA, 19 nt, artificial
  Oligomer
ucagcacuuccaguuuaga

SEQ ID NO: 29049 - RNA, 19 nt, artificial
  Oligomer
ggaacagucgaaaaagugg

SEQ ID NO: 29050 - RNA, 19 nt, artificial
  Oligomer
ucaugcugagcaaaguuca

SEQ ID NO: 29051 - RNA, 19 nt, artificial
  Oligomer
ggaaaugucaugugagguu

SEQ ID NO: 29052 - RNA, 19 nt, artificial
  Oligomer
uacaaucugucaccuucca

SEQ ID NO: 29053 - RNA, 19 nt, artificial
  Oligomer
gauuagcaucccauacuag

SEQ ID NO: 29054 - RNA, 19 nt, artificial
  Oligomer
ccuaaaaccaggugaucgu

SEQ ID NO: 29055 - RNA, 19 nt, artificial
  Oligomer
ucuucuacagcuucugaga

SEQ ID NO: 29056 - RNA, 19 nt, artificial
  Oligomer
ucuuucuguuggaaugauu

SEQ ID NO: 29057 - RNA, 19 nt, artificial
  Oligomer
cuugcguccaagucuguga

SEQ ID NO: 29058 - RNA, 19 nt, artificial
  Oligomer
ugccuucauugaggaagga

SEQ ID NO: 29059 - RNA, 19 nt, artificial
  Oligomer
ugaccagaaucccugaugu

SEQ ID NO: 29060 - RNA, 19 nt, artificial
  Oligomer
gguaucuuucuguuggaau

SEQ ID NO: 29061 - RNA, 19 nt, artificial
  Oligomer
guuaagaauaacuaauaca

SEQ ID NO: 29062 - RNA, 19 nt, artificial
  Oligomer
aagcucuggaggccuuuga

SEQ ID NO: 29063 - RNA, 19 nt, artificial
  Oligomer
auuuagaccuaaaucgcau

SEQ ID NO: 29064 - RNA, 19 nt, artificial
  Oligomer
guuauuagacaauuccauu

SEQ ID NO: 29065 - RNA, 19 nt, artificial
  Oligomer
uucuuucugguuauuauaa

SEQ ID NO: 29066 - RNA, 19 nt, artificial
  Oligomer
aaaggagaauaagaaaagg

SEQ ID NO: 29067 - RNA, 19 nt, artificial
  Oligomer
uggaggccuuugaaacauu

SEQ ID NO: 29068 - RNA, 19 nt, artificial
  Oligomer
ugaaccaggcccaaaugag

SEQ ID NO: 29069 - RNA, 19 nt, artificial
  Oligomer
auugggaauuuuauuguga

SEQ ID NO: 29070 - RNA, 19 nt, artificial
  Oligomer
uucagauugcuuuggguaa

SEQ ID NO: 29071 - RNA, 19 nt, artificial
  Oligomer
ccuugugcccgauucuuuc

SEQ ID NO: 29072 - RNA, 19 nt, artificial
  Oligomer
cugauuuucaugaaaaucu

SEQ ID NO: 29073 - RNA, 19 nt, artificial
  Oligomer
cgguucuauaagcacaaug

SEQ ID NO: 29074 - RNA, 19 nt, artificial
  Oligomer
ugaugcagaacuuucucuu

SEQ ID NO: 29075 - RNA, 19 nt, artificial
  Oligomer
aguuaugaaaagauaacuu

SEQ ID NO: 29076 - RNA, 19 nt, artificial
  Oligomer
ggacuacucagcacuguuu

SEQ ID NO: 29077 - RNA, 19 nt, artificial
  Oligomer
acagaaguccuuaagcaga

SEQ ID NO: 29078 - RNA, 19 nt, artificial
  Oligomer
acuucaugaagacuuaacu

SEQ ID NO: 29079 - RNA, 19 nt, artificial
  Oligomer
ugaugguuauuagacaauu

SEQ ID NO: 29080 - RNA, 19 nt, artificial
  Oligomer
auucaucaagaaugaggau

SEQ ID NO: 29081 - RNA, 19 nt, artificial
  Oligomer
ccauagguuuccucuggag

SEQ ID NO: 29082 - RNA, 19 nt, artificial
  Oligomer
gccuucauugaggaaggaa

SEQ ID NO: 29083 - RNA, 19 nt, artificial
  Oligomer
auggguggagggugaguuu

SEQ ID NO: 29084 - RNA, 19 nt, artificial
  Oligomer
uagacaauuccauuucuuu

SEQ ID NO: 29085 - RNA, 19 nt, artificial
  Oligomer
ugguuagcucacaggacuu

SEQ ID NO: 29086 - RNA, 19 nt, artificial
  Oligomer
acgcaauguuucuagagac

SEQ ID NO: 29087 - RNA, 19 nt, artificial
  Oligomer
aacagucgaaaaaguggga

SEQ ID NO: 29088 - RNA, 19 nt, artificial
  Oligomer
ccagaagcugauuuucaug

SEQ ID NO: 29089 - RNA, 19 nt, artificial
  Oligomer
acucaacuaggcucauacu

SEQ ID NO: 29090 - RNA, 19 nt, artificial
  Oligomer
ccaugacauagcuugagcu

SEQ ID NO: 29091 - RNA, 19 nt, artificial
  Oligomer
acaaugucaccuuugagga

SEQ ID NO: 29092 - RNA, 19 nt, artificial
  Oligomer
uggaaugauuucuaugaac

SEQ ID NO: 29093 - RNA, 19 nt, artificial
  Oligomer
acuacucagcacuguuuga

SEQ ID NO: 29094 - RNA, 19 nt, artificial
  Oligomer
caaguaguggugacugauc

SEQ ID NO: 29095 - RNA, 19 nt, artificial
  Oligomer
uugagcaugauuuucaacc

SEQ ID NO: 29096 - RNA, 19 nt, artificial
  Oligomer
uuuuucacaauaaaauucc

SEQ ID NO: 29097 - RNA, 19 nt, artificial
  Oligomer
uugaguaugagccuaguug

SEQ ID NO: 29098 - RNA, 19 nt, artificial
  Oligomer
uaaaauucccaauucgacc

SEQ ID NO: 29099 - RNA, 19 nt, artificial
  Oligomer
uuaaaaauuauccuggauc

SEQ ID NO: 29100 - RNA, 19 nt, artificial
  Oligomer
uugaugaauagucucaaag

SEQ ID NO: 29101 - RNA, 19 nt, artificial
  Oligomer
uacuauauccucauucuug

SEQ ID NO: 29102 - RNA, 19 nt, artificial
  Oligomer
uuuacauucacagacuugg

SEQ ID NO: 29103 - RNA, 19 nt, artificial
  Oligomer
uuauucuccuuuuaucauc

SEQ ID NO: 29104 - RNA, 19 nt, artificial
  Oligomer
uucaaacucacccuccacc

SEQ ID NO: 29105 - RNA, 19 nt, artificial
  Oligomer
uuuaggugcuuuaccgaug

SEQ ID NO: 29106 - RNA, 19 nt, artificial
  Oligomer
uucuuauucuccuuuuauc

SEQ ID NO: 29107 - RNA, 19 nt, artificial
  Oligomer
uuaguuauucuuaacauuc

SEQ ID NO: 29108 - RNA, 19 nt, artificial
  Oligomer
uugcucagcaugaacaggg

SEQ ID NO: 29109 - RNA, 19 nt, artificial
  Oligomer
ucauucuugaugaauaguc

SEQ ID NO: 29110 - RNA, 19 nt, artificial
  Oligomer
uugcaguaucgaaacacgc

SEQ ID NO: 29111 - RNA, 19 nt, artificial
  Oligomer
uaucuuuucauaacucagc

SEQ ID NO: 29112 - RNA, 19 nt, artificial
  Oligomer
uuucaugaaaaucagcuuc

SEQ ID NO: 29113 - RNA, 19 nt, artificial
  Oligomer
uaugucucuagaaacauug

SEQ ID NO: 29114 - RNA, 19 nt, artificial
  Oligomer
uuaucuuuucauaacucag

SEQ ID NO: 29115 - RNA, 19 nt, artificial
  Oligomer
uauauccucauucuugaug

SEQ ID NO: 29116 - RNA, 19 nt, artificial
  Oligomer
uucaugucccagcaccaug

SEQ ID NO: 29117 - RNA, 19 nt, artificial
  Oligomer
auugguuuaaaaauuaucc

SEQ ID NO: 29118 - RNA, 19 nt, artificial
  Oligomer
uuaacaucagggauucugg

SEQ ID NO: 29119 - RNA, 19 nt, artificial
  Oligomer
uuuauuacccaaagcaauc

SEQ ID NO: 29120 - RNA, 19 nt, artificial
  Oligomer
auuuucaugaaaaucagcu

SEQ ID NO: 29121 - RNA, 19 nt, artificial
  Oligomer
uuucacaauaaaauuccca

SEQ ID NO: 29122 - RNA, 19 nt, artificial
  Oligomer
uuuaaggcacaccaauucc

SEQ ID NO: 29123 - RNA, 19 nt, artificial
  Oligomer
uuuucauaacucagcccuc

SEQ ID NO: 29124 - RNA, 19 nt, artificial
  Oligomer
uucagggauaggauaguuc

SEQ ID NO: 29125 - RNA, 19 nt, artificial
  Oligomer
uuuaggucuaaaucuuacc

SEQ ID NO: 29126 - RNA, 19 nt, artificial
  Oligomer
acuuuuucgacuguucccg

SEQ ID NO: 29127 - RNA, 19 nt, artificial
  Oligomer
uucuugaugaauagucuca

SEQ ID NO: 29128 - RNA, 19 nt, artificial
  Oligomer
augaaaaucagcuucuggg

SEQ ID NO: 29129 - RNA, 19 nt, artificial
  Oligomer
uuacaagaaaaucagaacc

SEQ ID NO: 29130 - RNA, 19 nt, artificial
  Oligomer
augccuuuucuuauucucc

SEQ ID NO: 29131 - RNA, 19 nt, artificial
  Oligomer
uuguaucggcccaucuugc

SEQ ID NO: 29132 - RNA, 19 nt, artificial
  Oligomer
uuuucuguuuauaauaacc

SEQ ID NO: 29133 - RNA, 19 nt, artificial
  Oligomer
uacuuuuuccacauuaggg

SEQ ID NO: 29134 - RNA, 19 nt, artificial
  Oligomer
acaaguagcaguuuccugg

SEQ ID NO: 29135 - RNA, 19 nt, artificial
  Oligomer
uugugcuuauagaaccggc

SEQ ID NO: 29136 - RNA, 19 nt, artificial
  Oligomer
uuuaaauguuucaaaggcc

SEQ ID NO: 29137 - RNA, 19 nt, artificial
  Oligomer
uuucuguuuauaauaacca

SEQ ID NO: 29138 - RNA, 19 nt, artificial
  Oligomer
uaguaugggaugcuaaucu

SEQ ID NO: 29139 - RNA, 19 nt, artificial
  Oligomer
uucccgaagcuucaugucc

SEQ ID NO: 29140 - RNA, 19 nt, artificial
  Oligomer
auuaacaucagggauucug

SEQ ID NO: 29141 - RNA, 19 nt, artificial
  Oligomer
uuuuacauucacagacuug

SEQ ID NO: 29142 - RNA, 19 nt, artificial
  Oligomer
ucuuauucuccuuuuauca

SEQ ID NO: 29143 - RNA, 19 nt, artificial
  Oligomer
ucaaaagagaaaguucugc

SEQ ID NO: 29144 - RNA, 19 nt, artificial
  Oligomer
auaaaauucccaauucgac

SEQ ID NO: 29145 - RNA, 19 nt, artificial
  Oligomer
uugauauccaccucccgga

SEQ ID NO: 29146 - RNA, 19 nt, artificial
  Oligomer
aucaucaaaacaaacagcc

SEQ ID NO: 29147 - RNA, 19 nt, artificial
  Oligomer
uuuaucaucaaaacaaaca

SEQ ID NO: 29148 - RNA, 19 nt, artificial
  Oligomer
ucccaauucgaccauacuc

SEQ ID NO: 29149 - RNA, 19 nt, artificial
  Oligomer
uaugggaugcuaaucuucu

SEQ ID NO: 29150 - RNA, 19 nt, artificial
  Oligomer
uucaaaagagaaaguucug

SEQ ID NO: 29151 - RNA, 19 nt, artificial
  Oligomer
uuuuaggugcuuuaccgau

SEQ ID NO: 29152 - RNA, 19 nt, artificial
  Oligomer
uuucuuauucuccuuuuau

SEQ ID NO: 29153 - RNA, 19 nt, artificial
  Oligomer
uuuuaaauguuucaaaggc

SEQ ID NO: 29154 - RNA, 19 nt, artificial
  Oligomer
aaccucuucaaacucaccc

SEQ ID NO: 29155 - RNA, 19 nt, artificial
  Oligomer
uuccucaaaggugacauug

SEQ ID NO: 29156 - RNA, 19 nt, artificial
  Oligomer
aucuuuucauaacucagcc

SEQ ID NO: 29157 - RNA, 19 nt, artificial
  Oligomer
uucaaaggccuccagagcu

SEQ ID NO: 29158 - RNA, 19 nt, artificial
  Oligomer
ugcaguaucgaaacacgcc

SEQ ID NO: 29159 - RNA, 19 nt, artificial
  Oligomer
uuacuuuuuccacauuagg

SEQ ID NO: 29160 - RNA, 19 nt, artificial
  Oligomer
uaacucagcccucauuccc

SEQ ID NO: 29161 - RNA, 19 nt, artificial
  Oligomer
uugcguucuaaacuggaag

SEQ ID NO: 29162 - RNA, 19 nt, artificial
  Oligomer
uguaucuuuaaggcacacc

SEQ ID NO: 29163 - RNA, 19 nt, artificial
  Oligomer
ucuuuucauaacucagccc

SEQ ID NO: 29164 - RNA, 19 nt, artificial
  Oligomer
ucaaugaaggcacuccagg

SEQ ID NO: 29165 - RNA, 19 nt, artificial
  Oligomer
uucaugaaaaucagcuucu

SEQ ID NO: 29166 - RNA, 19 nt, artificial
  Oligomer
auuaaaauaagacaaguuc

SEQ ID NO: 29167 - RNA, 19 nt, artificial
  Oligomer
uuuccuuccucaaugaagg

SEQ ID NO: 29168 - RNA, 19 nt, artificial
  Oligomer
uuuacugguaaugagaaga

SEQ ID NO: 29169 - RNA, 19 nt, artificial
  Oligomer
ugguuuuaggugcuuuacc

SEQ ID NO: 29170 - RNA, 19 nt, artificial
  Oligomer
auuguaucggcccaucuug

SEQ ID NO: 29171 - RNA, 19 nt, artificial
  Oligomer
uucacaauaaaauucccaa

SEQ ID NO: 29172 - RNA, 19 nt, artificial
  Oligomer
uugguuuaaaaauuauccu

SEQ ID NO: 29173 - RNA, 19 nt, artificial
  Oligomer
ugucucuagaaacauugcg

SEQ ID NO: 29174 - RNA, 19 nt, artificial
  Oligomer
uucuaaacuggaagugcug

SEQ ID NO: 29175 - RNA, 19 nt, artificial
  Oligomer
uauagcucaagcuauguca

SEQ ID NO: 29176 - RNA, 19 nt, artificial
  Oligomer
uuaaggcacaccaauuccu

SEQ ID NO: 29177 - RNA, 19 nt, artificial
  Oligomer
ugggaugcuaaucuucugg

SEQ ID NO: 29178 - RNA, 19 nt, artificial
  Oligomer
auagaaaucauuccaacag

SEQ ID NO: 29179 - RNA, 19 nt, artificial
  Oligomer
uuuuuaaauguuucaaagg

SEQ ID NO: 29180 - RNA, 19 nt, artificial
  Oligomer
uuucauaacucagcccuca

SEQ ID NO: 29181 - RNA, 19 nt, artificial
  Oligomer
uuuucaugaaaaucagcuu

SEQ ID NO: 29182 - RNA, 19 nt, artificial
  Oligomer
aauucgaccauacucccag

SEQ ID NO: 29183 - RNA, 19 nt, artificial
  Oligomer
uaaggcacaccaauuccuc

SEQ ID NO: 29184 - RNA, 19 nt, artificial
  Oligomer
uuaucaucaaaacaaacag

SEQ ID NO: 29185 - RNA, 19 nt, artificial
  Oligomer
ugguuuaaaaauuauccug

SEQ ID NO: 29186 - RNA, 19 nt, artificial
  Oligomer
ugccuuuucuuauucuccu

SEQ ID NO: 29187 - RNA, 19 nt, artificial
  Oligomer
ucagucaccacuacuugag

SEQ ID NO: 29188 - RNA, 19 nt, artificial
  Oligomer
uuaaaauaagacaaguuca

SEQ ID NO: 29189 - RNA, 19 nt, artificial
  Oligomer
uuuucgacuguucccgaag

SEQ ID NO: 29190 - RNA, 19 nt, artificial
  Oligomer
uguugcaguaucgaaacac

SEQ ID NO: 29191 - RNA, 19 nt, artificial
  Oligomer
aaguucugcaucagagccc

SEQ ID NO: 29192 - RNA, 19 nt, artificial
  Oligomer
uuucaaaggccuccagagc

SEQ ID NO: 29193 - RNA, 19 nt, artificial
  Oligomer
ugacagauuguaucggccc

SEQ ID NO: 29194 - RNA, 19 nt, artificial
  Oligomer
uuaaauguuucaaaggccu

SEQ ID NO: 29195 - RNA, 19 nt, artificial
  Oligomer
uugucaggaagcuuguaac

SEQ ID NO: 29196 - RNA, 19 nt, artificial
  Oligomer
uucauagaaaucauuccaa

SEQ ID NO: 29197 - RNA, 19 nt, artificial
  Oligomer
uccaacagaaugcauccuc

SEQ ID NO: 29198 - RNA, 19 nt, artificial
  Oligomer
ucaaaggugacauugucag

SEQ ID NO: 29199 - RNA, 19 nt, artificial
  Oligomer
uuuaccgaugaucccacuu

SEQ ID NO: 29200 - RNA, 19 nt, artificial
  Oligomer
uaaaaauuauccuggaucc

SEQ ID NO: 29201 - RNA, 19 nt, artificial
  Oligomer
uauucuccuuuuaucauca

SEQ ID NO: 29202 - RNA, 19 nt, artificial
  Oligomer
uuauagaaccggcagaggu

SEQ ID NO: 29203 - RNA, 19 nt, artificial
  Oligomer
uuaccgaugaucccacuuu

SEQ ID NO: 29204 - RNA, 19 nt, artificial
  Oligomer
ugagcuaaccaaacccucc

SEQ ID NO: 29205 - RNA, 19 nt, artificial
  Oligomer
uuaggucuaaaucuuacca

SEQ ID NO: 29206 - RNA, 19 nt, artificial
  Oligomer
ugaccuucuacuuuccugg

SEQ ID NO: 29207 - RNA, 19 nt, artificial
  Oligomer
auuuccugagggcucuccu

SEQ ID NO: 29208 - RNA, 19 nt, artificial
  Oligomer
uccucaaugaaggcacucc

SEQ ID NO: 29209 - RNA, 19 nt, artificial
  Oligomer
uaggucuaaaucuuaccag

SEQ ID NO: 29210 - RNA, 19 nt, artificial
  Oligomer
ugcuuuaccgaugauccca

SEQ ID NO: 29211 - RNA, 19 nt, artificial
  Oligomer
aaguucauagaaaucauuc

SEQ ID NO: 29212 - RNA, 19 nt, artificial
  Oligomer
ucucaaagucacaaguugg

SEQ ID NO: 29213 - RNA, 19 nt, artificial
  Oligomer
uuacugguaaugagaagag

SEQ ID NO: 29214 - RNA, 19 nt, artificial
  Oligomer
ugagaucccaagacugugg

SEQ ID NO: 29215 - RNA, 19 nt, artificial
  Oligomer
augaauagucucaaaguca

SEQ ID NO: 29216 - RNA, 19 nt, artificial
  Oligomer
auucaaaagagaaaguucu

SEQ ID NO: 29217 - RNA, 19 nt, artificial
  Oligomer
ucagggauucuggucacug

SEQ ID NO: 29218 - RNA, 19 nt, artificial
  Oligomer
auucuugaugaauagucuc

SEQ ID NO: 29219 - RNA, 19 nt, artificial
  Oligomer
uuuucacaauaaaauuccc

SEQ ID NO: 29220 - RNA, 19 nt, artificial
  Oligomer
uuuccugagggcucuccuu

SEQ ID NO: 29221 - RNA, 19 nt, artificial
  Oligomer
cuuuucauaacucagcccu

SEQ ID NO: 29222 - RNA, 19 nt, artificial
  Oligomer
uucauaacucagcccucau

SEQ ID NO: 29223 - RNA, 19 nt, artificial
  Oligomer
auggaauugucuaauaacc

SEQ ID NO: 29224 - RNA, 19 nt, artificial
  Oligomer
uaccagaaaaaaaacccac

SEQ ID NO: 29225 - RNA, 19 nt, artificial
  Oligomer
uuuuaucaucaaaacaaac

SEQ ID NO: 29226 - RNA, 19 nt, artificial
  Oligomer
ucuuacuuuuuccacauua

SEQ ID NO: 29227 - RNA, 19 nt, artificial
  Oligomer
uuaaccucacaugacauuu

SEQ ID NO: 29228 - RNA, 19 nt, artificial
  Oligomer
uucuguuuauaauaaccag

SEQ ID NO: 29229 - RNA, 19 nt, artificial
  Oligomer
uugaguaugagucuaguau

SEQ ID NO: 29230 - RNA, 19 nt, artificial
  Oligomer
uucaugaaguuaucuuuuc

SEQ ID NO: 29231 - RNA, 19 nt, artificial
  Oligomer
uaccaagagccuuuacugg

SEQ ID NO: 29232 - RNA, 19 nt, artificial
  Oligomer
ugcgauuuaggucuaaauc

SEQ ID NO: 29233 - RNA, 19 nt, artificial
  Oligomer
ucuuuaaggcacaccaauu

SEQ ID NO: 29234 - RNA, 19 nt, artificial
  Oligomer
ugcauugugcuuauagaac

SEQ ID NO: 29235 - RNA, 19 nt, artificial
  Oligomer
uacuugcugaacuuugcuc

SEQ ID NO: 29236 - RNA, 19 nt, artificial
  Oligomer
uccacaaguagcaguuucc

SEQ ID NO: 29237 - RNA, 19 nt, artificial
  Oligomer
uuuauaauaaccagaaaga

SEQ ID NO: 29238 - RNA, 19 nt, artificial
  Oligomer
uaggauaguucuccaggcg

SEQ ID NO: 29239 - RNA, 19 nt, artificial
  Oligomer
aaauuauccuggauccagg

SEQ ID NO: 29240 - RNA, 19 nt, artificial
  Oligomer
ugaauagucucaaagucac

SEQ ID NO: 29241 - RNA, 19 nt, artificial
  Oligomer
auaccaagagccuuuacug

SEQ ID NO: 29242 - RNA, 19 nt, artificial
  Oligomer
ugcauccucagcaagaccu

SEQ ID NO: 29243 - RNA, 19 nt, artificial
  Oligomer
auugugcuuauagaaccgg

SEQ ID NO: 29244 - RNA, 19 nt, artificial
  Oligomer
cccaauucgaccauacucc

SEQ ID NO: 29245 - RNA, 19 nt, artificial
  Oligomer
uugagcugcucccauugcu

SEQ ID NO: 29246 - RNA, 19 nt, artificial
  Oligomer
ugcagaauucaucauuuuc

SEQ ID NO: 29247 - RNA, 19 nt, artificial
  Oligomer
uguagaagaggcaaucuuc

SEQ ID NO: 29248 - RNA, 19 nt, artificial
  Oligomer
uuggacgcaagcaucgaaa

SEQ ID NO: 29249 - RNA, 19 nt, artificial
  Oligomer
ucuuaccagaaaaaaaacc

SEQ ID NO: 29250 - RNA, 19 nt, artificial
  Oligomer
uucuguucacaaugaauug

SEQ ID NO: 29251 - RNA, 19 nt, artificial
  Oligomer
agacagaucagucaccacu

SEQ ID NO: 29252 - RNA, 19 nt, artificial
  Oligomer
uaguccucuuacuuuuucc

SEQ ID NO: 29253 - RNA, 19 nt, artificial
  Oligomer
uacgguggucaucucagag

SEQ ID NO: 29254 - RNA, 19 nt, artificial
  Oligomer
ucuugaugaauagucucaa

SEQ ID NO: 29255 - RNA, 19 nt, artificial
  Oligomer
aaaauuauccuggauccag

SEQ ID NO: 29256 - RNA, 19 nt, artificial
  Oligomer
aacauugcguucuaaacug

SEQ ID NO: 29257 - RNA, 19 nt, artificial
  Oligomer
auuuaggucuaaaucuuac

SEQ ID NO: 29258 - RNA, 19 nt, artificial
  Oligomer
agaaaguucugcaucagag

SEQ ID NO: 29259 - RNA, 19 nt, artificial
  Oligomer
ucacacuugagcaugauuu

SEQ ID NO: 29260 - RNA, 19 nt, artificial
  Oligomer
gaauucaucauuuucucgg

SEQ ID NO: 29261 - RNA, 19 nt, artificial
  Oligomer
uauuacccaaagcaaucug

SEQ ID NO: 29262 - RNA, 19 nt, artificial
  Oligomer
ucuccuuuuaucaucaaaa

SEQ ID NO: 29263 - RNA, 19 nt, artificial
  Oligomer
uuggacaaucggguagcag

SEQ ID NO: 29264 - RNA, 19 nt, artificial
  Oligomer
ugacaagccuucaucccag

SEQ ID NO: 29265 - RNA, 19 nt, artificial
  Oligomer
aaaguucugcaucagagcc

SEQ ID NO: 29266 - RNA, 19 nt, artificial
  Oligomer
uuucgacuguucccgaagc

SEQ ID NO: 29267 - RNA, 19 nt, artificial
  Oligomer
uacaagaaaaucagaaccu

SEQ ID NO: 29268 - RNA, 19 nt, artificial
  Oligomer
ucagcaagaccucauuugg

SEQ ID NO: 29269 - RNA, 19 nt, artificial
  Oligomer
uuaccagaaaaaaaaccca

SEQ ID NO: 29270 - RNA, 19 nt, artificial
  Oligomer
ugucuaauaaccaucaauu

SEQ ID NO: 29271 - RNA, 19 nt, artificial
  Oligomer
aucaccugguuuuaggugc

SEQ ID NO: 29272 - RNA, 19 nt, artificial
  Oligomer
uuuccugguugccugguga

SEQ ID NO: 29273 - RNA, 19 nt, artificial
  Oligomer
uuccucaaugaaggcacuc

SEQ ID NO: 29274 - RNA, 19 nt, artificial
  Oligomer
uuuaaccucacaugacauu

SEQ ID NO: 29275 - RNA, 19 nt, artificial
  Oligomer
acauucacagacuuggacg

SEQ ID NO: 29276 - RNA, 19 nt, artificial
  Oligomer
aaauaagacaaguucauag

SEQ ID NO: 29277 - RNA, 19 nt, artificial
  Oligomer
ugaaaaucagcuucugggc

SEQ ID NO: 29278 - RNA, 19 nt, artificial
  Oligomer
uaugagucuaguaugggau

SEQ ID NO: 29279 - RNA, 19 nt, artificial
  Oligomer
ucggguagcagacagauca

SEQ ID NO: 29280 - RNA, 19 nt, artificial
  Oligomer
uuaaaggcuauagcucaag

SEQ ID NO: 29281 - RNA, 19 nt, artificial
  Oligomer
uuaaggacuucuguucaca

SEQ ID NO: 29282 - RNA, 19 nt, artificial
  Oligomer
uccucuuacuuuuuccaca

SEQ ID NO: 29283 - RNA, 19 nt, artificial
  Oligomer
aagaaaaucagaaccucuu

SEQ ID NO: 29284 - RNA, 19 nt, artificial
  Oligomer
ugcuuaaggacuucuguuc

SEQ ID NO: 29285 - RNA, 19 nt, artificial
  Oligomer
uggaauugucuaauaacca

SEQ ID NO: 29286 - RNA, 19 nt, artificial
  Oligomer
uaguucuccaggcgcaagu

SEQ ID NO: 29287 - RNA, 19 nt, artificial
  Oligomer
auuuccuuccucaaugaag

SEQ ID NO: 29288 - RNA, 19 nt, artificial
  Oligomer
uaaauguuucaaaggccuc

SEQ ID NO: 29289 - RNA, 19 nt, artificial
  Oligomer
uuauccuggauccaggaaa

SEQ ID NO: 29290 - RNA, 19 nt, artificial
  Oligomer
augaaggcacuccaggaag

SEQ ID NO: 29291 - RNA, 19 nt, artificial
  Oligomer
cuuaccagaaaaaaaaccc

SEQ ID NO: 29292 - RNA, 19 nt, artificial
  Oligomer
ucuguuuauaauaaccaga

SEQ ID NO: 29293 - RNA, 19 nt, artificial
  Oligomer
uggaagugcugacaagccu

SEQ ID NO: 29294 - RNA, 19 nt, artificial
  Oligomer
ucuacuugcugaacuuugc

SEQ ID NO: 29295 - RNA, 19 nt, artificial
  Oligomer
cuuuuucacaauaaaauuc

SEQ ID NO: 29296 - RNA, 19 nt, artificial
  Oligomer
uucuuaacauucaaaagag

SEQ ID NO: 29297 - RNA, 19 nt, artificial
  Oligomer
aaagugaccaucccgauug

SEQ ID NO: 29298 - RNA, 19 nt, artificial
  Oligomer
aucuggaggacuaaaucag

SEQ ID NO: 29299 - RNA, 19 nt, artificial
  Oligomer
uggaggacuaaaucagccc

SEQ ID NO: 29300 - RNA, 19 nt, artificial
  Oligomer
uaacauucaaaagagaaag

SEQ ID NO: 29301 - RNA, 19 nt, artificial
  Oligomer
aauaaaauucccaauucga

SEQ ID NO: 29302 - RNA, 19 nt, artificial
  Oligomer
uagcaguuuccugguugcc

SEQ ID NO: 29303 - RNA, 19 nt, artificial
  Oligomer
aaucagaaccucuucaaac

SEQ ID NO: 29304 - RNA, 19 nt, artificial
  Oligomer
agggauaggauaguucucc

SEQ ID NO: 29305 - RNA, 19 nt, artificial
  Oligomer
aaauguuucaaaggccucc

SEQ ID NO: 29306 - RNA, 19 nt, artificial
  Oligomer
auugucaggaagcuuguaa

SEQ ID NO: 29307 - RNA, 19 nt, artificial
  Oligomer
uuuucuuauucuccuuuua

SEQ ID NO: 29308 - RNA, 19 nt, artificial
  Oligomer
uucuccagaggaaaccuau

SEQ ID NO: 29309 - RNA, 19 nt, artificial
  Oligomer
ucuagaaacauugcguucu

SEQ ID NO: 29310 - RNA, 19 nt, artificial
  Oligomer
uaucaucaaaacaaacagc

SEQ ID NO: 29311 - RNA, 19 nt, artificial
  Oligomer
uaagucuucaugaaguuau

SEQ ID NO: 29312 - RNA, 19 nt, artificial
  Oligomer
uuauuacccaaagcaaucu

SEQ ID NO: 29313 - RNA, 19 nt, artificial
  Oligomer
aaagagaaaguucugcauc

SEQ ID NO: 29314 - RNA, 19 nt, artificial
  Oligomer
ucuugcagaauucaucauu

SEQ ID NO: 29315 - RNA, 19 nt, artificial
  Oligomer
uuaggugcuuuaccgauga

SEQ ID NO: 29316 - RNA, 19 nt, artificial
  Oligomer
caucaauugaguaugagcc

SEQ ID NO: 29317 - RNA, 19 nt, artificial
  Oligomer
auaauaaccagaaagaaau

SEQ ID NO: 29318 - RNA, 19 nt, artificial
  Oligomer
uacauucacagacuuggac

SEQ ID NO: 29319 - RNA, 19 nt, artificial
  Oligomer
uaaccaucaauugaguaug

SEQ ID NO: 29320 - RNA, 19 nt, artificial
  Oligomer
ucuggaggacuaaaucagc

SEQ ID NO: 29321 - RNA, 19 nt, artificial
  Oligomer
cucuacuugcugaacuuug

SEQ ID NO: 29322 - RNA, 19 nt, artificial
  Oligomer
aaaguaaggaauuaaaggc

SEQ ID NO: 29323 - RNA, 19 nt, artificial
  Oligomer
uccugugagcuaaccaaac

SEQ ID NO: 29324 - RNA, 19 nt, artificial
  Oligomer
cugaccuucuacuuuccug

SEQ ID NO: 29325 - RNA, 19 nt, artificial
  Oligomer
ucuaauaaccaucaauuga

SEQ ID NO: 29326 - RNA, 19 nt, artificial
  Oligomer
ugcugacaagccuucaucc

SEQ ID NO: 29327 - RNA, 19 nt, artificial
  Oligomer
ucuccuuggagaucuggag

SEQ ID NO: 29328 - RNA, 19 nt, artificial
  Oligomer
cucuucaaacucacccucc

SEQ ID NO: 29329 - RNA, 19 nt, artificial
  Oligomer
uucccaauucgaccauacu

SEQ ID NO: 29330 - RNA, 19 nt, artificial
  Oligomer
uagcagacagaucagucac

SEQ ID NO: 29331 - RNA, 19 nt, artificial
  Oligomer
acagaaugcauccucagca

SEQ ID NO: 29332 - RNA, 19 nt, artificial
  Oligomer
uccaacagaaagauaccaa

SEQ ID NO: 29333 - RNA, 19 nt, artificial
  Oligomer
uccagaggaaaccuauggg

SEQ ID NO: 29334 - RNA, 19 nt, artificial
  Oligomer
ucauagaaaucauuccaac

SEQ ID NO: 29335 - RNA, 19 nt, artificial
  Oligomer
cauaacucagcccucauuc

SEQ ID NO: 29336 - RNA, 19 nt, artificial
  Oligomer
uuucuccagaggaaaccua

SEQ ID NO: 29337 - RNA, 19 nt, artificial
  Oligomer
ugaauuguauuaguuauuc

SEQ ID NO: 29338 - RNA, 19 nt, artificial
  Oligomer
ucuucaugaaguuaucuuu

SEQ ID NO: 29339 - RNA, 19 nt, artificial
  Oligomer
aaaccuaugggugacgagg

SEQ ID NO: 29340 - RNA, 19 nt, artificial
  Oligomer
uaucgaaacacgcccuuga

SEQ ID NO: 29341 - RNA, 19 nt, artificial
  Oligomer
agcaguuuccugguugccu

SEQ ID NO: 29342 - RNA, 19 nt, artificial
  Oligomer
ugaguaugagucuaguaug

SEQ ID NO: 29343 - RNA, 19 nt, artificial
  Oligomer
accagaaaaaaaacccacc

SEQ ID NO: 29344 - RNA, 19 nt, artificial
  Oligomer
agaauucaucauuuucucg

SEQ ID NO: 29345 - RNA, 19 nt, artificial
  Oligomer
aaccaaacccuccuggucu

SEQ ID NO: 29346 - RNA, 19 nt, artificial
  Oligomer
ugugagcuaaccaaacccu

SEQ ID NO: 29347 - RNA, 19 nt, artificial
  Oligomer
cuaauaaccaucaauugag

SEQ ID NO: 29348 - RNA, 19 nt, artificial
  Oligomer
uugaguugaguaugagucu

SEQ ID NO: 29349 - RNA, 19 nt, artificial
  Oligomer
aguagcaguuuccugguug

SEQ ID NO: 29350 - RNA, 19 nt, artificial
  Oligomer
uguaacaaaaggcugcauu

SEQ ID NO: 29351 - RNA, 19 nt, artificial
  Oligomer
auagucucaaagucacaag

SEQ ID NO: 29352 - RNA, 19 nt, artificial
  Oligomer
ugcaaacugguuuaaccuc

SEQ ID NO: 29353 - RNA, 19 nt, artificial
  Oligomer
cugugagcuaaccaaaccc

SEQ ID NO: 29354 - RNA, 19 nt, artificial
  Oligomer
uucacaaugaauuguauua

SEQ ID NO: 29355 - RNA, 19 nt, artificial
  Oligomer
ugguucagggauaggauag

SEQ ID NO: 29356 - RNA, 19 nt, artificial
  Oligomer
uuccaacagaaagauacca

SEQ ID NO: 29357 - RNA, 19 nt, artificial
  Oligomer
ucagaaccucuucaaacuc

SEQ ID NO: 29358 - RNA, 19 nt, artificial
  Oligomer
guaucuuuaaggcacacca

SEQ ID NO: 29359 - RNA, 19 nt, artificial
  Oligomer
ugugcuuauagaaccggca

SEQ ID NO: 29360 - RNA, 19 nt, artificial
  Oligomer
uugucuaauaaccaucaau

SEQ ID NO: 29361 - RNA, 19 nt, artificial
  Oligomer
uauaauaaccagaaagaaa

SEQ ID NO: 29362 - RNA, 19 nt, artificial
  Oligomer
aucuuuaaggcacaccaau

SEQ ID NO: 29363 - RNA, 19 nt, artificial
  Oligomer
cagauuuucaugaaaauca

SEQ ID NO: 29364 - RNA, 19 nt, artificial
  Oligomer
uaaccaaacccuccugguc

SEQ ID NO: 29365 - RNA, 19 nt, artificial
  Oligomer
uacuugagcugcucccauu

SEQ ID NO: 29366 - RNA, 19 nt, artificial
  Oligomer
acguguugcaguaucgaaa

SEQ ID NO: 29367 - RNA, 19 nt, artificial
  Oligomer
uccucauucuugaugaaua

SEQ ID NO: 29368 - RNA, 19 nt, artificial
  Oligomer
uuugcucagcaugaacagg

SEQ ID NO: 29369 - RNA, 19 nt, artificial
  Oligomer
ucauaacucagcccucauu

SEQ ID NO: 29370 - RNA, 19 nt, artificial
  Oligomer
uauagaaccggcagagguu

SEQ ID NO: 29371 - RNA, 19 nt, artificial
  Oligomer
uuaacauucaaaagagaaa

SEQ ID NO: 29372 - RNA, 19 nt, artificial
  Oligomer
aaaauucccaauucgacca

SEQ ID NO: 29373 - RNA, 19 nt, artificial
  Oligomer
aggcacaccaauuccucug

SEQ ID NO: 29374 - RNA, 19 nt, artificial
  Oligomer
gacauugucaggaagcuug

SEQ ID NO: 29375 - RNA, 19 nt, artificial
  Oligomer
ugacaagggaccaugcuua

SEQ ID NO: 29376 - RNA, 19 nt, artificial
  Oligomer
aacuaucccagauuguauc

SEQ ID NO: 29377 - RNA, 19 nt, artificial
  Oligomer
gguuuuaggugcuuuaccg

SEQ ID NO: 29378 - RNA, 19 nt, artificial
  Oligomer
aggugcuuuaccgaugauc

SEQ ID NO: 29379 - RNA, 19 nt, artificial
  Oligomer
acaaaaggcugcauugugc

SEQ ID NO: 29380 - RNA, 19 nt, artificial
  Oligomer
auaggauaguucuccaggc

SEQ ID NO: 29381 - RNA, 19 nt, artificial
  Oligomer
aaagauaccaagagccuuu

SEQ ID NO: 29382 - RNA, 19 nt, artificial
  Oligomer
augagaagaggaaagauuu

SEQ ID NO: 29383 - RNA, 19 nt, artificial
  Oligomer
aacaaaaggcugcauugug

SEQ ID NO: 29384 - RNA, 19 nt, artificial
  Oligomer
augggaugcuaaucuucug

SEQ ID NO: 29385 - RNA, 19 nt, artificial
  Oligomer
guugaguugaguaugaguc

SEQ ID NO: 29386 - RNA, 19 nt, artificial
  Oligomer
ugagcaugauuuucaaccc

SEQ ID NO: 29387 - RNA, 19 nt, artificial
  Oligomer
aucccuuuuuaaauguuuc

SEQ ID NO: 29388 - RNA, 19 nt, artificial
  Oligomer
cuuuaaggcacaccaauuc

SEQ ID NO: 29389 - RNA, 19 nt, artificial
  Oligomer
ucagggauaggauaguucu

SEQ ID NO: 29390 - RNA, 19 nt, artificial
  Oligomer
augcaaacugguuuaaccu

SEQ ID NO: 29391 - RNA, 19 nt, artificial
  Oligomer
ucauuugggccugguucag

SEQ ID NO: 29392 - RNA, 19 nt, artificial
  Oligomer
ugcugaguaguccucuuac

SEQ ID NO: 29393 - RNA, 19 nt, artificial
  Oligomer
aaggugacagauuguaucg

SEQ ID NO: 29394 - RNA, 19 nt, artificial
  Oligomer
uccaggaaagugaugccuu

SEQ ID NO: 29395 - RNA, 19 nt, artificial
  Oligomer
agcaaagugaccaucccga

SEQ ID NO: 29396 - RNA, 19 nt, artificial
  Oligomer
uccuuuuaucaucaaaaca

SEQ ID NO: 29397 - RNA, 19 nt, artificial
  Oligomer
agaucagucaccacuacuu

SEQ ID NO: 29398 - RNA, 19 nt, artificial
  Oligomer
aaaucauuccaacagaaag

SEQ ID NO: 29399 - RNA, 19 nt, artificial
  Oligomer
caugaugcgauuuaggucu

SEQ ID NO: 29400 - RNA, 19 nt, artificial
  Oligomer
uguucccgaagcuucaugu

SEQ ID NO: 29401 - RNA, 19 nt, artificial
  Oligomer
uuuuucgacuguucccgaa

SEQ ID NO: 29402 - RNA, 19 nt, artificial
  Oligomer
aaacacgcccuugauaucc

SEQ ID NO: 29403 - RNA, 19 nt, artificial
  Oligomer
uagaaaucauuccaacaga

SEQ ID NO: 29404 - RNA, 19 nt, artificial
  Oligomer
aucaauugaguaugagccu

SEQ ID NO: 29405 - RNA, 19 nt, artificial
  Oligomer
agaagauggaaggugacag

SEQ ID NO: 29406 - RNA, 19 nt, artificial
  Oligomer
uucuccuuuuaucaucaaa

SEQ ID NO: 29407 - RNA, 19 nt, artificial
  Oligomer
ucgaccauacucccaguag

SEQ ID NO: 29408 - RNA, 19 nt, artificial
  Oligomer
uaugagccuaguugaguug

SEQ ID NO: 29409 - RNA, 19 nt, artificial
  Oligomer
ucucuagaaacauugcguu

SEQ ID NO: 29410 - RNA, 19 nt, artificial
  Oligomer
auagaaccggcagagguuc

SEQ ID NO: 29411 - RNA, 19 nt, artificial
  Oligomer
auccucagcaagaccucau

SEQ ID NO: 29412 - RNA, 19 nt, artificial
  Oligomer
uuguaucuuuaaggcacac

SEQ ID NO: 29413 - RNA, 19 nt, artificial
  Oligomer
auucccaauucgaccauac

SEQ ID NO: 29414 - RNA, 19 nt, artificial
  Oligomer
acuggaagugcugacaagc

SEQ ID NO: 29415 - RNA, 19 nt, artificial
  Oligomer
ucuggugagguccacaagu

SEQ ID NO: 29416 - RNA, 19 nt, artificial
  Oligomer
uucgacuguucccgaagcu

SEQ ID NO: 29417 - RNA, 19 nt, artificial
  Oligomer
acgagcaaagugaccaucc

SEQ ID NO: 29418 - RNA, 19 nt, artificial
  Oligomer
aucagucaccacuacuuga

SEQ ID NO: 29419 - RNA, 19 nt, artificial
  Oligomer
uaucuuuaaggcacaccaa

SEQ ID NO: 29420 - RNA, 19 nt, artificial
  Oligomer
uuacauucacagacuugga

SEQ ID NO: 29421 - RNA, 19 nt, artificial
  Oligomer
auauccucauucuugauga

SEQ ID NO: 29422 - RNA, 19 nt, artificial
  Oligomer
acugguuuaaccucacaug

SEQ ID NO: 29423 - RNA, 19 nt, artificial
  Oligomer
uguaucggcccaucuugca

SEQ ID NO: 29424 - RNA, 19 nt, artificial
  Oligomer
ugaguaguccucuuacuuu

SEQ ID NO: 29425 - RNA, 19 nt, artificial
  Oligomer
uccuggauccaggaaagug

SEQ ID NO: 29426 - RNA, 19 nt, artificial
  Oligomer
aacaucagggauucugguc

SEQ ID NO: 29427 - RNA, 19 nt, artificial
  Oligomer
uaucggcccaucuugcaga

SEQ ID NO: 29428 - RNA, 19 nt, artificial
  Oligomer
agcaagaccucauuugggc

SEQ ID NO: 29429 - RNA, 19 nt, artificial
  Oligomer
uacugguaaugagaagagg

SEQ ID NO: 29430 - RNA, 19 nt, artificial
  Oligomer
uuuaaaaauuauccuggau

SEQ ID NO: 29431 - RNA, 19 nt, artificial
  Oligomer
aguuaucuuuucauaacuc

SEQ ID NO: 29432 - RNA, 19 nt, artificial
  Oligomer
aacagaaugcauccucagc

SEQ ID NO: 29433 - RNA, 19 nt, artificial
  Oligomer
aaacauugcguucuaaacu

SEQ ID NO: 29434 - RNA, 19 nt, artificial
  Oligomer
aauucaucauuuucucggg

SEQ ID NO: 29435 - RNA, 19 nt, artificial
  Oligomer
ugaaguuaucuuuucauaa

SEQ ID NO: 29436 - RNA, 19 nt, artificial
  Oligomer
aaagugaugccuuuucuua

SEQ ID NO: 29437 - RNA, 19 nt, artificial
  Oligomer
acuugagcugcucccauug

SEQ ID NO: 29438 - RNA, 19 nt, artificial
  Oligomer
augaaguuaucuuuucaua

SEQ ID NO: 29439 - RNA, 19 nt, artificial
  Oligomer
acuauauccucauucuuga

SEQ ID NO: 29440 - RNA, 19 nt, artificial
  Oligomer
aguucauagaaaucauucc

SEQ ID NO: 29441 - RNA, 19 nt, artificial
  Oligomer
ugguuuaaccucacaugac

SEQ ID NO: 29442 - RNA, 19 nt, artificial
  Oligomer
aagugaugccuuuucuuau

SEQ ID NO: 29443 - RNA, 19 nt, artificial
  Oligomer
uucaucccagacccugagu

SEQ ID NO: 29444 - RNA, 19 nt, artificial
  Oligomer
aucagaaccucuucaaacu

SEQ ID NO: 29445 - RNA, 19 nt, artificial
  Oligomer
aaugcaaacugguuuaacc

SEQ ID NO: 29446 - RNA, 19 nt, artificial
  Oligomer
ucucuggugagguccacaa

SEQ ID NO: 29447 - RNA, 19 nt, artificial
  Oligomer
aacucugcucuacuugcug

SEQ ID NO: 29448 - RNA, 19 nt, artificial
  Oligomer
ucacaaugaauuguauuag

SEQ ID NO: 29449 - RNA, 19 nt, artificial
  Oligomer
auucuuaacauucaaaaga

SEQ ID NO: 29450 - RNA, 19 nt, artificial
  Oligomer
aucugaaagaaucgggcac

SEQ ID NO: 29451 - RNA, 19 nt, artificial
  Oligomer
uugugcccugagaucccaa

SEQ ID NO: 29452 - RNA, 19 nt, artificial
  Oligomer
ucaccacuacuugagcugc

SEQ ID NO: 29453 - RNA, 19 nt, artificial
  Oligomer
cugagaucccaagacugug

SEQ ID NO: 29454 - RNA, 19 nt, artificial
  Oligomer
cuguucccgaagcuucaug

SEQ ID NO: 29455 - RNA, 19 nt, artificial
  Oligomer
auaacucagcccucauucc

SEQ ID NO: 29456 - RNA, 19 nt, artificial
  Oligomer
uaguuauucuuaacauuca

SEQ ID NO: 29457 - RNA, 19 nt, artificial
  Oligomer
ucaugaaguuaucuuuuca

SEQ ID NO: 29458 - RNA, 19 nt, artificial
  Oligomer
agaaaaucagaaccucuuc

SEQ ID NO: 29459 - RNA, 19 nt, artificial
  Oligomer
augcauccucagcaagacc

SEQ ID NO: 29460 - RNA, 19 nt, artificial
  Oligomer
uagcucaagcuaugucaug

SEQ ID NO: 29461 - RNA, 19 nt, artificial
  Oligomer
aguggaaccaggaaaccca

SEQ ID NO: 29462 - RNA, 19 nt, artificial
  Oligomer
accagggaaagguuguugg

SEQ ID NO: 29463 - RNA, 19 nt, artificial
  Oligomer
ucuaguaugggaugcuaau

SEQ ID NO: 29464 - RNA, 19 nt, artificial
  Oligomer
uaucccagauuguaucuuu

SEQ ID NO: 29465 - RNA, 19 nt, artificial
  Oligomer
ucagaagcuguagaagagg

SEQ ID NO: 29466 - RNA, 19 nt, artificial
  Oligomer
uucacagacuuggacgcaa

SEQ ID NO: 29467 - RNA, 19 nt, artificial
  Oligomer
uucgaccauacucccagua

SEQ ID NO: 29468 - RNA, 19 nt, artificial
  Oligomer
aggacuucuguucacaaug

SEQ ID NO: 29469 - RNA, 19 nt, artificial
  Oligomer
uaaaauaagacaaguucau

SEQ ID NO: 29470 - RNA, 19 nt, artificial
  Oligomer
cagaaagauaccaagagcc

SEQ ID NO: 29471 - RNA, 19 nt, artificial
  Oligomer
cacuuuuucgacuguuccc

SEQ ID NO: 29472 - RNA, 19 nt, artificial
  Oligomer
ucccuuuuuaaauguuuca

SEQ ID NO: 29473 - RNA, 19 nt, artificial
  Oligomer
auugaguaugagccuaguu

SEQ ID NO: 29474 - RNA, 19 nt, artificial
  Oligomer
aaugagaagaggaaagauu

SEQ ID NO: 29475 - RNA, 19 nt, artificial
  Oligomer
uguuucaaaggccuccaga

SEQ ID NO: 29476 - RNA, 19 nt, artificial
  Oligomer
aacugguuuaaccucacau

SEQ ID NO: 29477 - RNA, 19 nt, artificial
  Oligomer
uucucagaagcuguagaag

SEQ ID NO: 29478 - RNA, 19 nt, artificial
  Oligomer
uaaacuggaagugcugaca

SEQ ID NO: 29479 - RNA, 19 nt, artificial
  Oligomer
ugaguaugagccuaguuga

SEQ ID NO: 29480 - RNA, 19 nt, artificial
  Oligomer
aguaguggacaucugagcc

SEQ ID NO: 29481 - RNA, 19 nt, artificial
  Oligomer
uaagacaaguucauagaaa

SEQ ID NO: 29482 - RNA, 19 nt, artificial
  Oligomer
cacaaguagcaguuuccug

SEQ ID NO: 29483 - RNA, 19 nt, artificial
  Oligomer
acagauuccaacagaaugc

SEQ ID NO: 29484 - RNA, 19 nt, artificial
  Oligomer
guugcaguaucgaaacacg

SEQ ID NO: 29485 - RNA, 19 nt, artificial
  Oligomer
gguuuaaaaauuauccugg

SEQ ID NO: 29486 - RNA, 19 nt, artificial
  Oligomer
aauagucucaaagucacaa

SEQ ID NO: 29487 - RNA, 19 nt, artificial
  Oligomer
uaccgaugaucccacuuuu

SEQ ID NO: 29488 - RNA, 19 nt, artificial
  Oligomer
uggacaaucggguagcaga

SEQ ID NO: 29489 - RNA, 19 nt, artificial
  Oligomer
uuaagucuucaugaaguua

SEQ ID NO: 29490 - RNA, 19 nt, artificial
  Oligomer
uugcugaacuuugcucagc

SEQ ID NO: 29491 - RNA, 19 nt, artificial
  Oligomer
uuggagaucuggaggacua

SEQ ID NO: 29492 - RNA, 19 nt, artificial
  Oligomer
accaagagccuuuacuggu

SEQ ID NO: 29493 - RNA, 19 nt, artificial
  Oligomer
guaugggaugcuaaucuuc

SEQ ID NO: 29494 - RNA, 19 nt, artificial
  Oligomer
cugaacuuugcucagcaug

SEQ ID NO: 29495 - RNA, 19 nt, artificial
  Oligomer
aaguaaggaauuaaaggcu

SEQ ID NO: 29496 - RNA, 19 nt, artificial
  Oligomer
ugaugccuuuucuuauucu

SEQ ID NO: 29497 - RNA, 19 nt, artificial
  Oligomer
uccagagcuuucuccagag

SEQ ID NO: 29498 - RNA, 19 nt, artificial
  Oligomer
aauuaaaggcuauagcuca

SEQ ID NO: 29499 - RNA, 19 nt, artificial
  Oligomer
ucaauugaguaugagccua

SEQ ID NO: 29500 - RNA, 19 nt, artificial
  Oligomer
cuucuguucacaaugaauu

SEQ ID NO: 29501 - RNA, 19 nt, artificial
  Oligomer
aauaaccagaaagaaaugg

SEQ ID NO: 29502 - RNA, 19 nt, artificial
  Oligomer
gugagcuaaccaaacccuc

SEQ ID NO: 29503 - RNA, 19 nt, artificial
  Oligomer
uauucuuaacauucaaaag

SEQ ID NO: 29504 - RNA, 19 nt, artificial
  Oligomer
ugagcugcucccauugcuu

SEQ ID NO: 29505 - RNA, 19 nt, artificial
  Oligomer
ucaguagcaguggaaccag

SEQ ID NO: 29506 - RNA, 19 nt, artificial
  Oligomer
ucuccagaggaaaccuaug

SEQ ID NO: 29507 - RNA, 19 nt, artificial
  Oligomer
cucagcaagaccucauuug

SEQ ID NO: 29508 - RNA, 19 nt, artificial
  Oligomer
ucugaaagaaucgggcaca

SEQ ID NO: 29509 - RNA, 19 nt, artificial
  Oligomer
ugacauugucaggaagcuu

SEQ ID NO: 29510 - RNA, 19 nt, artificial
  Oligomer
ucuaaaucuuaccagaaaa

SEQ ID NO: 29511 - RNA, 19 nt, artificial
  Oligomer
aucggguagcagacagauc

SEQ ID NO: 29512 - RNA, 19 nt, artificial
  Oligomer
auccaggaaagugaugccu

SEQ ID NO: 29513 - RNA, 19 nt, artificial
  Oligomer
ucgacuguucccgaagcuu

SEQ ID NO: 29514 - RNA, 19 nt, artificial
  Oligomer
uagucucaaagucacaagu

SEQ ID NO: 29515 - RNA, 19 nt, artificial
  Oligomer
gugacagauuguaucggcc

SEQ ID NO: 29516 - RNA, 19 nt, artificial
  Oligomer
ucuucaaacucacccucca

SEQ ID NO: 29517 - RNA, 19 nt, artificial
  Oligomer
guuuauaauaaccagaaag

SEQ ID NO: 29518 - RNA, 19 nt, artificial
  Oligomer
agggaaagguuguugggcu

SEQ ID NO: 29519 - RNA, 19 nt, artificial
  Oligomer
augaucccacuuuuucgac

SEQ ID NO: 29520 - RNA, 19 nt, artificial
  Oligomer
caaaagagaaaguucugca

SEQ ID NO: 29521 - RNA, 19 nt, artificial
  Oligomer
gucaccacuacuugagcug

SEQ ID NO: 29522 - RNA, 19 nt, artificial
  Oligomer
aagcuuguaacaaaaggcu

SEQ ID NO: 29523 - RNA, 19 nt, artificial
  Oligomer
auuccaacagaaugcaucc

SEQ ID NO: 29524 - RNA, 19 nt, artificial
  Oligomer
aggaaagugaugccuuuuc

SEQ ID NO: 29525 - RNA, 19 nt, artificial
  Oligomer
cgaugaucccacuuuuucg

SEQ ID NO: 29526 - RNA, 19 nt, artificial
  Oligomer
uaaaggcuauagcucaagc

SEQ ID NO: 29527 - RNA, 19 nt, artificial
  Oligomer
ugaugaauagucucaaagu

SEQ ID NO: 29528 - RNA, 19 nt, artificial
  Oligomer
auaaccaucaauugaguau

SEQ ID NO: 29529 - RNA, 19 nt, artificial
  Oligomer
acuugcugaacuuugcuca

SEQ ID NO: 29530 - RNA, 19 nt, artificial
  Oligomer
cucaaaggugacauuguca

SEQ ID NO: 29531 - RNA, 19 nt, artificial
  Oligomer
ucuucaaacagugcugagu

SEQ ID NO: 29532 - RNA, 19 nt, artificial
  Oligomer
agaaucgggcacaagguca

SEQ ID NO: 29533 - RNA, 19 nt, artificial
  Oligomer
aaacuaucccagauuguau

SEQ ID NO: 29534 - RNA, 19 nt, artificial
  Oligomer
agaaccucuucaaacucac

SEQ ID NO: 29535 - RNA, 19 nt, artificial
  Oligomer
ucaugaaaaucagcuucug

SEQ ID NO: 29536 - RNA, 19 nt, artificial
  Oligomer
agaaaaaaaacccaccauu

SEQ ID NO: 29537 - RNA, 19 nt, artificial
  Oligomer
agcuuguaacaaaaggcug

SEQ ID NO: 29538 - RNA, 19 nt, artificial
  Oligomer
gcuuuaccgaugaucccac

SEQ ID NO: 29539 - RNA, 19 nt, artificial
  Oligomer
gauaggauaguucuccagg

SEQ ID NO: 29540 - RNA, 19 nt, artificial
  Oligomer
auaaccagaaagaaaugga

SEQ ID NO: 29541 - RNA, 19 nt, artificial
  Oligomer
ccaaacucugcucuacuug

SEQ ID NO: 29542 - RNA, 19 nt, artificial
  Oligomer
uuccucugcuuaaggacuu

SEQ ID NO: 29543 - RNA, 19 nt, artificial
  Oligomer
acccaaagcaaucugaaag

SEQ ID NO: 29544 - RNA, 19 nt, artificial
  Oligomer
ggugcuuuaccgaugaucc

SEQ ID NO: 29545 - RNA, 19 nt, artificial
  Oligomer
caauaaaauucccaauucg

SEQ ID NO: 29546 - RNA, 19 nt, artificial
  Oligomer
cuggaggacuaaaucagcc

SEQ ID NO: 29547 - RNA, 19 nt, artificial
  Oligomer
gugcugacaagccuucauc

SEQ ID NO: 29548 - RNA, 19 nt, artificial
  Oligomer
ucuaaacuggaagugcuga

SEQ ID NO: 29549 - RNA, 19 nt, artificial
  Oligomer
ccacuuuuucgacuguucc

SEQ ID NO: 29550 - RNA, 19 nt, artificial
  Oligomer
ugaacuuugcucagcauga

SEQ ID NO: 29551 - RNA, 19 nt, artificial
  Oligomer
aaccucacaugacauuucc

SEQ ID NO: 29552 - RNA, 19 nt, artificial
  Oligomer
uggaaggugacagauugua

SEQ ID NO: 29553 - RNA, 19 nt, artificial
  Oligomer
cuaguaugggaugcuaauc

SEQ ID NO: 29554 - RNA, 19 nt, artificial
  Oligomer
acgaucaccugguuuuagg

SEQ ID NO: 29555 - RNA, 19 nt, artificial
  Oligomer
ucucagaagcuguagaaga

SEQ ID NO: 29556 - RNA, 19 nt, artificial
  Oligomer
aaucauuccaacagaaaga

SEQ ID NO: 29557 - RNA, 19 nt, artificial
  Oligomer
ucacagacuuggacgcaag

SEQ ID NO: 29558 - RNA, 19 nt, artificial
  Oligomer
uccuuccucaaugaaggca

SEQ ID NO: 29559 - RNA, 19 nt, artificial
  Oligomer
acaucagggauucugguca

SEQ ID NO: 29560 - RNA, 19 nt, artificial
  Oligomer
auuccaacagaaagauacc

SEQ ID NO: 29561 - RNA, 19 nt, artificial
  Oligomer
uguauuaguuauucuuaac

SEQ ID NO: 29562 - RNA, 19 nt, artificial
  Oligomer
ucaaaggccuccagagcuu

SEQ ID NO: 29563 - RNA, 19 nt, artificial
  Oligomer
augcgauuuaggucuaaau

SEQ ID NO: 29564 - RNA, 19 nt, artificial
  Oligomer
aauggaauugucuaauaac

SEQ ID NO: 29565 - RNA, 19 nt, artificial
  Oligomer
uuauaauaaccagaaagaa

SEQ ID NO: 29566 - RNA, 19 nt, artificial
  Oligomer
ccuuuucuuauucuccuuu

SEQ ID NO: 29567 - RNA, 19 nt, artificial
  Oligomer
aauguuucaaaggccucca

SEQ ID NO: 29568 - RNA, 19 nt, artificial
  Oligomer
cucauuugggccugguuca

SEQ ID NO: 29569 - RNA, 19 nt, artificial
  Oligomer
ucacaauaaaauucccaau

SEQ ID NO: 29570 - RNA, 19 nt, artificial
  Oligomer
uuacccaaagcaaucugaa

SEQ ID NO: 29571 - RNA, 19 nt, artificial
  Oligomer
gaaagaaucgggcacaagg

SEQ ID NO: 29572 - RNA, 19 nt, artificial
  Oligomer
agauuuucaugaaaaucag

SEQ ID NO: 29573 - RNA, 19 nt, artificial
  Oligomer
cauugugcuuauagaaccg

SEQ ID NO: 29574 - RNA, 19 nt, artificial
  Oligomer
aagagaaaguucugcauca

SEQ ID NO: 29575 - RNA, 19 nt, artificial
  Oligomer
aaguuaucuuuucauaacu

SEQ ID NO: 29576 - RNA, 19 nt, artificial
  Oligomer
aaacagugcugaguagucc

SEQ ID NO: 29577 - RNA, 19 nt, artificial
  Oligomer
ucugcuuaaggacuucugu

SEQ ID NO: 29578 - RNA, 19 nt, artificial
  Oligomer
aguuaagucuucaugaagu

SEQ ID NO: 29579 - RNA, 19 nt, artificial
  Oligomer
aauugucuaauaaccauca

SEQ ID NO: 29580 - RNA, 19 nt, artificial
  Oligomer
auccucauucuugaugaau

SEQ ID NO: 29581 - RNA, 19 nt, artificial
  Oligomer
cuccagaggaaaccuaugg

SEQ ID NO: 29582 - RNA, 19 nt, artificial
  Oligomer
uuccuuccucaaugaaggc

SEQ ID NO: 29583 - RNA, 19 nt, artificial
  Oligomer
aaacucacccuccacccau

SEQ ID NO: 29584 - RNA, 19 nt, artificial
  Oligomer
aaagaaauggaauugucua

SEQ ID NO: 29585 - RNA, 19 nt, artificial
  Oligomer
aaguccugugagcuaacca

SEQ ID NO: 29586 - RNA, 19 nt, artificial
  Oligomer
gucucuagaaacauugcgu

SEQ ID NO: 29587 - RNA, 19 nt, artificial
  Oligomer
ucccacuuuuucgacuguu

SEQ ID NO: 29588 - RNA, 19 nt, artificial
  Oligomer
caugaaaaucagcuucugg

SEQ ID NO: 29589 - RNA, 19 nt, artificial
  Oligomer
aguaugagccuaguugagu

SEQ ID NO: 29590 - RNA, 19 nt, artificial
  Oligomer
agcucaagcuaugucaugg

SEQ ID NO: 29591 - RNA, 19 nt, artificial
  Oligomer
uccucaaaggugacauugu

SEQ ID NO: 29592 - RNA, 19 nt, artificial
  Oligomer
guucauagaaaucauucca

SEQ ID NO: 29593 - RNA, 19 nt, artificial
  Oligomer
ucaaacagugcugaguagu

SEQ ID NO: 29594 - RNA, 19 nt, artificial
  Oligomer
gaucagucaccacuacuug

SEQ ID NO: 29595 - RNA, 19 nt, artificial
  Oligomer
ggaggaagucggugaagaa

SEQ ID NO: 29596 - RNA, 19 nt, artificial
  Oligomer
ggaggagcugccuuaaaaa

SEQ ID NO: 29597 - RNA, 19 nt, artificial
  Oligomer
ggagcugccuuaaaaaaaa

SEQ ID NO: 29598 - RNA, 19 nt, artificial
  Oligomer
cguggaggaugauggagaa

SEQ ID NO: 29599 - RNA, 19 nt, artificial
  Oligomer
cgagaaacuggacuuuuua

SEQ ID NO: 29600 - RNA, 19 nt, artificial
  Oligomer
ggagagguuuuaauuaaaa

SEQ ID NO: 29601 - RNA, 19 nt, artificial
  Oligomer
gcucgaaacugacuggaaa

SEQ ID NO: 29602 - RNA, 19 nt, artificial
  Oligomer
ccgagaugauccuaaaaau

SEQ ID NO: 29603 - RNA, 19 nt, artificial
  Oligomer
aggagagguuuuaauuaaa

SEQ ID NO: 29604 - RNA, 19 nt, artificial
  Oligomer
ggccgagaugauccuaaaa

SEQ ID NO: 29605 - RNA, 19 nt, artificial
  Oligomer
aggaggagcugccuuaaaa

SEQ ID NO: 29606 - RNA, 19 nt, artificial
  Oligomer
cgagaugauccuaaaaaua

SEQ ID NO: 29607 - RNA, 19 nt, artificial
  Oligomer
gagaaacuggacuuuuuaa

SEQ ID NO: 29608 - RNA, 19 nt, artificial
  Oligomer
ggaauauucucuauuuuaa

SEQ ID NO: 29609 - RNA, 19 nt, artificial
  Oligomer
agcaguaauuaaagaaaaa

SEQ ID NO: 29610 - RNA, 19 nt, artificial
  Oligomer
gugugaucagugugcuaaa

SEQ ID NO: 29611 - RNA, 19 nt, artificial
  Oligomer
agaagucaguagaauaaaa

SEQ ID NO: 29612 - RNA, 19 nt, artificial
  Oligomer
ccaccuucaccuacaugaa

SEQ ID NO: 29613 - RNA, 19 nt, artificial
  Oligomer
gagcugccuuaaaaaaaaa

SEQ ID NO: 29614 - RNA, 19 nt, artificial
  Oligomer
cagcgaaaucaacgagaaa

SEQ ID NO: 29615 - RNA, 19 nt, artificial
  Oligomer
cagcgaacgcacaucaaga

SEQ ID NO: 29616 - RNA, 19 nt, artificial
  Oligomer
caauuaugggaguaaacaa

SEQ ID NO: 29617 - RNA, 19 nt, artificial
  Oligomer
gggaguaaacaauagucua

SEQ ID NO: 29618 - RNA, 19 nt, artificial
  Oligomer
gagguaaaaggcaagcaaa

SEQ ID NO: 29619 - RNA, 19 nt, artificial
  Oligomer
cuucaauuucuguauaaaa

SEQ ID NO: 29620 - RNA, 19 nt, artificial
  Oligomer
cacccuagauuuguauaaa

SEQ ID NO: 29621 - RNA, 19 nt, artificial
  Oligomer
ccuucaaccucccacacua

SEQ ID NO: 29622 - RNA, 19 nt, artificial
  Oligomer
cugccuuaaaaaaaaauaa

SEQ ID NO: 29623 - RNA, 19 nt, artificial
  Oligomer
ccuucaauuucuguauaaa

SEQ ID NO: 29624 - RNA, 19 nt, artificial
  Oligomer
gaggagcugccuuaaaaaa

SEQ ID NO: 29625 - RNA, 19 nt, artificial
  Oligomer
cuuccuuaaagacauuuaa

SEQ ID NO: 29626 - RNA, 19 nt, artificial
  Oligomer
ugguaagcuuuaucauaua

SEQ ID NO: 29627 - RNA, 19 nt, artificial
  Oligomer
aaggcaacucguacccaaa

SEQ ID NO: 29628 - RNA, 19 nt, artificial
  Oligomer
gccuguuuggacuuuguaa

SEQ ID NO: 29629 - RNA, 19 nt, artificial
  Oligomer
gcccacugacagaccuuaa

SEQ ID NO: 29630 - RNA, 19 nt, artificial
  Oligomer
aaggagagguuuuaauuaa

SEQ ID NO: 29631 - RNA, 19 nt, artificial
  Oligomer
gacagaccuuaaucuuaau

SEQ ID NO: 29632 - RNA, 19 nt, artificial
  Oligomer
gcagcgaaaucaacgagaa

SEQ ID NO: 29633 - RNA, 19 nt, artificial
  Oligomer
aauggagcagcgaaaucaa

SEQ ID NO: 29634 - RNA, 19 nt, artificial
  Oligomer
uguuuuuguugaaaacaaa

SEQ ID NO: 29635 - RNA, 19 nt, artificial
  Oligomer
gagcuuuccucaaagggua

SEQ ID NO: 29636 - RNA, 19 nt, artificial
  Oligomer
gagguuuuaauuaaaacaa

SEQ ID NO: 29637 - RNA, 19 nt, artificial
  Oligomer
acggcuccagcaagaacaa

SEQ ID NO: 29638 - RNA, 19 nt, artificial
  Oligomer
cgaagaaagagaggaccaa

SEQ ID NO: 29639 - RNA, 19 nt, artificial
  Oligomer
ugacagaccuuaaucuuaa

SEQ ID NO: 29640 - RNA, 19 nt, artificial
  Oligomer
agaacaagccgcacgucaa

SEQ ID NO: 29641 - RNA, 19 nt, artificial
  Oligomer
gagaugauccuaaaaauaa

SEQ ID NO: 29642 - RNA, 19 nt, artificial
  Oligomer
aagagaggaccaaccagaa

SEQ ID NO: 29643 - RNA, 19 nt, artificial
  Oligomer
caguagaauaaaaucuuaa

SEQ ID NO: 29644 - RNA, 19 nt, artificial
  Oligomer
uagcaguaauuaaagaaaa

SEQ ID NO: 29645 - RNA, 19 nt, artificial
  Oligomer
agcucuggagacuucugaa

SEQ ID NO: 29646 - RNA, 19 nt, artificial
  Oligomer
caauuuuaccuucuuuaaa

SEQ ID NO: 29647 - RNA, 19 nt, artificial
  Oligomer
agaaacuggacuuuuuaaa

SEQ ID NO: 29648 - RNA, 19 nt, artificial
  Oligomer
gaugaaaucuguucuggga

SEQ ID NO: 29649 - RNA, 19 nt, artificial
  Oligomer
ccaauuuuaccuucuuuaa

SEQ ID NO: 29650 - RNA, 19 nt, artificial
  Oligomer
cuguuguauuaacauuuaa

SEQ ID NO: 29651 - RNA, 19 nt, artificial
  Oligomer
aaaggcaacucguacccaa

SEQ ID NO: 29652 - RNA, 19 nt, artificial
  Oligomer
gcaguaauuaaagaaaaaa

SEQ ID NO: 29653 - RNA, 19 nt, artificial
  Oligomer
aagcggagcucgaaacuga

SEQ ID NO: 29654 - RNA, 19 nt, artificial
  Oligomer
cagucuuaagaaagaggua

SEQ ID NO: 29655 - RNA, 19 nt, artificial
  Oligomer
aggagcugccuuaaaaaaa

SEQ ID NO: 29656 - RNA, 19 nt, artificial
  Oligomer
aaucuuaaagcacucauaa

SEQ ID NO: 29657 - RNA, 19 nt, artificial
  Oligomer
aagcguggaggaugaugga

SEQ ID NO: 29658 - RNA, 19 nt, artificial
  Oligomer
agauacuucuguaacuuaa

SEQ ID NO: 29659 - RNA, 19 nt, artificial
  Oligomer
aggaccacccggauuacaa

SEQ ID NO: 29660 - RNA, 19 nt, artificial
  Oligomer
aaacggugcugcugggaaa

SEQ ID NO: 29661 - RNA, 19 nt, artificial
  Oligomer
aaggaggagcugccuuaaa

SEQ ID NO: 29662 - RNA, 19 nt, artificial
  Oligomer
cuuuguuguuuuuguugaa

SEQ ID NO: 29663 - RNA, 19 nt, artificial
  Oligomer
ccuuugggcugccuuauau

SEQ ID NO: 29664 - RNA, 19 nt, artificial
  Oligomer
acgagaaacuggacuuuuu

SEQ ID NO: 29665 - RNA, 19 nt, artificial
  Oligomer
ccggaaacuuuucuuugca

SEQ ID NO: 29666 - RNA, 19 nt, artificial
  Oligomer
gcccuagcuuuucuugcaa

SEQ ID NO: 29667 - RNA, 19 nt, artificial
  Oligomer
aaaagcagaucuuuuuaaa

SEQ ID NO: 29668 - RNA, 19 nt, artificial
  Oligomer
gccgagaugauccuaaaaa

SEQ ID NO: 29669 - RNA, 19 nt, artificial
  Oligomer
agagguaaaaggcaagcaa

SEQ ID NO: 29670 - RNA, 19 nt, artificial
  Oligomer
uccucacccuagauuugua

SEQ ID NO: 29671 - RNA, 19 nt, artificial
  Oligomer
agcucgaaacugacuggaa

SEQ ID NO: 29672 - RNA, 19 nt, artificial
  Oligomer
aaaucuuaaagcacucaua

SEQ ID NO: 29673 - RNA, 19 nt, artificial
  Oligomer
aaagcagaucuuuuuaaaa

SEQ ID NO: 29674 - RNA, 19 nt, artificial
  Oligomer
agacauuccacuugcuaaa

SEQ ID NO: 29675 - RNA, 19 nt, artificial
  Oligomer
gaacgcacaucaagacgga

SEQ ID NO: 29676 - RNA, 19 nt, artificial
  Oligomer
cccacugacagaccuuaau

SEQ ID NO: 29677 - RNA, 19 nt, artificial
  Oligomer
gcuaaauggagcagcgaaa

SEQ ID NO: 29678 - RNA, 19 nt, artificial
  Oligomer
gauccuaaaaauaaccgaa

SEQ ID NO: 29679 - RNA, 19 nt, artificial
  Oligomer
agaccuuugggcugccuua

SEQ ID NO: 29680 - RNA, 19 nt, artificial
  Oligomer
uuguauuccucacccuaga

SEQ ID NO: 29681 - RNA, 19 nt, artificial
  Oligomer
ggcaagcaaaggagaugaa

SEQ ID NO: 29682 - RNA, 19 nt, artificial
  Oligomer
uguuggagcuuuccucaaa

SEQ ID NO: 29683 - RNA, 19 nt, artificial
  Oligomer
ccuugagccuuaaaacggu

SEQ ID NO: 29684 - RNA, 19 nt, artificial
  Oligomer
uaaagacauuuaagcuaaa

SEQ ID NO: 29685 - RNA, 19 nt, artificial
  Oligomer
caaccagaguauuuuugua

SEQ ID NO: 29686 - RNA, 19 nt, artificial
  Oligomer
agaugauccuaaaaauaac

SEQ ID NO: 29687 - RNA, 19 nt, artificial
  Oligomer
ccuaaaaauaaccgaagaa

SEQ ID NO: 29688 - RNA, 19 nt, artificial
  Oligomer
ggagcagcgaaaucaacga

SEQ ID NO: 29689 - RNA, 19 nt, artificial
  Oligomer
ggccuuauuuugcaauuau

SEQ ID NO: 29690 - RNA, 19 nt, artificial
  Oligomer
cgcguaugaaucuccugga

SEQ ID NO: 29691 - RNA, 19 nt, artificial
  Oligomer
agaaagagguaaaaggcaa

SEQ ID NO: 29692 - RNA, 19 nt, artificial
  Oligomer
ccuguuguauuaacauuua

SEQ ID NO: 29693 - RNA, 19 nt, artificial
  Oligomer
gcagaucuuuuuaaaaaga

SEQ ID NO: 29694 - RNA, 19 nt, artificial
  Oligomer
aaaacaccuugagccuuaa

SEQ ID NO: 29695 - RNA, 19 nt, artificial
  Oligomer
cgcucacaguacgacuaca

SEQ ID NO: 29696 - RNA, 19 nt, artificial
  Oligomer
ggcuaaauggagcagcgaa

SEQ ID NO: 29697 - RNA, 19 nt, artificial
  Oligomer
ccucaaaggguauggucau

SEQ ID NO: 29698 - RNA, 19 nt, artificial
  Oligomer
ucagaacaccagcaguuaa

SEQ ID NO: 29699 - RNA, 19 nt, artificial
  Oligomer
ggguuaacuuugcuuaauu

SEQ ID NO: 29700 - RNA, 19 nt, artificial
  Oligomer
cauccauauuucucuacau

SEQ ID NO: 29701 - RNA, 19 nt, artificial
  Oligomer
uguugaaaacaaacuggaa

SEQ ID NO: 29702 - RNA, 19 nt, artificial
  Oligomer
gaagagaaaaacaccuuga

SEQ ID NO: 29703 - RNA, 19 nt, artificial
  Oligomer
agagguuuuaauuaaaaca

SEQ ID NO: 29704 - RNA, 19 nt, artificial
  Oligomer
acccuagauuuguauaaau

SEQ ID NO: 29705 - RNA, 19 nt, artificial
  Oligomer
ucaguagaauaaaaucuua

SEQ ID NO: 29706 - RNA, 19 nt, artificial
  Oligomer
ugaagaugaccgacgagca

SEQ ID NO: 29707 - RNA, 19 nt, artificial
  Oligomer
gucuuaagaaagagguaaa

SEQ ID NO: 29708 - RNA, 19 nt, artificial
  Oligomer
ggagaaucgugugaucagu

SEQ ID NO: 29709 - RNA, 19 nt, artificial
  Oligomer
aaaucaacgagaaacugga

SEQ ID NO: 29710 - RNA, 19 nt, artificial
  Oligomer
agcuuuucuugcaaccaga

SEQ ID NO: 29711 - RNA, 19 nt, artificial
  Oligomer
cuuuguauuccucacccua

SEQ ID NO: 29712 - RNA, 19 nt, artificial
  Oligomer
ccuucaugaagaugaccga

SEQ ID NO: 29713 - RNA, 19 nt, artificial
  Oligomer
augagagauugcaaaugua

SEQ ID NO: 29714 - RNA, 19 nt, artificial
  Oligomer
ucacugcagucuuaagaaa

SEQ ID NO: 29715 - RNA, 19 nt, artificial
  Oligomer
aagcagaucuuuuuaaaaa

SEQ ID NO: 29716 - RNA, 19 nt, artificial
  Oligomer
ccucaggcuuugcgauuua

SEQ ID NO: 29717 - RNA, 19 nt, artificial
  Oligomer
guguaugauucauuaccau

SEQ ID NO: 29718 - RNA, 19 nt, artificial
  Oligomer
cucaggcuuugcgauuuaa

SEQ ID NO: 29719 - RNA, 19 nt, artificial
  Oligomer
gcugccuuaaaaaaaaaua

SEQ ID NO: 29720 - RNA, 19 nt, artificial
  Oligomer
caauaaauauacauugcau

SEQ ID NO: 29721 - RNA, 19 nt, artificial
  Oligomer
cucguacccaaauuuccaa

SEQ ID NO: 29722 - RNA, 19 nt, artificial
  Oligomer
acuucuguaacuuaagaaa

SEQ ID NO: 29723 - RNA, 19 nt, artificial
  Oligomer
aggcuuugcgauuuaagga

SEQ ID NO: 29724 - RNA, 19 nt, artificial
  Oligomer
ggaccaaccagaauucccu

SEQ ID NO: 29725 - RNA, 19 nt, artificial
  Oligomer
acauugcauuaaaaagaaa

SEQ ID NO: 29726 - RNA, 19 nt, artificial
  Oligomer
cugugaggaauauucucua

SEQ ID NO: 29727 - RNA, 19 nt, artificial
  Oligomer
acugcagucuuaagaaaga

SEQ ID NO: 29728 - RNA, 19 nt, artificial
  Oligomer
cauauuuugucuuuaggua

SEQ ID NO: 29729 - RNA, 19 nt, artificial
  Oligomer
cugacagaccuuaaucuua

SEQ ID NO: 29730 - RNA, 19 nt, artificial
  Oligomer
ggugcugcugggaaacauu

SEQ ID NO: 29731 - RNA, 19 nt, artificial
  Oligomer
acucguacccaaauuucca

SEQ ID NO: 29732 - RNA, 19 nt, artificial
  Oligomer
gcgacgucaucuccaacau

SEQ ID NO: 29733 - RNA, 19 nt, artificial
  Oligomer
cuuguucacugcagucuua

SEQ ID NO: 29734 - RNA, 19 nt, artificial
  Oligomer
ucuucuucuucuuccuuaa

SEQ ID NO: 29735 - RNA, 19 nt, artificial
  Oligomer
aguugaacagugugcccua

SEQ ID NO: 29736 - RNA, 19 nt, artificial
  Oligomer
uaaggaggagcugccuuaa

SEQ ID NO: 29737 - RNA, 19 nt, artificial
  Oligomer
aaaaauaaccgaagaaaga

SEQ ID NO: 29738 - RNA, 19 nt, artificial
  Oligomer
ucgagaccuucgaugucaa

SEQ ID NO: 29739 - RNA, 19 nt, artificial
  Oligomer
caauuucuguauaaaagca

SEQ ID NO: 29740 - RNA, 19 nt, artificial
  Oligomer
cuguucugggaauguuuca

SEQ ID NO: 29741 - RNA, 19 nt, artificial
  Oligomer
uugcaauuaugggaguaaa

SEQ ID NO: 29742 - RNA, 19 nt, artificial
  Oligomer
aggcaacucguacccaaau

SEQ ID NO: 29743 - RNA, 19 nt, artificial
  Oligomer
ggcaacucguacccaaauu

SEQ ID NO: 29744 - RNA, 19 nt, artificial
  Oligomer
guuuuagaagucaguagaa

SEQ ID NO: 29745 - RNA, 19 nt, artificial
  Oligomer
uguggauguccaagcagca

SEQ ID NO: 29746 - RNA, 19 nt, artificial
  Oligomer
aagcuaaaggcaacucgua

SEQ ID NO: 29747 - RNA, 19 nt, artificial
  Oligomer
accuuugggcugccuuaua

SEQ ID NO: 29748 - RNA, 19 nt, artificial
  Oligomer
gagagguuuuaauuaaaac

SEQ ID NO: 29749 - RNA, 19 nt, artificial
  Oligomer
cagcuaaacuacucuuagu

SEQ ID NO: 29750 - RNA, 19 nt, artificial
  Oligomer
cagcaguuaaccuucaaga

SEQ ID NO: 29751 - RNA, 19 nt, artificial
  Oligomer
aaacugacuggaaacuuca

SEQ ID NO: 29752 - RNA, 19 nt, artificial
  Oligomer
uuguaaggagagguuuuaa

SEQ ID NO: 29753 - RNA, 19 nt, artificial
  Oligomer
ccaacaucgagaccuucga

SEQ ID NO: 29754 - RNA, 19 nt, artificial
  Oligomer
uacauugcauuaaaaagaa

SEQ ID NO: 29755 - RNA, 19 nt, artificial
  Oligomer
agcccgaucugaagaagga

SEQ ID NO: 29756 - RNA, 19 nt, artificial
  Oligomer
aggaauauucucuauuuua

SEQ ID NO: 29757 - RNA, 19 nt, artificial
  Oligomer
auggucaucuguuguuaaa

SEQ ID NO: 29758 - RNA, 19 nt, artificial
  Oligomer
cugccuguuuggacuuugu

SEQ ID NO: 29759 - RNA, 19 nt, artificial
  Oligomer
accagcaguuaaccuucaa

SEQ ID NO: 29760 - RNA, 19 nt, artificial
  Oligomer
acuacaccgaccaccagaa

SEQ ID NO: 29761 - RNA, 19 nt, artificial
  Oligomer
agaccuuaaucuuaauuac

SEQ ID NO: 29762 - RNA, 19 nt, artificial
  Oligomer
caacgaguuugaccaguac

SEQ ID NO: 29763 - RNA, 19 nt, artificial
  Oligomer
ggcuagagaguuugaggau

SEQ ID NO: 29764 - RNA, 19 nt, artificial
  Oligomer
cagaccuuaaucuuaauua

SEQ ID NO: 29765 - RNA, 19 nt, artificial
  Oligomer
gaagucaguagaauaaaau

SEQ ID NO: 29766 - RNA, 19 nt, artificial
  Oligomer
uaaggagagguuuuaauua

SEQ ID NO: 29767 - RNA, 19 nt, artificial
  Oligomer
agaaaaaaguccucuguga

SEQ ID NO: 29768 - RNA, 19 nt, artificial
  Oligomer
ggaugauggagaaucgugu

SEQ ID NO: 29769 - RNA, 19 nt, artificial
  Oligomer
ucaugaagaugaccgacga

SEQ ID NO: 29770 - RNA, 19 nt, artificial
  Oligomer
gaggaauauucucuauuuu

SEQ ID NO: 29771 - RNA, 19 nt, artificial
  Oligomer
aagcauuugguaagcuuua

SEQ ID NO: 29772 - RNA, 19 nt, artificial
  Oligomer
guaaggagagguuuuaauu

SEQ ID NO: 29773 - RNA, 19 nt, artificial
  Oligomer
gguaagcuuuaucauauau

SEQ ID NO: 29774 - RNA, 19 nt, artificial
  Oligomer
ucuggagacuucugaacga

SEQ ID NO: 29775 - RNA, 19 nt, artificial
  Oligomer
aaacaccuugagccuuaaa

SEQ ID NO: 29776 - RNA, 19 nt, artificial
  Oligomer
cuuaaagcacucauaauau

SEQ ID NO: 29777 - RNA, 19 nt, artificial
  Oligomer
caagcaaaggagaugaaau

SEQ ID NO: 29778 - RNA, 19 nt, artificial
  Oligomer
gcaagcaaaggagaugaaa

SEQ ID NO: 29779 - RNA, 19 nt, artificial
  Oligomer
acguguggauguccaagca

SEQ ID NO: 29780 - RNA, 19 nt, artificial
  Oligomer
agaauaaaaucuuaaagca

SEQ ID NO: 29781 - RNA, 19 nt, artificial
  Oligomer
guuuggacuuuguaauuau

SEQ ID NO: 29782 - RNA, 19 nt, artificial
  Oligomer
caccagcaguuaaccuuca

SEQ ID NO: 29783 - RNA, 19 nt, artificial
  Oligomer
ggagcuuuccucaaagggu

SEQ ID NO: 29784 - RNA, 19 nt, artificial
  Oligomer
ucuucuucuuccuuaaaga

SEQ ID NO: 29785 - RNA, 19 nt, artificial
  Oligomer
gggauuuauacauauuuuu

SEQ ID NO: 29786 - RNA, 19 nt, artificial
  Oligomer
aacaccuugagccuuaaaa

SEQ ID NO: 29787 - RNA, 19 nt, artificial
  Oligomer
cuaaaaauaaccgaagaaa

SEQ ID NO: 29788 - RNA, 19 nt, artificial
  Oligomer
uauuuugucuuuagguaaa

SEQ ID NO: 29789 - RNA, 19 nt, artificial
  Oligomer
acuuguuucuuuuuuugua

SEQ ID NO: 29790 - RNA, 19 nt, artificial
  Oligomer
caguaauuaaagaaaaaag

SEQ ID NO: 29791 - RNA, 19 nt, artificial
  Oligomer
uccuucaauuucuguauaa

SEQ ID NO: 29792 - RNA, 19 nt, artificial
  Oligomer
aagacauuccacuugcuaa

SEQ ID NO: 29793 - RNA, 19 nt, artificial
  Oligomer
caaaggagaugaaaucugu

SEQ ID NO: 29794 - RNA, 19 nt, artificial
  Oligomer
cauuccacuugcuaaaauu

SEQ ID NO: 29795 - RNA, 19 nt, artificial
  Oligomer
acgucaucuccaacaucga

SEQ ID NO: 29796 - RNA, 19 nt, artificial
  Oligomer
ucguguuuuguuuguuuca

SEQ ID NO: 29797 - RNA, 19 nt, artificial
  Oligomer
ucuuaaagcacucauaaua

SEQ ID NO: 29798 - RNA, 19 nt, artificial
  Oligomer
cuagagaagcauuugguaa

SEQ ID NO: 29799 - RNA, 19 nt, artificial
  Oligomer
ggaggaugauggagaaucg

SEQ ID NO: 29800 - RNA, 19 nt, artificial
  Oligomer
gaccuauccaagcgcauua

SEQ ID NO: 29801 - RNA, 19 nt, artificial
  Oligomer
ggucaucuguuguuaaauu

SEQ ID NO: 29802 - RNA, 19 nt, artificial
  Oligomer
ugcccuagcuuuucuugca

SEQ ID NO: 29803 - RNA, 19 nt, artificial
  Oligomer
acauuuaagcuaaaggcaa

SEQ ID NO: 29804 - RNA, 19 nt, artificial
  Oligomer
guaagcuuuaucauauaua

SEQ ID NO: 29805 - RNA, 19 nt, artificial
  Oligomer
acuccaccuucaccuacau

SEQ ID NO: 29806 - RNA, 19 nt, artificial
  Oligomer
caggcuuugcgauuuaagg

SEQ ID NO: 29807 - RNA, 19 nt, artificial
  Oligomer
aaacauuugcacucuuuua

SEQ ID NO: 29808 - RNA, 19 nt, artificial
  Oligomer
ccucacccuagauuuguau

SEQ ID NO: 29809 - RNA, 19 nt, artificial
  Oligomer
gaaacuuguuucuuuuuuu

SEQ ID NO: 29810 - RNA, 19 nt, artificial
  Oligomer
uucacugcagucuuaagaa

SEQ ID NO: 29811 - RNA, 19 nt, artificial
  Oligomer
gauacuucuguaacuuaag

SEQ ID NO: 29812 - RNA, 19 nt, artificial
  Oligomer
gauugcaaauguaguguau

SEQ ID NO: 29813 - RNA, 19 nt, artificial
  Oligomer
gccuuuuuguccaucccuu

SEQ ID NO: 29814 - RNA, 19 nt, artificial
  Oligomer
cuggaaacuuguuucuuuu

SEQ ID NO: 29815 - RNA, 19 nt, artificial
  Oligomer
uguaaggagagguuuuaau

SEQ ID NO: 29816 - RNA, 19 nt, artificial
  Oligomer
ucuuaagaaagagguaaaa

SEQ ID NO: 29817 - RNA, 19 nt, artificial
  Oligomer
uaaacaauagucuagagaa

SEQ ID NO: 29818 - RNA, 19 nt, artificial
  Oligomer
ccauauuucucuacaucuu

SEQ ID NO: 29819 - RNA, 19 nt, artificial
  Oligomer
uagaagucaguagaauaaa

SEQ ID NO: 29820 - RNA, 19 nt, artificial
  Oligomer
uauggucaucuguuguuaa

SEQ ID NO: 29821 - RNA, 19 nt, artificial
  Oligomer
uauuuuuccaacagcuaaa

SEQ ID NO: 29822 - RNA, 19 nt, artificial
  Oligomer
cauccuucaauuucuguau

SEQ ID NO: 29823 - RNA, 19 nt, artificial
  Oligomer
ucacccuagauuuguauaa

SEQ ID NO: 29824 - RNA, 19 nt, artificial
  Oligomer
gcauccuucaauuucugua

SEQ ID NO: 29825 - RNA, 19 nt, artificial
  Oligomer
gggaaacauuugcacucuu

SEQ ID NO: 29826 - RNA, 19 nt, artificial
  Oligomer
agagaggaccaaccagaau

SEQ ID NO: 29827 - RNA, 19 nt, artificial
  Oligomer
cacuugcuaaaauuauuua

SEQ ID NO: 29828 - RNA, 19 nt, artificial
  Oligomer
cucagaacaccagcaguua

SEQ ID NO: 29829 - RNA, 19 nt, artificial
  Oligomer
uggagacuucugaacgaga

SEQ ID NO: 29830 - RNA, 19 nt, artificial
  Oligomer
acagcucacucgaccuuga

SEQ ID NO: 29831 - RNA, 19 nt, artificial
  Oligomer
ccuguuuggacuuuguaau

SEQ ID NO: 29832 - RNA, 19 nt, artificial
  Oligomer
cuuuuguucucuccgugaa

SEQ ID NO: 29833 - RNA, 19 nt, artificial
  Oligomer
caguuaaccuucaagacau

SEQ ID NO: 29834 - RNA, 19 nt, artificial
  Oligomer
aaagcaaguuucuuuguau

SEQ ID NO: 29835 - RNA, 19 nt, artificial
  Oligomer
uccuaaaaauaaccgaaga

SEQ ID NO: 29836 - RNA, 19 nt, artificial
  Oligomer
guugaaaacaaacuggaaa

SEQ ID NO: 29837 - RNA, 19 nt, artificial
  Oligomer
cagaucuuuuuaaaaagau

SEQ ID NO: 29838 - RNA, 19 nt, artificial
  Oligomer
ucaccugugccucucagaa

SEQ ID NO: 29839 - RNA, 19 nt, artificial
  Oligomer
ugccuguuuggacuuugua

SEQ ID NO: 29840 - RNA, 19 nt, artificial
  Oligomer
ccuuuuuguccaucccuuu

SEQ ID NO: 29841 - RNA, 19 nt, artificial
  Oligomer
agaguauuuuuguacagau

SEQ ID NO: 29842 - RNA, 19 nt, artificial
  Oligomer
uaaacuacucuuaguugaa

SEQ ID NO: 29843 - RNA, 19 nt, artificial
  Oligomer
gaaacuuuucuuugcagga

SEQ ID NO: 29844 - RNA, 19 nt, artificial
  Oligomer
ucgugugaucagugugcua

SEQ ID NO: 29845 - RNA, 19 nt, artificial
  Oligomer
gaccuuugggcugccuuau

SEQ ID NO: 29846 - RNA, 19 nt, artificial
  Oligomer
gaccaaccagaauucccuu

SEQ ID NO: 29847 - RNA, 19 nt, artificial
  Oligomer
accugugccucucagaaca

SEQ ID NO: 29848 - RNA, 19 nt, artificial
  Oligomer
uccacuugcuaaaauuauu

SEQ ID NO: 29849 - RNA, 19 nt, artificial
  Oligomer
uuucuuugcaggaggagaa

SEQ ID NO: 29850 - RNA, 19 nt, artificial
  Oligomer
uguccaucccuuuuuucuu

SEQ ID NO: 29851 - RNA, 19 nt, artificial
  Oligomer
gaccuuaaucuuaauuacu

SEQ ID NO: 29852 - RNA, 19 nt, artificial
  Oligomer
cuucuucuucuuccuuaaa

SEQ ID NO: 29853 - RNA, 19 nt, artificial
  Oligomer
gcgaaaucaacgagaaacu

SEQ ID NO: 29854 - RNA, 19 nt, artificial
  Oligomer
ggacuuuuuaaacccucuu

SEQ ID NO: 29855 - RNA, 19 nt, artificial
  Oligomer
cggaaacuuuucuuugcag

SEQ ID NO: 29856 - RNA, 19 nt, artificial
  Oligomer
gaguaaacaauagucuaga

SEQ ID NO: 29857 - RNA, 19 nt, artificial
  Oligomer
uuugguaagcuuuaucaua

SEQ ID NO: 29858 - RNA, 19 nt, artificial
  Oligomer
cgugugaucagugugcuaa

SEQ ID NO: 29859 - RNA, 19 nt, artificial
  Oligomer
aucuuaaagcacucauaau

SEQ ID NO: 29860 - RNA, 19 nt, artificial
  Oligomer
guuggagcuuuccucaaag

SEQ ID NO: 29861 - RNA, 19 nt, artificial
  Oligomer
gagagauugcaaauguagu

SEQ ID NO: 29862 - RNA, 19 nt, artificial
  Oligomer
uuguuuuuguugaaaacaa

SEQ ID NO: 29863 - RNA, 19 nt, artificial
  Oligomer
cucaaaggcuacgacugga

SEQ ID NO: 29864 - RNA, 19 nt, artificial
  Oligomer
caaguuucuuuguauuccu

SEQ ID NO: 29865 - RNA, 19 nt, artificial
  Oligomer
cauuugguaagcuuuauca

SEQ ID NO: 29866 - RNA, 19 nt, artificial
  Oligomer
ugaucagugugcuaaaucu

SEQ ID NO: 29867 - RNA, 19 nt, artificial
  Oligomer
cuuugcgauuuaaggagga

SEQ ID NO: 29868 - RNA, 19 nt, artificial
  Oligomer
gaguauuuuuguacagauu

SEQ ID NO: 29869 - RNA, 19 nt, artificial
  Oligomer
caauaagugcccgagcaca

SEQ ID NO: 29870 - RNA, 19 nt, artificial
  Oligomer
aacuccagcuccuacuaca

SEQ ID NO: 29871 - RNA, 19 nt, artificial
  Oligomer
aaaaguccucugugaggaa

SEQ ID NO: 29872 - RNA, 19 nt, artificial
  Oligomer
uuagcaguaauuaaagaaa

SEQ ID NO: 29873 - RNA, 19 nt, artificial
  Oligomer
gcaauuaugggaguaaaca

SEQ ID NO: 29874 - RNA, 19 nt, artificial
  Oligomer
gaaacuggacuuuuuaaac

SEQ ID NO: 29875 - RNA, 19 nt, artificial
  Oligomer
uugcaggaggagaagagaa

SEQ ID NO: 29876 - RNA, 19 nt, artificial
  Oligomer
cacaguacgacuacaccga

SEQ ID NO: 29877 - RNA, 19 nt, artificial
  Oligomer
gcaacucguacccaaauuu

SEQ ID NO: 29878 - RNA, 19 nt, artificial
  Oligomer
gauucauuaccauuuugag

SEQ ID NO: 29879 - RNA, 19 nt, artificial
  Oligomer
gucuuuagguaaaagcuuu

SEQ ID NO: 29880 - RNA, 19 nt, artificial
  Oligomer
gagaguuugaggauugcuu

SEQ ID NO: 29881 - RNA, 19 nt, artificial
  Oligomer
uuagaagucaguagaauaa

SEQ ID NO: 29882 - RNA, 19 nt, artificial
  Oligomer
ugaaaucuguucugggaau

SEQ ID NO: 29883 - RNA, 19 nt, artificial
  Oligomer
ggagacuucugaacgagag

SEQ ID NO: 29884 - RNA, 19 nt, artificial
  Oligomer
gccuuauuuugcaauuaug

SEQ ID NO: 29885 - RNA, 19 nt, artificial
  Oligomer
aagaaagagguaaaaggca

SEQ ID NO: 29886 - RNA, 19 nt, artificial
  Oligomer
ugaggaauauucucuauuu

SEQ ID NO: 29887 - RNA, 19 nt, artificial
  Oligomer
guuguuaaauuauguucuu

SEQ ID NO: 29888 - RNA, 19 nt, artificial
  Oligomer
guucguguuuuguuuguuu

SEQ ID NO: 29889 - RNA, 19 nt, artificial
  Oligomer
uauaaaugagagauugcaa

SEQ ID NO: 29890 - RNA, 19 nt, artificial
  Oligomer
auacuucuguaacuuaaga

SEQ ID NO: 29891 - RNA, 19 nt, artificial
  Oligomer
ccgaagaaagagaggacca

SEQ ID NO: 29892 - RNA, 19 nt, artificial
  Oligomer
uuuaaagaagagaaaaaca

SEQ ID NO: 29893 - RNA, 19 nt, artificial
  Oligomer
agcuuuccucaaaggguau

SEQ ID NO: 29894 - RNA, 19 nt, artificial
  Oligomer
cuucugaacgagagcgaga

SEQ ID NO: 29895 - RNA, 19 nt, artificial
  Oligomer
aauuauguucuuaacugua

SEQ ID NO: 29896 - RNA, 19 nt, artificial
  Oligomer
ucuagagaagcauuuggua

SEQ ID NO: 29897 - RNA, 19 nt, artificial
  Oligomer
agaaggaccacccggauua

SEQ ID NO: 29898 - RNA, 19 nt, artificial
  Oligomer
cacuuuugcucuuuuuccu

SEQ ID NO: 29899 - RNA, 19 nt, artificial
  Oligomer
auauuuugucuuuagguaa

SEQ ID NO: 29900 - RNA, 19 nt, artificial
  Oligomer
uuaaaaagauacuucugua

SEQ ID NO: 29901 - RNA, 19 nt, artificial
  Oligomer
ugcucuuauuuuuccaaca

SEQ ID NO: 29902 - RNA, 19 nt, artificial
  Oligomer
gaguuugaggauugcuuuu

SEQ ID NO: 29903 - RNA, 19 nt, artificial
  Oligomer
gccuuaaaacggugcugcu

SEQ ID NO: 29904 - RNA, 19 nt, artificial
  Oligomer
ccacuugcuaaaauuauuu

SEQ ID NO: 29905 - RNA, 19 nt, artificial
  Oligomer
agaccuucgaugucaacga

SEQ ID NO: 29906 - RNA, 19 nt, artificial
  Oligomer
ugggaacaacccgucuaca

SEQ ID NO: 29907 - RNA, 19 nt, artificial
  Oligomer
gcauuuaaaucauauuuug

SEQ ID NO: 29908 - RNA, 19 nt, artificial
  Oligomer
auuauguucuuaacuguaa

SEQ ID NO: 29909 - RNA, 19 nt, artificial
  Oligomer
gucaucuguuguuaaauua

SEQ ID NO: 29910 - RNA, 19 nt, artificial
  Oligomer
agaaagagaggaccaacca

SEQ ID NO: 29911 - RNA, 19 nt, artificial
  Oligomer
uauccaagcgcauuaccca

SEQ ID NO: 29912 - RNA, 19 nt, artificial
  Oligomer
aacuuugcuuaauuccuca

SEQ ID NO: 29913 - RNA, 19 nt, artificial
  Oligomer
gcuuguucacugcagucuu

SEQ ID NO: 29914 - RNA, 19 nt, artificial
  Oligomer
cacugacagaccuuaaucu

SEQ ID NO: 29915 - RNA, 19 nt, artificial
  Oligomer
gaagcauuugguaagcuuu

SEQ ID NO: 29916 - RNA, 19 nt, artificial
  Oligomer
aaacaaacuggaaacuugu

SEQ ID NO: 29917 - RNA, 19 nt, artificial
  Oligomer
ugugccucucagaacacca

SEQ ID NO: 29918 - RNA, 19 nt, artificial
  Oligomer
ucaacggcuccagcaagaa

SEQ ID NO: 29919 - RNA, 19 nt, artificial
  Oligomer
ggacuuuguaauuauuuuu

SEQ ID NO: 29920 - RNA, 19 nt, artificial
  Oligomer
acaccuugagccuuaaaac

SEQ ID NO: 29921 - RNA, 19 nt, artificial
  Oligomer
cgaaacugacuggaaacuu

SEQ ID NO: 29922 - RNA, 19 nt, artificial
  Oligomer
guucacugcagucuuaaga

SEQ ID NO: 29923 - RNA, 19 nt, artificial
  Oligomer
gacauuuaagcuaaaggca

SEQ ID NO: 29924 - RNA, 19 nt, artificial
  Oligomer
ucaacgaguuugaccagua

SEQ ID NO: 29925 - RNA, 19 nt, artificial
  Oligomer
caagacauuccacuugcua

SEQ ID NO: 29926 - RNA, 19 nt, artificial
  Oligomer
caaaaacaaugcaagcaug

SEQ ID NO: 29927 - RNA, 19 nt, artificial
  Oligomer
ggguauggucaucuguugu

SEQ ID NO: 29928 - RNA, 19 nt, artificial
  Oligomer
gucaguagaauaaaaucuu

SEQ ID NO: 29929 - RNA, 19 nt, artificial
  Oligomer
aaauguaguguaucacuga

SEQ ID NO: 29930 - RNA, 19 nt, artificial
  Oligomer
agcagaucuuuuuaaaaag

SEQ ID NO: 29931 - RNA, 19 nt, artificial
  Oligomer
cagaguauuuuuguacaga

SEQ ID NO: 29932 - RNA, 19 nt, artificial
  Oligomer
ugucauccauauuucucua

SEQ ID NO: 29933 - RNA, 19 nt, artificial
  Oligomer
ccaugaacgccuucauggu

SEQ ID NO: 29934 - RNA, 19 nt, artificial
  Oligomer
agguaaaaggcaagcaaag

SEQ ID NO: 29935 - RNA, 19 nt, artificial
  Oligomer
ccacccggauuacaaguac

SEQ ID NO: 29936 - RNA, 19 nt, artificial
  Oligomer
aacggcuccagcaagaaca

SEQ ID NO: 29937 - RNA, 19 nt, artificial
  Oligomer
gacauuccacuugcuaaaa

SEQ ID NO: 29938 - RNA, 19 nt, artificial
  Oligomer
acagauuugcuuucucuua

SEQ ID NO: 29939 - RNA, 19 nt, artificial
  Oligomer
guguuuuguuuguuucacu

SEQ ID NO: 29940 - RNA, 19 nt, artificial
  Oligomer
guauggucaucuguuguua

SEQ ID NO: 29941 - RNA, 19 nt, artificial
  Oligomer
cccuuuuuucuuuguuguu

SEQ ID NO: 29942 - RNA, 19 nt, artificial
  Oligomer
aggccuuauuuugcaauua

SEQ ID NO: 29943 - RNA, 19 nt, artificial
  Oligomer
guauaaaagcagaucuuuu

SEQ ID NO: 29944 - RNA, 19 nt, artificial
  Oligomer
gaacagugugcccuagcuu

SEQ ID NO: 29945 - RNA, 19 nt, artificial
  Oligomer
uggacuuuguaauuauuuu

SEQ ID NO: 29946 - RNA, 19 nt, artificial
  Oligomer
agcauuugguaagcuuuau

SEQ ID NO: 29947 - RNA, 19 nt, artificial
  Oligomer
aauuaugggaguaaacaau

SEQ ID NO: 29948 - RNA, 19 nt, artificial
  Oligomer
uuuuguucucuccgugaaa

SEQ ID NO: 29949 - RNA, 19 nt, artificial
  Oligomer
guaguguaucacugaguca

SEQ ID NO: 29950 - RNA, 19 nt, artificial
  Oligomer
auuuugucuuuagguaaaa

SEQ ID NO: 29951 - RNA, 19 nt, artificial
  Oligomer
gaaacugacuggaaacuuc

SEQ ID NO: 29952 - RNA, 19 nt, artificial
  Oligomer
gagaggaccaaccagaauu

SEQ ID NO: 29953 - RNA, 19 nt, artificial
  Oligomer
cuuauuuuuccaacagcua

SEQ ID NO: 29954 - RNA, 19 nt, artificial
  Oligomer
cguacccaaauuuccaaga

SEQ ID NO: 29955 - RNA, 19 nt, artificial
  Oligomer
auaaaugagagauugcaaa

SEQ ID NO: 29956 - RNA, 19 nt, artificial
  Oligomer
uaaaaagauacuucuguaa

SEQ ID NO: 29957 - RNA, 19 nt, artificial
  Oligomer
aaagagaggaccaaccaga

SEQ ID NO: 29958 - RNA, 19 nt, artificial
  Oligomer
agaguuugaggauugcuuu

SEQ ID NO: 29959 - RNA, 19 nt, artificial
  Oligomer
cucgaaacugacuggaaac

SEQ ID NO: 29960 - RNA, 19 nt, artificial
  Oligomer
acccggauuacaaguacca

SEQ ID NO: 29961 - RNA, 19 nt, artificial
  Oligomer
ccuucgaugucaacgaguu

SEQ ID NO: 29962 - RNA, 19 nt, artificial
  Oligomer
ugugaucagugugcuaaau

SEQ ID NO: 29963 - RNA, 19 nt, artificial
  Oligomer
uucugaacgagagcgagaa

SEQ ID NO: 29964 - RNA, 19 nt, artificial
  Oligomer
gccuuaaaaaaaaauaaag

SEQ ID NO: 29965 - RNA, 19 nt, artificial
  Oligomer
cuuguuucuuuuuuuguau

SEQ ID NO: 29966 - RNA, 19 nt, artificial
  Oligomer
caacgagaaacuggacuuu

SEQ ID NO: 29967 - RNA, 19 nt, artificial
  Oligomer
augaaaucuguucugggaa

SEQ ID NO: 29968 - RNA, 19 nt, artificial
  Oligomer
uguauuccucacccuagau

SEQ ID NO: 29969 - RNA, 19 nt, artificial
  Oligomer
cucacccuagauuuguaua

SEQ ID NO: 29970 - RNA, 19 nt, artificial
  Oligomer
gaaacauuugcacucuuuu

SEQ ID NO: 29971 - RNA, 19 nt, artificial
  Oligomer
uugguaagcuuuaucauau

SEQ ID NO: 29972 - RNA, 19 nt, artificial
  Oligomer
aaaagauacuucuguaacu

SEQ ID NO: 29973 - RNA, 19 nt, artificial
  Oligomer
accagaacuccagcuccua

SEQ ID NO: 29974 - RNA, 19 nt, artificial
  Oligomer
gauggagaaucgugugauc

SEQ ID NO: 29975 - RNA, 19 nt, artificial
  Oligomer
gcuuaauuccucaggcuuu

SEQ ID NO: 29976 - RNA, 19 nt, artificial
  Oligomer
acuggaaacuuguuucuuu

SEQ ID NO: 29977 - RNA, 19 nt, artificial
  Oligomer
aaauuauguucuuaacugu

SEQ ID NO: 29978 - RNA, 19 nt, artificial
  Oligomer
uacccaaauuuccaagaca

SEQ ID NO: 29979 - RNA, 19 nt, artificial
  Oligomer
gaggaagucggugaagaac

SEQ ID NO: 29980 - RNA, 19 nt, artificial
  Oligomer
cuaaacuacucuuaguuga

SEQ ID NO: 29981 - RNA, 19 nt, artificial
  Oligomer
uuauuuuuccaacagcuaa

SEQ ID NO: 29982 - RNA, 19 nt, artificial
  Oligomer
gacuucugaacgagagcga

SEQ ID NO: 29983 - RNA, 19 nt, artificial
  Oligomer
ggaaacauuugcacucuuu

SEQ ID NO: 29984 - RNA, 19 nt, artificial
  Oligomer
cuguauaaaagcagaucuu

SEQ ID NO: 29985 - RNA, 19 nt, artificial
  Oligomer
cccgaucugaagaaggaga

SEQ ID NO: 29986 - RNA, 19 nt, artificial
  Oligomer
cccuagauuuguauaaaug

SEQ ID NO: 29987 - RNA, 19 nt, artificial
  Oligomer
ccucugugaggaauauucu

SEQ ID NO: 29988 - RNA, 19 nt, artificial
  Oligomer
cuucgaugucaacgaguuu

SEQ ID NO: 29989 - RNA, 19 nt, artificial
  Oligomer
agaacuccagcuccuacua

SEQ ID NO: 29990 - RNA, 19 nt, artificial
  Oligomer
ccgugaaacuuaccuuucc

SEQ ID NO: 29991 - RNA, 19 nt, artificial
  Oligomer
accagaguauuuuuguaca

SEQ ID NO: 29992 - RNA, 19 nt, artificial
  Oligomer
aguccucugugaggaauau

SEQ ID NO: 29993 - RNA, 19 nt, artificial
  Oligomer
ccaagcgcauuacccacuu

SEQ ID NO: 29994 - RNA, 19 nt, artificial
  Oligomer
caacaucgagaccuucgau

SEQ ID NO: 29995 - RNA, 19 nt, artificial
  Oligomer
aaggguauggucaucuguu

SEQ ID NO: 29996 - RNA, 19 nt, artificial
  Oligomer
aaaggagaugaaaucuguu

SEQ ID NO: 29997 - RNA, 19 nt, artificial
  Oligomer
agcugccuuaaaaaaaaau

SEQ ID NO: 29998 - RNA, 19 nt, artificial
  Oligomer
acaauagucuagagaagca

SEQ ID NO: 29999 - RNA, 19 nt, artificial
  Oligomer
guccaucccuuuuuucuuu

SEQ ID NO: 30000 - RNA, 19 nt, artificial
  Oligomer
aagagaaaaacaccuugag

SEQ ID NO: 30001 - RNA, 19 nt, artificial
  Oligomer
aaaaacaccuugagccuua

SEQ ID NO: 30002 - RNA, 19 nt, artificial
  Oligomer
ugaacagugugcccuagcu

SEQ ID NO: 30003 - RNA, 19 nt, artificial
  Oligomer
cgugaaacuuaccuuuccc

SEQ ID NO: 30004 - RNA, 19 nt, artificial
  Oligomer
aucuguucugggaauguuu

SEQ ID NO: 30005 - RNA, 19 nt, artificial
  Oligomer
agauaaaauuaaaugcucu

SEQ ID NO: 30006 - RNA, 19 nt, artificial
  Oligomer
cauuuaagcuaaaggcaac

SEQ ID NO: 30007 - RNA, 19 nt, artificial
  Oligomer
cacaaacaugaccuaucca

SEQ ID NO: 30008 - RNA, 19 nt, artificial
  Oligomer
ucuucuuccuuaaagacau

SEQ ID NO: 30009 - RNA, 19 nt, artificial
  Oligomer
ugcagcacaagaaggacca

SEQ ID NO: 30010 - RNA, 19 nt, artificial
  Oligomer
aguguaucacugagucauu

SEQ ID NO: 30011 - RNA, 19 nt, artificial
  Oligomer
cgaugucaacgaguuugac

SEQ ID NO: 30012 - RNA, 19 nt, artificial
  Oligomer
guaaaaggcaagcaaagga

SEQ ID NO: 30013 - RNA, 19 nt, artificial
  Oligomer
cucucagaacaccagcagu

SEQ ID NO: 30014 - RNA, 19 nt, artificial
  Oligomer
ugauccuaaaaauaaccga

SEQ ID NO: 30015 - RNA, 19 nt, artificial
  Oligomer
uuguuguuuuuguugaaaa

SEQ ID NO: 30016 - RNA, 19 nt, artificial
  Oligomer
ccuuuuguucucuccguga

SEQ ID NO: 30017 - RNA, 19 nt, artificial
  Oligomer
cuucaaccucccacacuac

SEQ ID NO: 30018 - RNA, 19 nt, artificial
  Oligomer
cagugugcuaaaucucucu

SEQ ID NO: 30019 - RNA, 19 nt, artificial
  Oligomer
gauaaaauuaaaugcucuu

SEQ ID NO: 30020 - RNA, 19 nt, artificial
  Oligomer
uggucaucuguuguuaaau

SEQ ID NO: 30021 - RNA, 19 nt, artificial
  Oligomer
guucucuccgugaaacuua

SEQ ID NO: 30022 - RNA, 19 nt, artificial
  Oligomer
cuuuuuucuuuguuguuuu

SEQ ID NO: 30023 - RNA, 19 nt, artificial
  Oligomer
uaaaagcagaucuuuuuaa

SEQ ID NO: 30024 - RNA, 19 nt, artificial
  Oligomer
uacuucuguaacuuaagaa

SEQ ID NO: 30025 - RNA, 19 nt, artificial
  Oligomer
aacugacuggaaacuucag

SEQ ID NO: 30026 - RNA, 19 nt, artificial
  Oligomer
ggcauuuaaaucauauuuu

SEQ ID NO: 30027 - RNA, 19 nt, artificial
  Oligomer
gagucauuugcaguguuuu

SEQ ID NO: 30028 - RNA, 19 nt, artificial
  Oligomer
gguaaaagcuuugguuugu

SEQ ID NO: 30029 - RNA, 19 nt, artificial
  Oligomer
aaauaaccgaagaaagaga

SEQ ID NO: 30030 - RNA, 19 nt, artificial
  Oligomer
aaaaaauaaaggccuuauu

SEQ ID NO: 30031 - RNA, 19 nt, artificial
  Oligomer
uuuagaagucaguagaaua

SEQ ID NO: 30032 - RNA, 19 nt, artificial
  Oligomer
aucugaagaaggagagcga

SEQ ID NO: 30033 - RNA, 19 nt, artificial
  Oligomer
auccuucaauuucuguaua

SEQ ID NO: 30034 - RNA, 19 nt, artificial
  Oligomer
auuugguaagcuuuaucau

SEQ ID NO: 30035 - RNA, 19 nt, artificial
  Oligomer
ccuuaaagacauuuaagcu

SEQ ID NO: 30036 - RNA, 19 nt, artificial
  Oligomer
uuuuguccaucccuuuuuu

SEQ ID NO: 30037 - RNA, 19 nt, artificial
  Oligomer
gaaagagaggaccaaccag

SEQ ID NO: 30038 - RNA, 19 nt, artificial
  Oligomer
gugugcccuagcuuuucuu

SEQ ID NO: 30039 - RNA, 19 nt, artificial
  Oligomer
caaaggguauggucaucug

SEQ ID NO: 30040 - RNA, 19 nt, artificial
  Oligomer
uccucaaaggguaugguca

SEQ ID NO: 30041 - RNA, 19 nt, artificial
  Oligomer
ggaguaaacaauagucuag

SEQ ID NO: 30042 - RNA, 19 nt, artificial
  Oligomer
uuuuagcaguaauuaaaga

SEQ ID NO: 30043 - RNA, 19 nt, artificial
  Oligomer
caaacaugaccuauccaag

SEQ ID NO: 30044 - RNA, 19 nt, artificial
  Oligomer
uugcaaauguaguguauca

SEQ ID NO: 30045 - RNA, 19 nt, artificial
  Oligomer
cuguuuggacuuuguaauu

SEQ ID NO: 30046 - RNA, 19 nt, artificial
  Oligomer
agaaaaacaccuugagccu

SEQ ID NO: 30047 - RNA, 19 nt, artificial
  Oligomer
ugugaggaauauucucuau

SEQ ID NO: 30048 - RNA, 19 nt, artificial
  Oligomer
acuuuucuuugcaggagga

SEQ ID NO: 30049 - RNA, 19 nt, artificial
  Oligomer
guuguuggagcuuuccuca

SEQ ID NO: 30050 - RNA, 19 nt, artificial
  Oligomer
aaaagcaaguuucuuugua

SEQ ID NO: 30051 - RNA, 19 nt, artificial
  Oligomer
aaaugcucuuauuuuucca

SEQ ID NO: 30052 - RNA, 19 nt, artificial
  Oligomer
uuguuggagcuuuccucaa

SEQ ID NO: 30053 - RNA, 19 nt, artificial
  Oligomer
uggacuuuuuaaacccucu

SEQ ID NO: 30054 - RNA, 19 nt, artificial
  Oligomer
agcccacugacagaccuua

SEQ ID NO: 30055 - RNA, 19 nt, artificial
  Oligomer
cgucaucuccaacaucgag

SEQ ID NO: 30056 - RNA, 19 nt, artificial
  Oligomer
ucaucuguuguuaaauuau

SEQ ID NO: 30057 - RNA, 19 nt, artificial
  Oligomer
gaaagagguaaaaggcaag

SEQ ID NO: 30058 - RNA, 19 nt, artificial
  Oligomer
uaaaggccuuauuuugcaa

SEQ ID NO: 30059 - RNA, 19 nt, artificial
  Oligomer
gcuagagaguuugaggauu

SEQ ID NO: 30060 - RNA, 19 nt, artificial
  Oligomer
aagauacuucuguaacuua

SEQ ID NO: 30061 - RNA, 19 nt, artificial
  Oligomer
agucuuaagaaagagguaa

SEQ ID NO: 30062 - RNA, 19 nt, artificial
  Oligomer
cuucuuccuuaaagacauu

SEQ ID NO: 30063 - RNA, 19 nt, artificial
  Oligomer
caugaagaugaccgacgag

SEQ ID NO: 30064 - RNA, 19 nt, artificial
  Oligomer
ugucuuuagguaaaagcuu

SEQ ID NO: 30065 - RNA, 19 nt, artificial
  Oligomer
guauaaaugagagauugca

SEQ ID NO: 30066 - RNA, 19 nt, artificial
  Oligomer
auaaaagcagaucuuuuua

SEQ ID NO: 30067 - RNA, 19 nt, artificial
  Oligomer
auuccacuugcuaaaauua

SEQ ID NO: 30068 - RNA, 19 nt, artificial
  Oligomer
aagcaaguuucuuuguauu

SEQ ID NO: 30069 - RNA, 19 nt, artificial
  Oligomer
aaaacggugcugcugggaa

SEQ ID NO: 30070 - RNA, 19 nt, artificial
  Oligomer
uauuuauuuuguaaggaga

SEQ ID NO: 30071 - RNA, 19 nt, artificial
  Oligomer
aguuaaccuucaagacauu

SEQ ID NO: 30072 - RNA, 19 nt, artificial
  Oligomer
aacuacucuuaguugaaca

SEQ ID NO: 30073 - RNA, 19 nt, artificial
  Oligomer
aagcucuggagacuucuga

SEQ ID NO: 30074 - RNA, 19 nt, artificial
  Oligomer
cugcugggaaacauuugca

SEQ ID NO: 30075 - RNA, 19 nt, artificial
  Oligomer
ggaaacuuguuucuuuuuu

SEQ ID NO: 30076 - RNA, 19 nt, artificial
  Oligomer
auuaugggaguaaacaaua

SEQ ID NO: 30077 - RNA, 19 nt, artificial
  Oligomer
uucugggaauguuucagca

SEQ ID NO: 30078 - RNA, 19 nt, artificial
  Oligomer
uuaaagacauuuaagcuaa

SEQ ID NO: 30079 - RNA, 19 nt, artificial
  Oligomer
acagugugcccuagcuuuu

SEQ ID NO: 30080 - RNA, 19 nt, artificial
  Oligomer
gcaguuaaccuucaagaca

SEQ ID NO: 30081 - RNA, 19 nt, artificial
  Oligomer
aguuuuagaagucaguaga

SEQ ID NO: 30082 - RNA, 19 nt, artificial
  Oligomer
cugagucauuugcaguguu

SEQ ID NO: 30083 - RNA, 19 nt, artificial
  Oligomer
gcuaaaucucucugccugu

SEQ ID NO: 30084 - RNA, 19 nt, artificial
  Oligomer
cagaacaccagcaguuaac

SEQ ID NO: 30085 - RNA, 19 nt, artificial
  Oligomer
acuccagcuccuacuacag

SEQ ID NO: 30086 - RNA, 19 nt, artificial
  Oligomer
gcguaugaaucuccuggac

SEQ ID NO: 30087 - RNA, 19 nt, artificial
  Oligomer
caauagucuagagaagcau

SEQ ID NO: 30088 - RNA, 19 nt, artificial
  Oligomer
aucuguuguuaaauuaugu

SEQ ID NO: 30089 - RNA, 19 nt, artificial
  Oligomer
ucuccaacaucgagaccuu

SEQ ID NO: 30090 - RNA, 19 nt, artificial
  Oligomer
cccggauuacaaguaccag

SEQ ID NO: 30091 - RNA, 19 nt, artificial
  Oligomer
gugcugcugggaaacauuu

SEQ ID NO: 30092 - RNA, 19 nt, artificial
  Oligomer
acaaacaugaccuauccaa

SEQ ID NO: 30093 - RNA, 19 nt, artificial
  Oligomer
uucuucaccgacuuccucc

SEQ ID NO: 30094 - RNA, 19 nt, artificial
  Oligomer
uuuuuaaggcagcuccucc

SEQ ID NO: 30095 - RNA, 19 nt, artificial
  Oligomer
uuuuuuuuaaggcagcucc

SEQ ID NO: 30096 - RNA, 19 nt, artificial
  Oligomer
uucuccaucauccuccacg

SEQ ID NO: 30097 - RNA, 19 nt, artificial
  Oligomer
uaaaaaguccaguuucucg

SEQ ID NO: 30098 - RNA, 19 nt, artificial
  Oligomer
uuuuaauuaaaaccucucc

SEQ ID NO: 30099 - RNA, 19 nt, artificial
  Oligomer
uuuccagucaguuucgagc

SEQ ID NO: 30100 - RNA, 19 nt, artificial
  Oligomer
auuuuuaggaucaucucgg

SEQ ID NO: 30101 - RNA, 19 nt, artificial
  Oligomer
uuuaauuaaaaccucuccu

SEQ ID NO: 30102 - RNA, 19 nt, artificial
  Oligomer
uuuuaggaucaucucggcc

SEQ ID NO: 30103 - RNA, 19 nt, artificial
  Oligomer
uuuuaaggcagcuccuccu

SEQ ID NO: 30104 - RNA, 19 nt, artificial
  Oligomer
uauuuuuaggaucaucucg

SEQ ID NO: 30105 - RNA, 19 nt, artificial
  Oligomer
uuaaaaaguccaguuucuc

SEQ ID NO: 30106 - RNA, 19 nt, artificial
  Oligomer
uuaaaauagagaauauucc

SEQ ID NO: 30107 - RNA, 19 nt, artificial
  Oligomer
uuuuucuuuaauuacugcu

SEQ ID NO: 30108 - RNA, 19 nt, artificial
  Oligomer
uuuagcacacugaucacac

SEQ ID NO: 30109 - RNA, 19 nt, artificial
  Oligomer
uuuuauucuacugacuucu

SEQ ID NO: 30110 - RNA, 19 nt, artificial
  Oligomer
uucauguaggugaaggugg

SEQ ID NO: 30111 - RNA, 19 nt, artificial
  Oligomer
uuuuuuuuuaaggcagcuc

SEQ ID NO: 30112 - RNA, 19 nt, artificial
  Oligomer
uuucucguugauuucgcug

SEQ ID NO: 30113 - RNA, 19 nt, artificial
  Oligomer
ucuugaugugcguucgcug

SEQ ID NO: 30114 - RNA, 19 nt, artificial
  Oligomer
uuguuuacucccauaauug

SEQ ID NO: 30115 - RNA, 19 nt, artificial
  Oligomer
uagacuauuguuuacuccc

SEQ ID NO: 30116 - RNA, 19 nt, artificial
  Oligomer
uuugcuugccuuuuaccuc

SEQ ID NO: 30117 - RNA, 19 nt, artificial
  Oligomer
uuuuauacagaaauugaag

SEQ ID NO: 30118 - RNA, 19 nt, artificial
  Oligomer
uuuauacaaaucuagggug

SEQ ID NO: 30119 - RNA, 19 nt, artificial
  Oligomer
uagugugggagguugaagg

SEQ ID NO: 30120 - RNA, 19 nt, artificial
  Oligomer
uuauuuuuuuuuaaggcag

SEQ ID NO: 30121 - RNA, 19 nt, artificial
  Oligomer
uuuauacagaaauugaagg

SEQ ID NO: 30122 - RNA, 19 nt, artificial
  Oligomer
uuuuuuaaggcagcuccuc

SEQ ID NO: 30123 - RNA, 19 nt, artificial
  Oligomer
uuaaaugucuuuaaggaag

SEQ ID NO: 30124 - RNA, 19 nt, artificial
  Oligomer
uauaugauaaagcuuacca

SEQ ID NO: 30125 - RNA, 19 nt, artificial
  Oligomer
uuuggguacgaguugccuu

SEQ ID NO: 30126 - RNA, 19 nt, artificial
  Oligomer
uuacaaaguccaaacaggc

SEQ ID NO: 30127 - RNA, 19 nt, artificial
  Oligomer
uuaaggucugucagugggc

SEQ ID NO: 30128 - RNA, 19 nt, artificial
  Oligomer
uuaauuaaaaccucuccuu

SEQ ID NO: 30129 - RNA, 19 nt, artificial
  Oligomer
auuaagauuaaggucuguc

SEQ ID NO: 30130 - RNA, 19 nt, artificial
  Oligomer
uucucguugauuucgcugc

SEQ ID NO: 30131 - RNA, 19 nt, artificial
  Oligomer
uugauuucgcugcuccauu

SEQ ID NO: 30132 - RNA, 19 nt, artificial
  Oligomer
uuuguuuucaacaaaaaca

SEQ ID NO: 30133 - RNA, 19 nt, artificial
  Oligomer
uacccuuugaggaaagcuc

SEQ ID NO: 30134 - RNA, 19 nt, artificial
  Oligomer
uuguuuuaauuaaaaccuc

SEQ ID NO: 30135 - RNA, 19 nt, artificial
  Oligomer
uuguucuugcuggagccgu

SEQ ID NO: 30136 - RNA, 19 nt, artificial
  Oligomer
uugguccucucuuucuucg

SEQ ID NO: 30137 - RNA, 19 nt, artificial
  Oligomer
uuaagauuaaggucuguca

SEQ ID NO: 30138 - RNA, 19 nt, artificial
  Oligomer
uugacgugcggcuuguucu

SEQ ID NO: 30139 - RNA, 19 nt, artificial
  Oligomer
uuauuuuuaggaucaucuc

SEQ ID NO: 30140 - RNA, 19 nt, artificial
  Oligomer
uucugguugguccucucuu

SEQ ID NO: 30141 - RNA, 19 nt, artificial
  Oligomer
uuaagauuuuauucuacug

SEQ ID NO: 30142 - RNA, 19 nt, artificial
  Oligomer
uuuucuuuaauuacugcua

SEQ ID NO: 30143 - RNA, 19 nt, artificial
  Oligomer
uucagaagucuccagagcu

SEQ ID NO: 30144 - RNA, 19 nt, artificial
  Oligomer
uuuaaagaagguaaaauug

SEQ ID NO: 30145 - RNA, 19 nt, artificial
  Oligomer
uuuaaaaaguccaguuucu

SEQ ID NO: 30146 - RNA, 19 nt, artificial
  Oligomer
ucccagaacagauuucauc

SEQ ID NO: 30147 - RNA, 19 nt, artificial
  Oligomer
uuaaagaagguaaaauugg

SEQ ID NO: 30148 - RNA, 19 nt, artificial
  Oligomer
uuaaauguuaauacaacag

SEQ ID NO: 30149 - RNA, 19 nt, artificial
  Oligomer
uuggguacgaguugccuuu

SEQ ID NO: 30150 - RNA, 19 nt, artificial
  Oligomer
uuuuuucuuuaauuacugc

SEQ ID NO: 30151 - RNA, 19 nt, artificial
  Oligomer
ucaguuucgagcuccgcuu

SEQ ID NO: 30152 - RNA, 19 nt, artificial
  Oligomer
uaccucuuucuuaagacug

SEQ ID NO: 30153 - RNA, 19 nt, artificial
  Oligomer
uuuuuuuaaggcagcuccu

SEQ ID NO: 30154 - RNA, 19 nt, artificial
  Oligomer
uuaugagugcuuuaagauu

SEQ ID NO: 30155 - RNA, 19 nt, artificial
  Oligomer
uccaucauccuccacgcuu

SEQ ID NO: 30156 - RNA, 19 nt, artificial
  Oligomer
uuaaguuacagaaguaucu

SEQ ID NO: 30157 - RNA, 19 nt, artificial
  Oligomer
uuguaauccgggugguccu

SEQ ID NO: 30158 - RNA, 19 nt, artificial
  Oligomer
uuucccagcagcaccguuu

SEQ ID NO: 30159 - RNA, 19 nt, artificial
  Oligomer
uuuaaggcagcuccuccuu

SEQ ID NO: 30160 - RNA, 19 nt, artificial
  Oligomer
uucaacaaaaacaacaaag

SEQ ID NO: 30161 - RNA, 19 nt, artificial
  Oligomer
auauaaggcagcccaaagg

SEQ ID NO: 30162 - RNA, 19 nt, artificial
  Oligomer
aaaaaguccaguuucucgu

SEQ ID NO: 30163 - RNA, 19 nt, artificial
  Oligomer
ugcaaagaaaaguuuccgg

SEQ ID NO: 30164 - RNA, 19 nt, artificial
  Oligomer
uugcaagaaaagcuagggc

SEQ ID NO: 30165 - RNA, 19 nt, artificial
  Oligomer
uuuaaaaagaucugcuuuu

SEQ ID NO: 30166 - RNA, 19 nt, artificial
  Oligomer
uuuuuaggaucaucucggc

SEQ ID NO: 30167 - RNA, 19 nt, artificial
  Oligomer
uugcuugccuuuuaccucu

SEQ ID NO: 30168 - RNA, 19 nt, artificial
  Oligomer
uacaaaucuagggugagga

SEQ ID NO: 30169 - RNA, 19 nt, artificial
  Oligomer
uuccagucaguuucgagcu

SEQ ID NO: 30170 - RNA, 19 nt, artificial
  Oligomer
uaugagugcuuuaagauuu

SEQ ID NO: 30171 - RNA, 19 nt, artificial
  Oligomer
uuuuaaaaagaucugcuuu

SEQ ID NO: 30172 - RNA, 19 nt, artificial
  Oligomer
uuuagcaaguggaaugucu

SEQ ID NO: 30173 - RNA, 19 nt, artificial
  Oligomer
uccgucuugaugugcguuc

SEQ ID NO: 30174 - RNA, 19 nt, artificial
  Oligomer
auuaaggucugucaguggg

SEQ ID NO: 30175 - RNA, 19 nt, artificial
  Oligomer
uuucgcugcuccauuuagc

SEQ ID NO: 30176 - RNA, 19 nt, artificial
  Oligomer
uucgguuauuuuuaggauc

SEQ ID NO: 30177 - RNA, 19 nt, artificial
  Oligomer
uaaggcagcccaaaggucu

SEQ ID NO: 30178 - RNA, 19 nt, artificial
  Oligomer
ucuagggugaggaauacaa

SEQ ID NO: 30179 - RNA, 19 nt, artificial
  Oligomer
uucaucuccuuugcuugcc

SEQ ID NO: 30180 - RNA, 19 nt, artificial
  Oligomer
uuugaggaaagcuccaaca

SEQ ID NO: 30181 - RNA, 19 nt, artificial
  Oligomer
accguuuuaaggcucaagg

SEQ ID NO: 30182 - RNA, 19 nt, artificial
  Oligomer
uuuagcuuaaaugucuuua

SEQ ID NO: 30183 - RNA, 19 nt, artificial
  Oligomer
uacaaaaauacucugguug

SEQ ID NO: 30184 - RNA, 19 nt, artificial
  Oligomer
guuauuuuuaggaucaucu

SEQ ID NO: 30185 - RNA, 19 nt, artificial
  Oligomer
uucuucgguuauuuuuagg

SEQ ID NO: 30186 - RNA, 19 nt, artificial
  Oligomer
ucguugauuucgcugcucc

SEQ ID NO: 30187 - RNA, 19 nt, artificial
  Oligomer
auaauugcaaaauaaggcc

SEQ ID NO: 30188 - RNA, 19 nt, artificial
  Oligomer
uccaggagauucauacgcg

SEQ ID NO: 30189 - RNA, 19 nt, artificial
  Oligomer
uugccuuuuaccucuuucu

SEQ ID NO: 30190 - RNA, 19 nt, artificial
  Oligomer
uaaauguuaauacaacagg

SEQ ID NO: 30191 - RNA, 19 nt, artificial
  Oligomer
ucuuuuuaaaaagaucugc

SEQ ID NO: 30192 - RNA, 19 nt, artificial
  Oligomer
uuaaggcucaagguguuuu

SEQ ID NO: 30193 - RNA, 19 nt, artificial
  Oligomer
uguagucguacugugagcg

SEQ ID NO: 30194 - RNA, 19 nt, artificial
  Oligomer
uucgcugcuccauuuagcc

SEQ ID NO: 30195 - RNA, 19 nt, artificial
  Oligomer
augaccauacccuuugagg

SEQ ID NO: 30196 - RNA, 19 nt, artificial
  Oligomer
uuaacugcugguguucuga

SEQ ID NO: 30197 - RNA, 19 nt, artificial
  Oligomer
aauuaagcaaaguuaaccc

SEQ ID NO: 30198 - RNA, 19 nt, artificial
  Oligomer
auguagagaaauauggaug

SEQ ID NO: 30199 - RNA, 19 nt, artificial
  Oligomer
uuccaguuuguuuucaaca

SEQ ID NO: 30200 - RNA, 19 nt, artificial
  Oligomer
ucaagguguuuuucucuuc

SEQ ID NO: 30201 - RNA, 19 nt, artificial
  Oligomer
uguuuuaauuaaaaccucu

SEQ ID NO: 30202 - RNA, 19 nt, artificial
  Oligomer
auuuauacaaaucuagggu

SEQ ID NO: 30203 - RNA, 19 nt, artificial
  Oligomer
uaagauuuuauucuacuga

SEQ ID NO: 30204 - RNA, 19 nt, artificial
  Oligomer
ugcucgucggucaucuuca

SEQ ID NO: 30205 - RNA, 19 nt, artificial
  Oligomer
uuuaccucuuucuuaagac

SEQ ID NO: 30206 - RNA, 19 nt, artificial
  Oligomer
acugaucacacgauucucc

SEQ ID NO: 30207 - RNA, 19 nt, artificial
  Oligomer
uccaguuucucguugauuu

SEQ ID NO: 30208 - RNA, 19 nt, artificial
  Oligomer
ucugguugcaagaaaagcu

SEQ ID NO: 30209 - RNA, 19 nt, artificial
  Oligomer
uagggugaggaauacaaag

SEQ ID NO: 30210 - RNA, 19 nt, artificial
  Oligomer
ucggucaucuucaugaagg

SEQ ID NO: 30211 - RNA, 19 nt, artificial
  Oligomer
uacauuugcaaucucucau

SEQ ID NO: 30212 - RNA, 19 nt, artificial
  Oligomer
uuucuuaagacugcaguga

SEQ ID NO: 30213 - RNA, 19 nt, artificial
  Oligomer
uuuuuaaaaagaucugcuu

SEQ ID NO: 30214 - RNA, 19 nt, artificial
  Oligomer
uaaaucgcaaagccugagg

SEQ ID NO: 30215 - RNA, 19 nt, artificial
  Oligomer
augguaaugaaucauacac

SEQ ID NO: 30216 - RNA, 19 nt, artificial
  Oligomer
uuaaaucgcaaagccugag

SEQ ID NO: 30217 - RNA, 19 nt, artificial
  Oligomer
uauuuuuuuuuaaggcagc

SEQ ID NO: 30218 - RNA, 19 nt, artificial
  Oligomer
augcaauguauauuuauug

SEQ ID NO: 30219 - RNA, 19 nt, artificial
  Oligomer
uuggaaauuuggguacgag

SEQ ID NO: 30220 - RNA, 19 nt, artificial
  Oligomer
uuucuuaaguuacagaagu

SEQ ID NO: 30221 - RNA, 19 nt, artificial
  Oligomer
uccuuaaaucgcaaagccu

SEQ ID NO: 30222 - RNA, 19 nt, artificial
  Oligomer
agggaauucugguuggucc

SEQ ID NO: 30223 - RNA, 19 nt, artificial
  Oligomer
uuucuuuuuaaugcaaugu

SEQ ID NO: 30224 - RNA, 19 nt, artificial
  Oligomer
uagagaauauuccucacag

SEQ ID NO: 30225 - RNA, 19 nt, artificial
  Oligomer
ucuuucuuaagacugcagu

SEQ ID NO: 30226 - RNA, 19 nt, artificial
  Oligomer
uaccuaaagacaaaauaug

SEQ ID NO: 30227 - RNA, 19 nt, artificial
  Oligomer
uaagauuaaggucugucag

SEQ ID NO: 30228 - RNA, 19 nt, artificial
  Oligomer
aauguuucccagcagcacc

SEQ ID NO: 30229 - RNA, 19 nt, artificial
  Oligomer
uggaaauuuggguacgagu

SEQ ID NO: 30230 - RNA, 19 nt, artificial
  Oligomer
auguuggagaugacgucgc

SEQ ID NO: 30231 - RNA, 19 nt, artificial
  Oligomer
uaagacugcagugaacaag

SEQ ID NO: 30232 - RNA, 19 nt, artificial
  Oligomer
uuaaggaagaagaagaaga

SEQ ID NO: 30233 - RNA, 19 nt, artificial
  Oligomer
uagggcacacuguucaacu

SEQ ID NO: 30234 - RNA, 19 nt, artificial
  Oligomer
uuaaggcagcuccuccuua

SEQ ID NO: 30235 - RNA, 19 nt, artificial
  Oligomer
ucuuucuucgguuauuuuu

SEQ ID NO: 30236 - RNA, 19 nt, artificial
  Oligomer
uugacaucgaaggucucga

SEQ ID NO: 30237 - RNA, 19 nt, artificial
  Oligomer
ugcuuuuauacagaaauug

SEQ ID NO: 30238 - RNA, 19 nt, artificial
  Oligomer
ugaaacauucccagaacag

SEQ ID NO: 30239 - RNA, 19 nt, artificial
  Oligomer
uuuacucccauaauugcaa

SEQ ID NO: 30240 - RNA, 19 nt, artificial
  Oligomer
auuuggguacgaguugccu

SEQ ID NO: 30241 - RNA, 19 nt, artificial
  Oligomer
aauuuggguacgaguugcc

SEQ ID NO: 30242 - RNA, 19 nt, artificial
  Oligomer
uucuacugacuucuaaaac

SEQ ID NO: 30243 - RNA, 19 nt, artificial
  Oligomer
ugcugcuuggacauccaca

SEQ ID NO: 30244 - RNA, 19 nt, artificial
  Oligomer
uacgaguugccuuuagcuu

SEQ ID NO: 30245 - RNA, 19 nt, artificial
  Oligomer
uauaaggcagcccaaaggu

SEQ ID NO: 30246 - RNA, 19 nt, artificial
  Oligomer
guuuuaauuaaaaccucuc

SEQ ID NO: 30247 - RNA, 19 nt, artificial
  Oligomer
acuaagaguaguuuagcug

SEQ ID NO: 30248 - RNA, 19 nt, artificial
  Oligomer
ucuugaagguuaacugcug

SEQ ID NO: 30249 - RNA, 19 nt, artificial
  Oligomer
ugaaguuuccagucaguuu

SEQ ID NO: 30250 - RNA, 19 nt, artificial
  Oligomer
uuaaaaccucuccuuacaa

SEQ ID NO: 30251 - RNA, 19 nt, artificial
  Oligomer
ucgaaggucucgauguugg

SEQ ID NO: 30252 - RNA, 19 nt, artificial
  Oligomer
uucuuuuuaaugcaaugua

SEQ ID NO: 30253 - RNA, 19 nt, artificial
  Oligomer
uccuucuucagaucgggcu

SEQ ID NO: 30254 - RNA, 19 nt, artificial
  Oligomer
uaaaauagagaauauuccu

SEQ ID NO: 30255 - RNA, 19 nt, artificial
  Oligomer
uuuaacaacagaugaccau

SEQ ID NO: 30256 - RNA, 19 nt, artificial
  Oligomer
acaaaguccaaacaggcag

SEQ ID NO: 30257 - RNA, 19 nt, artificial
  Oligomer
uugaagguuaacugcuggu

SEQ ID NO: 30258 - RNA, 19 nt, artificial
  Oligomer
uucugguggucgguguagu

SEQ ID NO: 30259 - RNA, 19 nt, artificial
  Oligomer
guaauuaagauuaaggucu

SEQ ID NO: 30260 - RNA, 19 nt, artificial
  Oligomer
guacuggucaaacucguug

SEQ ID NO: 30261 - RNA, 19 nt, artificial
  Oligomer
auccucaaacucucuagcc

SEQ ID NO: 30262 - RNA, 19 nt, artificial
  Oligomer
uaauuaagauuaaggucug

SEQ ID NO: 30263 - RNA, 19 nt, artificial
  Oligomer
auuuuauucuacugacuuc

SEQ ID NO: 30264 - RNA, 19 nt, artificial
  Oligomer
uaauuaaaaccucuccuua

SEQ ID NO: 30265 - RNA, 19 nt, artificial
  Oligomer
ucacagaggacuuuuuucu

SEQ ID NO: 30266 - RNA, 19 nt, artificial
  Oligomer
acacgauucuccaucaucc

SEQ ID NO: 30267 - RNA, 19 nt, artificial
  Oligomer
ucgucggucaucuucauga

SEQ ID NO: 30268 - RNA, 19 nt, artificial
  Oligomer
aaaauagagaauauuccuc

SEQ ID NO: 30269 - RNA, 19 nt, artificial
  Oligomer
uaaagcuuaccaaaugcuu

SEQ ID NO: 30270 - RNA, 19 nt, artificial
  Oligomer
aauuaaaaccucuccuuac

SEQ ID NO: 30271 - RNA, 19 nt, artificial
  Oligomer
auauaugauaaagcuuacc

SEQ ID NO: 30272 - RNA, 19 nt, artificial
  Oligomer
ucguucagaagucuccaga

SEQ ID NO: 30273 - RNA, 19 nt, artificial
  Oligomer
uuuaaggcucaagguguuu

SEQ ID NO: 30274 - RNA, 19 nt, artificial
  Oligomer
auauuaugagugcuuuaag

SEQ ID NO: 30275 - RNA, 19 nt, artificial
  Oligomer
auuucaucuccuuugcuug

SEQ ID NO: 30276 - RNA, 19 nt, artificial
  Oligomer
uuucaucuccuuugcuugc

SEQ ID NO: 30277 - RNA, 19 nt, artificial
  Oligomer
ugcuuggacauccacacgu

SEQ ID NO: 30278 - RNA, 19 nt, artificial
  Oligomer
ugcuuuaagauuuuauucu

SEQ ID NO: 30279 - RNA, 19 nt, artificial
  Oligomer
auaauuacaaaguccaaac

SEQ ID NO: 30280 - RNA, 19 nt, artificial
  Oligomer
ugaagguuaacugcuggug

SEQ ID NO: 30281 - RNA, 19 nt, artificial
  Oligomer
acccuuugaggaaagcucc

SEQ ID NO: 30282 - RNA, 19 nt, artificial
  Oligomer
ucuuuaaggaagaagaaga

SEQ ID NO: 30283 - RNA, 19 nt, artificial
  Oligomer
aaaaauauguauaaauccc

SEQ ID NO: 30284 - RNA, 19 nt, artificial
  Oligomer
uuuuaaggcucaagguguu

SEQ ID NO: 30285 - RNA, 19 nt, artificial
  Oligomer
uuucuucgguuauuuuuag

SEQ ID NO: 30286 - RNA, 19 nt, artificial
  Oligomer
uuuaccuaaagacaaaaua

SEQ ID NO: 30287 - RNA, 19 nt, artificial
  Oligomer
uacaaaaaaagaaacaagu

SEQ ID NO: 30288 - RNA, 19 nt, artificial
  Oligomer
cuuuuuucuuuaauuacug

SEQ ID NO: 30289 - RNA, 19 nt, artificial
  Oligomer
uuauacagaaauugaagga

SEQ ID NO: 30290 - RNA, 19 nt, artificial
  Oligomer
uuagcaaguggaaugucuu

SEQ ID NO: 30291 - RNA, 19 nt, artificial
  Oligomer
acagauuucaucuccuuug

SEQ ID NO: 30292 - RNA, 19 nt, artificial
  Oligomer
aauuuuagcaaguggaaug

SEQ ID NO: 30293 - RNA, 19 nt, artificial
  Oligomer
ucgauguuggagaugacgu

SEQ ID NO: 30294 - RNA, 19 nt, artificial
  Oligomer
ugaaacaaacaaaacacga

SEQ ID NO: 30295 - RNA, 19 nt, artificial
  Oligomer
uauuaugagugcuuuaaga

SEQ ID NO: 30296 - RNA, 19 nt, artificial
  Oligomer
uuaccaaaugcuucucuag

SEQ ID NO: 30297 - RNA, 19 nt, artificial
  Oligomer
cgauucuccaucauccucc

SEQ ID NO: 30298 - RNA, 19 nt, artificial
  Oligomer
uaaugcgcuuggauagguc

SEQ ID NO: 30299 - RNA, 19 nt, artificial
  Oligomer
aauuuaacaacagaugacc

SEQ ID NO: 30300 - RNA, 19 nt, artificial
  Oligomer
ugcaagaaaagcuagggca

SEQ ID NO: 30301 - RNA, 19 nt, artificial
  Oligomer
uugccuuuagcuuaaaugu

SEQ ID NO: 30302 - RNA, 19 nt, artificial
  Oligomer
uauauaugauaaagcuuac

SEQ ID NO: 30303 - RNA, 19 nt, artificial
  Oligomer
auguaggugaagguggagu

SEQ ID NO: 30304 - RNA, 19 nt, artificial
  Oligomer
ccuuaaaucgcaaagccug

SEQ ID NO: 30305 - RNA, 19 nt, artificial
  Oligomer
uaaaagagugcaaauguuu

SEQ ID NO: 30306 - RNA, 19 nt, artificial
  Oligomer
auacaaaucuagggugagg

SEQ ID NO: 30307 - RNA, 19 nt, artificial
  Oligomer
aaaaaaagaaacaaguuuc

SEQ ID NO: 30308 - RNA, 19 nt, artificial
  Oligomer
uucuuaagacugcagugaa

SEQ ID NO: 30309 - RNA, 19 nt, artificial
  Oligomer
cuuaaguuacagaaguauc

SEQ ID NO: 30310 - RNA, 19 nt, artificial
  Oligomer
auacacuacauuugcaauc

SEQ ID NO: 30311 - RNA, 19 nt, artificial
  Oligomer
aagggauggacaaaaaggc

SEQ ID NO: 30312 - RNA, 19 nt, artificial
  Oligomer
aaaagaaacaaguuuccag

SEQ ID NO: 30313 - RNA, 19 nt, artificial
  Oligomer
auuaaaaccucuccuuaca

SEQ ID NO: 30314 - RNA, 19 nt, artificial
  Oligomer
uuuuaccucuuucuuaaga

SEQ ID NO: 30315 - RNA, 19 nt, artificial
  Oligomer
uucucuagacuauuguuua

SEQ ID NO: 30316 - RNA, 19 nt, artificial
  Oligomer
aagauguagagaaauaugg

SEQ ID NO: 30317 - RNA, 19 nt, artificial
  Oligomer
uuuauucuacugacuucua

SEQ ID NO: 30318 - RNA, 19 nt, artificial
  Oligomer
uuaacaacagaugaccaua

SEQ ID NO: 30319 - RNA, 19 nt, artificial
  Oligomer
uuuagcuguuggaaaaaua

SEQ ID NO: 30320 - RNA, 19 nt, artificial
  Oligomer
auacagaaauugaaggaug

SEQ ID NO: 30321 - RNA, 19 nt, artificial
  Oligomer
uuauacaaaucuaggguga

SEQ ID NO: 30322 - RNA, 19 nt, artificial
  Oligomer
uacagaaauugaaggaugc

SEQ ID NO: 30323 - RNA, 19 nt, artificial
  Oligomer
aagagugcaaauguuuccc

SEQ ID NO: 30324 - RNA, 19 nt, artificial
  Oligomer
auucugguugguccucucu

SEQ ID NO: 30325 - RNA, 19 nt, artificial
  Oligomer
uaaauaauuuuagcaagug

SEQ ID NO: 30326 - RNA, 19 nt, artificial
  Oligomer
uaacugcugguguucugag

SEQ ID NO: 30327 - RNA, 19 nt, artificial
  Oligomer
ucucguucagaagucucca

SEQ ID NO: 30328 - RNA, 19 nt, artificial
  Oligomer
ucaaggucgagugagcugu

SEQ ID NO: 30329 - RNA, 19 nt, artificial
  Oligomer
auuacaaaguccaaacagg

SEQ ID NO: 30330 - RNA, 19 nt, artificial
  Oligomer
uucacggagagaacaaaag

SEQ ID NO: 30331 - RNA, 19 nt, artificial
  Oligomer
augucuugaagguuaacug

SEQ ID NO: 30332 - RNA, 19 nt, artificial
  Oligomer
auacaaagaaacuugcuuu

SEQ ID NO: 30333 - RNA, 19 nt, artificial
  Oligomer
ucuucgguuauuuuuagga

SEQ ID NO: 30334 - RNA, 19 nt, artificial
  Oligomer
uuuccaguuuguuuucaac

SEQ ID NO: 30335 - RNA, 19 nt, artificial
  Oligomer
aucuuuuuaaaaagaucug

SEQ ID NO: 30336 - RNA, 19 nt, artificial
  Oligomer
uucugagaggcacagguga

SEQ ID NO: 30337 - RNA, 19 nt, artificial
  Oligomer
uacaaaguccaaacaggca

SEQ ID NO: 30338 - RNA, 19 nt, artificial
  Oligomer
aaagggauggacaaaaagg

SEQ ID NO: 30339 - RNA, 19 nt, artificial
  Oligomer
aucuguacaaaaauacucu

SEQ ID NO: 30340 - RNA, 19 nt, artificial
  Oligomer
uucaacuaagaguaguuua

SEQ ID NO: 30341 - RNA, 19 nt, artificial
  Oligomer
uccugcaaagaaaaguuuc

SEQ ID NO: 30342 - RNA, 19 nt, artificial
  Oligomer
uagcacacugaucacacga

SEQ ID NO: 30343 - RNA, 19 nt, artificial
  Oligomer
auaaggcagcccaaagguc

SEQ ID NO: 30344 - RNA, 19 nt, artificial
  Oligomer
aagggaauucugguugguc

SEQ ID NO: 30345 - RNA, 19 nt, artificial
  Oligomer
uguucugagaggcacaggu

SEQ ID NO: 30346 - RNA, 19 nt, artificial
  Oligomer
aauaauuuuagcaagugga

SEQ ID NO: 30347 - RNA, 19 nt, artificial
  Oligomer
uucuccuccugcaaagaaa

SEQ ID NO: 30348 - RNA, 19 nt, artificial
  Oligomer
aagaaaaaagggauggaca

SEQ ID NO: 30349 - RNA, 19 nt, artificial
  Oligomer
aguaauuaagauuaagguc

SEQ ID NO: 30350 - RNA, 19 nt, artificial
  Oligomer
uuuaaggaagaagaagaag

SEQ ID NO: 30351 - RNA, 19 nt, artificial
  Oligomer
aguuucucguugauuucgc

SEQ ID NO: 30352 - RNA, 19 nt, artificial
  Oligomer
aagaggguuuaaaaagucc

SEQ ID NO: 30353 - RNA, 19 nt, artificial
  Oligomer
cugcaaagaaaaguuuccg

SEQ ID NO: 30354 - RNA, 19 nt, artificial
  Oligomer
ucuagacuauuguuuacuc

SEQ ID NO: 30355 - RNA, 19 nt, artificial
  Oligomer
uaugauaaagcuuaccaaa

SEQ ID NO: 30356 - RNA, 19 nt, artificial
  Oligomer
uuagcacacugaucacacg

SEQ ID NO: 30357 - RNA, 19 nt, artificial
  Oligomer
auuaugagugcuuuaagau

SEQ ID NO: 30358 - RNA, 19 nt, artificial
  Oligomer
cuuugaggaaagcuccaac

SEQ ID NO: 30359 - RNA, 19 nt, artificial
  Oligomer
acuacauuugcaaucucuc

SEQ ID NO: 30360 - RNA, 19 nt, artificial
  Oligomer
uuguuuucaacaaaaacaa

SEQ ID NO: 30361 - RNA, 19 nt, artificial
  Oligomer
uccagucguagccuuugag

SEQ ID NO: 30362 - RNA, 19 nt, artificial
  Oligomer
aggaauacaaagaaacuug

SEQ ID NO: 30363 - RNA, 19 nt, artificial
  Oligomer
ugauaaagcuuaccaaaug

SEQ ID NO: 30364 - RNA, 19 nt, artificial
  Oligomer
agauuuagcacacugauca

SEQ ID NO: 30365 - RNA, 19 nt, artificial
  Oligomer
uccuccuuaaaucgcaaag

SEQ ID NO: 30366 - RNA, 19 nt, artificial
  Oligomer
aaucuguacaaaaauacuc

SEQ ID NO: 30367 - RNA, 19 nt, artificial
  Oligomer
ugugcucgggcacuuauug

SEQ ID NO: 30368 - RNA, 19 nt, artificial
  Oligomer
uguaguaggagcuggaguu

SEQ ID NO: 30369 - RNA, 19 nt, artificial
  Oligomer
uuccucacagaggacuuuu

SEQ ID NO: 30370 - RNA, 19 nt, artificial
  Oligomer
uuucuuuaauuacugcuaa

SEQ ID NO: 30371 - RNA, 19 nt, artificial
  Oligomer
uguuuacucccauaauugc

SEQ ID NO: 30372 - RNA, 19 nt, artificial
  Oligomer
guuuaaaaaguccaguuuc

SEQ ID NO: 30373 - RNA, 19 nt, artificial
  Oligomer
uucucuucuccuccugcaa

SEQ ID NO: 30374 - RNA, 19 nt, artificial
  Oligomer
ucgguguagucguacugug

SEQ ID NO: 30375 - RNA, 19 nt, artificial
  Oligomer
aaauuuggguacgaguugc

SEQ ID NO: 30376 - RNA, 19 nt, artificial
  Oligomer
cucaaaaugguaaugaauc

SEQ ID NO: 30377 - RNA, 19 nt, artificial
  Oligomer
aaagcuuuuaccuaaagac

SEQ ID NO: 30378 - RNA, 19 nt, artificial
  Oligomer
aagcaauccucaaacucuc

SEQ ID NO: 30379 - RNA, 19 nt, artificial
  Oligomer
uuauucuacugacuucuaa

SEQ ID NO: 30380 - RNA, 19 nt, artificial
  Oligomer
auucccagaacagauuuca

SEQ ID NO: 30381 - RNA, 19 nt, artificial
  Oligomer
cucucguucagaagucucc

SEQ ID NO: 30382 - RNA, 19 nt, artificial
  Oligomer
cauaauugcaaaauaaggc

SEQ ID NO: 30383 - RNA, 19 nt, artificial
  Oligomer
ugccuuuuaccucuuucuu

SEQ ID NO: 30384 - RNA, 19 nt, artificial
  Oligomer
aaauagagaauauuccuca

SEQ ID NO: 30385 - RNA, 19 nt, artificial
  Oligomer
aagaacauaauuuaacaac

SEQ ID NO: 30386 - RNA, 19 nt, artificial
  Oligomer
aaacaaacaaaacacgaac

SEQ ID NO: 30387 - RNA, 19 nt, artificial
  Oligomer
uugcaaucucucauuuaua

SEQ ID NO: 30388 - RNA, 19 nt, artificial
  Oligomer
ucuuaaguuacagaaguau

SEQ ID NO: 30389 - RNA, 19 nt, artificial
  Oligomer
ugguccucucuuucuucgg

SEQ ID NO: 30390 - RNA, 19 nt, artificial
  Oligomer
uguuuuucucuucuuuaaa

SEQ ID NO: 30391 - RNA, 19 nt, artificial
  Oligomer
auacccuuugaggaaagcu

SEQ ID NO: 30392 - RNA, 19 nt, artificial
  Oligomer
ucucgcucucguucagaag

SEQ ID NO: 30393 - RNA, 19 nt, artificial
  Oligomer
uacaguuaagaacauaauu

SEQ ID NO: 30394 - RNA, 19 nt, artificial
  Oligomer
uaccaaaugcuucucuaga

SEQ ID NO: 30395 - RNA, 19 nt, artificial
  Oligomer
uaauccgggugguccuucu

SEQ ID NO: 30396 - RNA, 19 nt, artificial
  Oligomer
aggaaaaagagcaaaagug

SEQ ID NO: 30397 - RNA, 19 nt, artificial
  Oligomer
uuaccuaaagacaaaauau

SEQ ID NO: 30398 - RNA, 19 nt, artificial
  Oligomer
uacagaaguaucuuuuuaa

SEQ ID NO: 30399 - RNA, 19 nt, artificial
  Oligomer
uguuggaaaaauaagagca

SEQ ID NO: 30400 - RNA, 19 nt, artificial
  Oligomer
aaaagcaauccucaaacuc

SEQ ID NO: 30401 - RNA, 19 nt, artificial
  Oligomer
agcagcaccguuuuaaggc

SEQ ID NO: 30402 - RNA, 19 nt, artificial
  Oligomer
aaauaauuuuagcaagugg

SEQ ID NO: 30403 - RNA, 19 nt, artificial
  Oligomer
ucguugacaucgaaggucu

SEQ ID NO: 30404 - RNA, 19 nt, artificial
  Oligomer
uguagacggguuguuccca

SEQ ID NO: 30405 - RNA, 19 nt, artificial
  Oligomer
caaaauaugauuuaaaugc

SEQ ID NO: 30406 - RNA, 19 nt, artificial
  Oligomer
uuacaguuaagaacauaau

SEQ ID NO: 30407 - RNA, 19 nt, artificial
  Oligomer
uaauuuaacaacagaugac

SEQ ID NO: 30408 - RNA, 19 nt, artificial
  Oligomer
ugguugguccucucuuucu

SEQ ID NO: 30409 - RNA, 19 nt, artificial
  Oligomer
uggguaaugcgcuuggaua

SEQ ID NO: 30410 - RNA, 19 nt, artificial
  Oligomer
ugaggaauuaagcaaaguu

SEQ ID NO: 30411 - RNA, 19 nt, artificial
  Oligomer
aagacugcagugaacaagc

SEQ ID NO: 30412 - RNA, 19 nt, artificial
  Oligomer
agauuaaggucugucagug

SEQ ID NO: 30413 - RNA, 19 nt, artificial
  Oligomer
aaagcuuaccaaaugcuuc

SEQ ID NO: 30414 - RNA, 19 nt, artificial
  Oligomer
acaaguuuccaguuuguuu

SEQ ID NO: 30415 - RNA, 19 nt, artificial
  Oligomer
ugguguucugagaggcaca

SEQ ID NO: 30416 - RNA, 19 nt, artificial
  Oligomer
uucuugcuggagccguuga

SEQ ID NO: 30417 - RNA, 19 nt, artificial
  Oligomer
aaaaauaauuacaaagucc

SEQ ID NO: 30418 - RNA, 19 nt, artificial
  Oligomer
guuuuaaggcucaaggugu

SEQ ID NO: 30419 - RNA, 19 nt, artificial
  Oligomer
aaguuuccagucaguuucg

SEQ ID NO: 30420 - RNA, 19 nt, artificial
  Oligomer
ucuuaagacugcagugaac

SEQ ID NO: 30421 - RNA, 19 nt, artificial
  Oligomer
ugccuuuagcuuaaauguc

SEQ ID NO: 30422 - RNA, 19 nt, artificial
  Oligomer
uacuggucaaacucguuga

SEQ ID NO: 30423 - RNA, 19 nt, artificial
  Oligomer
uagcaaguggaaugucuug

SEQ ID NO: 30424 - RNA, 19 nt, artificial
  Oligomer
caugcuugcauuguuuuug

SEQ ID NO: 30425 - RNA, 19 nt, artificial
  Oligomer
acaacagaugaccauaccc

SEQ ID NO: 30426 - RNA, 19 nt, artificial
  Oligomer
aagauuuuauucuacugac

SEQ ID NO: 30427 - RNA, 19 nt, artificial
  Oligomer
ucagugauacacuacauuu

SEQ ID NO: 30428 - RNA, 19 nt, artificial
  Oligomer
cuuuuuaaaaagaucugcu

SEQ ID NO: 30429 - RNA, 19 nt, artificial
  Oligomer
ucuguacaaaaauacucug

SEQ ID NO: 30430 - RNA, 19 nt, artificial
  Oligomer
uagagaaauauggaugaca

SEQ ID NO: 30431 - RNA, 19 nt, artificial
  Oligomer
accaugaaggcguucaugg

SEQ ID NO: 30432 - RNA, 19 nt, artificial
  Oligomer
cuuugcuugccuuuuaccu

SEQ ID NO: 30433 - RNA, 19 nt, artificial
  Oligomer
guacuuguaauccgggugg

SEQ ID NO: 30434 - RNA, 19 nt, artificial
  Oligomer
uguucuugcuggagccguu

SEQ ID NO: 30435 - RNA, 19 nt, artificial
  Oligomer
uuuuagcaaguggaauguc

SEQ ID NO: 30436 - RNA, 19 nt, artificial
  Oligomer
uaagagaaagcaaaucugu

SEQ ID NO: 30437 - RNA, 19 nt, artificial
  Oligomer
agugaaacaaacaaaacac

SEQ ID NO: 30438 - RNA, 19 nt, artificial
  Oligomer
uaacaacagaugaccauac

SEQ ID NO: 30439 - RNA, 19 nt, artificial
  Oligomer
aacaacaaagaaaaaaggg

SEQ ID NO: 30440 - RNA, 19 nt, artificial
  Oligomer
uaauugcaaaauaaggccu

SEQ ID NO: 30441 - RNA, 19 nt, artificial
  Oligomer
aaaagaucugcuuuuauac

SEQ ID NO: 30442 - RNA, 19 nt, artificial
  Oligomer
aagcuagggcacacuguuc

SEQ ID NO: 30443 - RNA, 19 nt, artificial
  Oligomer
aaaauaauuacaaagucca

SEQ ID NO: 30444 - RNA, 19 nt, artificial
  Oligomer
auaaagcuuaccaaaugcu

SEQ ID NO: 30445 - RNA, 19 nt, artificial
  Oligomer
auuguuuacucccauaauu

SEQ ID NO: 30446 - RNA, 19 nt, artificial
  Oligomer
uuucacggagagaacaaaa

SEQ ID NO: 30447 - RNA, 19 nt, artificial
  Oligomer
ugacucagugauacacuac

SEQ ID NO: 30448 - RNA, 19 nt, artificial
  Oligomer
uuuuaccuaaagacaaaau

SEQ ID NO: 30449 - RNA, 19 nt, artificial
  Oligomer
gaaguuuccagucaguuuc

SEQ ID NO: 30450 - RNA, 19 nt, artificial
  Oligomer
aauucugguugguccucuc

SEQ ID NO: 30451 - RNA, 19 nt, artificial
  Oligomer
uagcuguuggaaaaauaag

SEQ ID NO: 30452 - RNA, 19 nt, artificial
  Oligomer
ucuuggaaauuuggguacg

SEQ ID NO: 30453 - RNA, 19 nt, artificial
  Oligomer
uuugcaaucucucauuuau

SEQ ID NO: 30454 - RNA, 19 nt, artificial
  Oligomer
uuacagaaguaucuuuuua

SEQ ID NO: 30455 - RNA, 19 nt, artificial
  Oligomer
ucugguugguccucucuuu

SEQ ID NO: 30456 - RNA, 19 nt, artificial
  Oligomer
aaagcaauccucaaacucu

SEQ ID NO: 30457 - RNA, 19 nt, artificial
  Oligomer
guuuccagucaguuucgag

SEQ ID NO: 30458 - RNA, 19 nt, artificial
  Oligomer
ugguacuuguaauccgggu

SEQ ID NO: 30459 - RNA, 19 nt, artificial
  Oligomer
aacucguugacaucgaagg

SEQ ID NO: 30460 - RNA, 19 nt, artificial
  Oligomer
auuuagcacacugaucaca

SEQ ID NO: 30461 - RNA, 19 nt, artificial
  Oligomer
uucucgcucucguucagaa

SEQ ID NO: 30462 - RNA, 19 nt, artificial
  Oligomer
cuuuauuuuuuuuuaaggc

SEQ ID NO: 30463 - RNA, 19 nt, artificial
  Oligomer
auacaaaaaaagaaacaag

SEQ ID NO: 30464 - RNA, 19 nt, artificial
  Oligomer
aaaguccaguuucucguug

SEQ ID NO: 30465 - RNA, 19 nt, artificial
  Oligomer
uucccagaacagauuucau

SEQ ID NO: 30466 - RNA, 19 nt, artificial
  Oligomer
aucuagggugaggaauaca

SEQ ID NO: 30467 - RNA, 19 nt, artificial
  Oligomer
uauacaaaucuagggugag

SEQ ID NO: 30468 - RNA, 19 nt, artificial
  Oligomer
aaaagagugcaaauguuuc

SEQ ID NO: 30469 - RNA, 19 nt, artificial
  Oligomer
auaugauaaagcuuaccaa

SEQ ID NO: 30470 - RNA, 19 nt, artificial
  Oligomer
aguuacagaaguaucuuuu

SEQ ID NO: 30471 - RNA, 19 nt, artificial
  Oligomer
uaggagcuggaguucuggu

SEQ ID NO: 30472 - RNA, 19 nt, artificial
  Oligomer
gaucacacgauucuccauc

SEQ ID NO: 30473 - RNA, 19 nt, artificial
  Oligomer
aaagccugaggaauuaagc

SEQ ID NO: 30474 - RNA, 19 nt, artificial
  Oligomer
aaagaaacaaguuuccagu

SEQ ID NO: 30475 - RNA, 19 nt, artificial
  Oligomer
acaguuaagaacauaauuu

SEQ ID NO: 30476 - RNA, 19 nt, artificial
  Oligomer
ugucuuggaaauuugggua

SEQ ID NO: 30477 - RNA, 19 nt, artificial
  Oligomer
guucuucaccgacuuccuc

SEQ ID NO: 30478 - RNA, 19 nt, artificial
  Oligomer
ucaacuaagaguaguuuag

SEQ ID NO: 30479 - RNA, 19 nt, artificial
  Oligomer
uuagcuguuggaaaaauaa

SEQ ID NO: 30480 - RNA, 19 nt, artificial
  Oligomer
ucgcucucguucagaaguc

SEQ ID NO: 30481 - RNA, 19 nt, artificial
  Oligomer
aaagagugcaaauguuucc

SEQ ID NO: 30482 - RNA, 19 nt, artificial
  Oligomer
aagaucugcuuuuauacag

SEQ ID NO: 30483 - RNA, 19 nt, artificial
  Oligomer
ucuccuucuucagaucggg

SEQ ID NO: 30484 - RNA, 19 nt, artificial
  Oligomer
cauuuauacaaaucuaggg

SEQ ID NO: 30485 - RNA, 19 nt, artificial
  Oligomer
agaauauuccucacagagg

SEQ ID NO: 30486 - RNA, 19 nt, artificial
  Oligomer
aaacucguugacaucgaag

SEQ ID NO: 30487 - RNA, 19 nt, artificial
  Oligomer
uaguaggagcuggaguucu

SEQ ID NO: 30488 - RNA, 19 nt, artificial
  Oligomer
ggaaagguaaguuucacgg

SEQ ID NO: 30489 - RNA, 19 nt, artificial
  Oligomer
uguacaaaaauacucuggu

SEQ ID NO: 30490 - RNA, 19 nt, artificial
  Oligomer
auauuccucacagaggacu

SEQ ID NO: 30491 - RNA, 19 nt, artificial
  Oligomer
aaguggguaaugcgcuugg

SEQ ID NO: 30492 - RNA, 19 nt, artificial
  Oligomer
aucgaaggucucgauguug

SEQ ID NO: 30493 - RNA, 19 nt, artificial
  Oligomer
aacagaugaccauacccuu

SEQ ID NO: 30494 - RNA, 19 nt, artificial
  Oligomer
aacagauuucaucuccuuu

SEQ ID NO: 30495 - RNA, 19 nt, artificial
  Oligomer
auuuuuuuuuaaggcagcu

SEQ ID NO: 30496 - RNA, 19 nt, artificial
  Oligomer
ugcuucucuagacuauugu

SEQ ID NO: 30497 - RNA, 19 nt, artificial
  Oligomer
aaagaaaaaagggauggac

SEQ ID NO: 30498 - RNA, 19 nt, artificial
  Oligomer
cucaagguguuuuucucuu

SEQ ID NO: 30499 - RNA, 19 nt, artificial
  Oligomer
uaaggcucaagguguuuuu

SEQ ID NO: 30500 - RNA, 19 nt, artificial
  Oligomer
agcuagggcacacuguuca

SEQ ID NO: 30501 - RNA, 19 nt, artificial
  Oligomer
gggaaagguaaguuucacg

SEQ ID NO: 30502 - RNA, 19 nt, artificial
  Oligomer
aaacauucccagaacagau

SEQ ID NO: 30503 - RNA, 19 nt, artificial
  Oligomer
agagcauuuaauuuuaucu

SEQ ID NO: 30504 - RNA, 19 nt, artificial
  Oligomer
guugccuuuagcuuaaaug

SEQ ID NO: 30505 - RNA, 19 nt, artificial
  Oligomer
uggauaggucauguuugug

SEQ ID NO: 30506 - RNA, 19 nt, artificial
  Oligomer
augucuuuaaggaagaaga

SEQ ID NO: 30507 - RNA, 19 nt, artificial
  Oligomer
ugguccuucuugugcugca

SEQ ID NO: 30508 - RNA, 19 nt, artificial
  Oligomer
aaugacucagugauacacu

SEQ ID NO: 30509 - RNA, 19 nt, artificial
  Oligomer
gucaaacucguugacaucg

SEQ ID NO: 30510 - RNA, 19 nt, artificial
  Oligomer
uccuuugcuugccuuuuac

SEQ ID NO: 30511 - RNA, 19 nt, artificial
  Oligomer
acugcugguguucugagag

SEQ ID NO: 30512 - RNA, 19 nt, artificial
  Oligomer
ucgguuauuuuuaggauca

SEQ ID NO: 30513 - RNA, 19 nt, artificial
  Oligomer
uuuucaacaaaaacaacaa

SEQ ID NO: 30514 - RNA, 19 nt, artificial
  Oligomer
ucacggagagaacaaaagg

SEQ ID NO: 30515 - RNA, 19 nt, artificial
  Oligomer
guagugugggagguugaag

SEQ ID NO: 30516 - RNA, 19 nt, artificial
  Oligomer
agagagauuuagcacacug

SEQ ID NO: 30517 - RNA, 19 nt, artificial
  Oligomer
aagagcauuuaauuuuauc

SEQ ID NO: 30518 - RNA, 19 nt, artificial
  Oligomer
auuuaacaacagaugacca

SEQ ID NO: 30519 - RNA, 19 nt, artificial
  Oligomer
uaaguuucacggagagaac

SEQ ID NO: 30520 - RNA, 19 nt, artificial
  Oligomer
aaaacaacaaagaaaaaag

SEQ ID NO: 30521 - RNA, 19 nt, artificial
  Oligomer
uuaaaaagaucugcuuuua

SEQ ID NO: 30522 - RNA, 19 nt, artificial
  Oligomer
uucuuaaguuacagaagua

SEQ ID NO: 30523 - RNA, 19 nt, artificial
  Oligomer
cugaaguuuccagucaguu

SEQ ID NO: 30524 - RNA, 19 nt, artificial
  Oligomer
aaaauaugauuuaaaugcc

SEQ ID NO: 30525 - RNA, 19 nt, artificial
  Oligomer
aaaacacugcaaaugacuc

SEQ ID NO: 30526 - RNA, 19 nt, artificial
  Oligomer
acaaaccaaagcuuuuacc

SEQ ID NO: 30527 - RNA, 19 nt, artificial
  Oligomer
ucucuuucuucgguuauuu

SEQ ID NO: 30528 - RNA, 19 nt, artificial
  Oligomer
aauaaggccuuuauuuuuu

SEQ ID NO: 30529 - RNA, 19 nt, artificial
  Oligomer
uauucuacugacuucuaaa

SEQ ID NO: 30530 - RNA, 19 nt, artificial
  Oligomer
ucgcucuccuucuucagau

SEQ ID NO: 30531 - RNA, 19 nt, artificial
  Oligomer
uauacagaaauugaaggau

SEQ ID NO: 30532 - RNA, 19 nt, artificial
  Oligomer
augauaaagcuuaccaaau

SEQ ID NO: 30533 - RNA, 19 nt, artificial
  Oligomer
agcuuaaaugucuuuaagg

SEQ ID NO: 30534 - RNA, 19 nt, artificial
  Oligomer
aaaaaagggauggacaaaa

SEQ ID NO: 30535 - RNA, 19 nt, artificial
  Oligomer
cugguugguccucucuuuc

SEQ ID NO: 30536 - RNA, 19 nt, artificial
  Oligomer
aagaaaagcuagggcacac

SEQ ID NO: 30537 - RNA, 19 nt, artificial
  Oligomer
cagaugaccauacccuuug

SEQ ID NO: 30538 - RNA, 19 nt, artificial
  Oligomer
ugaccauacccuuugagga

SEQ ID NO: 30539 - RNA, 19 nt, artificial
  Oligomer
cuagacuauuguuuacucc

SEQ ID NO: 30540 - RNA, 19 nt, artificial
  Oligomer
ucuuuaauuacugcuaaaa

SEQ ID NO: 30541 - RNA, 19 nt, artificial
  Oligomer
cuuggauaggucauguuug

SEQ ID NO: 30542 - RNA, 19 nt, artificial
  Oligomer
ugauacacuacauuugcaa

SEQ ID NO: 30543 - RNA, 19 nt, artificial
  Oligomer
aauuacaaaguccaaacag

SEQ ID NO: 30544 - RNA, 19 nt, artificial
  Oligomer
aggcucaagguguuuuucu

SEQ ID NO: 30545 - RNA, 19 nt, artificial
  Oligomer
auagagaauauuccucaca

SEQ ID NO: 30546 - RNA, 19 nt, artificial
  Oligomer
uccuccugcaaagaaaagu

SEQ ID NO: 30547 - RNA, 19 nt, artificial
  Oligomer
ugaggaaagcuccaacaac

SEQ ID NO: 30548 - RNA, 19 nt, artificial
  Oligomer
uacaaagaaacuugcuuuu

SEQ ID NO: 30549 - RNA, 19 nt, artificial
  Oligomer
uggaaaaauaagagcauuu

SEQ ID NO: 30550 - RNA, 19 nt, artificial
  Oligomer
uugaggaaagcuccaacaa

SEQ ID NO: 30551 - RNA, 19 nt, artificial
  Oligomer
agaggguuuaaaaagucca

SEQ ID NO: 30552 - RNA, 19 nt, artificial
  Oligomer
uaaggucugucagugggcu

SEQ ID NO: 30553 - RNA, 19 nt, artificial
  Oligomer
cucgauguuggagaugacg

SEQ ID NO: 30554 - RNA, 19 nt, artificial
  Oligomer
auaauuuaacaacagauga

SEQ ID NO: 30555 - RNA, 19 nt, artificial
  Oligomer
cuugccuuuuaccucuuuc

SEQ ID NO: 30556 - RNA, 19 nt, artificial
  Oligomer
uugcaaaauaaggccuuua

SEQ ID NO: 30557 - RNA, 19 nt, artificial
  Oligomer
aauccucaaacucucuagc

SEQ ID NO: 30558 - RNA, 19 nt, artificial
  Oligomer
uaaguuacagaaguaucuu

SEQ ID NO: 30559 - RNA, 19 nt, artificial
  Oligomer
uuaccucuuucuuaagacu

SEQ ID NO: 30560 - RNA, 19 nt, artificial
  Oligomer
aaugucuuuaaggaagaag

SEQ ID NO: 30561 - RNA, 19 nt, artificial
  Oligomer
cucgucggucaucuucaug

SEQ ID NO: 30562 - RNA, 19 nt, artificial
  Oligomer
aagcuuuuaccuaaagaca

SEQ ID NO: 30563 - RNA, 19 nt, artificial
  Oligomer
ugcaaucucucauuuauac

SEQ ID NO: 30564 - RNA, 19 nt, artificial
  Oligomer
uaaaaagaucugcuuuuau

SEQ ID NO: 30565 - RNA, 19 nt, artificial
  Oligomer
uaauuuuagcaaguggaau

SEQ ID NO: 30566 - RNA, 19 nt, artificial
  Oligomer
aauacaaagaaacuugcuu

SEQ ID NO: 30567 - RNA, 19 nt, artificial
  Oligomer
uucccagcagcaccguuuu

SEQ ID NO: 30568 - RNA, 19 nt, artificial
  Oligomer
ucuccuuacaaaauaaaua

SEQ ID NO: 30569 - RNA, 19 nt, artificial
  Oligomer
aaugucuugaagguuaacu

SEQ ID NO: 30570 - RNA, 19 nt, artificial
  Oligomer
uguucaacuaagaguaguu

SEQ ID NO: 30571 - RNA, 19 nt, artificial
  Oligomer
ucagaagucuccagagcuu

SEQ ID NO: 30572 - RNA, 19 nt, artificial
  Oligomer
ugcaaauguuucccagcag

SEQ ID NO: 30573 - RNA, 19 nt, artificial
  Oligomer
aaaaaagaaacaaguuucc

SEQ ID NO: 30574 - RNA, 19 nt, artificial
  Oligomer
uauuguuuacucccauaau

SEQ ID NO: 30575 - RNA, 19 nt, artificial
  Oligomer
ugcugaaacauucccagaa

SEQ ID NO: 30576 - RNA, 19 nt, artificial
  Oligomer
uuagcuuaaaugucuuuaa

SEQ ID NO: 30577 - RNA, 19 nt, artificial
  Oligomer
aaaagcuagggcacacugu

SEQ ID NO: 30578 - RNA, 19 nt, artificial
  Oligomer
ugucuugaagguuaacugc

SEQ ID NO: 30579 - RNA, 19 nt, artificial
  Oligomer
ucuacugacuucuaaaacu

SEQ ID NO: 30580 - RNA, 19 nt, artificial
  Oligomer
aacacugcaaaugacucag

SEQ ID NO: 30581 - RNA, 19 nt, artificial
  Oligomer
acaggcagagagauuuagc

SEQ ID NO: 30582 - RNA, 19 nt, artificial
  Oligomer
guuaacugcugguguucug

SEQ ID NO: 30583 - RNA, 19 nt, artificial
  Oligomer
cuguaguaggagcuggagu

SEQ ID NO: 30584 - RNA, 19 nt, artificial
  Oligomer
guccaggagauucauacgc

SEQ ID NO: 30585 - RNA, 19 nt, artificial
  Oligomer
augcuucucuagacuauug

SEQ ID NO: 30586 - RNA, 19 nt, artificial
  Oligomer
acauaauuuaacaacagau

SEQ ID NO: 30587 - RNA, 19 nt, artificial
  Oligomer
aaggucucgauguuggaga

SEQ ID NO: 30588 - RNA, 19 nt, artificial
  Oligomer
cugguacuuguaauccggg

SEQ ID NO: 30589 - RNA, 19 nt, artificial
  Oligomer
aaauguuucccagcagcac

SEQ ID NO: 30590 - RNA, 19 nt, artificial
  Oligomer
uuggauaggucauguuugu

SEQ ID NO: 30591 - RNA, 19 nt, artificial
  Oligomer
uguaauccgggugguccuu

SEQ ID NO: 30592 - RNA, 19 nt, artificial
  Oligomer
aguaggagcuggaguucug

SEQ ID NO: 30593 - RNA, 19 nt, artificial
  Oligomer
aaggaccacccggauuaca

SEQ ID NO: 30594 - RNA, 19 nt, artificial
  Oligomer
cagaacuccagcuccuacu

SEQ ID NO: 30595 - RNA, 19 nt, artificial
  Oligomer
ggaugauauggaugaugaa

SEQ ID NO: 30596 - RNA, 19 nt, artificial
  Oligomer
ccaaguaaguccaacgaaa

SEQ ID NO: 30597 - RNA, 19 nt, artificial
  Oligomer
ggaugaccagagugcugaa

SEQ ID NO: 30598 - RNA, 19 nt, artificial
  Oligomer
gacugaggucaaaaucuaa

SEQ ID NO: 30599 - RNA, 19 nt, artificial
  Oligomer
ggaugaugaagaugaugau

SEQ ID NO: 30600 - RNA, 19 nt, artificial
  Oligomer
gcuuuauagcaaaaugaaa

SEQ ID NO: 30601 - RNA, 19 nt, artificial
  Oligomer
gaacgacucugaugaugua

SEQ ID NO: 30602 - RNA, 19 nt, artificial
  Oligomer
cauggaaacucccuguaaa

SEQ ID NO: 30603 - RNA, 19 nt, artificial
  Oligomer
auagcaaaaugaaagagaa

SEQ ID NO: 30604 - RNA, 19 nt, artificial
  Oligomer
aaaugaaagagaacaugaa

SEQ ID NO: 30605 - RNA, 19 nt, artificial
  Oligomer
ggacugaggucaaaaucua

SEQ ID NO: 30606 - RNA, 19 nt, artificial
  Oligomer
aaguaaggaagaagauaaa

SEQ ID NO: 30607 - RNA, 19 nt, artificial
  Oligomer
cgacucugaugauguagau

SEQ ID NO: 30608 - RNA, 19 nt, artificial
  Oligomer
gcauuuagucaaaagaaaa

SEQ ID NO: 30609 - RNA, 19 nt, artificial
  Oligomer
gguuguccagcaauuaaua

SEQ ID NO: 30610 - RNA, 19 nt, artificial
  Oligomer
ugauguagaugacacugau

SEQ ID NO: 30611 - RNA, 19 nt, artificial
  Oligomer
gaaacucccuguaaacuaa

SEQ ID NO: 30612 - RNA, 19 nt, artificial
  Oligomer
ugaagaugaugaugaccau

SEQ ID NO: 30613 - RNA, 19 nt, artificial
  Oligomer
agaagauaaacaccugaaa

SEQ ID NO: 30614 - RNA, 19 nt, artificial
  Oligomer
gucucaccauucugaugaa

SEQ ID NO: 30615 - RNA, 19 nt, artificial
  Oligomer
ccaguacccugaugcuaca

SEQ ID NO: 30616 - RNA, 19 nt, artificial
  Oligomer
aaugaaagagaacaugaaa

SEQ ID NO: 30617 - RNA, 19 nt, artificial
  Oligomer
cuauguucauucuauagaa

SEQ ID NO: 30618 - RNA, 19 nt, artificial
  Oligomer
cagagugcugaaacccaca

SEQ ID NO: 30619 - RNA, 19 nt, artificial
  Oligomer
cuucugaggucaauuaaaa

SEQ ID NO: 30620 - RNA, 19 nt, artificial
  Oligomer
cauuuagucaaaagaaaaa

SEQ ID NO: 30621 - RNA, 19 nt, artificial
  Oligomer
ccacauggaugauauggau

SEQ ID NO: 30622 - RNA, 19 nt, artificial
  Oligomer
caauuaaaaggagaaaaaa

SEQ ID NO: 30623 - RNA, 19 nt, artificial
  Oligomer
uauggaugaugaagaugau

SEQ ID NO: 30624 - RNA, 19 nt, artificial
  Oligomer
cuggaaguucugaggaaaa

SEQ ID NO: 30625 - RNA, 19 nt, artificial
  Oligomer
caaggaaaacucacuacca

SEQ ID NO: 30626 - RNA, 19 nt, artificial
  Oligomer
ccaugagaauugcagugau

SEQ ID NO: 30627 - RNA, 19 nt, artificial
  Oligomer
aacuaucacuguauuuuaa

SEQ ID NO: 30628 - RNA, 19 nt, artificial
  Oligomer
gcaaaaugaaagagaacau

SEQ ID NO: 30629 - RNA, 19 nt, artificial
  Oligomer
ugcuuuauagcaaaaugaa

SEQ ID NO: 30630 - RNA, 19 nt, artificial
  Oligomer
uggaaagcgaggaguugaa

SEQ ID NO: 30631 - RNA, 19 nt, artificial
  Oligomer
agcaguccagauuauauaa

SEQ ID NO: 30632 - RNA, 19 nt, artificial
  Oligomer
ugauauggaugaugaagau

SEQ ID NO: 30633 - RNA, 19 nt, artificial
  Oligomer
ugggaaggacaguuaugaa

SEQ ID NO: 30634 - RNA, 19 nt, artificial
  Oligomer
cgguuguccagcaauuaau

SEQ ID NO: 30635 - RNA, 19 nt, artificial
  Oligomer
gucugcagcagcauuuaaa

SEQ ID NO: 30636 - RNA, 19 nt, artificial
  Oligomer
gagcaaugagcauuccgau

SEQ ID NO: 30637 - RNA, 19 nt, artificial
  Oligomer
cgaugugauugauagucag

SEQ ID NO: 30638 - RNA, 19 nt, artificial
  Oligomer
ccauucugaugaaucugau

SEQ ID NO: 30639 - RNA, 19 nt, artificial
  Oligomer
gggaaggacaguuaugaaa

SEQ ID NO: 30640 - RNA, 19 nt, artificial
  Oligomer
ugcauuuagucaaaagaaa

SEQ ID NO: 30641 - RNA, 19 nt, artificial
  Oligomer
cagcaauuaauaaaacaua

SEQ ID NO: 30642 - RNA, 19 nt, artificial
  Oligomer
aaagcagcuuuacaacaaa

SEQ ID NO: 30643 - RNA, 19 nt, artificial
  Oligomer
cacuuugcauuuagucaaa

SEQ ID NO: 30644 - RNA, 19 nt, artificial
  Oligomer
gaggaaaagcagcuuuaca

SEQ ID NO: 30645 - RNA, 19 nt, artificial
  Oligomer
ugugauugauagucaggaa

SEQ ID NO: 30646 - RNA, 19 nt, artificial
  Oligomer
cuaucacuguauuuuaaua

SEQ ID NO: 30647 - RNA, 19 nt, artificial
  Oligomer
gacccaucucagaagcaga

SEQ ID NO: 30648 - RNA, 19 nt, artificial
  Oligomer
gaagaaaugcaaacuauca

SEQ ID NO: 30649 - RNA, 19 nt, artificial
  Oligomer
ccagcaaccgaaguuuuca

SEQ ID NO: 30650 - RNA, 19 nt, artificial
  Oligomer
cauuuuaugucacuauaau

SEQ ID NO: 30651 - RNA, 19 nt, artificial
  Oligomer
ggacaguuaugaaacgagu

SEQ ID NO: 30652 - RNA, 19 nt, artificial
  Oligomer
cgaggaguugaauggugca

SEQ ID NO: 30653 - RNA, 19 nt, artificial
  Oligomer
aggacuccauugacucgaa

SEQ ID NO: 30654 - RNA, 19 nt, artificial
  Oligomer
uauguagaagcaaacaaaa

SEQ ID NO: 30655 - RNA, 19 nt, artificial
  Oligomer
agaaaccaaugacuuuaaa

SEQ ID NO: 30656 - RNA, 19 nt, artificial
  Oligomer
ggcugauucuggaaguucu

SEQ ID NO: 30657 - RNA, 19 nt, artificial
  Oligomer
ccaaaaguaaggaagaaga

SEQ ID NO: 30658 - RNA, 19 nt, artificial
  Oligomer
ucguauuucucaugaauua

SEQ ID NO: 30659 - RNA, 19 nt, artificial
  Oligomer
ggguuaugucuauguucau

SEQ ID NO: 30660 - RNA, 19 nt, artificial
  Oligomer
aagcaguccagauuauaua

SEQ ID NO: 30661 - RNA, 19 nt, artificial
  Oligomer
ccagauuauauaagcggaa

SEQ ID NO: 30662 - RNA, 19 nt, artificial
  Oligomer
gaagauaaacaccugaaau

SEQ ID NO: 30663 - RNA, 19 nt, artificial
  Oligomer
ucuucugaggucaauuaaa

SEQ ID NO: 30664 - RNA, 19 nt, artificial
  Oligomer
caaaaguaaggaagaagau

SEQ ID NO: 30665 - RNA, 19 nt, artificial
  Oligomer
ugucuauguucauucuaua

SEQ ID NO: 30666 - RNA, 19 nt, artificial
  Oligomer
aaacgccgaccaaggaaaa

SEQ ID NO: 30667 - RNA, 19 nt, artificial
  Oligomer
aaacuaucacuguauuuua

SEQ ID NO: 30668 - RNA, 19 nt, artificial
  Oligomer
aagagaacaugaaaugcuu

SEQ ID NO: 30669 - RNA, 19 nt, artificial
  Oligomer
guuuauggacugaggucaa

SEQ ID NO: 30670 - RNA, 19 nt, artificial
  Oligomer
aaggaaaacucacuaccau

SEQ ID NO: 30671 - RNA, 19 nt, artificial
  Oligomer
agaauuugguggugucaau

SEQ ID NO: 30672 - RNA, 19 nt, artificial
  Oligomer
aggaaaagcagcuuuacaa

SEQ ID NO: 30673 - RNA, 19 nt, artificial
  Oligomer
aguugaauggugcauacaa

SEQ ID NO: 30674 - RNA, 19 nt, artificial
  Oligomer
aaaaaugcuuuauagcaaa

SEQ ID NO: 30675 - RNA, 19 nt, artificial
  Oligomer
caagcaguccagauuauau

SEQ ID NO: 30676 - RNA, 19 nt, artificial
  Oligomer
gcuucaggguuaugucuau

SEQ ID NO: 30677 - RNA, 19 nt, artificial
  Oligomer
gcagcagcauuuaaauucu

SEQ ID NO: 30678 - RNA, 19 nt, artificial
  Oligomer
caaacgccgaccaaggaaa

SEQ ID NO: 30679 - RNA, 19 nt, artificial
  Oligomer
uuauguagaagcaaacaaa

SEQ ID NO: 30680 - RNA, 19 nt, artificial
  Oligomer
aggugauagugugguuuau

SEQ ID NO: 30681 - RNA, 19 nt, artificial
  Oligomer
caugaauuagauagugcau

SEQ ID NO: 30682 - RNA, 19 nt, artificial
  Oligomer
aagagacccuuccaaguaa

SEQ ID NO: 30683 - RNA, 19 nt, artificial
  Oligomer
ggucaauuaaaaggagaaa

SEQ ID NO: 30684 - RNA, 19 nt, artificial
  Oligomer
uguucauucuauagaagaa

SEQ ID NO: 30685 - RNA, 19 nt, artificial
  Oligomer
gugcaucuucugaggucaa

SEQ ID NO: 30686 - RNA, 19 nt, artificial
  Oligomer
ugaugaacuggucacugau

SEQ ID NO: 30687 - RNA, 19 nt, artificial
  Oligomer
gcuucuuucucaguuuauu

SEQ ID NO: 30688 - RNA, 19 nt, artificial
  Oligomer
ugaugaagaugaugaugac

SEQ ID NO: 30689 - RNA, 19 nt, artificial
  Oligomer
aaaguaaggaagaagauaa

SEQ ID NO: 30690 - RNA, 19 nt, artificial
  Oligomer
aaccaaugacuuuaaacaa

SEQ ID NO: 30691 - RNA, 19 nt, artificial
  Oligomer
cacuuaaaaagagaauaua

SEQ ID NO: 30692 - RNA, 19 nt, artificial
  Oligomer
uguccagcaauuaauaaaa

SEQ ID NO: 30693 - RNA, 19 nt, artificial
  Oligomer
caggaacuuuccaaaguca

SEQ ID NO: 30694 - RNA, 19 nt, artificial
  Oligomer
ccgugggaaggacaguuau

SEQ ID NO: 30695 - RNA, 19 nt, artificial
  Oligomer
gguggugucaauugcuuau

SEQ ID NO: 30696 - RNA, 19 nt, artificial
  Oligomer
acccaucucagaagcagaa

SEQ ID NO: 30697 - RNA, 19 nt, artificial
  Oligomer
uucugaugaaucugaugaa

SEQ ID NO: 30698 - RNA, 19 nt, artificial
  Oligomer
uguagaugacacugaugau

SEQ ID NO: 30699 - RNA, 19 nt, artificial
  Oligomer
cgaccaaggaaaacucacu

SEQ ID NO: 30700 - RNA, 19 nt, artificial
  Oligomer
ucucaugaauagaaauuua

SEQ ID NO: 30701 - RNA, 19 nt, artificial
  Oligomer
acgguuguccagcaauuaa

SEQ ID NO: 30702 - RNA, 19 nt, artificial
  Oligomer
acauuuuaugucacuauaa

SEQ ID NO: 30703 - RNA, 19 nt, artificial
  Oligomer
ucugcagcagcauuuaaau

SEQ ID NO: 30704 - RNA, 19 nt, artificial
  Oligomer
caaugaugagagcaaugag

SEQ ID NO: 30705 - RNA, 19 nt, artificial
  Oligomer
ccacgguuguccagcaauu

SEQ ID NO: 30706 - RNA, 19 nt, artificial
  Oligomer
aagauaugcugguuguaga

SEQ ID NO: 30707 - RNA, 19 nt, artificial
  Oligomer
gaagaagauaaacaccuga

SEQ ID NO: 30708 - RNA, 19 nt, artificial
  Oligomer
gaccaaggaaaacucacua

SEQ ID NO: 30709 - RNA, 19 nt, artificial
  Oligomer
gaaauuucguauuucucau

SEQ ID NO: 30710 - RNA, 19 nt, artificial
  Oligomer
cacgguuguccagcaauua

SEQ ID NO: 30711 - RNA, 19 nt, artificial
  Oligomer
ggaaacucccuguaaacua

SEQ ID NO: 30712 - RNA, 19 nt, artificial
  Oligomer
uguagaagcaaacaaaaua

SEQ ID NO: 30713 - RNA, 19 nt, artificial
  Oligomer
ccaaugacuuuaaacaaga

SEQ ID NO: 30714 - RNA, 19 nt, artificial
  Oligomer
aaauuuauguagaagcaaa

SEQ ID NO: 30715 - RNA, 19 nt, artificial
  Oligomer
ucuggaaguucugaggaaa

SEQ ID NO: 30716 - RNA, 19 nt, artificial
  Oligomer
cagauuauauaagcggaaa

SEQ ID NO: 30717 - RNA, 19 nt, artificial
  Oligomer
aaaaggagaaaaaauacaa

SEQ ID NO: 30718 - RNA, 19 nt, artificial
  Oligomer
cucugaugauguagaugac

SEQ ID NO: 30719 - RNA, 19 nt, artificial
  Oligomer
aggucaauuaaaaggagaa

SEQ ID NO: 30720 - RNA, 19 nt, artificial
  Oligomer
cauggaugauauggaugau

SEQ ID NO: 30721 - RNA, 19 nt, artificial
  Oligomer
cugaggaaaagcagcuuua

SEQ ID NO: 30722 - RNA, 19 nt, artificial
  Oligomer
ggucaaaaucuaagaaguu

SEQ ID NO: 30723 - RNA, 19 nt, artificial
  Oligomer
aagucagccgugaauucca

SEQ ID NO: 30724 - RNA, 19 nt, artificial
  Oligomer
ugaggucaaaaucuaagaa

SEQ ID NO: 30725 - RNA, 19 nt, artificial
  Oligomer
aaugcaaacuaucacugua

SEQ ID NO: 30726 - RNA, 19 nt, artificial
  Oligomer
agaugacacugaugauucu

SEQ ID NO: 30727 - RNA, 19 nt, artificial
  Oligomer
gcuuuacaacaaauaccca

SEQ ID NO: 30728 - RNA, 19 nt, artificial
  Oligomer
cugaugaacuggucacuga

SEQ ID NO: 30729 - RNA, 19 nt, artificial
  Oligomer
cugaggucaaaaucuaaga

SEQ ID NO: 30730 - RNA, 19 nt, artificial
  Oligomer
aaaaaaugcuuuauagcaa

SEQ ID NO: 30731 - RNA, 19 nt, artificial
  Oligomer
cuuuuaucuugaauguaau

SEQ ID NO: 30732 - RNA, 19 nt, artificial
  Oligomer
ugucugcagcagcauuuaa

SEQ ID NO: 30733 - RNA, 19 nt, artificial
  Oligomer
cuguaaacuaaaagcuuca

SEQ ID NO: 30734 - RNA, 19 nt, artificial
  Oligomer
gauugauagucaggaacuu

SEQ ID NO: 30735 - RNA, 19 nt, artificial
  Oligomer
aacucccuguaaacuaaaa

SEQ ID NO: 30736 - RNA, 19 nt, artificial
  Oligomer
ugaugagagcaaugagcau

SEQ ID NO: 30737 - RNA, 19 nt, artificial
  Oligomer
acgaggacaucaccucaca

SEQ ID NO: 30738 - RNA, 19 nt, artificial
  Oligomer
cucgaacgacucugaugau

SEQ ID NO: 30739 - RNA, 19 nt, artificial
  Oligomer
ugagcauuccgaugugauu

SEQ ID NO: 30740 - RNA, 19 nt, artificial
  Oligomer
ggaugucugcagcagcauu

SEQ ID NO: 30741 - RNA, 19 nt, artificial
  Oligomer
ucuugaauguaauaagaau

SEQ ID NO: 30742 - RNA, 19 nt, artificial
  Oligomer
uagucaggaacuuuccaaa

SEQ ID NO: 30743 - RNA, 19 nt, artificial
  Oligomer
ccacuuaaaaagagaauau

SEQ ID NO: 30744 - RNA, 19 nt, artificial
  Oligomer
ccgaugugauugauaguca

SEQ ID NO: 30745 - RNA, 19 nt, artificial
  Oligomer
aaccgaaguuuucacucca

SEQ ID NO: 30746 - RNA, 19 nt, artificial
  Oligomer
cuuuuuguggugugaauaa

SEQ ID NO: 30747 - RNA, 19 nt, artificial
  Oligomer
ccacaagcaguccagauua

SEQ ID NO: 30748 - RNA, 19 nt, artificial
  Oligomer
auuucguauuucucaugaa

SEQ ID NO: 30749 - RNA, 19 nt, artificial
  Oligomer
auacuuuuacccacuuaaa

SEQ ID NO: 30750 - RNA, 19 nt, artificial
  Oligomer
cgaaguuuucacuccaguu

SEQ ID NO: 30751 - RNA, 19 nt, artificial
  Oligomer
ccugaaauuucguauuucu

SEQ ID NO: 30752 - RNA, 19 nt, artificial
  Oligomer
ucaugaauuagauagugca

SEQ ID NO: 30753 - RNA, 19 nt, artificial
  Oligomer
agacgaggacaucaccuca

SEQ ID NO: 30754 - RNA, 19 nt, artificial
  Oligomer
ucaauuaaaaggagaaaaa

SEQ ID NO: 30755 - RNA, 19 nt, artificial
  Oligomer
cuauuugagucuggaaaua

SEQ ID NO: 30756 - RNA, 19 nt, artificial
  Oligomer
agagcaaugagcauuccga

SEQ ID NO: 30757 - RNA, 19 nt, artificial
  Oligomer
acuuuuacccacuuaaaaa

SEQ ID NO: 30758 - RNA, 19 nt, artificial
  Oligomer
gaauagaaauuuauguaga

SEQ ID NO: 30759 - RNA, 19 nt, artificial
  Oligomer
caucuucugaggucaauua

SEQ ID NO: 30760 - RNA, 19 nt, artificial
  Oligomer
agaaauuuauguagaagca

SEQ ID NO: 30761 - RNA, 19 nt, artificial
  Oligomer
aggucaaaaucuaagaagu

SEQ ID NO: 30762 - RNA, 19 nt, artificial
  Oligomer
uacuuuuacccacuuaaaa

SEQ ID NO: 30763 - RNA, 19 nt, artificial
  Oligomer
guauuucucaugaauuaga

SEQ ID NO: 30764 - RNA, 19 nt, artificial
  Oligomer
gccgaccaaggaaaacuca

SEQ ID NO: 30765 - RNA, 19 nt, artificial
  Oligomer
caaaagaaaaaaugcuuua

SEQ ID NO: 30766 - RNA, 19 nt, artificial
  Oligomer
ugguggugucaauugcuua

SEQ ID NO: 30767 - RNA, 19 nt, artificial
  Oligomer
guaucuauuugagucugga

SEQ ID NO: 30768 - RNA, 19 nt, artificial
  Oligomer
gucugaugagucucaccau

SEQ ID NO: 30769 - RNA, 19 nt, artificial
  Oligomer
aagaagauaaacaccugaa

SEQ ID NO: 30770 - RNA, 19 nt, artificial
  Oligomer
ggaagaagauaaacaccug

SEQ ID NO: 30771 - RNA, 19 nt, artificial
  Oligomer
ccagcaauuaauaaaacau

SEQ ID NO: 30772 - RNA, 19 nt, artificial
  Oligomer
uucuggaaguucugaggaa

SEQ ID NO: 30773 - RNA, 19 nt, artificial
  Oligomer
uugcauuuagucaaaagaa

SEQ ID NO: 30774 - RNA, 19 nt, artificial
  Oligomer
gcagcuuuacaacaaauac

SEQ ID NO: 30775 - RNA, 19 nt, artificial
  Oligomer
auucucucaugaauagaaa

SEQ ID NO: 30776 - RNA, 19 nt, artificial
  Oligomer
agaugaugaugaccaugug

SEQ ID NO: 30777 - RNA, 19 nt, artificial
  Oligomer
aaacaagagacccuuccaa

SEQ ID NO: 30778 - RNA, 19 nt, artificial
  Oligomer
ugauagugugguuuaugga

SEQ ID NO: 30779 - RNA, 19 nt, artificial
  Oligomer
aaaggagaaaaaauacaau

SEQ ID NO: 30780 - RNA, 19 nt, artificial
  Oligomer
ccgaggugauagugugguu

SEQ ID NO: 30781 - RNA, 19 nt, artificial
  Oligomer
cacaagcaguccagauuau

SEQ ID NO: 30782 - RNA, 19 nt, artificial
  Oligomer
ggugugaauaaaucuuuua

SEQ ID NO: 30783 - RNA, 19 nt, artificial
  Oligomer
gagucuggaaauaacuaau

SEQ ID NO: 30784 - RNA, 19 nt, artificial
  Oligomer
gaaucugaugaacugguca

SEQ ID NO: 30785 - RNA, 19 nt, artificial
  Oligomer
cccuguaaacuaaaagcuu

SEQ ID NO: 30786 - RNA, 19 nt, artificial
  Oligomer
aaacucccuguaaacuaaa

SEQ ID NO: 30787 - RNA, 19 nt, artificial
  Oligomer
ggaaaacucacuaccauga

SEQ ID NO: 30788 - RNA, 19 nt, artificial
  Oligomer
gaugcuacagacgaggaca

SEQ ID NO: 30789 - RNA, 19 nt, artificial
  Oligomer
gcuacagacgaggacauca

SEQ ID NO: 30790 - RNA, 19 nt, artificial
  Oligomer
aacccugacccaucucaga

SEQ ID NO: 30791 - RNA, 19 nt, artificial
  Oligomer
aagaaaccaaugacuuuaa

SEQ ID NO: 30792 - RNA, 19 nt, artificial
  Oligomer
gaaaaaauacaauuucuca

SEQ ID NO: 30793 - RNA, 19 nt, artificial
  Oligomer
aacauuuuaugucacuaua

SEQ ID NO: 30794 - RNA, 19 nt, artificial
  Oligomer
gaggugauagugugguuua

SEQ ID NO: 30795 - RNA, 19 nt, artificial
  Oligomer
uaucuugaauguaauaaga

SEQ ID NO: 30796 - RNA, 19 nt, artificial
  Oligomer
gaaaaaaugcuuuauagca

SEQ ID NO: 30797 - RNA, 19 nt, artificial
  Oligomer
accagagugcugaaaccca

SEQ ID NO: 30798 - RNA, 19 nt, artificial
  Oligomer
gaaguucugaggaaaagca

SEQ ID NO: 30799 - RNA, 19 nt, artificial
  Oligomer
gagaaaaaauacaauuucu

SEQ ID NO: 30800 - RNA, 19 nt, artificial
  Oligomer
caugagaauugcagugauu

SEQ ID NO: 30801 - RNA, 19 nt, artificial
  Oligomer
ggaguugaauggugcauac

SEQ ID NO: 30802 - RNA, 19 nt, artificial
  Oligomer
uaaacaggcugauucugga

SEQ ID NO: 30803 - RNA, 19 nt, artificial
  Oligomer
ggaaagcgaggaguugaau

SEQ ID NO: 30804 - RNA, 19 nt, artificial
  Oligomer
guaaggaagaagauaaaca

SEQ ID NO: 30805 - RNA, 19 nt, artificial
  Oligomer
gaggucaauuaaaaggaga

SEQ ID NO: 30806 - RNA, 19 nt, artificial
  Oligomer
cccuuccaaguaaguccaa

SEQ ID NO: 30807 - RNA, 19 nt, artificial
  Oligomer
uagaagaaaugcaaacuau

SEQ ID NO: 30808 - RNA, 19 nt, artificial
  Oligomer
ucuauagaagaaaugcaaa

SEQ ID NO: 30809 - RNA, 19 nt, artificial
  Oligomer
caguuuauugguugaaugu

SEQ ID NO: 30810 - RNA, 19 nt, artificial
  Oligomer
cauuccgaugugauugaua

SEQ ID NO: 30811 - RNA, 19 nt, artificial
  Oligomer
aaaagcagcuuuacaacaa

SEQ ID NO: 30812 - RNA, 19 nt, artificial
  Oligomer
uggaugauauggaugauga

SEQ ID NO: 30813 - RNA, 19 nt, artificial
  Oligomer
gaaauuuauguagaagcaa

SEQ ID NO: 30814 - RNA, 19 nt, artificial
  Oligomer
caaguaaguccaacgaaag

SEQ ID NO: 30815 - RNA, 19 nt, artificial
  Oligomer
caagagacccuuccaagua

SEQ ID NO: 30816 - RNA, 19 nt, artificial
  Oligomer
uaucuauuugagucuggaa

SEQ ID NO: 30817 - RNA, 19 nt, artificial
  Oligomer
gauagucaggaacuuucca

SEQ ID NO: 30818 - RNA, 19 nt, artificial
  Oligomer
ugaugauguagaugacacu

SEQ ID NO: 30819 - RNA, 19 nt, artificial
  Oligomer
cacugaugauucucaccag

SEQ ID NO: 30820 - RNA, 19 nt, artificial
  Oligomer
cacuaccaugagaauugca

SEQ ID NO: 30821 - RNA, 19 nt, artificial
  Oligomer
gcuuuugccuccuaggcau

SEQ ID NO: 30822 - RNA, 19 nt, artificial
  Oligomer
cccacuuaaaaagagaaua

SEQ ID NO: 30823 - RNA, 19 nt, artificial
  Oligomer
ucaccauucugaugaaucu

SEQ ID NO: 30824 - RNA, 19 nt, artificial
  Oligomer
caacaaauacccagaugcu

SEQ ID NO: 30825 - RNA, 19 nt, artificial
  Oligomer
ucagaagcagaaucuccua

SEQ ID NO: 30826 - RNA, 19 nt, artificial
  Oligomer
uguccucugaagaaaccaa

SEQ ID NO: 30827 - RNA, 19 nt, artificial
  Oligomer
cagcauuuaaauucuggga

SEQ ID NO: 30828 - RNA, 19 nt, artificial
  Oligomer
uucuauagaagaaaugcaa

SEQ ID NO: 30829 - RNA, 19 nt, artificial
  Oligomer
gugucaauugcuuauuugu

SEQ ID NO: 30830 - RNA, 19 nt, artificial
  Oligomer
aaaaugcuuuauagcaaaa

SEQ ID NO: 30831 - RNA, 19 nt, artificial
  Oligomer
uguuauucucucaugaaua

SEQ ID NO: 30832 - RNA, 19 nt, artificial
  Oligomer
ucuuuuaucuugaauguaa

SEQ ID NO: 30833 - RNA, 19 nt, artificial
  Oligomer
aaaaugaaagagaacauga

SEQ ID NO: 30834 - RNA, 19 nt, artificial
  Oligomer
ugaaauuucguauuucuca

SEQ ID NO: 30835 - RNA, 19 nt, artificial
  Oligomer
cugacauccaguacccuga

SEQ ID NO: 30836 - RNA, 19 nt, artificial
  Oligomer
uauuucucaugaauuagau

SEQ ID NO: 30837 - RNA, 19 nt, artificial
  Oligomer
cauccaguacccugaugcu

SEQ ID NO: 30838 - RNA, 19 nt, artificial
  Oligomer
gcugauucuggaaguucug

SEQ ID NO: 30839 - RNA, 19 nt, artificial
  Oligomer
aaaaguaaggaagaagaua

SEQ ID NO: 30840 - RNA, 19 nt, artificial
  Oligomer
uggugugaauaaaucuuuu

SEQ ID NO: 30841 - RNA, 19 nt, artificial
  Oligomer
guguauauuuuguugugau

SEQ ID NO: 30842 - RNA, 19 nt, artificial
  Oligomer
caaugacuuuaaacaagag

SEQ ID NO: 30843 - RNA, 19 nt, artificial
  Oligomer
ugagucucaccauucugau

SEQ ID NO: 30844 - RNA, 19 nt, artificial
  Oligomer
uuuauagcaaaaugaaaga

SEQ ID NO: 30845 - RNA, 19 nt, artificial
  Oligomer
ugaugagucucaccauucu

SEQ ID NO: 30846 - RNA, 19 nt, artificial
  Oligomer
ccaugaccacauggaugau

SEQ ID NO: 30847 - RNA, 19 nt, artificial
  Oligomer
aaaacucacuaccaugaga

SEQ ID NO: 30848 - RNA, 19 nt, artificial
  Oligomer
guuugauaauuaguuuagu

SEQ ID NO: 30849 - RNA, 19 nt, artificial
  Oligomer
agcagcuuuacaacaaaua

SEQ ID NO: 30850 - RNA, 19 nt, artificial
  Oligomer
aacucacuaccaugagaau

SEQ ID NO: 30851 - RNA, 19 nt, artificial
  Oligomer
ccucugaagaaaccaauga

SEQ ID NO: 30852 - RNA, 19 nt, artificial
  Oligomer
agaaguuucgcagaccuga

SEQ ID NO: 30853 - RNA, 19 nt, artificial
  Oligomer
cuaaaagcuucaggguuau

SEQ ID NO: 30854 - RNA, 19 nt, artificial
  Oligomer
cgaacgacucugaugaugu

SEQ ID NO: 30855 - RNA, 19 nt, artificial
  Oligomer
ugaugaaucugaugaacug

SEQ ID NO: 30856 - RNA, 19 nt, artificial
  Oligomer
cagcaaccgaaguuuucac

SEQ ID NO: 30857 - RNA, 19 nt, artificial
  Oligomer
gaaggacaguuaugaaacg

SEQ ID NO: 30858 - RNA, 19 nt, artificial
  Oligomer
agcaaaaugaaagagaaca

SEQ ID NO: 30859 - RNA, 19 nt, artificial
  Oligomer
gcagaccugacauccagua

SEQ ID NO: 30860 - RNA, 19 nt, artificial
  Oligomer
ucauggaaacucccuguaa

SEQ ID NO: 30861 - RNA, 19 nt, artificial
  Oligomer
aucuucugaggucaauuaa

SEQ ID NO: 30862 - RNA, 19 nt, artificial
  Oligomer
augcuuuauagcaaaauga

SEQ ID NO: 30863 - RNA, 19 nt, artificial
  Oligomer
guuguccagcaauuaauaa

SEQ ID NO: 30864 - RNA, 19 nt, artificial
  Oligomer
cucaguuuauugguugaau

SEQ ID NO: 30865 - RNA, 19 nt, artificial
  Oligomer
cuaccaugagaauugcagu

SEQ ID NO: 30866 - RNA, 19 nt, artificial
  Oligomer
gugggaaggacaguuauga

SEQ ID NO: 30867 - RNA, 19 nt, artificial
  Oligomer
uggugucaauugcuuauuu

SEQ ID NO: 30868 - RNA, 19 nt, artificial
  Oligomer
guguuugauaauuaguuua

SEQ ID NO: 30869 - RNA, 19 nt, artificial
  Oligomer
guugaauggugcauacaag

SEQ ID NO: 30870 - RNA, 19 nt, artificial
  Oligomer
aagcagcuuuacaacaaau

SEQ ID NO: 30871 - RNA, 19 nt, artificial
  Oligomer
ugagucuggaaauaacuaa

SEQ ID NO: 30872 - RNA, 19 nt, artificial
  Oligomer
gugugaauaaaucuuuuau

SEQ ID NO: 30873 - RNA, 19 nt, artificial
  Oligomer
cugaugcuacagacgagga

SEQ ID NO: 30874 - RNA, 19 nt, artificial
  Oligomer
ugaagauaugcugguugua

SEQ ID NO: 30875 - RNA, 19 nt, artificial
  Oligomer
aggguuaugucuauguuca

SEQ ID NO: 30876 - RNA, 19 nt, artificial
  Oligomer
gaugaacuggucacugauu

SEQ ID NO: 30877 - RNA, 19 nt, artificial
  Oligomer
uauggacugaggucaaaau

SEQ ID NO: 30878 - RNA, 19 nt, artificial
  Oligomer
aagaaaaaaugcuuuauag

SEQ ID NO: 30879 - RNA, 19 nt, artificial
  Oligomer
ugacucgaacgacucugau

SEQ ID NO: 30880 - RNA, 19 nt, artificial
  Oligomer
aauacuuuuacccacuuaa

SEQ ID NO: 30881 - RNA, 19 nt, artificial
  Oligomer
auguagaagcaaacaaaau

SEQ ID NO: 30882 - RNA, 19 nt, artificial
  Oligomer
uacccacuuaaaaagagaa

SEQ ID NO: 30883 - RNA, 19 nt, artificial
  Oligomer
guucauucuauagaagaaa

SEQ ID NO: 30884 - RNA, 19 nt, artificial
  Oligomer
gaagcaaacaaaauacuuu

SEQ ID NO: 30885 - RNA, 19 nt, artificial
  Oligomer
aagauaaacaccugaaauu

SEQ ID NO: 30886 - RNA, 19 nt, artificial
  Oligomer
gcaucuucugaggucaauu

SEQ ID NO: 30887 - RNA, 19 nt, artificial
  Oligomer
cucaugaauagaaauuuau

SEQ ID NO: 30888 - RNA, 19 nt, artificial
  Oligomer
ccaugaagauaugcugguu

SEQ ID NO: 30889 - RNA, 19 nt, artificial
  Oligomer
uccaaguaaguccaacgaa

SEQ ID NO: 30890 - RNA, 19 nt, artificial
  Oligomer
aaacgagucagcuggauga

SEQ ID NO: 30891 - RNA, 19 nt, artificial
  Oligomer
ccgaaguuuucacuccagu

SEQ ID NO: 30892 - RNA, 19 nt, artificial
  Oligomer
uguuuuuuaaguuagugua

SEQ ID NO: 30893 - RNA, 19 nt, artificial
  Oligomer
ccaaugaugagagcaauga

SEQ ID NO: 30894 - RNA, 19 nt, artificial
  Oligomer
gucaauuaaaaggagaaaa

SEQ ID NO: 30895 - RNA, 19 nt, artificial
  Oligomer
uauucucucaugaauagaa

SEQ ID NO: 30896 - RNA, 19 nt, artificial
  Oligomer
cuuuauagcaaaaugaaag

SEQ ID NO: 30897 - RNA, 19 nt, artificial
  Oligomer
ugacauccaguacccugau

SEQ ID NO: 30898 - RNA, 19 nt, artificial
  Oligomer
aaaccaaugacuuuaaaca

SEQ ID NO: 30899 - RNA, 19 nt, artificial
  Oligomer
uccagcaauuaauaaaaca

SEQ ID NO: 30900 - RNA, 19 nt, artificial
  Oligomer
ggugucaauugcuuauuug

SEQ ID NO: 30901 - RNA, 19 nt, artificial
  Oligomer
ugaugaugaccauguggac

SEQ ID NO: 30902 - RNA, 19 nt, artificial
  Oligomer
uuuuuguggugugaauaaa

SEQ ID NO: 30903 - RNA, 19 nt, artificial
  Oligomer
acccugacccaucucagaa

SEQ ID NO: 30904 - RNA, 19 nt, artificial
  Oligomer
gaagaaaccaaugacuuua

SEQ ID NO: 30905 - RNA, 19 nt, artificial
  Oligomer
aaacaggcugauucuggaa

SEQ ID NO: 30906 - RNA, 19 nt, artificial
  Oligomer
guccucugaagaaaccaau

SEQ ID NO: 30907 - RNA, 19 nt, artificial
  Oligomer
aguuaaacaggcugauucu

SEQ ID NO: 30908 - RNA, 19 nt, artificial
  Oligomer
uuuauggacugaggucaaa

SEQ ID NO: 30909 - RNA, 19 nt, artificial
  Oligomer
acuaaaagcuucaggguua

SEQ ID NO: 30910 - RNA, 19 nt, artificial
  Oligomer
uuucguauuucucaugaau

SEQ ID NO: 30911 - RNA, 19 nt, artificial
  Oligomer
gcauuccgaugugauugau

SEQ ID NO: 30912 - RNA, 19 nt, artificial
  Oligomer
uuuuguggugugaauaaau

SEQ ID NO: 30913 - RNA, 19 nt, artificial
  Oligomer
caaugagcauuccgaugug

SEQ ID NO: 30914 - RNA, 19 nt, artificial
  Oligomer
agauaaacaccugaaauuu

SEQ ID NO: 30915 - RNA, 19 nt, artificial
  Oligomer
cugcagcagcauuuaaauu

SEQ ID NO: 30916 - RNA, 19 nt, artificial
  Oligomer
augucugcagcagcauuua

SEQ ID NO: 30917 - RNA, 19 nt, artificial
  Oligomer
ggaaaagcagcuuuacaac

SEQ ID NO: 30918 - RNA, 19 nt, artificial
  Oligomer
ugaugauucucaccagucu

SEQ ID NO: 30919 - RNA, 19 nt, artificial
  Oligomer
acucgaacgacucugauga

SEQ ID NO: 30920 - RNA, 19 nt, artificial
  Oligomer
ugcaaacuaucacuguauu

SEQ ID NO: 30921 - RNA, 19 nt, artificial
  Oligomer
accacauggaugauaugga

SEQ ID NO: 30922 - RNA, 19 nt, artificial
  Oligomer
uuauggacugaggucaaaa

SEQ ID NO: 30923 - RNA, 19 nt, artificial
  Oligomer
caugaauagaaauuuaugu

SEQ ID NO: 30924 - RNA, 19 nt, artificial
  Oligomer
aagaauuugguggugucaa

SEQ ID NO: 30925 - RNA, 19 nt, artificial
  Oligomer
ugaccagagugcugaaacc

SEQ ID NO: 30926 - RNA, 19 nt, artificial
  Oligomer
ugaacuggucacugauuuu

SEQ ID NO: 30927 - RNA, 19 nt, artificial
  Oligomer
cugaggucaauuaaaagga

SEQ ID NO: 30928 - RNA, 19 nt, artificial
  Oligomer
augcuucuuucucaguuua

SEQ ID NO: 30929 - RNA, 19 nt, artificial
  Oligomer
acaagcaguccagauuaua

SEQ ID NO: 30930 - RNA, 19 nt, artificial
  Oligomer
aucuugaauguaauaagaa

SEQ ID NO: 30931 - RNA, 19 nt, artificial
  Oligomer
caguccagauuauauaagc

SEQ ID NO: 30932 - RNA, 19 nt, artificial
  Oligomer
caggcugauucuggaaguu

SEQ ID NO: 30933 - RNA, 19 nt, artificial
  Oligomer
aaacucacuaccaugagaa

SEQ ID NO: 30934 - RNA, 19 nt, artificial
  Oligomer
acgacucugaugauguaga

SEQ ID NO: 30935 - RNA, 19 nt, artificial
  Oligomer
ugcuucuuucucaguuuau

SEQ ID NO: 30936 - RNA, 19 nt, artificial
  Oligomer
augaaagagaacaugaaau

SEQ ID NO: 30937 - RNA, 19 nt, artificial
  Oligomer
agcaaacaaaauacuuuua

SEQ ID NO: 30938 - RNA, 19 nt, artificial
  Oligomer
gucaauugcuuauuuguuu

SEQ ID NO: 30939 - RNA, 19 nt, artificial
  Oligomer
gaaaagcagcuuuacaaca

SEQ ID NO: 30940 - RNA, 19 nt, artificial
  Oligomer
acauggaaagcgaggaguu

SEQ ID NO: 30941 - RNA, 19 nt, artificial
  Oligomer
auuucucaugaauuagaua

SEQ ID NO: 30942 - RNA, 19 nt, artificial
  Oligomer
cagcagcauuuaaauucug

SEQ ID NO: 30943 - RNA, 19 nt, artificial
  Oligomer
gcuaaacccugacccaucu

SEQ ID NO: 30944 - RNA, 19 nt, artificial
  Oligomer
gauaauuaguuuaguuugu

SEQ ID NO: 30945 - RNA, 19 nt, artificial
  Oligomer
aaguuucgcagaccugaca

SEQ ID NO: 30946 - RNA, 19 nt, artificial
  Oligomer
cacuguauuuuaauauuug

SEQ ID NO: 30947 - RNA, 19 nt, artificial
  Oligomer
uuguccagcaauuaauaaa

SEQ ID NO: 30948 - RNA, 19 nt, artificial
  Oligomer
gcaaacuaucacuguauuu

SEQ ID NO: 30949 - RNA, 19 nt, artificial
  Oligomer
auagaagaaaugcaaacua

SEQ ID NO: 30950 - RNA, 19 nt, artificial
  Oligomer
aucuuuuuguggugugaau

SEQ ID NO: 30951 - RNA, 19 nt, artificial
  Oligomer
agaagcaaacaaaauacuu

SEQ ID NO: 30952 - RNA, 19 nt, artificial
  Oligomer
cccaucucagaagcagaau

SEQ ID NO: 30953 - RNA, 19 nt, artificial
  Oligomer
augaaaugcuucuuucuca

SEQ ID NO: 30954 - RNA, 19 nt, artificial
  Oligomer
uugcuuauuuguuuuccca

SEQ ID NO: 30955 - RNA, 19 nt, artificial
  Oligomer
ucacuuugcauuuagucaa

SEQ ID NO: 30956 - RNA, 19 nt, artificial
  Oligomer
gaugaccagagugcugaaa

SEQ ID NO: 30957 - RNA, 19 nt, artificial
  Oligomer
augaccacauggaugauau

SEQ ID NO: 30958 - RNA, 19 nt, artificial
  Oligomer
uccagauuauauaagcgga

SEQ ID NO: 30959 - RNA, 19 nt, artificial
  Oligomer
guuuuuuaaguuaguguau

SEQ ID NO: 30960 - RNA, 19 nt, artificial
  Oligomer
agaagaaaugcaaacuauc

SEQ ID NO: 30961 - RNA, 19 nt, artificial
  Oligomer
caccugaaauuucguauuu

SEQ ID NO: 30962 - RNA, 19 nt, artificial
  Oligomer
uuuguuauucucucaugaa

SEQ ID NO: 30963 - RNA, 19 nt, artificial
  Oligomer
aucuauuugagucuggaaa

SEQ ID NO: 30964 - RNA, 19 nt, artificial
  Oligomer
uagcaaaaugaaagagaac

SEQ ID NO: 30965 - RNA, 19 nt, artificial
  Oligomer
ucugaugauguagaugaca

SEQ ID NO: 30966 - RNA, 19 nt, artificial
  Oligomer
uucgcagaccugacaucca

SEQ ID NO: 30967 - RNA, 19 nt, artificial
  Oligomer
ccaguuaaacaggcugauu

SEQ ID NO: 30968 - RNA, 19 nt, artificial
  Oligomer
ugaccacauggaugauaug

SEQ ID NO: 30969 - RNA, 19 nt, artificial
  Oligomer
gaguugaauggugcauaca

SEQ ID NO: 30970 - RNA, 19 nt, artificial
  Oligomer
aaaucuaagaaguuucgca

SEQ ID NO: 30971 - RNA, 19 nt, artificial
  Oligomer
agugcaucuucugagguca

SEQ ID NO: 30972 - RNA, 19 nt, artificial
  Oligomer
augucuauguucauucuau

SEQ ID NO: 30973 - RNA, 19 nt, artificial
  Oligomer
uauagcaaaaugaaagaga

SEQ ID NO: 30974 - RNA, 19 nt, artificial
  Oligomer
augauauggaugaugaaga

SEQ ID NO: 30975 - RNA, 19 nt, artificial
  Oligomer
aggagaaaaaauacaauuu

SEQ ID NO: 30976 - RNA, 19 nt, artificial
  Oligomer
ucaccagucugaugagucu

SEQ ID NO: 30977 - RNA, 19 nt, artificial
  Oligomer
cgugggaaggacaguuaug

SEQ ID NO: 30978 - RNA, 19 nt, artificial
  Oligomer
gaaguuucgcagaccugac

SEQ ID NO: 30979 - RNA, 19 nt, artificial
  Oligomer
augcuacagacgaggacau

SEQ ID NO: 30980 - RNA, 19 nt, artificial
  Oligomer
aagcaaacaaaauacuuuu

SEQ ID NO: 30981 - RNA, 19 nt, artificial
  Oligomer
uaaggaagaagauaaacac

SEQ ID NO: 30982 - RNA, 19 nt, artificial
  Oligomer
ugucaauugcuuauuuguu

SEQ ID NO: 30983 - RNA, 19 nt, artificial
  Oligomer
acuuugcauuuagucaaaa

SEQ ID NO: 30984 - RNA, 19 nt, artificial
  Oligomer
gaauuugguggugucaauu

SEQ ID NO: 30985 - RNA, 19 nt, artificial
  Oligomer
auuuguuauucucucauga

SEQ ID NO: 30986 - RNA, 19 nt, artificial
  Oligomer
uuguuauucucucaugaau

SEQ ID NO: 30987 - RNA, 19 nt, artificial
  Oligomer
uuccaaagucagccgugaa

SEQ ID NO: 30988 - RNA, 19 nt, artificial
  Oligomer
aaugcuucuuucucaguuu

SEQ ID NO: 30989 - RNA, 19 nt, artificial
  Oligomer
cguauuucucaugaauuag

SEQ ID NO: 30990 - RNA, 19 nt, artificial
  Oligomer
gucagccgugaauuccaca

SEQ ID NO: 30991 - RNA, 19 nt, artificial
  Oligomer
ucugaugagucucaccauu

SEQ ID NO: 30992 - RNA, 19 nt, artificial
  Oligomer
acuaucacuguauuuuaau

SEQ ID NO: 30993 - RNA, 19 nt, artificial
  Oligomer
gcaauuaauaaaacauaac

SEQ ID NO: 30994 - RNA, 19 nt, artificial
  Oligomer
ugugguuuauggacugagg

SEQ ID NO: 30995 - RNA, 19 nt, artificial
  Oligomer
gagaauauaacauuuuaug

SEQ ID NO: 30996 - RNA, 19 nt, artificial
  Oligomer
guacccugaugcuacagac

SEQ ID NO: 30997 - RNA, 19 nt, artificial
  Oligomer
cugauucuggaaguucuga

SEQ ID NO: 30998 - RNA, 19 nt, artificial
  Oligomer
uaaacaagagacccuucca

SEQ ID NO: 30999 - RNA, 19 nt, artificial
  Oligomer
gaauugcagugauuugcuu

SEQ ID NO: 31000 - RNA, 19 nt, artificial
  Oligomer
uauuugagucuggaaauaa

SEQ ID NO: 31001 - RNA, 19 nt, artificial
  Oligomer
ucuauuugagucuggaaau

SEQ ID NO: 31002 - RNA, 19 nt, artificial
  Oligomer
uaaaaggagaaaaaauaca

SEQ ID NO: 31003 - RNA, 19 nt, artificial
  Oligomer
auggaaagcgaggaguuga

SEQ ID NO: 31004 - RNA, 19 nt, artificial
  Oligomer
gguuuauggacugagguca

SEQ ID NO: 31005 - RNA, 19 nt, artificial
  Oligomer
ugaagaaaccaaugacuuu

SEQ ID NO: 31006 - RNA, 19 nt, artificial
  Oligomer
cauugacucgaacgacucu

SEQ ID NO: 31007 - RNA, 19 nt, artificial
  Oligomer
uuccgaugugauugauagu

SEQ ID NO: 31008 - RNA, 19 nt, artificial
  Oligomer
uuacccacuuaaaaagaga

SEQ ID NO: 31009 - RNA, 19 nt, artificial
  Oligomer
cacuauaaucuuuuguuuu

SEQ ID NO: 31010 - RNA, 19 nt, artificial
  Oligomer
auuagauagugcaucuucu

SEQ ID NO: 31011 - RNA, 19 nt, artificial
  Oligomer
cucagaagcagaaucuccu

SEQ ID NO: 31012 - RNA, 19 nt, artificial
  Oligomer
gugaauaaaucuuuuaucu

SEQ ID NO: 31013 - RNA, 19 nt, artificial
  Oligomer
cauucugaugaaucugaug

SEQ ID NO: 31014 - RNA, 19 nt, artificial
  Oligomer
agaaaugcaaacuaucacu

SEQ ID NO: 31015 - RNA, 19 nt, artificial
  Oligomer
cuugaauguaauaagaauu

SEQ ID NO: 31016 - RNA, 19 nt, artificial
  Oligomer
gauuugcuuuugccuccua

SEQ ID NO: 31017 - RNA, 19 nt, artificial
  Oligomer
cagugauuugcuuuugccu

SEQ ID NO: 31018 - RNA, 19 nt, artificial
  Oligomer
agcauuccgaugugauuga

SEQ ID NO: 31019 - RNA, 19 nt, artificial
  Oligomer
aggaguugaauggugcaua

SEQ ID NO: 31020 - RNA, 19 nt, artificial
  Oligomer
aaggagaaaaaauacaauu

SEQ ID NO: 31021 - RNA, 19 nt, artificial
  Oligomer
uggaugaugaagaugauga

SEQ ID NO: 31022 - RNA, 19 nt, artificial
  Oligomer
acaagagacccuuccaagu

SEQ ID NO: 31023 - RNA, 19 nt, artificial
  Oligomer
auauggaugaugaagauga

SEQ ID NO: 31024 - RNA, 19 nt, artificial
  Oligomer
ucacuauaaucuuuuguuu

SEQ ID NO: 31025 - RNA, 19 nt, artificial
  Oligomer
agucaaaagaaaaaaugcu

SEQ ID NO: 31026 - RNA, 19 nt, artificial
  Oligomer
augcaaacuaucacuguau

SEQ ID NO: 31027 - RNA, 19 nt, artificial
  Oligomer
caaaaugaaagagaacaug

SEQ ID NO: 31028 - RNA, 19 nt, artificial
  Oligomer
uguauauuuuguugugauu

SEQ ID NO: 31029 - RNA, 19 nt, artificial
  Oligomer
cuuaaaaagagaauauaac

SEQ ID NO: 31030 - RNA, 19 nt, artificial
  Oligomer
uucucaguuuauugguuga

SEQ ID NO: 31031 - RNA, 19 nt, artificial
  Oligomer
uccaaagucagccgugaau

SEQ ID NO: 31032 - RNA, 19 nt, artificial
  Oligomer
uggacugaggucaaaaucu

SEQ ID NO: 31033 - RNA, 19 nt, artificial
  Oligomer
ugaggucaauuaaaaggag

SEQ ID NO: 31034 - RNA, 19 nt, artificial
  Oligomer
ucaggguuaugucuauguu

SEQ ID NO: 31035 - RNA, 19 nt, artificial
  Oligomer
guagaagcaaacaaaauac

SEQ ID NO: 31036 - RNA, 19 nt, artificial
  Oligomer
ugaaaugcuucuuucucag

SEQ ID NO: 31037 - RNA, 19 nt, artificial
  Oligomer
cugaacgcgccuucugauu

SEQ ID NO: 31038 - RNA, 19 nt, artificial
  Oligomer
acaugaaaugcuucuuucu

SEQ ID NO: 31039 - RNA, 19 nt, artificial
  Oligomer
cugacccaucucagaagca

SEQ ID NO: 31040 - RNA, 19 nt, artificial
  Oligomer
aaggacaguuaugaaacga

SEQ ID NO: 31041 - RNA, 19 nt, artificial
  Oligomer
ggacuccauugacucgaac

SEQ ID NO: 31042 - RNA, 19 nt, artificial
  Oligomer
gauagugcaucuucugagg

SEQ ID NO: 31043 - RNA, 19 nt, artificial
  Oligomer
acaguuaugaaacgaguca

SEQ ID NO: 31044 - RNA, 19 nt, artificial
  Oligomer
aaguuaguguauauuuugu

SEQ ID NO: 31045 - RNA, 19 nt, artificial
  Oligomer
ccaaagucagccgugaauu

SEQ ID NO: 31046 - RNA, 19 nt, artificial
  Oligomer
uacaauuucucacuuugca

SEQ ID NO: 31047 - RNA, 19 nt, artificial
  Oligomer
ccgaccaaggaaaacucac

SEQ ID NO: 31048 - RNA, 19 nt, artificial
  Oligomer
caucucagaagcagaaucu

SEQ ID NO: 31049 - RNA, 19 nt, artificial
  Oligomer
gaugaugaccauguggaca

SEQ ID NO: 31050 - RNA, 19 nt, artificial
  Oligomer
acauggaugauauggauga

SEQ ID NO: 31051 - RNA, 19 nt, artificial
  Oligomer
uaagaaguuucgcagaccu

SEQ ID NO: 31052 - RNA, 19 nt, artificial
  Oligomer
caaaauacuuuuacccacu

SEQ ID NO: 31053 - RNA, 19 nt, artificial
  Oligomer
uggaaguucugaggaaaag

SEQ ID NO: 31054 - RNA, 19 nt, artificial
  Oligomer
cgaggugauagugugguuu

SEQ ID NO: 31055 - RNA, 19 nt, artificial
  Oligomer
ugacacugaugauucucac

SEQ ID NO: 31056 - RNA, 19 nt, artificial
  Oligomer
aauauuuguuauucucuca

SEQ ID NO: 31057 - RNA, 19 nt, artificial
  Oligomer
ggagaaaaaauacaauuuc

SEQ ID NO: 31058 - RNA, 19 nt, artificial
  Oligomer
gaugucugcagcagcauuu

SEQ ID NO: 31059 - RNA, 19 nt, artificial
  Oligomer
cugaugauguagaugacac

SEQ ID NO: 31060 - RNA, 19 nt, artificial
  Oligomer
cauggaaagcgaggaguug

SEQ ID NO: 31061 - RNA, 19 nt, artificial
  Oligomer
ugcaucuucugaggucaau

SEQ ID NO: 31062 - RNA, 19 nt, artificial
  Oligomer
gagacccuuccaaguaagu

SEQ ID NO: 31063 - RNA, 19 nt, artificial
  Oligomer
gugguuuauggacugaggu

SEQ ID NO: 31064 - RNA, 19 nt, artificial
  Oligomer
uugagucuggaaauaacua

SEQ ID NO: 31065 - RNA, 19 nt, artificial
  Oligomer
aaacauaaccuuuuuuacu

SEQ ID NO: 31066 - RNA, 19 nt, artificial
  Oligomer
caaagucagccgugaauuc

SEQ ID NO: 31067 - RNA, 19 nt, artificial
  Oligomer
cucugaagaaaccaaugac

SEQ ID NO: 31068 - RNA, 19 nt, artificial
  Oligomer
aggacaguuaugaaacgag

SEQ ID NO: 31069 - RNA, 19 nt, artificial
  Oligomer
gaauuagauagugcaucuu

SEQ ID NO: 31070 - RNA, 19 nt, artificial
  Oligomer
aaagagaacaugaaaugcu

SEQ ID NO: 31071 - RNA, 19 nt, artificial
  Oligomer
ggaaggacaguuaugaaac

SEQ ID NO: 31072 - RNA, 19 nt, artificial
  Oligomer
guuuucccacgguugucca

SEQ ID NO: 31073 - RNA, 19 nt, artificial
  Oligomer
auucuauagaagaaaugca

SEQ ID NO: 31074 - RNA, 19 nt, artificial
  Oligomer
guguccucugaagaaacca

SEQ ID NO: 31075 - RNA, 19 nt, artificial
  Oligomer
auagucaggaacuuuccaa

SEQ ID NO: 31076 - RNA, 19 nt, artificial
  Oligomer
ugaauuagauagugcaucu

SEQ ID NO: 31077 - RNA, 19 nt, artificial
  Oligomer
agauaugcugguuguagac

SEQ ID NO: 31078 - RNA, 19 nt, artificial
  Oligomer
acucugaugauguagauga

SEQ ID NO: 31079 - RNA, 19 nt, artificial
  Oligomer
gguuaugucuauguucauu

SEQ ID NO: 31080 - RNA, 19 nt, artificial
  Oligomer
gugauagugugguuuaugg

SEQ ID NO: 31081 - RNA, 19 nt, artificial
  Oligomer
augagucucaccauucuga

SEQ ID NO: 31082 - RNA, 19 nt, artificial
  Oligomer
ugaggaaaagcagcuuuac

SEQ ID NO: 31083 - RNA, 19 nt, artificial
  Oligomer
gauguagaugacacugaug

SEQ ID NO: 31084 - RNA, 19 nt, artificial
  Oligomer
aaacaccugaaauuucgua

SEQ ID NO: 31085 - RNA, 19 nt, artificial
  Oligomer
gaacaugaaaugcuucuuu

SEQ ID NO: 31086 - RNA, 19 nt, artificial
  Oligomer
agucagccgugaauuccac

SEQ ID NO: 31087 - RNA, 19 nt, artificial
  Oligomer
aaaacauaaccuuuuuuac

SEQ ID NO: 31088 - RNA, 19 nt, artificial
  Oligomer
augaaacgagucagcugga

SEQ ID NO: 31089 - RNA, 19 nt, artificial
  Oligomer
aaugagcauuccgauguga

SEQ ID NO: 31090 - RNA, 19 nt, artificial
  Oligomer
cagcuuuacaacaaauacc

SEQ ID NO: 31091 - RNA, 19 nt, artificial
  Oligomer
ucagcuggaugaccagagu

SEQ ID NO: 31092 - RNA, 19 nt, artificial
  Oligomer
cuuugcauuuagucaaaag

SEQ ID NO: 31093 - RNA, 19 nt, artificial
  Oligomer
auuugagucuggaaauaac

SEQ ID NO: 31094 - RNA, 19 nt, artificial
  Oligomer
uuuauguagaagcaaacaa

SEQ ID NO: 31095 - RNA, 19 nt, artificial
  Oligomer
gugccauaccaguuaaaca

SEQ ID NO: 31096 - RNA, 19 nt, artificial
  Oligomer
uucaucauccauaucaucc

SEQ ID NO: 31097 - RNA, 19 nt, artificial
  Oligomer
uuucguuggacuuacuugg

SEQ ID NO: 31098 - RNA, 19 nt, artificial
  Oligomer
uucagcacucuggucaucc

SEQ ID NO: 31099 - RNA, 19 nt, artificial
  Oligomer
uuagauuuugaccucaguc

SEQ ID NO: 31100 - RNA, 19 nt, artificial
  Oligomer
aucaucaucuucaucaucc

SEQ ID NO: 31101 - RNA, 19 nt, artificial
  Oligomer
uuucauuuugcuauaaagc

SEQ ID NO: 31102 - RNA, 19 nt, artificial
  Oligomer
uacaucaucagagucguuc

SEQ ID NO: 31103 - RNA, 19 nt, artificial
  Oligomer
uuuacagggaguuuccaug

SEQ ID NO: 31104 - RNA, 19 nt, artificial
  Oligomer
uucucuuucauuuugcuau

SEQ ID NO: 31105 - RNA, 19 nt, artificial
  Oligomer
uucauguucucuuucauuu

SEQ ID NO: 31106 - RNA, 19 nt, artificial
  Oligomer
uagauuuugaccucagucc

SEQ ID NO: 31107 - RNA, 19 nt, artificial
  Oligomer
uuuaucuucuuccuuacuu

SEQ ID NO: 31108 - RNA, 19 nt, artificial
  Oligomer
aucuacaucaucagagucg

SEQ ID NO: 31109 - RNA, 19 nt, artificial
  Oligomer
uuuucuuuugacuaaaugc

SEQ ID NO: 31110 - RNA, 19 nt, artificial
  Oligomer
uauuaauugcuggacaacc

SEQ ID NO: 31111 - RNA, 19 nt, artificial
  Oligomer
aucagugucaucuacauca

SEQ ID NO: 31112 - RNA, 19 nt, artificial
  Oligomer
uuaguuuacagggaguuuc

SEQ ID NO: 31113 - RNA, 19 nt, artificial
  Oligomer
auggucaucaucaucuuca

SEQ ID NO: 31114 - RNA, 19 nt, artificial
  Oligomer
uuucagguguuuaucuucu

SEQ ID NO: 31115 - RNA, 19 nt, artificial
  Oligomer
uucaucagaauggugagac

SEQ ID NO: 31116 - RNA, 19 nt, artificial
  Oligomer
uguagcaucaggguacugg

SEQ ID NO: 31117 - RNA, 19 nt, artificial
  Oligomer
uuucauguucucuuucauu

SEQ ID NO: 31118 - RNA, 19 nt, artificial
  Oligomer
uucuauagaaugaacauag

SEQ ID NO: 31119 - RNA, 19 nt, artificial
  Oligomer
uguggguuucagcacucug

SEQ ID NO: 31120 - RNA, 19 nt, artificial
  Oligomer
uuuuaauugaccucagaag

SEQ ID NO: 31121 - RNA, 19 nt, artificial
  Oligomer
uuuuucuuuugacuaaaug

SEQ ID NO: 31122 - RNA, 19 nt, artificial
  Oligomer
auccauaucauccaugugg

SEQ ID NO: 31123 - RNA, 19 nt, artificial
  Oligomer
uuuuuucuccuuuuaauug

SEQ ID NO: 31124 - RNA, 19 nt, artificial
  Oligomer
aucaucuucaucauccaua

SEQ ID NO: 31125 - RNA, 19 nt, artificial
  Oligomer
uuuuccucagaacuuccag

SEQ ID NO: 31126 - RNA, 19 nt, artificial
  Oligomer
ugguagugaguuuuccuug

SEQ ID NO: 31127 - RNA, 19 nt, artificial
  Oligomer
aucacugcaauucucaugg

SEQ ID NO: 31128 - RNA, 19 nt, artificial
  Oligomer
uuaaaauacagugauaguu

SEQ ID NO: 31129 - RNA, 19 nt, artificial
  Oligomer
auguucucuuucauuuugc

SEQ ID NO: 31130 - RNA, 19 nt, artificial
  Oligomer
uucauuuugcuauaaagca

SEQ ID NO: 31131 - RNA, 19 nt, artificial
  Oligomer
uucaacuccucgcuuucca

SEQ ID NO: 31132 - RNA, 19 nt, artificial
  Oligomer
uuauauaaucuggacugcu

SEQ ID NO: 31133 - RNA, 19 nt, artificial
  Oligomer
aucuucaucauccauauca

SEQ ID NO: 31134 - RNA, 19 nt, artificial
  Oligomer
uucauaacuguccuuccca

SEQ ID NO: 31135 - RNA, 19 nt, artificial
  Oligomer
auuaauugcuggacaaccg

SEQ ID NO: 31136 - RNA, 19 nt, artificial
  Oligomer
uuuaaaugcugcugcagac

SEQ ID NO: 31137 - RNA, 19 nt, artificial
  Oligomer
aucggaaugcucauugcuc

SEQ ID NO: 31138 - RNA, 19 nt, artificial
  Oligomer
cugacuaucaaucacaucg

SEQ ID NO: 31139 - RNA, 19 nt, artificial
  Oligomer
aucagauucaucagaaugg

SEQ ID NO: 31140 - RNA, 19 nt, artificial
  Oligomer
uuucauaacuguccuuccc

SEQ ID NO: 31141 - RNA, 19 nt, artificial
  Oligomer
uuucuuuugacuaaaugca

SEQ ID NO: 31142 - RNA, 19 nt, artificial
  Oligomer
uauguuuuauuaauugcug

SEQ ID NO: 31143 - RNA, 19 nt, artificial
  Oligomer
uuuguuguaaagcugcuuu

SEQ ID NO: 31144 - RNA, 19 nt, artificial
  Oligomer
uuugacuaaaugcaaagug

SEQ ID NO: 31145 - RNA, 19 nt, artificial
  Oligomer
uguaaagcugcuuuuccuc

SEQ ID NO: 31146 - RNA, 19 nt, artificial
  Oligomer
uuccugacuaucaaucaca

SEQ ID NO: 31147 - RNA, 19 nt, artificial
  Oligomer
uauuaaaauacagugauag

SEQ ID NO: 31148 - RNA, 19 nt, artificial
  Oligomer
ucugcuucugagauggguc

SEQ ID NO: 31149 - RNA, 19 nt, artificial
  Oligomer
ugauaguuugcauuucuuc

SEQ ID NO: 31150 - RNA, 19 nt, artificial
  Oligomer
ugaaaacuucgguugcugg

SEQ ID NO: 31151 - RNA, 19 nt, artificial
  Oligomer
auuauagugacauaaaaug

SEQ ID NO: 31152 - RNA, 19 nt, artificial
  Oligomer
acucguuucauaacugucc

SEQ ID NO: 31153 - RNA, 19 nt, artificial
  Oligomer
ugcaccauucaacuccucg

SEQ ID NO: 31154 - RNA, 19 nt, artificial
  Oligomer
uucgagucaauggaguccu

SEQ ID NO: 31155 - RNA, 19 nt, artificial
  Oligomer
uuuuguuugcuucuacaua

SEQ ID NO: 31156 - RNA, 19 nt, artificial
  Oligomer
uuuaaagucauugguuucu

SEQ ID NO: 31157 - RNA, 19 nt, artificial
  Oligomer
agaacuuccagaaucagcc

SEQ ID NO: 31158 - RNA, 19 nt, artificial
  Oligomer
ucuucuuccuuacuuuugg

SEQ ID NO: 31159 - RNA, 19 nt, artificial
  Oligomer
uaauucaugagaaauacga

SEQ ID NO: 31160 - RNA, 19 nt, artificial
  Oligomer
augaacauagacauaaccc

SEQ ID NO: 31161 - RNA, 19 nt, artificial
  Oligomer
uauauaaucuggacugcuu

SEQ ID NO: 31162 - RNA, 19 nt, artificial
  Oligomer
uuccgcuuauauaaucugg

SEQ ID NO: 31163 - RNA, 19 nt, artificial
  Oligomer
auuucagguguuuaucuuc

SEQ ID NO: 31164 - RNA, 19 nt, artificial
  Oligomer
uuuaauugaccucagaaga

SEQ ID NO: 31165 - RNA, 19 nt, artificial
  Oligomer
aucuucuuccuuacuuuug

SEQ ID NO: 31166 - RNA, 19 nt, artificial
  Oligomer
uauagaaugaacauagaca

SEQ ID NO: 31167 - RNA, 19 nt, artificial
  Oligomer
uuuuccuuggucggcguuu

SEQ ID NO: 31168 - RNA, 19 nt, artificial
  Oligomer
uaaaauacagugauaguuu

SEQ ID NO: 31169 - RNA, 19 nt, artificial
  Oligomer
aagcauuucauguucucuu

SEQ ID NO: 31170 - RNA, 19 nt, artificial
  Oligomer
uugaccucaguccauaaac

SEQ ID NO: 31171 - RNA, 19 nt, artificial
  Oligomer
augguagugaguuuuccuu

SEQ ID NO: 31172 - RNA, 19 nt, artificial
  Oligomer
auugacaccaccaaauucu

SEQ ID NO: 31173 - RNA, 19 nt, artificial
  Oligomer
uuguaaagcugcuuuuccu

SEQ ID NO: 31174 - RNA, 19 nt, artificial
  Oligomer
uuguaugcaccauucaacu

SEQ ID NO: 31175 - RNA, 19 nt, artificial
  Oligomer
uuugcuauaaagcauuuuu

SEQ ID NO: 31176 - RNA, 19 nt, artificial
  Oligomer
auauaaucuggacugcuug

SEQ ID NO: 31177 - RNA, 19 nt, artificial
  Oligomer
auagacauaacccugaagc

SEQ ID NO: 31178 - RNA, 19 nt, artificial
  Oligomer
agaauuuaaaugcugcugc

SEQ ID NO: 31179 - RNA, 19 nt, artificial
  Oligomer
uuuccuuggucggcguuug

SEQ ID NO: 31180 - RNA, 19 nt, artificial
  Oligomer
uuuguuugcuucuacauaa

SEQ ID NO: 31181 - RNA, 19 nt, artificial
  Oligomer
auaaaccacacuaucaccu

SEQ ID NO: 31182 - RNA, 19 nt, artificial
  Oligomer
augcacuaucuaauucaug

SEQ ID NO: 31183 - RNA, 19 nt, artificial
  Oligomer
uuacuuggaagggucucuu

SEQ ID NO: 31184 - RNA, 19 nt, artificial
  Oligomer
uuucuccuuuuaauugacc

SEQ ID NO: 31185 - RNA, 19 nt, artificial
  Oligomer
uucuucuauagaaugaaca

SEQ ID NO: 31186 - RNA, 19 nt, artificial
  Oligomer
uugaccucagaagaugcac

SEQ ID NO: 31187 - RNA, 19 nt, artificial
  Oligomer
aucagugaccaguucauca

SEQ ID NO: 31188 - RNA, 19 nt, artificial
  Oligomer
aauaaacugagaaagaagc

SEQ ID NO: 31189 - RNA, 19 nt, artificial
  Oligomer
gucaucaucaucuucauca

SEQ ID NO: 31190 - RNA, 19 nt, artificial
  Oligomer
uuaucuucuuccuuacuuu

SEQ ID NO: 31191 - RNA, 19 nt, artificial
  Oligomer
uuguuuaaagucauugguu

SEQ ID NO: 31192 - RNA, 19 nt, artificial
  Oligomer
uauauucucuuuuuaagug

SEQ ID NO: 31193 - RNA, 19 nt, artificial
  Oligomer
uuuuauuaauugcuggaca

SEQ ID NO: 31194 - RNA, 19 nt, artificial
  Oligomer
ugacuuuggaaaguuccug

SEQ ID NO: 31195 - RNA, 19 nt, artificial
  Oligomer
auaacuguccuucccacgg

SEQ ID NO: 31196 - RNA, 19 nt, artificial
  Oligomer
auaagcaauugacaccacc

SEQ ID NO: 31197 - RNA, 19 nt, artificial
  Oligomer
uucugcuucugagaugggu

SEQ ID NO: 31198 - RNA, 19 nt, artificial
  Oligomer
uucaucagauucaucagaa

SEQ ID NO: 31199 - RNA, 19 nt, artificial
  Oligomer
aucaucagugucaucuaca

SEQ ID NO: 31200 - RNA, 19 nt, artificial
  Oligomer
agugaguuuuccuuggucg

SEQ ID NO: 31201 - RNA, 19 nt, artificial
  Oligomer
uaaauuucuauucaugaga

SEQ ID NO: 31202 - RNA, 19 nt, artificial
  Oligomer
uuaauugcuggacaaccgu

SEQ ID NO: 31203 - RNA, 19 nt, artificial
  Oligomer
uuauagugacauaaaaugu

SEQ ID NO: 31204 - RNA, 19 nt, artificial
  Oligomer
auuuaaaugcugcugcaga

SEQ ID NO: 31205 - RNA, 19 nt, artificial
  Oligomer
cucauugcucucaucauug

SEQ ID NO: 31206 - RNA, 19 nt, artificial
  Oligomer
aauugcuggacaaccgugg

SEQ ID NO: 31207 - RNA, 19 nt, artificial
  Oligomer
ucuacaaccagcauaucuu

SEQ ID NO: 31208 - RNA, 19 nt, artificial
  Oligomer
ucagguguuuaucuucuuc

SEQ ID NO: 31209 - RNA, 19 nt, artificial
  Oligomer
uagugaguuuuccuugguc

SEQ ID NO: 31210 - RNA, 19 nt, artificial
  Oligomer
augagaaauacgaaauuuc

SEQ ID NO: 31211 - RNA, 19 nt, artificial
  Oligomer
uaauugcuggacaaccgug

SEQ ID NO: 31212 - RNA, 19 nt, artificial
  Oligomer
uaguuuacagggaguuucc

SEQ ID NO: 31213 - RNA, 19 nt, artificial
  Oligomer
uauuuuguuugcuucuaca

SEQ ID NO: 31214 - RNA, 19 nt, artificial
  Oligomer
ucuuguuuaaagucauugg

SEQ ID NO: 31215 - RNA, 19 nt, artificial
  Oligomer
uuugcuucuacauaaauuu

SEQ ID NO: 31216 - RNA, 19 nt, artificial
  Oligomer
uuuccucagaacuuccaga

SEQ ID NO: 31217 - RNA, 19 nt, artificial
  Oligomer
uuuccgcuuauauaaucug

SEQ ID NO: 31218 - RNA, 19 nt, artificial
  Oligomer
uuguauuuuuucuccuuuu

SEQ ID NO: 31219 - RNA, 19 nt, artificial
  Oligomer
gucaucuacaucaucagag

SEQ ID NO: 31220 - RNA, 19 nt, artificial
  Oligomer
uucuccuuuuaauugaccu

SEQ ID NO: 31221 - RNA, 19 nt, artificial
  Oligomer
aucauccauaucauccaug

SEQ ID NO: 31222 - RNA, 19 nt, artificial
  Oligomer
uaaagcugcuuuuccucag

SEQ ID NO: 31223 - RNA, 19 nt, artificial
  Oligomer
aacuucuuagauuuugacc

SEQ ID NO: 31224 - RNA, 19 nt, artificial
  Oligomer
uggaauucacggcugacuu

SEQ ID NO: 31225 - RNA, 19 nt, artificial
  Oligomer
uucuuagauuuugaccuca

SEQ ID NO: 31226 - RNA, 19 nt, artificial
  Oligomer
uacagugauaguuugcauu

SEQ ID NO: 31227 - RNA, 19 nt, artificial
  Oligomer
agaaucaucagugucaucu

SEQ ID NO: 31228 - RNA, 19 nt, artificial
  Oligomer
uggguauuuguuguaaagc

SEQ ID NO: 31229 - RNA, 19 nt, artificial
  Oligomer
ucagugaccaguucaucag

SEQ ID NO: 31230 - RNA, 19 nt, artificial
  Oligomer
ucuuagauuuugaccucag

SEQ ID NO: 31231 - RNA, 19 nt, artificial
  Oligomer
uugcuauaaagcauuuuuu

SEQ ID NO: 31232 - RNA, 19 nt, artificial
  Oligomer
auuacauucaagauaaaag

SEQ ID NO: 31233 - RNA, 19 nt, artificial
  Oligomer
uuaaaugcugcugcagaca

SEQ ID NO: 31234 - RNA, 19 nt, artificial
  Oligomer
ugaagcuuuuaguuuacag

SEQ ID NO: 31235 - RNA, 19 nt, artificial
  Oligomer
aaguuccugacuaucaauc

SEQ ID NO: 31236 - RNA, 19 nt, artificial
  Oligomer
uuuuaguuuacagggaguu

SEQ ID NO: 31237 - RNA, 19 nt, artificial
  Oligomer
augcucauugcucucauca

SEQ ID NO: 31238 - RNA, 19 nt, artificial
  Oligomer
ugugaggugauguccucgu

SEQ ID NO: 31239 - RNA, 19 nt, artificial
  Oligomer
aucaucagagucguucgag

SEQ ID NO: 31240 - RNA, 19 nt, artificial
  Oligomer
aaucacaucggaaugcuca

SEQ ID NO: 31241 - RNA, 19 nt, artificial
  Oligomer
aaugcugcugcagacaucc

SEQ ID NO: 31242 - RNA, 19 nt, artificial
  Oligomer
auucuuauuacauucaaga

SEQ ID NO: 31243 - RNA, 19 nt, artificial
  Oligomer
uuuggaaaguuccugacua

SEQ ID NO: 31244 - RNA, 19 nt, artificial
  Oligomer
auauucucuuuuuaagugg

SEQ ID NO: 31245 - RNA, 19 nt, artificial
  Oligomer
ugacuaucaaucacaucgg

SEQ ID NO: 31246 - RNA, 19 nt, artificial
  Oligomer
uggagugaaaacuucgguu

SEQ ID NO: 31247 - RNA, 19 nt, artificial
  Oligomer
uuauucacaccacaaaaag

SEQ ID NO: 31248 - RNA, 19 nt, artificial
  Oligomer
uaaucuggacugcuugugg

SEQ ID NO: 31249 - RNA, 19 nt, artificial
  Oligomer
uucaugagaaauacgaaau

SEQ ID NO: 31250 - RNA, 19 nt, artificial
  Oligomer
uuuaaguggguaaaaguau

SEQ ID NO: 31251 - RNA, 19 nt, artificial
  Oligomer
aacuggagugaaaacuucg

SEQ ID NO: 31252 - RNA, 19 nt, artificial
  Oligomer
agaaauacgaaauuucagg

SEQ ID NO: 31253 - RNA, 19 nt, artificial
  Oligomer
ugcacuaucuaauucauga

SEQ ID NO: 31254 - RNA, 19 nt, artificial
  Oligomer
ugaggugauguccucgucu

SEQ ID NO: 31255 - RNA, 19 nt, artificial
  Oligomer
uuuuucuccuuuuaauuga

SEQ ID NO: 31256 - RNA, 19 nt, artificial
  Oligomer
uauuuccagacucaaauag

SEQ ID NO: 31257 - RNA, 19 nt, artificial
  Oligomer
ucggaaugcucauugcucu

SEQ ID NO: 31258 - RNA, 19 nt, artificial
  Oligomer
uuuuuaaguggguaaaagu

SEQ ID NO: 31259 - RNA, 19 nt, artificial
  Oligomer
ucuacauaaauuucuauuc

SEQ ID NO: 31260 - RNA, 19 nt, artificial
  Oligomer
uaauugaccucagaagaug

SEQ ID NO: 31261 - RNA, 19 nt, artificial
  Oligomer
ugcuucuacauaaauuucu

SEQ ID NO: 31262 - RNA, 19 nt, artificial
  Oligomer
acuucuuagauuuugaccu

SEQ ID NO: 31263 - RNA, 19 nt, artificial
  Oligomer
uuuuaaguggguaaaagua

SEQ ID NO: 31264 - RNA, 19 nt, artificial
  Oligomer
ucuaauucaugagaaauac

SEQ ID NO: 31265 - RNA, 19 nt, artificial
  Oligomer
ugaguuuuccuuggucggc

SEQ ID NO: 31266 - RNA, 19 nt, artificial
  Oligomer
uaaagcauuuuuucuuuug

SEQ ID NO: 31267 - RNA, 19 nt, artificial
  Oligomer
uaagcaauugacaccacca

SEQ ID NO: 31268 - RNA, 19 nt, artificial
  Oligomer
uccagacucaaauagauac

SEQ ID NO: 31269 - RNA, 19 nt, artificial
  Oligomer
auggugagacucaucagac

SEQ ID NO: 31270 - RNA, 19 nt, artificial
  Oligomer
uucagguguuuaucuucuu

SEQ ID NO: 31271 - RNA, 19 nt, artificial
  Oligomer
cagguguuuaucuucuucc

SEQ ID NO: 31272 - RNA, 19 nt, artificial
  Oligomer
auguuuuauuaauugcugg

SEQ ID NO: 31273 - RNA, 19 nt, artificial
  Oligomer
uuccucagaacuuccagaa

SEQ ID NO: 31274 - RNA, 19 nt, artificial
  Oligomer
uucuuuugacuaaaugcaa

SEQ ID NO: 31275 - RNA, 19 nt, artificial
  Oligomer
guauuuguuguaaagcugc

SEQ ID NO: 31276 - RNA, 19 nt, artificial
  Oligomer
uuucuauucaugagagaau

SEQ ID NO: 31277 - RNA, 19 nt, artificial
  Oligomer
cacauggucaucaucaucu

SEQ ID NO: 31278 - RNA, 19 nt, artificial
  Oligomer
uuggaagggucucuuguuu

SEQ ID NO: 31279 - RNA, 19 nt, artificial
  Oligomer
uccauaaaccacacuauca

SEQ ID NO: 31280 - RNA, 19 nt, artificial
  Oligomer
auuguauuuuuucuccuuu

SEQ ID NO: 31281 - RNA, 19 nt, artificial
  Oligomer
aaccacacuaucaccucgg

SEQ ID NO: 31282 - RNA, 19 nt, artificial
  Oligomer
auaaucuggacugcuugug

SEQ ID NO: 31283 - RNA, 19 nt, artificial
  Oligomer
uaaaagauuuauucacacc

SEQ ID NO: 31284 - RNA, 19 nt, artificial
  Oligomer
auuaguuauuuccagacuc

SEQ ID NO: 31285 - RNA, 19 nt, artificial
  Oligomer
ugaccaguucaucagauuc

SEQ ID NO: 31286 - RNA, 19 nt, artificial
  Oligomer
aagcuuuuaguuuacaggg

SEQ ID NO: 31287 - RNA, 19 nt, artificial
  Oligomer
uuuaguuuacagggaguuu

SEQ ID NO: 31288 - RNA, 19 nt, artificial
  Oligomer
ucaugguagugaguuuucc

SEQ ID NO: 31289 - RNA, 19 nt, artificial
  Oligomer
uguccucgucuguagcauc

SEQ ID NO: 31290 - RNA, 19 nt, artificial
  Oligomer
ugauguccucgucuguagc

SEQ ID NO: 31291 - RNA, 19 nt, artificial
  Oligomer
ucugagaugggucaggguu

SEQ ID NO: 31292 - RNA, 19 nt, artificial
  Oligomer
uuaaagucauugguuucuu

SEQ ID NO: 31293 - RNA, 19 nt, artificial
  Oligomer
ugagaaauuguauuuuuuc

SEQ ID NO: 31294 - RNA, 19 nt, artificial
  Oligomer
uauagugacauaaaauguu

SEQ ID NO: 31295 - RNA, 19 nt, artificial
  Oligomer
uaaaccacacuaucaccuc

SEQ ID NO: 31296 - RNA, 19 nt, artificial
  Oligomer
ucuuauuacauucaagaua

SEQ ID NO: 31297 - RNA, 19 nt, artificial
  Oligomer
ugcuauaaagcauuuuuuc

SEQ ID NO: 31298 - RNA, 19 nt, artificial
  Oligomer
uggguuucagcacucuggu

SEQ ID NO: 31299 - RNA, 19 nt, artificial
  Oligomer
ugcuuuuccucagaacuuc

SEQ ID NO: 31300 - RNA, 19 nt, artificial
  Oligomer
agaaauuguauuuuuucuc

SEQ ID NO: 31301 - RNA, 19 nt, artificial
  Oligomer
aaucacugcaauucucaug

SEQ ID NO: 31302 - RNA, 19 nt, artificial
  Oligomer
guaugcaccauucaacucc

SEQ ID NO: 31303 - RNA, 19 nt, artificial
  Oligomer
uccagaaucagccuguuua

SEQ ID NO: 31304 - RNA, 19 nt, artificial
  Oligomer
auucaacuccucgcuuucc

SEQ ID NO: 31305 - RNA, 19 nt, artificial
  Oligomer
uguuuaucuucuuccuuac

SEQ ID NO: 31306 - RNA, 19 nt, artificial
  Oligomer
ucuccuuuuaauugaccuc

SEQ ID NO: 31307 - RNA, 19 nt, artificial
  Oligomer
uuggacuuacuuggaaggg

SEQ ID NO: 31308 - RNA, 19 nt, artificial
  Oligomer
auaguuugcauuucuucua

SEQ ID NO: 31309 - RNA, 19 nt, artificial
  Oligomer
uuugcauuucuucuauaga

SEQ ID NO: 31310 - RNA, 19 nt, artificial
  Oligomer
acauucaaccaauaaacug

SEQ ID NO: 31311 - RNA, 19 nt, artificial
  Oligomer
uaucaaucacaucggaaug

SEQ ID NO: 31312 - RNA, 19 nt, artificial
  Oligomer
uuguuguaaagcugcuuuu

SEQ ID NO: 31313 - RNA, 19 nt, artificial
  Oligomer
ucaucauccauaucaucca

SEQ ID NO: 31314 - RNA, 19 nt, artificial
  Oligomer
uugcuucuacauaaauuuc

SEQ ID NO: 31315 - RNA, 19 nt, artificial
  Oligomer
cuuucguuggacuuacuug

SEQ ID NO: 31316 - RNA, 19 nt, artificial
  Oligomer
uacuuggaagggucucuug

SEQ ID NO: 31317 - RNA, 19 nt, artificial
  Oligomer
uuccagacucaaauagaua

SEQ ID NO: 31318 - RNA, 19 nt, artificial
  Oligomer
uggaaaguuccugacuauc

SEQ ID NO: 31319 - RNA, 19 nt, artificial
  Oligomer
agugucaucuacaucauca

SEQ ID NO: 31320 - RNA, 19 nt, artificial
  Oligomer
cuggugagaaucaucagug

SEQ ID NO: 31321 - RNA, 19 nt, artificial
  Oligomer
ugcaauucucaugguagug

SEQ ID NO: 31322 - RNA, 19 nt, artificial
  Oligomer
augccuaggaggcaaaagc

SEQ ID NO: 31323 - RNA, 19 nt, artificial
  Oligomer
uauucucuuuuuaaguggg

SEQ ID NO: 31324 - RNA, 19 nt, artificial
  Oligomer
agauucaucagaaugguga

SEQ ID NO: 31325 - RNA, 19 nt, artificial
  Oligomer
agcaucuggguauuuguug

SEQ ID NO: 31326 - RNA, 19 nt, artificial
  Oligomer
uaggagauucugcuucuga

SEQ ID NO: 31327 - RNA, 19 nt, artificial
  Oligomer
uugguuucuucagaggaca

SEQ ID NO: 31328 - RNA, 19 nt, artificial
  Oligomer
ucccagaauuuaaaugcug

SEQ ID NO: 31329 - RNA, 19 nt, artificial
  Oligomer
uugcauuucuucuauagaa

SEQ ID NO: 31330 - RNA, 19 nt, artificial
  Oligomer
acaaauaagcaauugacac

SEQ ID NO: 31331 - RNA, 19 nt, artificial
  Oligomer
uuuugcuauaaagcauuuu

SEQ ID NO: 31332 - RNA, 19 nt, artificial
  Oligomer
uauucaugagagaauaaca

SEQ ID NO: 31333 - RNA, 19 nt, artificial
  Oligomer
uuacauucaagauaaaaga

SEQ ID NO: 31334 - RNA, 19 nt, artificial
  Oligomer
ucauguucucuuucauuuu

SEQ ID NO: 31335 - RNA, 19 nt, artificial
  Oligomer
ugagaaauacgaaauuuca

SEQ ID NO: 31336 - RNA, 19 nt, artificial
  Oligomer
ucaggguacuggaugucag

SEQ ID NO: 31337 - RNA, 19 nt, artificial
  Oligomer
aucuaauucaugagaaaua

SEQ ID NO: 31338 - RNA, 19 nt, artificial
  Oligomer
agcaucaggguacuggaug

SEQ ID NO: 31339 - RNA, 19 nt, artificial
  Oligomer
cagaacuuccagaaucagc

SEQ ID NO: 31340 - RNA, 19 nt, artificial
  Oligomer
uaucuucuuccuuacuuuu

SEQ ID NO: 31341 - RNA, 19 nt, artificial
  Oligomer
aaaagauuuauucacacca

SEQ ID NO: 31342 - RNA, 19 nt, artificial
  Oligomer
aucacaacaaaauauacac

SEQ ID NO: 31343 - RNA, 19 nt, artificial
  Oligomer
cucuuguuuaaagucauug

SEQ ID NO: 31344 - RNA, 19 nt, artificial
  Oligomer
aucagaauggugagacuca

SEQ ID NO: 31345 - RNA, 19 nt, artificial
  Oligomer
ucuuucauuuugcuauaaa

SEQ ID NO: 31346 - RNA, 19 nt, artificial
  Oligomer
agaauggugagacucauca

SEQ ID NO: 31347 - RNA, 19 nt, artificial
  Oligomer
aucauccauguggucaugg

SEQ ID NO: 31348 - RNA, 19 nt, artificial
  Oligomer
ucucaugguagugaguuuu

SEQ ID NO: 31349 - RNA, 19 nt, artificial
  Oligomer
acuaaacuaauuaucaaac

SEQ ID NO: 31350 - RNA, 19 nt, artificial
  Oligomer
uauuuguuguaaagcugcu

SEQ ID NO: 31351 - RNA, 19 nt, artificial
  Oligomer
auucucaugguagugaguu

SEQ ID NO: 31352 - RNA, 19 nt, artificial
  Oligomer
ucauugguuucuucagagg

SEQ ID NO: 31353 - RNA, 19 nt, artificial
  Oligomer
ucaggucugcgaaacuucu

SEQ ID NO: 31354 - RNA, 19 nt, artificial
  Oligomer
auaacccugaagcuuuuag

SEQ ID NO: 31355 - RNA, 19 nt, artificial
  Oligomer
acaucaucagagucguucg

SEQ ID NO: 31356 - RNA, 19 nt, artificial
  Oligomer
caguucaucagauucauca

SEQ ID NO: 31357 - RNA, 19 nt, artificial
  Oligomer
gugaaaacuucgguugcug

SEQ ID NO: 31358 - RNA, 19 nt, artificial
  Oligomer
cguuucauaacuguccuuc

SEQ ID NO: 31359 - RNA, 19 nt, artificial
  Oligomer
uguucucuuucauuuugcu

SEQ ID NO: 31360 - RNA, 19 nt, artificial
  Oligomer
uacuggaugucaggucugc

SEQ ID NO: 31361 - RNA, 19 nt, artificial
  Oligomer
uuacagggaguuuccauga

SEQ ID NO: 31362 - RNA, 19 nt, artificial
  Oligomer
uuaauugaccucagaagau

SEQ ID NO: 31363 - RNA, 19 nt, artificial
  Oligomer
ucauuuugcuauaaagcau

SEQ ID NO: 31364 - RNA, 19 nt, artificial
  Oligomer
uuauuaauugcuggacaac

SEQ ID NO: 31365 - RNA, 19 nt, artificial
  Oligomer
auucaaccaauaaacugag

SEQ ID NO: 31366 - RNA, 19 nt, artificial
  Oligomer
acugcaauucucaugguag

SEQ ID NO: 31367 - RNA, 19 nt, artificial
  Oligomer
ucauaacuguccuucccac

SEQ ID NO: 31368 - RNA, 19 nt, artificial
  Oligomer
aaauaagcaauugacacca

SEQ ID NO: 31369 - RNA, 19 nt, artificial
  Oligomer
uaaacuaauuaucaaacac

SEQ ID NO: 31370 - RNA, 19 nt, artificial
  Oligomer
cuuguaugcaccauucaac

SEQ ID NO: 31371 - RNA, 19 nt, artificial
  Oligomer
auuuguuguaaagcugcuu

SEQ ID NO: 31372 - RNA, 19 nt, artificial
  Oligomer
uuaguuauuuccagacuca

SEQ ID NO: 31373 - RNA, 19 nt, artificial
  Oligomer
auaaaagauuuauucacac

SEQ ID NO: 31374 - RNA, 19 nt, artificial
  Oligomer
uccucgucuguagcaucag

SEQ ID NO: 31375 - RNA, 19 nt, artificial
  Oligomer
uacaaccagcauaucuuca

SEQ ID NO: 31376 - RNA, 19 nt, artificial
  Oligomer
ugaacauagacauaacccu

SEQ ID NO: 31377 - RNA, 19 nt, artificial
  Oligomer
aaucagugaccaguucauc

SEQ ID NO: 31378 - RNA, 19 nt, artificial
  Oligomer
auuuugaccucaguccaua

SEQ ID NO: 31379 - RNA, 19 nt, artificial
  Oligomer
cuauaaagcauuuuuucuu

SEQ ID NO: 31380 - RNA, 19 nt, artificial
  Oligomer
aucagagucguucgaguca

SEQ ID NO: 31381 - RNA, 19 nt, artificial
  Oligomer
uuaaguggguaaaaguauu

SEQ ID NO: 31382 - RNA, 19 nt, artificial
  Oligomer
auuuuguuugcuucuacau

SEQ ID NO: 31383 - RNA, 19 nt, artificial
  Oligomer
uucucuuuuuaagugggua

SEQ ID NO: 31384 - RNA, 19 nt, artificial
  Oligomer
uuucuucuauagaaugaac

SEQ ID NO: 31385 - RNA, 19 nt, artificial
  Oligomer
aaaguauuuuguuugcuuc

SEQ ID NO: 31386 - RNA, 19 nt, artificial
  Oligomer
aauuucagguguuuaucuu

SEQ ID NO: 31387 - RNA, 19 nt, artificial
  Oligomer
aauugaccucagaagaugc

SEQ ID NO: 31388 - RNA, 19 nt, artificial
  Oligomer
auaaauuucuauucaugag

SEQ ID NO: 31389 - RNA, 19 nt, artificial
  Oligomer
aaccagcauaucuucaugg

SEQ ID NO: 31390 - RNA, 19 nt, artificial
  Oligomer
uucguuggacuuacuugga

SEQ ID NO: 31391 - RNA, 19 nt, artificial
  Oligomer
ucauccagcugacucguuu

SEQ ID NO: 31392 - RNA, 19 nt, artificial
  Oligomer
acuggagugaaaacuucgg

SEQ ID NO: 31393 - RNA, 19 nt, artificial
  Oligomer
uacacuaacuuaaaaaaca

SEQ ID NO: 31394 - RNA, 19 nt, artificial
  Oligomer
ucauugcucucaucauugg

SEQ ID NO: 31395 - RNA, 19 nt, artificial
  Oligomer
uuuucuccuuuuaauugac

SEQ ID NO: 31396 - RNA, 19 nt, artificial
  Oligomer
uucuauucaugagagaaua

SEQ ID NO: 31397 - RNA, 19 nt, artificial
  Oligomer
cuuucauuuugcuauaaag

SEQ ID NO: 31398 - RNA, 19 nt, artificial
  Oligomer
aucaggguacuggauguca

SEQ ID NO: 31399 - RNA, 19 nt, artificial
  Oligomer
uguuuaaagucauugguuu

SEQ ID NO: 31400 - RNA, 19 nt, artificial
  Oligomer
uguuuuauuaauugcugga

SEQ ID NO: 31401 - RNA, 19 nt, artificial
  Oligomer
caaauaagcaauugacacc

SEQ ID NO: 31402 - RNA, 19 nt, artificial
  Oligomer
guccacauggucaucauca

SEQ ID NO: 31403 - RNA, 19 nt, artificial
  Oligomer
uuuauucacaccacaaaaa

SEQ ID NO: 31404 - RNA, 19 nt, artificial
  Oligomer
uucugagaugggucagggu

SEQ ID NO: 31405 - RNA, 19 nt, artificial
  Oligomer
uaaagucauugguuucuuc

SEQ ID NO: 31406 - RNA, 19 nt, artificial
  Oligomer
uuccagaaucagccuguuu

SEQ ID NO: 31407 - RNA, 19 nt, artificial
  Oligomer
auugguuucuucagaggac

SEQ ID NO: 31408 - RNA, 19 nt, artificial
  Oligomer
agaaucagccuguuuaacu

SEQ ID NO: 31409 - RNA, 19 nt, artificial
  Oligomer
uuugaccucaguccauaaa

SEQ ID NO: 31410 - RNA, 19 nt, artificial
  Oligomer
uaacccugaagcuuuuagu

SEQ ID NO: 31411 - RNA, 19 nt, artificial
  Oligomer
auucaugagaaauacgaaa

SEQ ID NO: 31412 - RNA, 19 nt, artificial
  Oligomer
aucaaucacaucggaaugc

SEQ ID NO: 31413 - RNA, 19 nt, artificial
  Oligomer
auuuauucacaccacaaaa

SEQ ID NO: 31414 - RNA, 19 nt, artificial
  Oligomer
cacaucggaaugcucauug

SEQ ID NO: 31415 - RNA, 19 nt, artificial
  Oligomer
aaauuucagguguuuaucu

SEQ ID NO: 31416 - RNA, 19 nt, artificial
  Oligomer
aauuuaaaugcugcugcag

SEQ ID NO: 31417 - RNA, 19 nt, artificial
  Oligomer
uaaaugcugcugcagacau

SEQ ID NO: 31418 - RNA, 19 nt, artificial
  Oligomer
guuguaaagcugcuuuucc

SEQ ID NO: 31419 - RNA, 19 nt, artificial
  Oligomer
agacuggugagaaucauca

SEQ ID NO: 31420 - RNA, 19 nt, artificial
  Oligomer
ucaucagagucguucgagu

SEQ ID NO: 31421 - RNA, 19 nt, artificial
  Oligomer
aauacagugauaguuugca

SEQ ID NO: 31422 - RNA, 19 nt, artificial
  Oligomer
uccauaucauccauguggu

SEQ ID NO: 31423 - RNA, 19 nt, artificial
  Oligomer
uuuugaccucaguccauaa

SEQ ID NO: 31424 - RNA, 19 nt, artificial
  Oligomer
acauaaauuucuauucaug

SEQ ID NO: 31425 - RNA, 19 nt, artificial
  Oligomer
uugacaccaccaaauucuu

SEQ ID NO: 31426 - RNA, 19 nt, artificial
  Oligomer
gguuucagcacucugguca

SEQ ID NO: 31427 - RNA, 19 nt, artificial
  Oligomer
aaaaucagugaccaguuca

SEQ ID NO: 31428 - RNA, 19 nt, artificial
  Oligomer
uccuuuuaauugaccucag

SEQ ID NO: 31429 - RNA, 19 nt, artificial
  Oligomer
uaaacugagaaagaagcau

SEQ ID NO: 31430 - RNA, 19 nt, artificial
  Oligomer
uauaaucuggacugcuugu

SEQ ID NO: 31431 - RNA, 19 nt, artificial
  Oligomer
uucuuauuacauucaagau

SEQ ID NO: 31432 - RNA, 19 nt, artificial
  Oligomer
gcuuauauaaucuggacug

SEQ ID NO: 31433 - RNA, 19 nt, artificial
  Oligomer
aacuuccagaaucagccug

SEQ ID NO: 31434 - RNA, 19 nt, artificial
  Oligomer
uucucaugguagugaguuu

SEQ ID NO: 31435 - RNA, 19 nt, artificial
  Oligomer
ucuacaucaucagagucgu

SEQ ID NO: 31436 - RNA, 19 nt, artificial
  Oligomer
auaaacugagaaagaagca

SEQ ID NO: 31437 - RNA, 19 nt, artificial
  Oligomer
auuucauguucucuuucau

SEQ ID NO: 31438 - RNA, 19 nt, artificial
  Oligomer
uaaaaguauuuuguuugcu

SEQ ID NO: 31439 - RNA, 19 nt, artificial
  Oligomer
aaacaaauaagcaauugac

SEQ ID NO: 31440 - RNA, 19 nt, artificial
  Oligomer
uguuguaaagcugcuuuuc

SEQ ID NO: 31441 - RNA, 19 nt, artificial
  Oligomer
aacuccucgcuuuccaugu

SEQ ID NO: 31442 - RNA, 19 nt, artificial
  Oligomer
uaucuaauucaugagaaau

SEQ ID NO: 31443 - RNA, 19 nt, artificial
  Oligomer
cagaauuuaaaugcugcug

SEQ ID NO: 31444 - RNA, 19 nt, artificial
  Oligomer
agaugggucaggguuuagc

SEQ ID NO: 31445 - RNA, 19 nt, artificial
  Oligomer
acaaacuaaacuaauuauc

SEQ ID NO: 31446 - RNA, 19 nt, artificial
  Oligomer
ugucaggucugcgaaacuu

SEQ ID NO: 31447 - RNA, 19 nt, artificial
  Oligomer
caaauauuaaaauacagug

SEQ ID NO: 31448 - RNA, 19 nt, artificial
  Oligomer
uuuauuaauugcuggacaa

SEQ ID NO: 31449 - RNA, 19 nt, artificial
  Oligomer
aaauacagugauaguuugc

SEQ ID NO: 31450 - RNA, 19 nt, artificial
  Oligomer
uaguuugcauuucuucuau

SEQ ID NO: 31451 - RNA, 19 nt, artificial
  Oligomer
auucacaccacaaaaagau

SEQ ID NO: 31452 - RNA, 19 nt, artificial
  Oligomer
aaguauuuuguuugcuucu

SEQ ID NO: 31453 - RNA, 19 nt, artificial
  Oligomer
auucugcuucugagauggg

SEQ ID NO: 31454 - RNA, 19 nt, artificial
  Oligomer
ugagaaagaagcauuucau

SEQ ID NO: 31455 - RNA, 19 nt, artificial
  Oligomer
ugggaaaacaaauaagcaa

SEQ ID NO: 31456 - RNA, 19 nt, artificial
  Oligomer
uugacuaaaugcaaaguga

SEQ ID NO: 31457 - RNA, 19 nt, artificial
  Oligomer
uuucagcacucuggucauc

SEQ ID NO: 31458 - RNA, 19 nt, artificial
  Oligomer
auaucauccauguggucau

SEQ ID NO: 31459 - RNA, 19 nt, artificial
  Oligomer
uccgcuuauauaaucugga

SEQ ID NO: 31460 - RNA, 19 nt, artificial
  Oligomer
auacacuaacuuaaaaaac

SEQ ID NO: 31461 - RNA, 19 nt, artificial
  Oligomer
gauaguuugcauuucuucu

SEQ ID NO: 31462 - RNA, 19 nt, artificial
  Oligomer
aaauacgaaauuucaggug

SEQ ID NO: 31463 - RNA, 19 nt, artificial
  Oligomer
uucaugagagaauaacaaa

SEQ ID NO: 31464 - RNA, 19 nt, artificial
  Oligomer
uuuccagacucaaauagau

SEQ ID NO: 31465 - RNA, 19 nt, artificial
  Oligomer
guucucuuucauuuugcua

SEQ ID NO: 31466 - RNA, 19 nt, artificial
  Oligomer
ugucaucuacaucaucaga

SEQ ID NO: 31467 - RNA, 19 nt, artificial
  Oligomer
uggaugucaggucugcgaa

SEQ ID NO: 31468 - RNA, 19 nt, artificial
  Oligomer
aaucagccuguuuaacugg

SEQ ID NO: 31469 - RNA, 19 nt, artificial
  Oligomer
cauaucauccaugugguca

SEQ ID NO: 31470 - RNA, 19 nt, artificial
  Oligomer
uguaugcaccauucaacuc

SEQ ID NO: 31471 - RNA, 19 nt, artificial
  Oligomer
ugcgaaacuucuuagauuu

SEQ ID NO: 31472 - RNA, 19 nt, artificial
  Oligomer
ugaccucagaagaugcacu

SEQ ID NO: 31473 - RNA, 19 nt, artificial
  Oligomer
auagaaugaacauagacau

SEQ ID NO: 31474 - RNA, 19 nt, artificial
  Oligomer
ucucuuucauuuugcuaua

SEQ ID NO: 31475 - RNA, 19 nt, artificial
  Oligomer
ucuucaucauccauaucau

SEQ ID NO: 31476 - RNA, 19 nt, artificial
  Oligomer
aaauuguauuuuuucuccu

SEQ ID NO: 31477 - RNA, 19 nt, artificial
  Oligomer
agacucaucagacugguga

SEQ ID NO: 31478 - RNA, 19 nt, artificial
  Oligomer
cauaacuguccuucccacg

SEQ ID NO: 31479 - RNA, 19 nt, artificial
  Oligomer
gucaggucugcgaaacuuc

SEQ ID NO: 31480 - RNA, 19 nt, artificial
  Oligomer
auguccucgucuguagcau

SEQ ID NO: 31481 - RNA, 19 nt, artificial
  Oligomer
aaaaguauuuuguuugcuu

SEQ ID NO: 31482 - RNA, 19 nt, artificial
  Oligomer
guguuuaucuucuuccuua

SEQ ID NO: 31483 - RNA, 19 nt, artificial
  Oligomer
aacaaauaagcaauugaca

SEQ ID NO: 31484 - RNA, 19 nt, artificial
  Oligomer
uuuugacuaaaugcaaagu

SEQ ID NO: 31485 - RNA, 19 nt, artificial
  Oligomer
aauugacaccaccaaauuc

SEQ ID NO: 31486 - RNA, 19 nt, artificial
  Oligomer
ucaugagagaauaacaaau

SEQ ID NO: 31487 - RNA, 19 nt, artificial
  Oligomer
auucaugagagaauaacaa

SEQ ID NO: 31488 - RNA, 19 nt, artificial
  Oligomer
uucacggcugacuuuggaa

SEQ ID NO: 31489 - RNA, 19 nt, artificial
  Oligomer
aaacugagaaagaagcauu

SEQ ID NO: 31490 - RNA, 19 nt, artificial
  Oligomer
cuaauucaugagaaauacg

SEQ ID NO: 31491 - RNA, 19 nt, artificial
  Oligomer
uguggaauucacggcugac

SEQ ID NO: 31492 - RNA, 19 nt, artificial
  Oligomer
aauggugagacucaucaga

SEQ ID NO: 31493 - RNA, 19 nt, artificial
  Oligomer
auuaaaauacagugauagu

SEQ ID NO: 31494 - RNA, 19 nt, artificial
  Oligomer
guuauguuuuauuaauugc

SEQ ID NO: 31495 - RNA, 19 nt, artificial
  Oligomer
ccucaguccauaaaccaca

SEQ ID NO: 31496 - RNA, 19 nt, artificial
  Oligomer
cauaaaauguuauauucuc

SEQ ID NO: 31497 - RNA, 19 nt, artificial
  Oligomer
gucuguagcaucaggguac

SEQ ID NO: 31498 - RNA, 19 nt, artificial
  Oligomer
ucagaacuuccagaaucag

SEQ ID NO: 31499 - RNA, 19 nt, artificial
  Oligomer
uggaagggucucuuguuua

SEQ ID NO: 31500 - RNA, 19 nt, artificial
  Oligomer
aagcaaaucacugcaauuc

SEQ ID NO: 31501 - RNA, 19 nt, artificial
  Oligomer
uuauuuccagacucaaaua

SEQ ID NO: 31502 - RNA, 19 nt, artificial
  Oligomer
auuuccagacucaaauaga

SEQ ID NO: 31503 - RNA, 19 nt, artificial
  Oligomer
uguauuuuuucuccuuuua

SEQ ID NO: 31504 - RNA, 19 nt, artificial
  Oligomer
ucaacuccucgcuuuccau

SEQ ID NO: 31505 - RNA, 19 nt, artificial
  Oligomer
ugaccucaguccauaaacc

SEQ ID NO: 31506 - RNA, 19 nt, artificial
  Oligomer
aaagucauugguuucuuca

SEQ ID NO: 31507 - RNA, 19 nt, artificial
  Oligomer
agagucguucgagucaaug

SEQ ID NO: 31508 - RNA, 19 nt, artificial
  Oligomer
acuaucaaucacaucggaa

SEQ ID NO: 31509 - RNA, 19 nt, artificial
  Oligomer
ucucuuuuuaaguggguaa

SEQ ID NO: 31510 - RNA, 19 nt, artificial
  Oligomer
aaaacaaaagauuauagug

SEQ ID NO: 31511 - RNA, 19 nt, artificial
  Oligomer
agaagaugcacuaucuaau

SEQ ID NO: 31512 - RNA, 19 nt, artificial
  Oligomer
aggagauucugcuucugag

SEQ ID NO: 31513 - RNA, 19 nt, artificial
  Oligomer
agauaaaagauuuauucac

SEQ ID NO: 31514 - RNA, 19 nt, artificial
  Oligomer
caucagauucaucagaaug

SEQ ID NO: 31515 - RNA, 19 nt, artificial
  Oligomer
agugauaguuugcauuucu

SEQ ID NO: 31516 - RNA, 19 nt, artificial
  Oligomer
aauucuuauuacauucaag

SEQ ID NO: 31517 - RNA, 19 nt, artificial
  Oligomer
uaggaggcaaaagcaaauc

SEQ ID NO: 31518 - RNA, 19 nt, artificial
  Oligomer
aggcaaaagcaaaucacug

SEQ ID NO: 31519 - RNA, 19 nt, artificial
  Oligomer
ucaaucacaucggaaugcu

SEQ ID NO: 31520 - RNA, 19 nt, artificial
  Oligomer
uaugcaccauucaacuccu

SEQ ID NO: 31521 - RNA, 19 nt, artificial
  Oligomer
aauuguauuuuuucuccuu

SEQ ID NO: 31522 - RNA, 19 nt, artificial
  Oligomer
ucaucaucuucaucaucca

SEQ ID NO: 31523 - RNA, 19 nt, artificial
  Oligomer
acuuggaagggucucuugu

SEQ ID NO: 31524 - RNA, 19 nt, artificial
  Oligomer
ucaucuucaucauccauau

SEQ ID NO: 31525 - RNA, 19 nt, artificial
  Oligomer
aaacaaaagauuauaguga

SEQ ID NO: 31526 - RNA, 19 nt, artificial
  Oligomer
agcauuuuuucuuuugacu

SEQ ID NO: 31527 - RNA, 19 nt, artificial
  Oligomer
auacagugauaguuugcau

SEQ ID NO: 31528 - RNA, 19 nt, artificial
  Oligomer
cauguucucuuucauuuug

SEQ ID NO: 31529 - RNA, 19 nt, artificial
  Oligomer
aaucacaacaaaauauaca

SEQ ID NO: 31530 - RNA, 19 nt, artificial
  Oligomer
guuauauucucuuuuuaag

SEQ ID NO: 31531 - RNA, 19 nt, artificial
  Oligomer
ucaaccaauaaacugagaa

SEQ ID NO: 31532 - RNA, 19 nt, artificial
  Oligomer
auucacggcugacuuugga

SEQ ID NO: 31533 - RNA, 19 nt, artificial
  Oligomer
agauuuugaccucagucca

SEQ ID NO: 31534 - RNA, 19 nt, artificial
  Oligomer
cuccuuuuaauugaccuca

SEQ ID NO: 31535 - RNA, 19 nt, artificial
  Oligomer
aacauagacauaacccuga

SEQ ID NO: 31536 - RNA, 19 nt, artificial
  Oligomer
guauuuuguuugcuucuac

SEQ ID NO: 31537 - RNA, 19 nt, artificial
  Oligomer
cugagaaagaagcauuuca

SEQ ID NO: 31538 - RNA, 19 nt, artificial
  Oligomer
aaucagaaggcgcguucag

SEQ ID NO: 31539 - RNA, 19 nt, artificial
  Oligomer
agaaagaagcauuucaugu

SEQ ID NO: 31540 - RNA, 19 nt, artificial
  Oligomer
ugcuucugagaugggucag

SEQ ID NO: 31541 - RNA, 19 nt, artificial
  Oligomer
ucguuucauaacuguccuu

SEQ ID NO: 31542 - RNA, 19 nt, artificial
  Oligomer
guucgagucaauggagucc

SEQ ID NO: 31543 - RNA, 19 nt, artificial
  Oligomer
ccucagaagaugcacuauc

SEQ ID NO: 31544 - RNA, 19 nt, artificial
  Oligomer
ugacucguuucauaacugu

SEQ ID NO: 31545 - RNA, 19 nt, artificial
  Oligomer
acaaaauauacacuaacuu

SEQ ID NO: 31546 - RNA, 19 nt, artificial
  Oligomer
aauucacggcugacuuugg

SEQ ID NO: 31547 - RNA, 19 nt, artificial
  Oligomer
ugcaaagugagaaauugua

SEQ ID NO: 31548 - RNA, 19 nt, artificial
  Oligomer
gugaguuuuccuuggucgg

SEQ ID NO: 31549 - RNA, 19 nt, artificial
  Oligomer
agauucugcuucugagaug

SEQ ID NO: 31550 - RNA, 19 nt, artificial
  Oligomer
uguccacauggucaucauc

SEQ ID NO: 31551 - RNA, 19 nt, artificial
  Oligomer
ucauccauaucauccaugu

SEQ ID NO: 31552 - RNA, 19 nt, artificial
  Oligomer
aggucugcgaaacuucuua

SEQ ID NO: 31553 - RNA, 19 nt, artificial
  Oligomer
aguggguaaaaguauuuug

SEQ ID NO: 31554 - RNA, 19 nt, artificial
  Oligomer
cuuuuccucagaacuucca

SEQ ID NO: 31555 - RNA, 19 nt, artificial
  Oligomer
aaaccacacuaucaccucg

SEQ ID NO: 31556 - RNA, 19 nt, artificial
  Oligomer
gugagaaucaucaguguca

SEQ ID NO: 31557 - RNA, 19 nt, artificial
  Oligomer
ugagagaauaacaaauauu

SEQ ID NO: 31558 - RNA, 19 nt, artificial
  Oligomer
gaaauuguauuuuuucucc

SEQ ID NO: 31559 - RNA, 19 nt, artificial
  Oligomer
aaaugcugcugcagacauc

SEQ ID NO: 31560 - RNA, 19 nt, artificial
  Oligomer
gugucaucuacaucaucag

SEQ ID NO: 31561 - RNA, 19 nt, artificial
  Oligomer
caacuccucgcuuuccaug

SEQ ID NO: 31562 - RNA, 19 nt, artificial
  Oligomer
auugaccucagaagaugca

SEQ ID NO: 31563 - RNA, 19 nt, artificial
  Oligomer
acuuacuuggaagggucuc

SEQ ID NO: 31564 - RNA, 19 nt, artificial
  Oligomer
accucaguccauaaaccac

SEQ ID NO: 31565 - RNA, 19 nt, artificial
  Oligomer
uaguuauuuccagacucaa

SEQ ID NO: 31566 - RNA, 19 nt, artificial
  Oligomer
aguaaaaaagguuauguuu

SEQ ID NO: 31567 - RNA, 19 nt, artificial
  Oligomer
gaauucacggcugacuuug

SEQ ID NO: 31568 - RNA, 19 nt, artificial
  Oligomer
gucauugguuucuucagag

SEQ ID NO: 31569 - RNA, 19 nt, artificial
  Oligomer
cucguuucauaacuguccu

SEQ ID NO: 31570 - RNA, 19 nt, artificial
  Oligomer
aagaugcacuaucuaauuc

SEQ ID NO: 31571 - RNA, 19 nt, artificial
  Oligomer
agcauuucauguucucuuu

SEQ ID NO: 31572 - RNA, 19 nt, artificial
  Oligomer
guuucauaacuguccuucc

SEQ ID NO: 31573 - RNA, 19 nt, artificial
  Oligomer
uggacaaccgugggaaaac

SEQ ID NO: 31574 - RNA, 19 nt, artificial
  Oligomer
ugcauuucuucuauagaau

SEQ ID NO: 31575 - RNA, 19 nt, artificial
  Oligomer
ugguuucuucagaggacac

SEQ ID NO: 31576 - RNA, 19 nt, artificial
  Oligomer
uuggaaaguuccugacuau

SEQ ID NO: 31577 - RNA, 19 nt, artificial
  Oligomer
agaugcacuaucuaauuca

SEQ ID NO: 31578 - RNA, 19 nt, artificial
  Oligomer
gucuacaaccagcauaucu

SEQ ID NO: 31579 - RNA, 19 nt, artificial
  Oligomer
ucaucuacaucaucagagu

SEQ ID NO: 31580 - RNA, 19 nt, artificial
  Oligomer
aaugaacauagacauaacc

SEQ ID NO: 31581 - RNA, 19 nt, artificial
  Oligomer
ccauaaaccacacuaucac

SEQ ID NO: 31582 - RNA, 19 nt, artificial
  Oligomer
ucagaauggugagacucau

SEQ ID NO: 31583 - RNA, 19 nt, artificial
  Oligomer
guaaagcugcuuuuccuca

SEQ ID NO: 31584 - RNA, 19 nt, artificial
  Oligomer
caucagugucaucuacauc

SEQ ID NO: 31585 - RNA, 19 nt, artificial
  Oligomer
uacgaaauuucagguguuu

SEQ ID NO: 31586 - RNA, 19 nt, artificial
  Oligomer
aaagaagcauuucauguuc

SEQ ID NO: 31587 - RNA, 19 nt, artificial
  Oligomer
guggaauucacggcugacu

SEQ ID NO: 31588 - RNA, 19 nt, artificial
  Oligomer
guaaaaaagguuauguuuu

SEQ ID NO: 31589 - RNA, 19 nt, artificial
  Oligomer
uccagcugacucguuucau

SEQ ID NO: 31590 - RNA, 19 nt, artificial
  Oligomer
ucacaucggaaugcucauu

SEQ ID NO: 31591 - RNA, 19 nt, artificial
  Oligomer
gguauuuguuguaaagcug

SEQ ID NO: 31592 - RNA, 19 nt, artificial
  Oligomer
acucuggucauccagcuga

SEQ ID NO: 31593 - RNA, 19 nt, artificial
  Oligomer
cuuuugacuaaaugcaaag

SEQ ID NO: 31594 - RNA, 19 nt, artificial
  Oligomer
guuauuuccagacucaaau

SEQ ID NO: 31595 - RNA, 19 nt, artificial
  Oligomer
uuguuugcuucuacauaaa

SEQ ID NO: 31596 - RNA, 19 nt, artificial
  Oligomer
uguuuaacugguauggcac

SEQ ID NO: 31597 - RNA, 19 nt, artificial
  Oligomer
cagggaagacgaagaugaa

SEQ ID NO: 31598 - RNA, 19 nt, artificial
  Oligomer
ggagaaccaugaaaacgaa

SEQ ID NO: 31599 - RNA, 19 nt, artificial
  Oligomer
gaaugagggugaaauucaa

SEQ ID NO: 31600 - RNA, 19 nt, artificial
  Oligomer
cgcugagggagaaagagaa

SEQ ID NO: 31601 - RNA, 19 nt, artificial
  Oligomer
agacgaagaugaaaucgaa

SEQ ID NO: 31602 - RNA, 19 nt, artificial
  Oligomer
gagugaugcugaccuagaa

SEQ ID NO: 31603 - RNA, 19 nt, artificial
  Oligomer
gguugucagugaacaauaa

SEQ ID NO: 31604 - RNA, 19 nt, artificial
  Oligomer
ccagaauaacccagaagaa

SEQ ID NO: 31605 - RNA, 19 nt, artificial
  Oligomer
ggaucugacucuugcugaa

SEQ ID NO: 31606 - RNA, 19 nt, artificial
  Oligomer
gaucauagcugacuuuaaa

SEQ ID NO: 31607 - RNA, 19 nt, artificial
  Oligomer
ccguguaucucaguaacaa

SEQ ID NO: 31608 - RNA, 19 nt, artificial
  Oligomer
gcuugaaagcgaugaagaa

SEQ ID NO: 31609 - RNA, 19 nt, artificial
  Oligomer
caaacuaaaggcucuaaaa

SEQ ID NO: 31610 - RNA, 19 nt, artificial
  Oligomer
ugcucagguugcaaauaaa

SEQ ID NO: 31611 - RNA, 19 nt, artificial
  Oligomer
gggagaauuugaccuugua

SEQ ID NO: 31612 - RNA, 19 nt, artificial
  Oligomer
gaauaagcguaauucagaa

SEQ ID NO: 31613 - RNA, 19 nt, artificial
  Oligomer
gguggaucugugcaaagaa

SEQ ID NO: 31614 - RNA, 19 nt, artificial
  Oligomer
ccuggugaauaucgaagaa

SEQ ID NO: 31615 - RNA, 19 nt, artificial
  Oligomer
gauccaaguuuaaaaagaa

SEQ ID NO: 31616 - RNA, 19 nt, artificial
  Oligomer
ggaucaaguugaugaugga

SEQ ID NO: 31617 - RNA, 19 nt, artificial
  Oligomer
caugggaacuaaaccaaaa

SEQ ID NO: 31618 - RNA, 19 nt, artificial
  Oligomer
ugagcaggagaaacuuaaa

SEQ ID NO: 31619 - RNA, 19 nt, artificial
  Oligomer
ggacauuuagcgugaugaa

SEQ ID NO: 31620 - RNA, 19 nt, artificial
  Oligomer
cagagaacauuuauuccaa

SEQ ID NO: 31621 - RNA, 19 nt, artificial
  Oligomer
cgagcgucgaagagacaaa

SEQ ID NO: 31622 - RNA, 19 nt, artificial
  Oligomer
ggaagcuaagcuaaaaaaa

SEQ ID NO: 31623 - RNA, 19 nt, artificial
  Oligomer
cauggauaagcguguuaau

SEQ ID NO: 31624 - RNA, 19 nt, artificial
  Oligomer
cauccacagggaagacgaa

SEQ ID NO: 31625 - RNA, 19 nt, artificial
  Oligomer
ggcugaauuuuaaucugua

SEQ ID NO: 31626 - RNA, 19 nt, artificial
  Oligomer
cauugugaguggaccaaga

SEQ ID NO: 31627 - RNA, 19 nt, artificial
  Oligomer
gggcgcgccuuaaugauaa

SEQ ID NO: 31628 - RNA, 19 nt, artificial
  Oligomer
ccagguucuaagcaagaaa

SEQ ID NO: 31629 - RNA, 19 nt, artificial
  Oligomer
gagggagaaagagaagaaa

SEQ ID NO: 31630 - RNA, 19 nt, artificial
  Oligomer
aggacaaacuugcguaaaa

SEQ ID NO: 31631 - RNA, 19 nt, artificial
  Oligomer
agcuaagaaacaaauugaa

SEQ ID NO: 31632 - RNA, 19 nt, artificial
  Oligomer
gcucagguugcaaauaaaa

SEQ ID NO: 31633 - RNA, 19 nt, artificial
  Oligomer
gguacaguuugguguaaau

SEQ ID NO: 31634 - RNA, 19 nt, artificial
  Oligomer
gcaucuuaagaauuauaca

SEQ ID NO: 31635 - RNA, 19 nt, artificial
  Oligomer
cguguaucucaguaacaau

SEQ ID NO: 31636 - RNA, 19 nt, artificial
  Oligomer
ccaguaauuagauguagaa

SEQ ID NO: 31637 - RNA, 19 nt, artificial
  Oligomer
ugaugagcugcccaugaaa

SEQ ID NO: 31638 - RNA, 19 nt, artificial
  Oligomer
caggauccaaguuuaaaaa

SEQ ID NO: 31639 - RNA, 19 nt, artificial
  Oligomer
cgugguggaucugugcaaa

SEQ ID NO: 31640 - RNA, 19 nt, artificial
  Oligomer
gaagaagaaggcagcucua

SEQ ID NO: 31641 - RNA, 19 nt, artificial
  Oligomer
gaaggagacugcaugacaa

SEQ ID NO: 31642 - RNA, 19 nt, artificial
  Oligomer
gcagauaagugcgaggaaa

SEQ ID NO: 31643 - RNA, 19 nt, artificial
  Oligomer
gcccaaaucuccagaauaa

SEQ ID NO: 31644 - RNA, 19 nt, artificial
  Oligomer
caagaauccugucuaguaa

SEQ ID NO: 31645 - RNA, 19 nt, artificial
  Oligomer
caggaagcuaagcuaaaaa

SEQ ID NO: 31646 - RNA, 19 nt, artificial
  Oligomer
ucaggaagcuaagcuaaaa

SEQ ID NO: 31647 - RNA, 19 nt, artificial
  Oligomer
ggagaaacuuaaaaggcua

SEQ ID NO: 31648 - RNA, 19 nt, artificial
  Oligomer
gacuguacccaagaauuaa

SEQ ID NO: 31649 - RNA, 19 nt, artificial
  Oligomer
ugcgcuuugggauuaugaa

SEQ ID NO: 31650 - RNA, 19 nt, artificial
  Oligomer
ccguaauauuugucaagau

SEQ ID NO: 31651 - RNA, 19 nt, artificial
  Oligomer
caacgauuuggaagucaga

SEQ ID NO: 31652 - RNA, 19 nt, artificial
  Oligomer
caccaaggccucuaaagaa

SEQ ID NO: 31653 - RNA, 19 nt, artificial
  Oligomer
ggcugcuucacaaacuaaa

SEQ ID NO: 31654 - RNA, 19 nt, artificial
  Oligomer
ccaugggaacuaaaccaaa

SEQ ID NO: 31655 - RNA, 19 nt, artificial
  Oligomer
gaaacaaauugaaucaaga

SEQ ID NO: 31656 - RNA, 19 nt, artificial
  Oligomer
gcugcagcuaagaaacaaa

SEQ ID NO: 31657 - RNA, 19 nt, artificial
  Oligomer
acuuguggaggaaauugaa

SEQ ID NO: 31658 - RNA, 19 nt, artificial
  Oligomer
gagcaggagaaacuuaaaa

SEQ ID NO: 31659 - RNA, 19 nt, artificial
  Oligomer
agaucauagcugacuuuaa

SEQ ID NO: 31660 - RNA, 19 nt, artificial
  Oligomer
cugggacuguacccaagaa

SEQ ID NO: 31661 - RNA, 19 nt, artificial
  Oligomer
aaaggagaacgguguuaau

SEQ ID NO: 31662 - RNA, 19 nt, artificial
  Oligomer
guugguugucagugaacaa

SEQ ID NO: 31663 - RNA, 19 nt, artificial
  Oligomer
agaauuaaaccaagacaaa

SEQ ID NO: 31664 - RNA, 19 nt, artificial
  Oligomer
agaugggcauaaugaauaa

SEQ ID NO: 31665 - RNA, 19 nt, artificial
  Oligomer
cauugugcugccucaugua

SEQ ID NO: 31666 - RNA, 19 nt, artificial
  Oligomer
cauuuagcgugaugaaaua

SEQ ID NO: 31667 - RNA, 19 nt, artificial
  Oligomer
cagagggaguguuugaaua

SEQ ID NO: 31668 - RNA, 19 nt, artificial
  Oligomer
caguuugguguaaauguaa

SEQ ID NO: 31669 - RNA, 19 nt, artificial
  Oligomer
cucagaaagcccaguagaa

SEQ ID NO: 31670 - RNA, 19 nt, artificial
  Oligomer
agaagaugggcauaaugaa

SEQ ID NO: 31671 - RNA, 19 nt, artificial
  Oligomer
agcucuacagcaaaaagaa

SEQ ID NO: 31672 - RNA, 19 nt, artificial
  Oligomer
ggagaacgguguuaauagu

SEQ ID NO: 31673 - RNA, 19 nt, artificial
  Oligomer
cgauguuucuuaccgugua

SEQ ID NO: 31674 - RNA, 19 nt, artificial
  Oligomer
ggacuguacccaagaauua

SEQ ID NO: 31675 - RNA, 19 nt, artificial
  Oligomer
gcgcuuaaaguuuuugaaa

SEQ ID NO: 31676 - RNA, 19 nt, artificial
  Oligomer
gaccaagacucauaccaga

SEQ ID NO: 31677 - RNA, 19 nt, artificial
  Oligomer
cucagguugcaaauaaaaa

SEQ ID NO: 31678 - RNA, 19 nt, artificial
  Oligomer
gagacuaagcaaugggaaa

SEQ ID NO: 31679 - RNA, 19 nt, artificial
  Oligomer
ccagagugaugcugaccua

SEQ ID NO: 31680 - RNA, 19 nt, artificial
  Oligomer
ccagcagcaacagauugaa

SEQ ID NO: 31681 - RNA, 19 nt, artificial
  Oligomer
gaaccaugaaaacgaaaga

SEQ ID NO: 31682 - RNA, 19 nt, artificial
  Oligomer
aguucaggagaaccaugaa

SEQ ID NO: 31683 - RNA, 19 nt, artificial
  Oligomer
gcucuacagcaaaaagaaa

SEQ ID NO: 31684 - RNA, 19 nt, artificial
  Oligomer
ccaagaucucaggauccaa

SEQ ID NO: 31685 - RNA, 19 nt, artificial
  Oligomer
ucaggauccaaguuuaaaa

SEQ ID NO: 31686 - RNA, 19 nt, artificial
  Oligomer
cagcuaagaaacaaauuga

SEQ ID NO: 31687 - RNA, 19 nt, artificial
  Oligomer
ugugcugccucauguaaca

SEQ ID NO: 31688 - RNA, 19 nt, artificial
  Oligomer
cagacuuacccguaauauu

SEQ ID NO: 31689 - RNA, 19 nt, artificial
  Oligomer
gagaaugaaggauugaaga

SEQ ID NO: 31690 - RNA, 19 nt, artificial
  Oligomer
gaauuuuagucaaugaaga

SEQ ID NO: 31691 - RNA, 19 nt, artificial
  Oligomer
gaaugucucuagaagagaa

SEQ ID NO: 31692 - RNA, 19 nt, artificial
  Oligomer
ggccugaauugcuggugaa

SEQ ID NO: 31693 - RNA, 19 nt, artificial
  Oligomer
guagcuugaaagcgaugaa

SEQ ID NO: 31694 - RNA, 19 nt, artificial
  Oligomer
agggaagacgaagaugaaa

SEQ ID NO: 31695 - RNA, 19 nt, artificial
  Oligomer
gaccuagaagccuuacgaa

SEQ ID NO: 31696 - RNA, 19 nt, artificial
  Oligomer
agagggaguguuugaauaa

SEQ ID NO: 31697 - RNA, 19 nt, artificial
  Oligomer
gggagaaagagaagaaagu

SEQ ID NO: 31698 - RNA, 19 nt, artificial
  Oligomer
cagaauuuuagucaaugaa

SEQ ID NO: 31699 - RNA, 19 nt, artificial
  Oligomer
gggcugcuucacaaacuaa

SEQ ID NO: 31700 - RNA, 19 nt, artificial
  Oligomer
ccguguagcacucagauaa

SEQ ID NO: 31701 - RNA, 19 nt, artificial
  Oligomer
ggauaagcguguuaaugag

SEQ ID NO: 31702 - RNA, 19 nt, artificial
  Oligomer
cugagaaucaggaagcuaa

SEQ ID NO: 31703 - RNA, 19 nt, artificial
  Oligomer
agcgcuuaaaguuuuugaa

SEQ ID NO: 31704 - RNA, 19 nt, artificial
  Oligomer
ccuacaaaaccaaaacaga

SEQ ID NO: 31705 - RNA, 19 nt, artificial
  Oligomer
gaaucaggaagcuaagcua

SEQ ID NO: 31706 - RNA, 19 nt, artificial
  Oligomer
ccaugaaaacgaaagaauu

SEQ ID NO: 31707 - RNA, 19 nt, artificial
  Oligomer
gcuacagacuuacccguaa

SEQ ID NO: 31708 - RNA, 19 nt, artificial
  Oligomer
aaaagugagagcacuuaaa

SEQ ID NO: 31709 - RNA, 19 nt, artificial
  Oligomer
ccaguuacuccagaaacaa

SEQ ID NO: 31710 - RNA, 19 nt, artificial
  Oligomer
cagaaagcccaguagaaau

SEQ ID NO: 31711 - RNA, 19 nt, artificial
  Oligomer
gaaggcagcucuacagcaa

SEQ ID NO: 31712 - RNA, 19 nt, artificial
  Oligomer
ugagggagaaagagaagaa

SEQ ID NO: 31713 - RNA, 19 nt, artificial
  Oligomer
ggauccaaguuuaaaaaga

SEQ ID NO: 31714 - RNA, 19 nt, artificial
  Oligomer
gcaccaaggccucuaaaga

SEQ ID NO: 31715 - RNA, 19 nt, artificial
  Oligomer
ggcaguccagaaccugaaa

SEQ ID NO: 31716 - RNA, 19 nt, artificial
  Oligomer
uuuguaggcugaauuuuaa

SEQ ID NO: 31717 - RNA, 19 nt, artificial
  Oligomer
gaaaggagaacgguguuaa

SEQ ID NO: 31718 - RNA, 19 nt, artificial
  Oligomer
cccaagaauuaaaccaaga

SEQ ID NO: 31719 - RNA, 19 nt, artificial
  Oligomer
aggcagcucuacagcaaaa

SEQ ID NO: 31720 - RNA, 19 nt, artificial
  Oligomer
cuaaggaacagcgcuuaaa

SEQ ID NO: 31721 - RNA, 19 nt, artificial
  Oligomer
cguggaacagaagagacua

SEQ ID NO: 31722 - RNA, 19 nt, artificial
  Oligomer
cuuaaaaggcuaaaagaaa

SEQ ID NO: 31723 - RNA, 19 nt, artificial
  Oligomer
caauguagcuugaaagcga

SEQ ID NO: 31724 - RNA, 19 nt, artificial
  Oligomer
gcuuaaaguuuuugaaaca

SEQ ID NO: 31725 - RNA, 19 nt, artificial
  Oligomer
cuguuaagaagaaguaaua

SEQ ID NO: 31726 - RNA, 19 nt, artificial
  Oligomer
ggaugcucagguugcaaau

SEQ ID NO: 31727 - RNA, 19 nt, artificial
  Oligomer
accggcuguggaagaagaa

SEQ ID NO: 31728 - RNA, 19 nt, artificial
  Oligomer
gggcauaaugaauaaagga

SEQ ID NO: 31729 - RNA, 19 nt, artificial
  Oligomer
ccuuguacagagaauuauu

SEQ ID NO: 31730 - RNA, 19 nt, artificial
  Oligomer
ccacagggaagacgaagau

SEQ ID NO: 31731 - RNA, 19 nt, artificial
  Oligomer
gcgacaauccuguuuucua

SEQ ID NO: 31732 - RNA, 19 nt, artificial
  Oligomer
gcugaauuuuaaucuguau

SEQ ID NO: 31733 - RNA, 19 nt, artificial
  Oligomer
agaagaaggcagcucuaca

SEQ ID NO: 31734 - RNA, 19 nt, artificial
  Oligomer
guagcaucuuaagaauuau

SEQ ID NO: 31735 - RNA, 19 nt, artificial
  Oligomer
caacagagggaguguuuga

SEQ ID NO: 31736 - RNA, 19 nt, artificial
  Oligomer
guuccuggugaauaucgaa

SEQ ID NO: 31737 - RNA, 19 nt, artificial
  Oligomer
aaaaagaaaugguguaaaa

SEQ ID NO: 31738 - RNA, 19 nt, artificial
  Oligomer
ggcacugcacacuuguaua

SEQ ID NO: 31739 - RNA, 19 nt, artificial
  Oligomer
cugagcaggagaaacuuaa

SEQ ID NO: 31740 - RNA, 19 nt, artificial
  Oligomer
cucucugccuccugguaaa

SEQ ID NO: 31741 - RNA, 19 nt, artificial
  Oligomer
aauguuugauguucuucaa

SEQ ID NO: 31742 - RNA, 19 nt, artificial
  Oligomer
aacagaagagacuaagcaa

SEQ ID NO: 31743 - RNA, 19 nt, artificial
  Oligomer
cagauaagugcgaggaaau

SEQ ID NO: 31744 - RNA, 19 nt, artificial
  Oligomer
uaaaguuuuugaaacaaca

SEQ ID NO: 31745 - RNA, 19 nt, artificial
  Oligomer
cuagaagccuuacgaaaga

SEQ ID NO: 31746 - RNA, 19 nt, artificial
  Oligomer
gacuuauuuuaaugacaau

SEQ ID NO: 31747 - RNA, 19 nt, artificial
  Oligomer
uguaaaaguuccuggugaa

SEQ ID NO: 31748 - RNA, 19 nt, artificial
  Oligomer
cagacacugcccaacauga

SEQ ID NO: 31749 - RNA, 19 nt, artificial
  Oligomer
caaugagcagcacuucaca

SEQ ID NO: 31750 - RNA, 19 nt, artificial
  Oligomer
ugggaaugcucuggaucaa

SEQ ID NO: 31751 - RNA, 19 nt, artificial
  Oligomer
ccaucauacccauccaagu

SEQ ID NO: 31752 - RNA, 19 nt, artificial
  Oligomer
cagugaacaauaacuuuau

SEQ ID NO: 31753 - RNA, 19 nt, artificial
  Oligomer
gaugaagaaugucucuaga

SEQ ID NO: 31754 - RNA, 19 nt, artificial
  Oligomer
gaagaaugucucuagaaga

SEQ ID NO: 31755 - RNA, 19 nt, artificial
  Oligomer
gcaucacggcucuucacaa

SEQ ID NO: 31756 - RNA, 19 nt, artificial
  Oligomer
agacuuauuuuaaugacaa

SEQ ID NO: 31757 - RNA, 19 nt, artificial
  Oligomer
aguuugguguaaauguaaa

SEQ ID NO: 31758 - RNA, 19 nt, artificial
  Oligomer
ccuuauuuuggacaaacua

SEQ ID NO: 31759 - RNA, 19 nt, artificial
  Oligomer
ccacguggaacagaagaga

SEQ ID NO: 31760 - RNA, 19 nt, artificial
  Oligomer
cgaugaaaauacagacacu

SEQ ID NO: 31761 - RNA, 19 nt, artificial
  Oligomer
gaaacuugcuacagacuua

SEQ ID NO: 31762 - RNA, 19 nt, artificial
  Oligomer
gaauuauacauauguuuga

SEQ ID NO: 31763 - RNA, 19 nt, artificial
  Oligomer
acaguuugguguaaaugua

SEQ ID NO: 31764 - RNA, 19 nt, artificial
  Oligomer
acuguacccaagaauuaaa

SEQ ID NO: 31765 - RNA, 19 nt, artificial
  Oligomer
ccaucucugucccaucaua

SEQ ID NO: 31766 - RNA, 19 nt, artificial
  Oligomer
gagcuugaucgccucuaua

SEQ ID NO: 31767 - RNA, 19 nt, artificial
  Oligomer
aaaguuuuugaaacaacaa

SEQ ID NO: 31768 - RNA, 19 nt, artificial
  Oligomer
aggagcugcagcuaagaaa

SEQ ID NO: 31769 - RNA, 19 nt, artificial
  Oligomer
ggacauugugaguggacca

SEQ ID NO: 31770 - RNA, 19 nt, artificial
  Oligomer
aaaaguuccuggugaauau

SEQ ID NO: 31771 - RNA, 19 nt, artificial
  Oligomer
uacgaaagaaacugucuaa

SEQ ID NO: 31772 - RNA, 19 nt, artificial
  Oligomer
agcuagagaugcucaagaa

SEQ ID NO: 31773 - RNA, 19 nt, artificial
  Oligomer
gauugaagcccagcaacaa

SEQ ID NO: 31774 - RNA, 19 nt, artificial
  Oligomer
ccaguuucaucugauggaa

SEQ ID NO: 31775 - RNA, 19 nt, artificial
  Oligomer
gaaacugucuaacgcacca

SEQ ID NO: 31776 - RNA, 19 nt, artificial
  Oligomer
aggaagcuaagcuaaaaaa

SEQ ID NO: 31777 - RNA, 19 nt, artificial
  Oligomer
aggaaauugaacagaugaa

SEQ ID NO: 31778 - RNA, 19 nt, artificial
  Oligomer
ccacucagcccaacuaaau

SEQ ID NO: 31779 - RNA, 19 nt, artificial
  Oligomer
guggaacagaagagacuaa

SEQ ID NO: 31780 - RNA, 19 nt, artificial
  Oligomer
cuuguauauugucagugaa

SEQ ID NO: 31781 - RNA, 19 nt, artificial
  Oligomer
ggcagcuagagaugcucaa

SEQ ID NO: 31782 - RNA, 19 nt, artificial
  Oligomer
gucccaucauacccaucca

SEQ ID NO: 31783 - RNA, 19 nt, artificial
  Oligomer
auccaaguuuaaaaagaaa

SEQ ID NO: 31784 - RNA, 19 nt, artificial
  Oligomer
gaguuuuuguagcaucuua

SEQ ID NO: 31785 - RNA, 19 nt, artificial
  Oligomer
ggacaaacuugcguaaaac

SEQ ID NO: 31786 - RNA, 19 nt, artificial
  Oligomer
guccguucucaauguuuga

SEQ ID NO: 31787 - RNA, 19 nt, artificial
  Oligomer
aagaauuaaaccaagacaa

SEQ ID NO: 31788 - RNA, 19 nt, artificial
  Oligomer
cuucuuccuucgucaugaa

SEQ ID NO: 31789 - RNA, 19 nt, artificial
  Oligomer
accuccuguuccuacaaaa

SEQ ID NO: 31790 - RNA, 19 nt, artificial
  Oligomer
ccauguauacgcaacagca

SEQ ID NO: 31791 - RNA, 19 nt, artificial
  Oligomer
gaaguaauacgauuauuuu

SEQ ID NO: 31792 - RNA, 19 nt, artificial
  Oligomer
gaagaaccagagcagugaa

SEQ ID NO: 31793 - RNA, 19 nt, artificial
  Oligomer
caccauuagaggacauuua

SEQ ID NO: 31794 - RNA, 19 nt, artificial
  Oligomer
caagaauuaaaccaagaca

SEQ ID NO: 31795 - RNA, 19 nt, artificial
  Oligomer
gcagcaaguucaauauauu

SEQ ID NO: 31796 - RNA, 19 nt, artificial
  Oligomer
cccagaagaaccaaaucca

SEQ ID NO: 31797 - RNA, 19 nt, artificial
  Oligomer
gggaugcucagguugcaaa

SEQ ID NO: 31798 - RNA, 19 nt, artificial
  Oligomer
aauuuuagucaaugaagaa

SEQ ID NO: 31799 - RNA, 19 nt, artificial
  Oligomer
cuuuggagggagaauuuga

SEQ ID NO: 31800 - RNA, 19 nt, artificial
  Oligomer
aaggcagcucuacagcaaa

SEQ ID NO: 31801 - RNA, 19 nt, artificial
  Oligomer
gaauaacccagaagaacca

SEQ ID NO: 31802 - RNA, 19 nt, artificial
  Oligomer
gagcguaucgcucauggaa

SEQ ID NO: 31803 - RNA, 19 nt, artificial
  Oligomer
acagcaaaaagaaaaucua

SEQ ID NO: 31804 - RNA, 19 nt, artificial
  Oligomer
cucuguuaagaagaaguaa

SEQ ID NO: 31805 - RNA, 19 nt, artificial
  Oligomer
gcccaguagaaauccagaa

SEQ ID NO: 31806 - RNA, 19 nt, artificial
  Oligomer
acuuaaaaggcuaaaagaa

SEQ ID NO: 31807 - RNA, 19 nt, artificial
  Oligomer
cacucagcccaacuaaauu

SEQ ID NO: 31808 - RNA, 19 nt, artificial
  Oligomer
gcguugaccaagacucaua

SEQ ID NO: 31809 - RNA, 19 nt, artificial
  Oligomer
aauugaaucaagagcagaa

SEQ ID NO: 31810 - RNA, 19 nt, artificial
  Oligomer
ugagcagcacuucacagaa

SEQ ID NO: 31811 - RNA, 19 nt, artificial
  Oligomer
agauaaguauacagcgaca

SEQ ID NO: 31812 - RNA, 19 nt, artificial
  Oligomer
ccuguuccuacaaaaccaa

SEQ ID NO: 31813 - RNA, 19 nt, artificial
  Oligomer
cccugauuggaguccuuca

SEQ ID NO: 31814 - RNA, 19 nt, artificial
  Oligomer
caugcagacugcugcagau

SEQ ID NO: 31815 - RNA, 19 nt, artificial
  Oligomer
aaauguaaaugcugcugau

SEQ ID NO: 31816 - RNA, 19 nt, artificial
  Oligomer
uaagcuacgguaccaguaa

SEQ ID NO: 31817 - RNA, 19 nt, artificial
  Oligomer
gguccaagaugaugccgau

SEQ ID NO: 31818 - RNA, 19 nt, artificial
  Oligomer
gaagaaguaauacgauuau

SEQ ID NO: 31819 - RNA, 19 nt, artificial
  Oligomer
gagacugcaugacaaucau

SEQ ID NO: 31820 - RNA, 19 nt, artificial
  Oligomer
ccaugacaaucagucugca

SEQ ID NO: 31821 - RNA, 19 nt, artificial
  Oligomer
uggugaauaucgaagaaag

SEQ ID NO: 31822 - RNA, 19 nt, artificial
  Oligomer
gaccuuguacagagaauua

SEQ ID NO: 31823 - RNA, 19 nt, artificial
  Oligomer
cacagaaguuccaguuacu

SEQ ID NO: 31824 - RNA, 19 nt, artificial
  Oligomer
gagaaccaugaaaacgaaa

SEQ ID NO: 31825 - RNA, 19 nt, artificial
  Oligomer
ucagguugcaaauaaaaau

SEQ ID NO: 31826 - RNA, 19 nt, artificial
  Oligomer
gacgaagaugaaaucgaau

SEQ ID NO: 31827 - RNA, 19 nt, artificial
  Oligomer
guauauugucagugaagaa

SEQ ID NO: 31828 - RNA, 19 nt, artificial
  Oligomer
ggugaauaucgaagaaagg

SEQ ID NO: 31829 - RNA, 19 nt, artificial
  Oligomer
agggauauguuccacguaa

SEQ ID NO: 31830 - RNA, 19 nt, artificial
  Oligomer
cgcguugaccaagacucau

SEQ ID NO: 31831 - RNA, 19 nt, artificial
  Oligomer
aguuuuuguagcaucuuaa

SEQ ID NO: 31832 - RNA, 19 nt, artificial
  Oligomer
ucucaggauccaaguuuaa

SEQ ID NO: 31833 - RNA, 19 nt, artificial
  Oligomer
gaaacguaguucuauuaca

SEQ ID NO: 31834 - RNA, 19 nt, artificial
  Oligomer
acgcaccaaggccucuaaa

SEQ ID NO: 31835 - RNA, 19 nt, artificial
  Oligomer
ugcucuggaucaaguugau

SEQ ID NO: 31836 - RNA, 19 nt, artificial
  Oligomer
gaggaaggcuacacucagu

SEQ ID NO: 31837 - RNA, 19 nt, artificial
  Oligomer
ccaccuccuguuccuacaa

SEQ ID NO: 31838 - RNA, 19 nt, artificial
  Oligomer
gcacccagagaacauuuau

SEQ ID NO: 31839 - RNA, 19 nt, artificial
  Oligomer
guaccaguaauuagaugua

SEQ ID NO: 31840 - RNA, 19 nt, artificial
  Oligomer
gcgugaugaaauaaagcau

SEQ ID NO: 31841 - RNA, 19 nt, artificial
  Oligomer
aagaauuaaucucuguuaa

SEQ ID NO: 31842 - RNA, 19 nt, artificial
  Oligomer
guuuguaggcugaauuuua

SEQ ID NO: 31843 - RNA, 19 nt, artificial
  Oligomer
gaauaucgaagaaaggaga

SEQ ID NO: 31844 - RNA, 19 nt, artificial
  Oligomer
ggauaaugagcgaauguuu

SEQ ID NO: 31845 - RNA, 19 nt, artificial
  Oligomer
aucaggaagcuaagcuaaa

SEQ ID NO: 31846 - RNA, 19 nt, artificial
  Oligomer
gggccgaugaaaauacaga

SEQ ID NO: 31847 - RNA, 19 nt, artificial
  Oligomer
gaaauugaacagaugaaua

SEQ ID NO: 31848 - RNA, 19 nt, artificial
  Oligomer
acuaaggaacagcgcuuaa

SEQ ID NO: 31849 - RNA, 19 nt, artificial
  Oligomer
ucacaagacuuauuuuaau

SEQ ID NO: 31850 - RNA, 19 nt, artificial
  Oligomer
aagcuacgguaccaguaau

SEQ ID NO: 31851 - RNA, 19 nt, artificial
  Oligomer
cucauguaacaacguccaa

SEQ ID NO: 31852 - RNA, 19 nt, artificial
  Oligomer
gagaaacuuaaaaggcuaa

SEQ ID NO: 31853 - RNA, 19 nt, artificial
  Oligomer
gggacuguacccaagaauu

SEQ ID NO: 31854 - RNA, 19 nt, artificial
  Oligomer
gucucuagaagagaaugaa

SEQ ID NO: 31855 - RNA, 19 nt, artificial
  Oligomer
agaucagcgacaacagcaa

SEQ ID NO: 31856 - RNA, 19 nt, artificial
  Oligomer
ggcagcucuacagcaaaaa

SEQ ID NO: 31857 - RNA, 19 nt, artificial
  Oligomer
gaauaaaggagucauuuau

SEQ ID NO: 31858 - RNA, 19 nt, artificial
  Oligomer
ugaagaauucaccauuaga

SEQ ID NO: 31859 - RNA, 19 nt, artificial
  Oligomer
cacugggaaugcucuggau

SEQ ID NO: 31860 - RNA, 19 nt, artificial
  Oligomer
ccaaggcucugcuucugua

SEQ ID NO: 31861 - RNA, 19 nt, artificial
  Oligomer
guauaugguaagccuguaa

SEQ ID NO: 31862 - RNA, 19 nt, artificial
  Oligomer
cucugcuucuguaccucaa

SEQ ID NO: 31863 - RNA, 19 nt, artificial
  Oligomer
gguucggguccaagaugau

SEQ ID NO: 31864 - RNA, 19 nt, artificial
  Oligomer
gcugcuaucucccagcaua

SEQ ID NO: 31865 - RNA, 19 nt, artificial
  Oligomer
guaucucagaaauuagaaa

SEQ ID NO: 31866 - RNA, 19 nt, artificial
  Oligomer
ggaaacuuguggaggaaau

SEQ ID NO: 31867 - RNA, 19 nt, artificial
  Oligomer
cgucuacuaugccucggau

SEQ ID NO: 31868 - RNA, 19 nt, artificial
  Oligomer
cucaggauccaaguuuaaa

SEQ ID NO: 31869 - RNA, 19 nt, artificial
  Oligomer
ugacaaucauccacaggga

SEQ ID NO: 31870 - RNA, 19 nt, artificial
  Oligomer
cuacaaaaccaaaacagau

SEQ ID NO: 31871 - RNA, 19 nt, artificial
  Oligomer
guucuucaacgauuuggaa

SEQ ID NO: 31872 - RNA, 19 nt, artificial
  Oligomer
agcugcagcuaagaaacaa

SEQ ID NO: 31873 - RNA, 19 nt, artificial
  Oligomer
gacacugcccaacaugaga

SEQ ID NO: 31874 - RNA, 19 nt, artificial
  Oligomer
aacgcaccaaggccucuaa

SEQ ID NO: 31875 - RNA, 19 nt, artificial
  Oligomer
aggagaaccaugaaaacga

SEQ ID NO: 31876 - RNA, 19 nt, artificial
  Oligomer
augacaauguagcuugaaa

SEQ ID NO: 31877 - RNA, 19 nt, artificial
  Oligomer
ccuuugguacucugaggaa

SEQ ID NO: 31878 - RNA, 19 nt, artificial
  Oligomer
cagaagaaccaaauccaga

SEQ ID NO: 31879 - RNA, 19 nt, artificial
  Oligomer
cuuauuuuggacaaacuaa

SEQ ID NO: 31880 - RNA, 19 nt, artificial
  Oligomer
caguuucaucugauggaaa

SEQ ID NO: 31881 - RNA, 19 nt, artificial
  Oligomer
aauccuuaccgaaaccaga

SEQ ID NO: 31882 - RNA, 19 nt, artificial
  Oligomer
cuccaggccuugauuauga

SEQ ID NO: 31883 - RNA, 19 nt, artificial
  Oligomer
aauuaaucucuguuaagaa

SEQ ID NO: 31884 - RNA, 19 nt, artificial
  Oligomer
gcgaauguuugauguucuu

SEQ ID NO: 31885 - RNA, 19 nt, artificial
  Oligomer
gggaagacgaagaugaaau

SEQ ID NO: 31886 - RNA, 19 nt, artificial
  Oligomer
cagcgcuuaaaguuuuuga

SEQ ID NO: 31887 - RNA, 19 nt, artificial
  Oligomer
aguucucagcaguugucaa

SEQ ID NO: 31888 - RNA, 19 nt, artificial
  Oligomer
caguuacuccagaaacaau

SEQ ID NO: 31889 - RNA, 19 nt, artificial
  Oligomer
ugagcugcccaugaaagaa

SEQ ID NO: 31890 - RNA, 19 nt, artificial
  Oligomer
cagcucuacagcaaaaaga

SEQ ID NO: 31891 - RNA, 19 nt, artificial
  Oligomer
cagggacauugugagugga

SEQ ID NO: 31892 - RNA, 19 nt, artificial
  Oligomer
uacccguaauauuugucaa

SEQ ID NO: 31893 - RNA, 19 nt, artificial
  Oligomer
aguuccaguuacuccagaa

SEQ ID NO: 31894 - RNA, 19 nt, artificial
  Oligomer
aguugaugauggagagguu

SEQ ID NO: 31895 - RNA, 19 nt, artificial
  Oligomer
uaaucucuguuaagaagaa

SEQ ID NO: 31896 - RNA, 19 nt, artificial
  Oligomer
ccugguacaguuuggugua

SEQ ID NO: 31897 - RNA, 19 nt, artificial
  Oligomer
gaaagagaagaaagugcgu

SEQ ID NO: 31898 - RNA, 19 nt, artificial
  Oligomer
gcacuucacagaaguucca

SEQ ID NO: 31899 - RNA, 19 nt, artificial
  Oligomer
caguuguaauaaacuuuuu

SEQ ID NO: 31900 - RNA, 19 nt, artificial
  Oligomer
uacagagaauuauuuauga

SEQ ID NO: 31901 - RNA, 19 nt, artificial
  Oligomer
gcaaaaauuucacaagacu

SEQ ID NO: 31902 - RNA, 19 nt, artificial
  Oligomer
ucagaaagcccaguagaaa

SEQ ID NO: 31903 - RNA, 19 nt, artificial
  Oligomer
gcugcaguaggucccuaua

SEQ ID NO: 31904 - RNA, 19 nt, artificial
  Oligomer
gacaaucauccacagggaa

SEQ ID NO: 31905 - RNA, 19 nt, artificial
  Oligomer
aauccagaauccauauuua

SEQ ID NO: 31906 - RNA, 19 nt, artificial
  Oligomer
ccuccugguaaaaggacaa

SEQ ID NO: 31907 - RNA, 19 nt, artificial
  Oligomer
aauccuguuuucuacaaga

SEQ ID NO: 31908 - RNA, 19 nt, artificial
  Oligomer
augaugagcugcccaugaa

SEQ ID NO: 31909 - RNA, 19 nt, artificial
  Oligomer
aagagaaugaaggauugaa

SEQ ID NO: 31910 - RNA, 19 nt, artificial
  Oligomer
gaaccagagcagugaagau

SEQ ID NO: 31911 - RNA, 19 nt, artificial
  Oligomer
aaaaagugagagcacuuaa

SEQ ID NO: 31912 - RNA, 19 nt, artificial
  Oligomer
gagaauuugaccuuguaca

SEQ ID NO: 31913 - RNA, 19 nt, artificial
  Oligomer
agaaugaaggauugaagaa

SEQ ID NO: 31914 - RNA, 19 nt, artificial
  Oligomer
aguguuugaauaagcguaa

SEQ ID NO: 31915 - RNA, 19 nt, artificial
  Oligomer
uccaguuacuccagaaaca

SEQ ID NO: 31916 - RNA, 19 nt, artificial
  Oligomer
aaaggacaaacuugcguaa

SEQ ID NO: 31917 - RNA, 19 nt, artificial
  Oligomer
ccaagaugaugccgauguu

SEQ ID NO: 31918 - RNA, 19 nt, artificial
  Oligomer
uacgguaccaguaauuaga

SEQ ID NO: 31919 - RNA, 19 nt, artificial
  Oligomer
cucaauguuugaugcagua

SEQ ID NO: 31920 - RNA, 19 nt, artificial
  Oligomer
cgacaauccuguuuucuac

SEQ ID NO: 31921 - RNA, 19 nt, artificial
  Oligomer
caaaaccaaaacagauuaa

SEQ ID NO: 31922 - RNA, 19 nt, artificial
  Oligomer
accaguaauuagauguaga

SEQ ID NO: 31923 - RNA, 19 nt, artificial
  Oligomer
ugguugucagugaacaaua

SEQ ID NO: 31924 - RNA, 19 nt, artificial
  Oligomer
gaguguuugaauaagcgua

SEQ ID NO: 31925 - RNA, 19 nt, artificial
  Oligomer
agagaacauuuauuccaau

SEQ ID NO: 31926 - RNA, 19 nt, artificial
  Oligomer
acagaauuuuagucaauga

SEQ ID NO: 31927 - RNA, 19 nt, artificial
  Oligomer
gcuaagaaacaaauugaau

SEQ ID NO: 31928 - RNA, 19 nt, artificial
  Oligomer
cuaagcuacgguaccagua

SEQ ID NO: 31929 - RNA, 19 nt, artificial
  Oligomer
uaaugacaauguagcuuga

SEQ ID NO: 31930 - RNA, 19 nt, artificial
  Oligomer
guuugauguucuucaacga

SEQ ID NO: 31931 - RNA, 19 nt, artificial
  Oligomer
gagggaguguuugaauaag

SEQ ID NO: 31932 - RNA, 19 nt, artificial
  Oligomer
cguguagcacucagauaag

SEQ ID NO: 31933 - RNA, 19 nt, artificial
  Oligomer
uaguaaauaggaucauuua

SEQ ID NO: 31934 - RNA, 19 nt, artificial
  Oligomer
gacggaaguucucagcagu

SEQ ID NO: 31935 - RNA, 19 nt, artificial
  Oligomer
gaggaaauugaacagauga

SEQ ID NO: 31936 - RNA, 19 nt, artificial
  Oligomer
ggaaugagggugaaauuca

SEQ ID NO: 31937 - RNA, 19 nt, artificial
  Oligomer
gcaagaaaguccaccugcu

SEQ ID NO: 31938 - RNA, 19 nt, artificial
  Oligomer
ccacacuuuucaaguguau

SEQ ID NO: 31939 - RNA, 19 nt, artificial
  Oligomer
cccguaauauuugucaaga

SEQ ID NO: 31940 - RNA, 19 nt, artificial
  Oligomer
gaaacuuaaaaggcuaaaa

SEQ ID NO: 31941 - RNA, 19 nt, artificial
  Oligomer
aguuuuugaaacaacaaga

SEQ ID NO: 31942 - RNA, 19 nt, artificial
  Oligomer
guucaggagaaccaugaaa

SEQ ID NO: 31943 - RNA, 19 nt, artificial
  Oligomer
aggagaagaugggcauaau

SEQ ID NO: 31944 - RNA, 19 nt, artificial
  Oligomer
gaaagugcguccguucuca

SEQ ID NO: 31945 - RNA, 19 nt, artificial
  Oligomer
auaauuuguuccagcaaaa

SEQ ID NO: 31946 - RNA, 19 nt, artificial
  Oligomer
gaagcuaagcuaaaaaaag

SEQ ID NO: 31947 - RNA, 19 nt, artificial
  Oligomer
gagcugcagcuaagaaaca

SEQ ID NO: 31948 - RNA, 19 nt, artificial
  Oligomer
aacuuaaaaggcuaaaaga

SEQ ID NO: 31949 - RNA, 19 nt, artificial
  Oligomer
uagcaucuuaagaauuaua

SEQ ID NO: 31950 - RNA, 19 nt, artificial
  Oligomer
ugcagauaagugcgaggaa

SEQ ID NO: 31951 - RNA, 19 nt, artificial
  Oligomer
gcucagaaagcccaguaga

SEQ ID NO: 31952 - RNA, 19 nt, artificial
  Oligomer
uucagcagcugcuccuaaa

SEQ ID NO: 31953 - RNA, 19 nt, artificial
  Oligomer
ugucuuuuguaucucagaa

SEQ ID NO: 31954 - RNA, 19 nt, artificial
  Oligomer
uggauaagcguguuaauga

SEQ ID NO: 31955 - RNA, 19 nt, artificial
  Oligomer
ggauuaugaaccucagaau

SEQ ID NO: 31956 - RNA, 19 nt, artificial
  Oligomer
ucuccagaauaacccagaa

SEQ ID NO: 31957 - RNA, 19 nt, artificial
  Oligomer
caaagacaccuuacuucca

SEQ ID NO: 31958 - RNA, 19 nt, artificial
  Oligomer
gaauaauuuguuccagcaa

SEQ ID NO: 31959 - RNA, 19 nt, artificial
  Oligomer
gagaacauuuauuccaaua

SEQ ID NO: 31960 - RNA, 19 nt, artificial
  Oligomer
gcgacaacagcaacaaguu

SEQ ID NO: 31961 - RNA, 19 nt, artificial
  Oligomer
aaucaggaagcuaagcuaa

SEQ ID NO: 31962 - RNA, 19 nt, artificial
  Oligomer
gaagagaaugaaggauuga

SEQ ID NO: 31963 - RNA, 19 nt, artificial
  Oligomer
cucuacagcaaaaagaaaa

SEQ ID NO: 31964 - RNA, 19 nt, artificial
  Oligomer
aaagugcguccguucucaa

SEQ ID NO: 31965 - RNA, 19 nt, artificial
  Oligomer
gacucuugcugaacuucag

SEQ ID NO: 31966 - RNA, 19 nt, artificial
  Oligomer
cccagacaacagcccaaau

SEQ ID NO: 31967 - RNA, 19 nt, artificial
  Oligomer
cucccaauuucuuuaugga

SEQ ID NO: 31968 - RNA, 19 nt, artificial
  Oligomer
aguuccuggugaauaucga

SEQ ID NO: 31969 - RNA, 19 nt, artificial
  Oligomer
caauguuugaugcaguaga

SEQ ID NO: 31970 - RNA, 19 nt, artificial
  Oligomer
accaaggccucuaaagaaa

SEQ ID NO: 31971 - RNA, 19 nt, artificial
  Oligomer
acgugguggaucugugcaa

SEQ ID NO: 31972 - RNA, 19 nt, artificial
  Oligomer
gcaaguucaauauauucca

SEQ ID NO: 31973 - RNA, 19 nt, artificial
  Oligomer
gaugaugagcugcccauga

SEQ ID NO: 31974 - RNA, 19 nt, artificial
  Oligomer
agcuugaucgccucuauaa

SEQ ID NO: 31975 - RNA, 19 nt, artificial
  Oligomer
aacugaccaggcagcuaga

SEQ ID NO: 31976 - RNA, 19 nt, artificial
  Oligomer
caaucauccacagggaaga

SEQ ID NO: 31977 - RNA, 19 nt, artificial
  Oligomer
gacaaacuugcguaaaacu

SEQ ID NO: 31978 - RNA, 19 nt, artificial
  Oligomer
uguagcaucuuaagaauua

SEQ ID NO: 31979 - RNA, 19 nt, artificial
  Oligomer
aaauugaacagaugaauaa

SEQ ID NO: 31980 - RNA, 19 nt, artificial
  Oligomer
ccucauguaacaacgucca

SEQ ID NO: 31981 - RNA, 19 nt, artificial
  Oligomer
gaauguuugauguucuuca

SEQ ID NO: 31982 - RNA, 19 nt, artificial
  Oligomer
gccuuauuuuggacaaacu

SEQ ID NO: 31983 - RNA, 19 nt, artificial
  Oligomer
cugguaaaaggacaaacuu

SEQ ID NO: 31984 - RNA, 19 nt, artificial
  Oligomer
uacccaagaauuaaaccaa

SEQ ID NO: 31985 - RNA, 19 nt, artificial
  Oligomer
cuguuccuacaaaaccaaa

SEQ ID NO: 31986 - RNA, 19 nt, artificial
  Oligomer
ggaggaaauugaacagaug

SEQ ID NO: 31987 - RNA, 19 nt, artificial
  Oligomer
uaauauuugucaagaucau

SEQ ID NO: 31988 - RNA, 19 nt, artificial
  Oligomer
guaacuugcugggacugua

SEQ ID NO: 31989 - RNA, 19 nt, artificial
  Oligomer
gacuuuaaaaacaguugua

SEQ ID NO: 31990 - RNA, 19 nt, artificial
  Oligomer
cccguguagcacucagaua

SEQ ID NO: 31991 - RNA, 19 nt, artificial
  Oligomer
aaauacagacacugcccaa

SEQ ID NO: 31992 - RNA, 19 nt, artificial
  Oligomer
cgguguuaauaguccuagg

SEQ ID NO: 31993 - RNA, 19 nt, artificial
  Oligomer
gucuuuuguaucucagaaa

SEQ ID NO: 31994 - RNA, 19 nt, artificial
  Oligomer
uuuagucaaugaagaauua

SEQ ID NO: 31995 - RNA, 19 nt, artificial
  Oligomer
ggcagcaaguucaauauau

SEQ ID NO: 31996 - RNA, 19 nt, artificial
  Oligomer
agcccaguagaaauccaga

SEQ ID NO: 31997 - RNA, 19 nt, artificial
  Oligomer
agcagcugcuccuaaacca

SEQ ID NO: 31998 - RNA, 19 nt, artificial
  Oligomer
guuaguugguugucaguga

SEQ ID NO: 31999 - RNA, 19 nt, artificial
  Oligomer
ccagagaacauuuauucca

SEQ ID NO: 32000 - RNA, 19 nt, artificial
  Oligomer
gaauuaaucucuguuaaga

SEQ ID NO: 32001 - RNA, 19 nt, artificial
  Oligomer
agacuuacccguaauauuu

SEQ ID NO: 32002 - RNA, 19 nt, artificial
  Oligomer
ugaauaagcguaauucaga

SEQ ID NO: 32003 - RNA, 19 nt, artificial
  Oligomer
ggauggacuccauuacauu

SEQ ID NO: 32004 - RNA, 19 nt, artificial
  Oligomer
cccuugcuuuacugcuaga

SEQ ID NO: 32005 - RNA, 19 nt, artificial
  Oligomer
gauuuggaagucagaggaa

SEQ ID NO: 32006 - RNA, 19 nt, artificial
  Oligomer
ggcgcgccuuaaugauaag

SEQ ID NO: 32007 - RNA, 19 nt, artificial
  Oligomer
gcgccuuaaugauaaggag

SEQ ID NO: 32008 - RNA, 19 nt, artificial
  Oligomer
ggcuccacaugugcuugau

SEQ ID NO: 32009 - RNA, 19 nt, artificial
  Oligomer
acaaacuaaaggcucuaaa

SEQ ID NO: 32010 - RNA, 19 nt, artificial
  Oligomer
ugauguucuucaacgauuu

SEQ ID NO: 32011 - RNA, 19 nt, artificial
  Oligomer
cuugcugaacuucaggaaa

SEQ ID NO: 32012 - RNA, 19 nt, artificial
  Oligomer
gacauuuagcgugaugaaa

SEQ ID NO: 32013 - RNA, 19 nt, artificial
  Oligomer
guuccaguuacuccagaaa

SEQ ID NO: 32014 - RNA, 19 nt, artificial
  Oligomer
caaaaauuucacaagacuu

SEQ ID NO: 32015 - RNA, 19 nt, artificial
  Oligomer
guuugguguaaauguaaau

SEQ ID NO: 32016 - RNA, 19 nt, artificial
  Oligomer
gcuacgguaccaguaauua

SEQ ID NO: 32017 - RNA, 19 nt, artificial
  Oligomer
gaagaauuaaucucuguua

SEQ ID NO: 32018 - RNA, 19 nt, artificial
  Oligomer
gaagaaggcagcucuacag

SEQ ID NO: 32019 - RNA, 19 nt, artificial
  Oligomer
ggaaauugaacagaugaau

SEQ ID NO: 32020 - RNA, 19 nt, artificial
  Oligomer
caguucaggagaaccauga

SEQ ID NO: 32021 - RNA, 19 nt, artificial
  Oligomer
cuuaaaguuuuugaaacaa

SEQ ID NO: 32022 - RNA, 19 nt, artificial
  Oligomer
gggaacuaaaccaaaacca

SEQ ID NO: 32023 - RNA, 19 nt, artificial
  Oligomer
gugaauaucgaagaaagga

SEQ ID NO: 32024 - RNA, 19 nt, artificial
  Oligomer
ccagaagaaccaaauccag

SEQ ID NO: 32025 - RNA, 19 nt, artificial
  Oligomer
ccaguacagagaacaguga

SEQ ID NO: 32026 - RNA, 19 nt, artificial
  Oligomer
guauuuauugucuuuugua

SEQ ID NO: 32027 - RNA, 19 nt, artificial
  Oligomer
gagggauauguuccacgua

SEQ ID NO: 32028 - RNA, 19 nt, artificial
  Oligomer
aagaauccugucuaguaaa

SEQ ID NO: 32029 - RNA, 19 nt, artificial
  Oligomer
acagauugaagcccagcaa

SEQ ID NO: 32030 - RNA, 19 nt, artificial
  Oligomer
cacccagagaacauuuauu

SEQ ID NO: 32031 - RNA, 19 nt, artificial
  Oligomer
aguugcugagcaggagaaa

SEQ ID NO: 32032 - RNA, 19 nt, artificial
  Oligomer
caaguugcugagcaggaga

SEQ ID NO: 32033 - RNA, 19 nt, artificial
  Oligomer
uagucaaugaagaauuaau

SEQ ID NO: 32034 - RNA, 19 nt, artificial
  Oligomer
ucaauauauuccauguaua

SEQ ID NO: 32035 - RNA, 19 nt, artificial
  Oligomer
agagacuaagcaaugggaa

SEQ ID NO: 32036 - RNA, 19 nt, artificial
  Oligomer
ggaaguucucagcaguugu

SEQ ID NO: 32037 - RNA, 19 nt, artificial
  Oligomer
gggauuaugaaccucagaa

SEQ ID NO: 32038 - RNA, 19 nt, artificial
  Oligomer
gugcgaggaaauggaggaa

SEQ ID NO: 32039 - RNA, 19 nt, artificial
  Oligomer
guccaguugcggauaauga

SEQ ID NO: 32040 - RNA, 19 nt, artificial
  Oligomer
cuuuaaaaacaguuguaau

SEQ ID NO: 32041 - RNA, 19 nt, artificial
  Oligomer
gcaacagauugaagcccag

SEQ ID NO: 32042 - RNA, 19 nt, artificial
  Oligomer
ucugcuucuguaccucaaa

SEQ ID NO: 32043 - RNA, 19 nt, artificial
  Oligomer
ugagcuugaucgccucuau

SEQ ID NO: 32044 - RNA, 19 nt, artificial
  Oligomer
agaagccuuacgaaagaaa

SEQ ID NO: 32045 - RNA, 19 nt, artificial
  Oligomer
gcugagcaggagaaacuua

SEQ ID NO: 32046 - RNA, 19 nt, artificial
  Oligomer
ugggaaacuuguggaggaa

SEQ ID NO: 32047 - RNA, 19 nt, artificial
  Oligomer
aucucaggauccaaguuua

SEQ ID NO: 32048 - RNA, 19 nt, artificial
  Oligomer
agaccagacccuuucucca

SEQ ID NO: 32049 - RNA, 19 nt, artificial
  Oligomer
cggaugguuccuuggucau

SEQ ID NO: 32050 - RNA, 19 nt, artificial
  Oligomer
agaaguuccaguuacucca

SEQ ID NO: 32051 - RNA, 19 nt, artificial
  Oligomer
uuaguugguugucagugaa

SEQ ID NO: 32052 - RNA, 19 nt, artificial
  Oligomer
aacagagggaguguuugaa

SEQ ID NO: 32053 - RNA, 19 nt, artificial
  Oligomer
ugagaaucaggaagcuaag

SEQ ID NO: 32054 - RNA, 19 nt, artificial
  Oligomer
guagcacucagauaaguau

SEQ ID NO: 32055 - RNA, 19 nt, artificial
  Oligomer
acgguaccaguaauuagau

SEQ ID NO: 32056 - RNA, 19 nt, artificial
  Oligomer
gaagaugggcauaaugaau

SEQ ID NO: 32057 - RNA, 19 nt, artificial
  Oligomer
ccugguaaaaggacaaacu

SEQ ID NO: 32058 - RNA, 19 nt, artificial
  Oligomer
aguuucaucugauggaaau

SEQ ID NO: 32059 - RNA, 19 nt, artificial
  Oligomer
guuguuccguccaugggaa

SEQ ID NO: 32060 - RNA, 19 nt, artificial
  Oligomer
caucuuaagaauuauacau

SEQ ID NO: 32061 - RNA, 19 nt, artificial
  Oligomer
uuuuguagcaucuuaagaa

SEQ ID NO: 32062 - RNA, 19 nt, artificial
  Oligomer
gggaaacuuguggaggaaa

SEQ ID NO: 32063 - RNA, 19 nt, artificial
  Oligomer
aggaaauggaggaaggcua

SEQ ID NO: 32064 - RNA, 19 nt, artificial
  Oligomer
cguugaccaagacucauac

SEQ ID NO: 32065 - RNA, 19 nt, artificial
  Oligomer
cuccagguucuaagcaaga

SEQ ID NO: 32066 - RNA, 19 nt, artificial
  Oligomer
cugcagcuaagaaacaaau

SEQ ID NO: 32067 - RNA, 19 nt, artificial
  Oligomer
gauguuucuuaccguguau

SEQ ID NO: 32068 - RNA, 19 nt, artificial
  Oligomer
cugguacaguuugguguaa

SEQ ID NO: 32069 - RNA, 19 nt, artificial
  Oligomer
uuaugagguugaugaccca

SEQ ID NO: 32070 - RNA, 19 nt, artificial
  Oligomer
cugccuccugguaaaagga

SEQ ID NO: 32071 - RNA, 19 nt, artificial
  Oligomer
ggucucucugguuccugaa

SEQ ID NO: 32072 - RNA, 19 nt, artificial
  Oligomer
cgauuuggaagucagagga

SEQ ID NO: 32073 - RNA, 19 nt, artificial
  Oligomer
aaggcacugcacacuugua

SEQ ID NO: 32074 - RNA, 19 nt, artificial
  Oligomer
cacaaacuaaaggcucuaa

SEQ ID NO: 32075 - RNA, 19 nt, artificial
  Oligomer
agaagaaguaauacgauua

SEQ ID NO: 32076 - RNA, 19 nt, artificial
  Oligomer
gcuucuguaccucaaagca

SEQ ID NO: 32077 - RNA, 19 nt, artificial
  Oligomer
cucucugguuccugaauca

SEQ ID NO: 32078 - RNA, 19 nt, artificial
  Oligomer
aaccaugaaaacgaaagaa

SEQ ID NO: 32079 - RNA, 19 nt, artificial
  Oligomer
accuagaagccuuacgaaa

SEQ ID NO: 32080 - RNA, 19 nt, artificial
  Oligomer
cuacgguaccaguaauuag

SEQ ID NO: 32081 - RNA, 19 nt, artificial
  Oligomer
gcaugacaaucauccacag

SEQ ID NO: 32082 - RNA, 19 nt, artificial
  Oligomer
ggauauguuccacguaacu

SEQ ID NO: 32083 - RNA, 19 nt, artificial
  Oligomer
ugguggaucugugcaaaga

SEQ ID NO: 32084 - RNA, 19 nt, artificial
  Oligomer
cuggugaauaucgaagaaa

SEQ ID NO: 32085 - RNA, 19 nt, artificial
  Oligomer
ugguacaguuugguguaaa

SEQ ID NO: 32086 - RNA, 19 nt, artificial
  Oligomer
uccagguucuaagcaagaa

SEQ ID NO: 32087 - RNA, 19 nt, artificial
  Oligomer
cugggaaugcucuggauca

SEQ ID NO: 32088 - RNA, 19 nt, artificial
  Oligomer
agaaaaucuaccaguuuca

SEQ ID NO: 32089 - RNA, 19 nt, artificial
  Oligomer
augcucagguugcaaauaa

SEQ ID NO: 32090 - RNA, 19 nt, artificial
  Oligomer
aggauugaagaauucacca

SEQ ID NO: 32091 - RNA, 19 nt, artificial
  Oligomer
gggaguguuugaauaagcg

SEQ ID NO: 32092 - RNA, 19 nt, artificial
  Oligomer
caccuccuguuccuacaaa

SEQ ID NO: 32093 - RNA, 19 nt, artificial
  Oligomer
uuacuuccacccuucagaa

SEQ ID NO: 32094 - RNA, 19 nt, artificial
  Oligomer
ucuagaagagaaugaagga

SEQ ID NO: 32095 - RNA, 19 nt, artificial
  Oligomer
ugaauaaaggagucauuua

SEQ ID NO: 32096 - RNA, 19 nt, artificial
  Oligomer
acaacaagaucagcgacaa

SEQ ID NO: 32097 - RNA, 19 nt, artificial
  Oligomer
uucaucuucgucuucccug

SEQ ID NO: 32098 - RNA, 19 nt, artificial
  Oligomer
uucguuuucaugguucucc

SEQ ID NO: 32099 - RNA, 19 nt, artificial
  Oligomer
uugaauuucacccucauuc

SEQ ID NO: 32100 - RNA, 19 nt, artificial
  Oligomer
uucucuuucucccucagcg

SEQ ID NO: 32101 - RNA, 19 nt, artificial
  Oligomer
uucgauuucaucuucgucu

SEQ ID NO: 32102 - RNA, 19 nt, artificial
  Oligomer
uucuaggucagcaucacuc

SEQ ID NO: 32103 - RNA, 19 nt, artificial
  Oligomer
uuauuguucacugacaacc

SEQ ID NO: 32104 - RNA, 19 nt, artificial
  Oligomer
uucuucuggguuauucugg

SEQ ID NO: 32105 - RNA, 19 nt, artificial
  Oligomer
uucagcaagagucagaucc

SEQ ID NO: 32106 - RNA, 19 nt, artificial
  Oligomer
uuuaaagucagcuaugauc

SEQ ID NO: 32107 - RNA, 19 nt, artificial
  Oligomer
uuguuacugagauacacgg

SEQ ID NO: 32108 - RNA, 19 nt, artificial
  Oligomer
uucuucaucgcuuucaagc

SEQ ID NO: 32109 - RNA, 19 nt, artificial
  Oligomer
uuuuagagccuuuaguuug

SEQ ID NO: 32110 - RNA, 19 nt, artificial
  Oligomer
uuuauuugcaaccugagca

SEQ ID NO: 32111 - RNA, 19 nt, artificial
  Oligomer
uacaaggucaaauucuccc

SEQ ID NO: 32112 - RNA, 19 nt, artificial
  Oligomer
uucugaauuacgcuuauuc

SEQ ID NO: 32113 - RNA, 19 nt, artificial
  Oligomer
uucuuugcacagauccacc

SEQ ID NO: 32114 - RNA, 19 nt, artificial
  Oligomer
uucuucgauauucaccagg

SEQ ID NO: 32115 - RNA, 19 nt, artificial
  Oligomer
uucuuuuuaaacuuggauc

SEQ ID NO: 32116 - RNA, 19 nt, artificial
  Oligomer
uccaucaucaacuugaucc

SEQ ID NO: 32117 - RNA, 19 nt, artificial
  Oligomer
uuuugguuuaguucccaug

SEQ ID NO: 32118 - RNA, 19 nt, artificial
  Oligomer
uuuaaguuucuccugcuca

SEQ ID NO: 32119 - RNA, 19 nt, artificial
  Oligomer
uucaucacgcuaaaugucc

SEQ ID NO: 32120 - RNA, 19 nt, artificial
  Oligomer
uuggaauaaauguucucug

SEQ ID NO: 32121 - RNA, 19 nt, artificial
  Oligomer
uuugucucuucgacgcucg

SEQ ID NO: 32122 - RNA, 19 nt, artificial
  Oligomer
uuuuuuuagcuuagcuucc

SEQ ID NO: 32123 - RNA, 19 nt, artificial
  Oligomer
auuaacacgcuuauccaug

SEQ ID NO: 32124 - RNA, 19 nt, artificial
  Oligomer
uucgucuucccuguggaug

SEQ ID NO: 32125 - RNA, 19 nt, artificial
  Oligomer
uacagauuaaaauucagcc

SEQ ID NO: 32126 - RNA, 19 nt, artificial
  Oligomer
ucuugguccacucacaaug

SEQ ID NO: 32127 - RNA, 19 nt, artificial
  Oligomer
uuaucauuaaggcgcgccc

SEQ ID NO: 32128 - RNA, 19 nt, artificial
  Oligomer
uuucuugcuuagaaccugg

SEQ ID NO: 32129 - RNA, 19 nt, artificial
  Oligomer
uuucuucucuuucucccuc

SEQ ID NO: 32130 - RNA, 19 nt, artificial
  Oligomer
uuuuacgcaaguuuguccu

SEQ ID NO: 32131 - RNA, 19 nt, artificial
  Oligomer
uucaauuuguuucuuagcu

SEQ ID NO: 32132 - RNA, 19 nt, artificial
  Oligomer
uuuuauuugcaaccugagc

SEQ ID NO: 32133 - RNA, 19 nt, artificial
  Oligomer
auuuacaccaaacuguacc

SEQ ID NO: 32134 - RNA, 19 nt, artificial
  Oligomer
uguauaauucuuaagaugc

SEQ ID NO: 32135 - RNA, 19 nt, artificial
  Oligomer
auuguuacugagauacacg

SEQ ID NO: 32136 - RNA, 19 nt, artificial
  Oligomer
uucuacaucuaauuacugg

SEQ ID NO: 32137 - RNA, 19 nt, artificial
  Oligomer
uuucaugggcagcucauca

SEQ ID NO: 32138 - RNA, 19 nt, artificial
  Oligomer
uuuuuaaacuuggauccug

SEQ ID NO: 32139 - RNA, 19 nt, artificial
  Oligomer
uuugcacagauccaccacg

SEQ ID NO: 32140 - RNA, 19 nt, artificial
  Oligomer
uagagcugccuucuucuuc

SEQ ID NO: 32141 - RNA, 19 nt, artificial
  Oligomer
uugucaugcagucuccuuc

SEQ ID NO: 32142 - RNA, 19 nt, artificial
  Oligomer
uuuccucgcacuuaucugc

SEQ ID NO: 32143 - RNA, 19 nt, artificial
  Oligomer
uuauucuggagauuugggc

SEQ ID NO: 32144 - RNA, 19 nt, artificial
  Oligomer
uuacuagacaggauucuug

SEQ ID NO: 32145 - RNA, 19 nt, artificial
  Oligomer
uuuuuagcuuagcuuccug

SEQ ID NO: 32146 - RNA, 19 nt, artificial
  Oligomer
uuuuagcuuagcuuccuga

SEQ ID NO: 32147 - RNA, 19 nt, artificial
  Oligomer
uagccuuuuaaguuucucc

SEQ ID NO: 32148 - RNA, 19 nt, artificial
  Oligomer
uuaauucuuggguacaguc

SEQ ID NO: 32149 - RNA, 19 nt, artificial
  Oligomer
uucauaaucccaaagcgca

SEQ ID NO: 32150 - RNA, 19 nt, artificial
  Oligomer
aucuugacaaauauuacgg

SEQ ID NO: 32151 - RNA, 19 nt, artificial
  Oligomer
ucugacuuccaaaucguug

SEQ ID NO: 32152 - RNA, 19 nt, artificial
  Oligomer
uucuuuagaggccuuggug

SEQ ID NO: 32153 - RNA, 19 nt, artificial
  Oligomer
uuuaguuugugaagcagcc

SEQ ID NO: 32154 - RNA, 19 nt, artificial
  Oligomer
uuugguuuaguucccaugg

SEQ ID NO: 32155 - RNA, 19 nt, artificial
  Oligomer
ucuugauucaauuuguuuc

SEQ ID NO: 32156 - RNA, 19 nt, artificial
  Oligomer
uuuguuucuuagcugcagc

SEQ ID NO: 32157 - RNA, 19 nt, artificial
  Oligomer
uucaauuuccuccacaagu

SEQ ID NO: 32158 - RNA, 19 nt, artificial
  Oligomer
uuuuaaguuucuccugcuc

SEQ ID NO: 32159 - RNA, 19 nt, artificial
  Oligomer
uuaaagucagcuaugaucu

SEQ ID NO: 32160 - RNA, 19 nt, artificial
  Oligomer
uucuuggguacagucccag

SEQ ID NO: 32161 - RNA, 19 nt, artificial
  Oligomer
auuaacaccguucuccuuu

SEQ ID NO: 32162 - RNA, 19 nt, artificial
  Oligomer
uuguucacugacaaccaac

SEQ ID NO: 32163 - RNA, 19 nt, artificial
  Oligomer
uuugucuugguuuaauucu

SEQ ID NO: 32164 - RNA, 19 nt, artificial
  Oligomer
uuauucauuaugcccaucu

SEQ ID NO: 32165 - RNA, 19 nt, artificial
  Oligomer
uacaugaggcagcacaaug

SEQ ID NO: 32166 - RNA, 19 nt, artificial
  Oligomer
uauuucaucacgcuaaaug

SEQ ID NO: 32167 - RNA, 19 nt, artificial
  Oligomer
uauucaaacacucccucug

SEQ ID NO: 32168 - RNA, 19 nt, artificial
  Oligomer
uuacauuuacaccaaacug

SEQ ID NO: 32169 - RNA, 19 nt, artificial
  Oligomer
uucuacugggcuuucugag

SEQ ID NO: 32170 - RNA, 19 nt, artificial
  Oligomer
uucauuaugcccaucuucu

SEQ ID NO: 32171 - RNA, 19 nt, artificial
  Oligomer
uucuuuuugcuguagagcu

SEQ ID NO: 32172 - RNA, 19 nt, artificial
  Oligomer
acuauuaacaccguucucc

SEQ ID NO: 32173 - RNA, 19 nt, artificial
  Oligomer
uacacgguaagaaacaucg

SEQ ID NO: 32174 - RNA, 19 nt, artificial
  Oligomer
uaauucuuggguacagucc

SEQ ID NO: 32175 - RNA, 19 nt, artificial
  Oligomer
uuucaaaaacuuuaagcgc

SEQ ID NO: 32176 - RNA, 19 nt, artificial
  Oligomer
ucugguaugagucuugguc

SEQ ID NO: 32177 - RNA, 19 nt, artificial
  Oligomer
uuuuuauuugcaaccugag

SEQ ID NO: 32178 - RNA, 19 nt, artificial
  Oligomer
uuucccauugcuuagucuc

SEQ ID NO: 32179 - RNA, 19 nt, artificial
  Oligomer
uaggucagcaucacucugg

SEQ ID NO: 32180 - RNA, 19 nt, artificial
  Oligomer
uucaaucuguugcugcugg

SEQ ID NO: 32181 - RNA, 19 nt, artificial
  Oligomer
ucuuucguuuucaugguuc

SEQ ID NO: 32182 - RNA, 19 nt, artificial
  Oligomer
uucaugguucuccugaacu

SEQ ID NO: 32183 - RNA, 19 nt, artificial
  Oligomer
uuucuuuuugcuguagagc

SEQ ID NO: 32184 - RNA, 19 nt, artificial
  Oligomer
uuggauccugagaucuugg

SEQ ID NO: 32185 - RNA, 19 nt, artificial
  Oligomer
uuuuaaacuuggauccuga

SEQ ID NO: 32186 - RNA, 19 nt, artificial
  Oligomer
ucaauuuguuucuuagcug

SEQ ID NO: 32187 - RNA, 19 nt, artificial
  Oligomer
uguuacaugaggcagcaca

SEQ ID NO: 32188 - RNA, 19 nt, artificial
  Oligomer
aauauuacggguaagucug

SEQ ID NO: 32189 - RNA, 19 nt, artificial
  Oligomer
ucuucaauccuucauucuc

SEQ ID NO: 32190 - RNA, 19 nt, artificial
  Oligomer
ucuucauugacuaaaauuc

SEQ ID NO: 32191 - RNA, 19 nt, artificial
  Oligomer
uucucuucuagagacauuc

SEQ ID NO: 32192 - RNA, 19 nt, artificial
  Oligomer
uucaccagcaauucaggcc

SEQ ID NO: 32193 - RNA, 19 nt, artificial
  Oligomer
uucaucgcuuucaagcuac

SEQ ID NO: 32194 - RNA, 19 nt, artificial
  Oligomer
uuucaucuucgucuucccu

SEQ ID NO: 32195 - RNA, 19 nt, artificial
  Oligomer
uucguaaggcuucuagguc

SEQ ID NO: 32196 - RNA, 19 nt, artificial
  Oligomer
uuauucaaacacucccucu

SEQ ID NO: 32197 - RNA, 19 nt, artificial
  Oligomer
acuuucuucucuuucuccc

SEQ ID NO: 32198 - RNA, 19 nt, artificial
  Oligomer
uucauugacuaaaauucug

SEQ ID NO: 32199 - RNA, 19 nt, artificial
  Oligomer
uuaguuugugaagcagccc

SEQ ID NO: 32200 - RNA, 19 nt, artificial
  Oligomer
uuaucugagugcuacacgg

SEQ ID NO: 32201 - RNA, 19 nt, artificial
  Oligomer
cucauuaacacgcuuaucc

SEQ ID NO: 32202 - RNA, 19 nt, artificial
  Oligomer
uuagcuuccugauucucag

SEQ ID NO: 32203 - RNA, 19 nt, artificial
  Oligomer
uucaaaaacuuuaagcgcu

SEQ ID NO: 32204 - RNA, 19 nt, artificial
  Oligomer
ucuguuuugguuuuguagg

SEQ ID NO: 32205 - RNA, 19 nt, artificial
  Oligomer
uagcuuagcuuccugauuc

SEQ ID NO: 32206 - RNA, 19 nt, artificial
  Oligomer
aauucuuucguuuucaugg

SEQ ID NO: 32207 - RNA, 19 nt, artificial
  Oligomer
uuacggguaagucuguagc

SEQ ID NO: 32208 - RNA, 19 nt, artificial
  Oligomer
uuuaagugcucucacuuuu

SEQ ID NO: 32209 - RNA, 19 nt, artificial
  Oligomer
uuguuucuggaguaacugg

SEQ ID NO: 32210 - RNA, 19 nt, artificial
  Oligomer
auuucuacugggcuuucug

SEQ ID NO: 32211 - RNA, 19 nt, artificial
  Oligomer
uugcuguagagcugccuuc

SEQ ID NO: 32212 - RNA, 19 nt, artificial
  Oligomer
uucuucucuuucucccuca

SEQ ID NO: 32213 - RNA, 19 nt, artificial
  Oligomer
ucuuuuuaaacuuggaucc

SEQ ID NO: 32214 - RNA, 19 nt, artificial
  Oligomer
ucuuuagaggccuuggugc

SEQ ID NO: 32215 - RNA, 19 nt, artificial
  Oligomer
uuucagguucuggacugcc

SEQ ID NO: 32216 - RNA, 19 nt, artificial
  Oligomer
uuaaaauucagccuacaaa

SEQ ID NO: 32217 - RNA, 19 nt, artificial
  Oligomer
uuaacaccguucuccuuuc

SEQ ID NO: 32218 - RNA, 19 nt, artificial
  Oligomer
ucuugguuuaauucuuggg

SEQ ID NO: 32219 - RNA, 19 nt, artificial
  Oligomer
uuuugcuguagagcugccu

SEQ ID NO: 32220 - RNA, 19 nt, artificial
  Oligomer
uuuaagcgcuguuccuuag

SEQ ID NO: 32221 - RNA, 19 nt, artificial
  Oligomer
uagucucuucuguuccacg

SEQ ID NO: 32222 - RNA, 19 nt, artificial
  Oligomer
uuucuuuuagccuuuuaag

SEQ ID NO: 32223 - RNA, 19 nt, artificial
  Oligomer
ucgcuuucaagcuacauug

SEQ ID NO: 32224 - RNA, 19 nt, artificial
  Oligomer
uguuucaaaaacuuuaagc

SEQ ID NO: 32225 - RNA, 19 nt, artificial
  Oligomer
uauuacuucuucuuaacag

SEQ ID NO: 32226 - RNA, 19 nt, artificial
  Oligomer
auuugcaaccugagcaucc

SEQ ID NO: 32227 - RNA, 19 nt, artificial
  Oligomer
uucuucuuccacagccggu

SEQ ID NO: 32228 - RNA, 19 nt, artificial
  Oligomer
uccuuuauucauuaugccc

SEQ ID NO: 32229 - RNA, 19 nt, artificial
  Oligomer
aauaauucucuguacaagg

SEQ ID NO: 32230 - RNA, 19 nt, artificial
  Oligomer
aucuucgucuucccugugg

SEQ ID NO: 32231 - RNA, 19 nt, artificial
  Oligomer
uagaaaacaggauugucgc

SEQ ID NO: 32232 - RNA, 19 nt, artificial
  Oligomer
auacagauuaaaauucagc

SEQ ID NO: 32233 - RNA, 19 nt, artificial
  Oligomer
uguagagcugccuucuucu

SEQ ID NO: 32234 - RNA, 19 nt, artificial
  Oligomer
auaauucuuaagaugcuac

SEQ ID NO: 32235 - RNA, 19 nt, artificial
  Oligomer
ucaaacacucccucuguug

SEQ ID NO: 32236 - RNA, 19 nt, artificial
  Oligomer
uucgauauucaccaggaac

SEQ ID NO: 32237 - RNA, 19 nt, artificial
  Oligomer
uuuuacaccauuucuuuuu

SEQ ID NO: 32238 - RNA, 19 nt, artificial
  Oligomer
uauacaagugugcagugcc

SEQ ID NO: 32239 - RNA, 19 nt, artificial
  Oligomer
uuaaguuucuccugcucag

SEQ ID NO: 32240 - RNA, 19 nt, artificial
  Oligomer
uuuaccaggaggcagagag

SEQ ID NO: 32241 - RNA, 19 nt, artificial
  Oligomer
uugaagaacaucaaacauu

SEQ ID NO: 32242 - RNA, 19 nt, artificial
  Oligomer
uugcuuagucucuucuguu

SEQ ID NO: 32243 - RNA, 19 nt, artificial
  Oligomer
auuuccucgcacuuaucug

SEQ ID NO: 32244 - RNA, 19 nt, artificial
  Oligomer
uguuguuucaaaaacuuua

SEQ ID NO: 32245 - RNA, 19 nt, artificial
  Oligomer
ucuuucguaaggcuucuag

SEQ ID NO: 32246 - RNA, 19 nt, artificial
  Oligomer
auugucauuaaaauaaguc

SEQ ID NO: 32247 - RNA, 19 nt, artificial
  Oligomer
uucaccaggaacuuuuaca

SEQ ID NO: 32248 - RNA, 19 nt, artificial
  Oligomer
ucauguugggcagugucug

SEQ ID NO: 32249 - RNA, 19 nt, artificial
  Oligomer
ugugaagugcugcucauug

SEQ ID NO: 32250 - RNA, 19 nt, artificial
  Oligomer
uugauccagagcauuccca

SEQ ID NO: 32251 - RNA, 19 nt, artificial
  Oligomer
acuuggauggguaugaugg

SEQ ID NO: 32252 - RNA, 19 nt, artificial
  Oligomer
auaaaguuauuguucacug

SEQ ID NO: 32253 - RNA, 19 nt, artificial
  Oligomer
ucuagagacauucuucauc

SEQ ID NO: 32254 - RNA, 19 nt, artificial
  Oligomer
ucuucuagagacauucuuc

SEQ ID NO: 32255 - RNA, 19 nt, artificial
  Oligomer
uugugaagagccgugaugc

SEQ ID NO: 32256 - RNA, 19 nt, artificial
  Oligomer
uugucauuaaaauaagucu

SEQ ID NO: 32257 - RNA, 19 nt, artificial
  Oligomer
uuuacauuuacaccaaacu

SEQ ID NO: 32258 - RNA, 19 nt, artificial
  Oligomer
uaguuuguccaaaauaagg

SEQ ID NO: 32259 - RNA, 19 nt, artificial
  Oligomer
ucucuucuguuccacgugg

SEQ ID NO: 32260 - RNA, 19 nt, artificial
  Oligomer
agugucuguauuuucaucg

SEQ ID NO: 32261 - RNA, 19 nt, artificial
  Oligomer
uaagucuguagcaaguuuc

SEQ ID NO: 32262 - RNA, 19 nt, artificial
  Oligomer
ucaaacauauguauaauuc

SEQ ID NO: 32263 - RNA, 19 nt, artificial
  Oligomer
uacauuuacaccaaacugu

SEQ ID NO: 32264 - RNA, 19 nt, artificial
  Oligomer
uuuaauucuuggguacagu

SEQ ID NO: 32265 - RNA, 19 nt, artificial
  Oligomer
uaugaugggacagagaugg

SEQ ID NO: 32266 - RNA, 19 nt, artificial
  Oligomer
uauagaggcgaucaagcuc

SEQ ID NO: 32267 - RNA, 19 nt, artificial
  Oligomer
uuguuguuucaaaaacuuu

SEQ ID NO: 32268 - RNA, 19 nt, artificial
  Oligomer
uuucuuagcugcagcuccu

SEQ ID NO: 32269 - RNA, 19 nt, artificial
  Oligomer
ugguccacucacaaugucc

SEQ ID NO: 32270 - RNA, 19 nt, artificial
  Oligomer
auauucaccaggaacuuuu

SEQ ID NO: 32271 - RNA, 19 nt, artificial
  Oligomer
uuagacaguuucuuucgua

SEQ ID NO: 32272 - RNA, 19 nt, artificial
  Oligomer
uucuugagcaucucuagcu

SEQ ID NO: 32273 - RNA, 19 nt, artificial
  Oligomer
uuguugcugggcuucaauc

SEQ ID NO: 32274 - RNA, 19 nt, artificial
  Oligomer
uuccaucagaugaaacugg

SEQ ID NO: 32275 - RNA, 19 nt, artificial
  Oligomer
uggugcguuagacaguuuc

SEQ ID NO: 32276 - RNA, 19 nt, artificial
  Oligomer
uuuuuuagcuuagcuuccu

SEQ ID NO: 32277 - RNA, 19 nt, artificial
  Oligomer
uucaucuguucaauuuccu

SEQ ID NO: 32278 - RNA, 19 nt, artificial
  Oligomer
auuuaguugggcugagugg

SEQ ID NO: 32279 - RNA, 19 nt, artificial
  Oligomer
uuagucucuucuguuccac

SEQ ID NO: 32280 - RNA, 19 nt, artificial
  Oligomer
uucacugacaauauacaag

SEQ ID NO: 32281 - RNA, 19 nt, artificial
  Oligomer
uugagcaucucuagcugcc

SEQ ID NO: 32282 - RNA, 19 nt, artificial
  Oligomer
uggauggguaugaugggac

SEQ ID NO: 32283 - RNA, 19 nt, artificial
  Oligomer
uuucuuuuuaaacuuggau

SEQ ID NO: 32284 - RNA, 19 nt, artificial
  Oligomer
uaagaugcuacaaaaacuc

SEQ ID NO: 32285 - RNA, 19 nt, artificial
  Oligomer
guuuuacgcaaguuugucc

SEQ ID NO: 32286 - RNA, 19 nt, artificial
  Oligomer
ucaaacauugagaacggac

SEQ ID NO: 32287 - RNA, 19 nt, artificial
  Oligomer
uugucuugguuuaauucuu

SEQ ID NO: 32288 - RNA, 19 nt, artificial
  Oligomer
uucaugacgaaggaagaag

SEQ ID NO: 32289 - RNA, 19 nt, artificial
  Oligomer
uuuuguaggaacaggaggu

SEQ ID NO: 32290 - RNA, 19 nt, artificial
  Oligomer
ugcuguugcguauacaugg

SEQ ID NO: 32291 - RNA, 19 nt, artificial
  Oligomer
aaaauaaucguauuacuuc

SEQ ID NO: 32292 - RNA, 19 nt, artificial
  Oligomer
uucacugcucugguucuuc

SEQ ID NO: 32293 - RNA, 19 nt, artificial
  Oligomer
uaaauguccucuaauggug

SEQ ID NO: 32294 - RNA, 19 nt, artificial
  Oligomer
ugucuugguuuaauucuug

SEQ ID NO: 32295 - RNA, 19 nt, artificial
  Oligomer
aauauauugaacuugcugc

SEQ ID NO: 32296 - RNA, 19 nt, artificial
  Oligomer
uggauuugguucuucuggg

SEQ ID NO: 32297 - RNA, 19 nt, artificial
  Oligomer
uuugcaaccugagcauccc

SEQ ID NO: 32298 - RNA, 19 nt, artificial
  Oligomer
uucuucauugacuaaaauu

SEQ ID NO: 32299 - RNA, 19 nt, artificial
  Oligomer
ucaaauucucccuccaaag

SEQ ID NO: 32300 - RNA, 19 nt, artificial
  Oligomer
uuugcuguagagcugccuu

SEQ ID NO: 32301 - RNA, 19 nt, artificial
  Oligomer
ugguucuucuggguuauuc

SEQ ID NO: 32302 - RNA, 19 nt, artificial
  Oligomer
uuccaugagcgauacgcuc

SEQ ID NO: 32303 - RNA, 19 nt, artificial
  Oligomer
uagauuuucuuuuugcugu

SEQ ID NO: 32304 - RNA, 19 nt, artificial
  Oligomer
uuacuucuucuuaacagag

SEQ ID NO: 32305 - RNA, 19 nt, artificial
  Oligomer
uucuggauuucuacugggc

SEQ ID NO: 32306 - RNA, 19 nt, artificial
  Oligomer
uucuuuuagccuuuuaagu

SEQ ID NO: 32307 - RNA, 19 nt, artificial
  Oligomer
aauuuaguugggcugagug

SEQ ID NO: 32308 - RNA, 19 nt, artificial
  Oligomer
uaugagucuuggucaacgc

SEQ ID NO: 32309 - RNA, 19 nt, artificial
  Oligomer
uucugcucuugauucaauu

SEQ ID NO: 32310 - RNA, 19 nt, artificial
  Oligomer
uucugugaagugcugcuca

SEQ ID NO: 32311 - RNA, 19 nt, artificial
  Oligomer
ugucgcuguauacuuaucu

SEQ ID NO: 32312 - RNA, 19 nt, artificial
  Oligomer
uugguuuuguaggaacagg

SEQ ID NO: 32313 - RNA, 19 nt, artificial
  Oligomer
ugaaggacuccaaucaggg

SEQ ID NO: 32314 - RNA, 19 nt, artificial
  Oligomer
aucugcagcagucugcaug

SEQ ID NO: 32315 - RNA, 19 nt, artificial
  Oligomer
aucagcagcauuuacauuu

SEQ ID NO: 32316 - RNA, 19 nt, artificial
  Oligomer
uuacugguaccguagcuua

SEQ ID NO: 32317 - RNA, 19 nt, artificial
  Oligomer
aucggcaucaucuuggacc

SEQ ID NO: 32318 - RNA, 19 nt, artificial
  Oligomer
auaaucguauuacuucuuc

SEQ ID NO: 32319 - RNA, 19 nt, artificial
  Oligomer
augauugucaugcagucuc

SEQ ID NO: 32320 - RNA, 19 nt, artificial
  Oligomer
ugcagacugauugucaugg

SEQ ID NO: 32321 - RNA, 19 nt, artificial
  Oligomer
cuuucuucgauauucacca

SEQ ID NO: 32322 - RNA, 19 nt, artificial
  Oligomer
uaauucucuguacaagguc

SEQ ID NO: 32323 - RNA, 19 nt, artificial
  Oligomer
aguaacuggaacuucugug

SEQ ID NO: 32324 - RNA, 19 nt, artificial
  Oligomer
uuucguuuucaugguucuc

SEQ ID NO: 32325 - RNA, 19 nt, artificial
  Oligomer
auuuuuauuugcaaccuga

SEQ ID NO: 32326 - RNA, 19 nt, artificial
  Oligomer
auucgauuucaucuucguc

SEQ ID NO: 32327 - RNA, 19 nt, artificial
  Oligomer
uucuucacugacaauauac

SEQ ID NO: 32328 - RNA, 19 nt, artificial
  Oligomer
ccuuucuucgauauucacc

SEQ ID NO: 32329 - RNA, 19 nt, artificial
  Oligomer
uuacguggaacauaucccu

SEQ ID NO: 32330 - RNA, 19 nt, artificial
  Oligomer
augagucuuggucaacgcg

SEQ ID NO: 32331 - RNA, 19 nt, artificial
  Oligomer
uuaagaugcuacaaaaacu

SEQ ID NO: 32332 - RNA, 19 nt, artificial
  Oligomer
uuaaacuuggauccugaga

SEQ ID NO: 32333 - RNA, 19 nt, artificial
  Oligomer
uguaauagaacuacguuuc

SEQ ID NO: 32334 - RNA, 19 nt, artificial
  Oligomer
uuuagaggccuuggugcgu

SEQ ID NO: 32335 - RNA, 19 nt, artificial
  Oligomer
aucaacuugauccagagca

SEQ ID NO: 32336 - RNA, 19 nt, artificial
  Oligomer
acugaguguagccuuccuc

SEQ ID NO: 32337 - RNA, 19 nt, artificial
  Oligomer
uuguaggaacaggaggugg

SEQ ID NO: 32338 - RNA, 19 nt, artificial
  Oligomer
auaaauguucucugggugc

SEQ ID NO: 32339 - RNA, 19 nt, artificial
  Oligomer
uacaucuaauuacugguac

SEQ ID NO: 32340 - RNA, 19 nt, artificial
  Oligomer
augcuuuauuucaucacgc

SEQ ID NO: 32341 - RNA, 19 nt, artificial
  Oligomer
uuaacagagauuaauucuu

SEQ ID NO: 32342 - RNA, 19 nt, artificial
  Oligomer
uaaaauucagccuacaaac

SEQ ID NO: 32343 - RNA, 19 nt, artificial
  Oligomer
ucuccuuucuucgauauuc

SEQ ID NO: 32344 - RNA, 19 nt, artificial
  Oligomer
aaacauucgcucauuaucc

SEQ ID NO: 32345 - RNA, 19 nt, artificial
  Oligomer
uuuagcuuagcuuccugau

SEQ ID NO: 32346 - RNA, 19 nt, artificial
  Oligomer
ucuguauuuucaucggccc

SEQ ID NO: 32347 - RNA, 19 nt, artificial
  Oligomer
uauucaucuguucaauuuc

SEQ ID NO: 32348 - RNA, 19 nt, artificial
  Oligomer
uuaagcgcuguuccuuagu

SEQ ID NO: 32349 - RNA, 19 nt, artificial
  Oligomer
auuaaaauaagucuuguga

SEQ ID NO: 32350 - RNA, 19 nt, artificial
  Oligomer
auuacugguaccguagcuu

SEQ ID NO: 32351 - RNA, 19 nt, artificial
  Oligomer
uuggacguuguuacaugag

SEQ ID NO: 32352 - RNA, 19 nt, artificial
  Oligomer
uuagccuuuuaaguuucuc

SEQ ID NO: 32353 - RNA, 19 nt, artificial
  Oligomer
aauucuuggguacaguccc

SEQ ID NO: 32354 - RNA, 19 nt, artificial
  Oligomer
uucauucucuucuagagac

SEQ ID NO: 32355 - RNA, 19 nt, artificial
  Oligomer
uugcuguugucgcugaucu

SEQ ID NO: 32356 - RNA, 19 nt, artificial
  Oligomer
uuuuugcuguagagcugcc

SEQ ID NO: 32357 - RNA, 19 nt, artificial
  Oligomer
auaaaugacuccuuuauuc

SEQ ID NO: 32358 - RNA, 19 nt, artificial
  Oligomer
ucuaauggugaauucuuca

SEQ ID NO: 32359 - RNA, 19 nt, artificial
  Oligomer
auccagagcauucccagug

SEQ ID NO: 32360 - RNA, 19 nt, artificial
  Oligomer
uacagaagcagagccuugg

SEQ ID NO: 32361 - RNA, 19 nt, artificial
  Oligomer
uuacaggcuuaccauauac

SEQ ID NO: 32362 - RNA, 19 nt, artificial
  Oligomer
uugagguacagaagcagag

SEQ ID NO: 32363 - RNA, 19 nt, artificial
  Oligomer
aucaucuuggacccgaacc

SEQ ID NO: 32364 - RNA, 19 nt, artificial
  Oligomer
uaugcugggagauagcagc

SEQ ID NO: 32365 - RNA, 19 nt, artificial
  Oligomer
uuucuaauuucugagauac

SEQ ID NO: 32366 - RNA, 19 nt, artificial
  Oligomer
auuuccuccacaaguuucc

SEQ ID NO: 32367 - RNA, 19 nt, artificial
  Oligomer
auccgaggcauaguagacg

SEQ ID NO: 32368 - RNA, 19 nt, artificial
  Oligomer
uuuaaacuuggauccugag

SEQ ID NO: 32369 - RNA, 19 nt, artificial
  Oligomer
ucccuguggaugauuguca

SEQ ID NO: 32370 - RNA, 19 nt, artificial
  Oligomer
aucuguuuugguuuuguag

SEQ ID NO: 32371 - RNA, 19 nt, artificial
  Oligomer
uuccaaaucguugaagaac

SEQ ID NO: 32372 - RNA, 19 nt, artificial
  Oligomer
uuguuucuuagcugcagcu

SEQ ID NO: 32373 - RNA, 19 nt, artificial
  Oligomer
ucucauguugggcaguguc

SEQ ID NO: 32374 - RNA, 19 nt, artificial
  Oligomer
uuagaggccuuggugcguu

SEQ ID NO: 32375 - RNA, 19 nt, artificial
  Oligomer
ucguuuucaugguucuccu

SEQ ID NO: 32376 - RNA, 19 nt, artificial
  Oligomer
uuucaagcuacauugucau

SEQ ID NO: 32377 - RNA, 19 nt, artificial
  Oligomer
uuccucagaguaccaaagg

SEQ ID NO: 32378 - RNA, 19 nt, artificial
  Oligomer
ucuggauuugguucuucug

SEQ ID NO: 32379 - RNA, 19 nt, artificial
  Oligomer
uuaguuuguccaaaauaag

SEQ ID NO: 32380 - RNA, 19 nt, artificial
  Oligomer
uuuccaucagaugaaacug

SEQ ID NO: 32381 - RNA, 19 nt, artificial
  Oligomer
ucugguuucgguaaggauu

SEQ ID NO: 32382 - RNA, 19 nt, artificial
  Oligomer
ucauaaucaaggccuggag

SEQ ID NO: 32383 - RNA, 19 nt, artificial
  Oligomer
uucuuaacagagauuaauu

SEQ ID NO: 32384 - RNA, 19 nt, artificial
  Oligomer
aagaacaucaaacauucgc

SEQ ID NO: 32385 - RNA, 19 nt, artificial
  Oligomer
auuucaucuucgucuuccc

SEQ ID NO: 32386 - RNA, 19 nt, artificial
  Oligomer
ucaaaaacuuuaagcgcug

SEQ ID NO: 32387 - RNA, 19 nt, artificial
  Oligomer
uugacaacugcugagaacu

SEQ ID NO: 32388 - RNA, 19 nt, artificial
  Oligomer
auuguuucuggaguaacug

SEQ ID NO: 32389 - RNA, 19 nt, artificial
  Oligomer
uucuuucaugggcagcuca

SEQ ID NO: 32390 - RNA, 19 nt, artificial
  Oligomer
ucuuuuugcuguagagcug

SEQ ID NO: 32391 - RNA, 19 nt, artificial
  Oligomer
uccacucacaaugucccug

SEQ ID NO: 32392 - RNA, 19 nt, artificial
  Oligomer
uugacaaauauuacgggua

SEQ ID NO: 32393 - RNA, 19 nt, artificial
  Oligomer
uucuggaguaacuggaacu

SEQ ID NO: 32394 - RNA, 19 nt, artificial
  Oligomer
aaccucuccaucaucaacu

SEQ ID NO: 32395 - RNA, 19 nt, artificial
  Oligomer
uucuucuuaacagagauua

SEQ ID NO: 32396 - RNA, 19 nt, artificial
  Oligomer
uacaccaaacuguaccagg

SEQ ID NO: 32397 - RNA, 19 nt, artificial
  Oligomer
acgcacuuucuucucuuuc

SEQ ID NO: 32398 - RNA, 19 nt, artificial
  Oligomer
uggaacuucugugaagugc

SEQ ID NO: 32399 - RNA, 19 nt, artificial
  Oligomer
aaaaaguuuauuacaacug

SEQ ID NO: 32400 - RNA, 19 nt, artificial
  Oligomer
ucauaaauaauucucugua

SEQ ID NO: 32401 - RNA, 19 nt, artificial
  Oligomer
agucuugugaaauuuuugc

SEQ ID NO: 32402 - RNA, 19 nt, artificial
  Oligomer
uuucuacugggcuuucuga

SEQ ID NO: 32403 - RNA, 19 nt, artificial
  Oligomer
uauagggaccuacugcagc

SEQ ID NO: 32404 - RNA, 19 nt, artificial
  Oligomer
uucccuguggaugauuguc

SEQ ID NO: 32405 - RNA, 19 nt, artificial
  Oligomer
uaaauauggauucuggauu

SEQ ID NO: 32406 - RNA, 19 nt, artificial
  Oligomer
uuguccuuuuaccaggagg

SEQ ID NO: 32407 - RNA, 19 nt, artificial
  Oligomer
ucuuguagaaaacaggauu

SEQ ID NO: 32408 - RNA, 19 nt, artificial
  Oligomer
uucaugggcagcucaucau

SEQ ID NO: 32409 - RNA, 19 nt, artificial
  Oligomer
uucaauccuucauucucuu

SEQ ID NO: 32410 - RNA, 19 nt, artificial
  Oligomer
aucuucacugcucugguuc

SEQ ID NO: 32411 - RNA, 19 nt, artificial
  Oligomer
uuaagugcucucacuuuuu

SEQ ID NO: 32412 - RNA, 19 nt, artificial
  Oligomer
uguacaaggucaaauucuc

SEQ ID NO: 32413 - RNA, 19 nt, artificial
  Oligomer
uucuucaauccuucauucu

SEQ ID NO: 32414 - RNA, 19 nt, artificial
  Oligomer
uuacgcuuauucaaacacu

SEQ ID NO: 32415 - RNA, 19 nt, artificial
  Oligomer
uguuucuggaguaacugga

SEQ ID NO: 32416 - RNA, 19 nt, artificial
  Oligomer
uuacgcaaguuuguccuuu

SEQ ID NO: 32417 - RNA, 19 nt, artificial
  Oligomer
aacaucggcaucaucuugg

SEQ ID NO: 32418 - RNA, 19 nt, artificial
  Oligomer
ucuaauuacugguaccgua

SEQ ID NO: 32419 - RNA, 19 nt, artificial
  Oligomer
uacugcaucaaacauugag

SEQ ID NO: 32420 - RNA, 19 nt, artificial
  Oligomer
guagaaaacaggauugucg

SEQ ID NO: 32421 - RNA, 19 nt, artificial
  Oligomer
uuaaucuguuuugguuuug

SEQ ID NO: 32422 - RNA, 19 nt, artificial
  Oligomer
ucuacaucuaauuacuggu

SEQ ID NO: 32423 - RNA, 19 nt, artificial
  Oligomer
uauuguucacugacaacca

SEQ ID NO: 32424 - RNA, 19 nt, artificial
  Oligomer
uacgcuuauucaaacacuc

SEQ ID NO: 32425 - RNA, 19 nt, artificial
  Oligomer
auuggaauaaauguucucu

SEQ ID NO: 32426 - RNA, 19 nt, artificial
  Oligomer
ucauugacuaaaauucugu

SEQ ID NO: 32427 - RNA, 19 nt, artificial
  Oligomer
auucaauuuguuucuuagc

SEQ ID NO: 32428 - RNA, 19 nt, artificial
  Oligomer
uacugguaccguagcuuag

SEQ ID NO: 32429 - RNA, 19 nt, artificial
  Oligomer
ucaagcuacauugucauua

SEQ ID NO: 32430 - RNA, 19 nt, artificial
  Oligomer
ucguugaagaacaucaaac

SEQ ID NO: 32431 - RNA, 19 nt, artificial
  Oligomer
cuuauucaaacacucccuc

SEQ ID NO: 32432 - RNA, 19 nt, artificial
  Oligomer
cuuaucugagugcuacacg

SEQ ID NO: 32433 - RNA, 19 nt, artificial
  Oligomer
uaaaugauccuauuuacua

SEQ ID NO: 32434 - RNA, 19 nt, artificial
  Oligomer
acugcugagaacuuccguc

SEQ ID NO: 32435 - RNA, 19 nt, artificial
  Oligomer
ucaucuguucaauuuccuc

SEQ ID NO: 32436 - RNA, 19 nt, artificial
  Oligomer
ugaauuucacccucauucc

SEQ ID NO: 32437 - RNA, 19 nt, artificial
  Oligomer
agcagguggacuuucuugc

SEQ ID NO: 32438 - RNA, 19 nt, artificial
  Oligomer
auacacuugaaaagugugg

SEQ ID NO: 32439 - RNA, 19 nt, artificial
  Oligomer
ucuugacaaauauuacggg

SEQ ID NO: 32440 - RNA, 19 nt, artificial
  Oligomer
uuuuagccuuuuaaguuuc

SEQ ID NO: 32441 - RNA, 19 nt, artificial
  Oligomer
ucuuguuguuucaaaaacu

SEQ ID NO: 32442 - RNA, 19 nt, artificial
  Oligomer
uuucaugguucuccugaac

SEQ ID NO: 32443 - RNA, 19 nt, artificial
  Oligomer
auuaugcccaucuucuccu

SEQ ID NO: 32444 - RNA, 19 nt, artificial
  Oligomer
ugagaacggacgcacuuuc

SEQ ID NO: 32445 - RNA, 19 nt, artificial
  Oligomer
uuuugcuggaacaaauuau

SEQ ID NO: 32446 - RNA, 19 nt, artificial
  Oligomer
cuuuuuuuagcuuagcuuc

SEQ ID NO: 32447 - RNA, 19 nt, artificial
  Oligomer
uguuucuuagcugcagcuc

SEQ ID NO: 32448 - RNA, 19 nt, artificial
  Oligomer
ucuuuuagccuuuuaaguu

SEQ ID NO: 32449 - RNA, 19 nt, artificial
  Oligomer
uauaauucuuaagaugcua

SEQ ID NO: 32450 - RNA, 19 nt, artificial
  Oligomer
uuccucgcacuuaucugca

SEQ ID NO: 32451 - RNA, 19 nt, artificial
  Oligomer
ucuacugggcuuucugagc

SEQ ID NO: 32452 - RNA, 19 nt, artificial
  Oligomer
uuuaggagcagcugcugaa

SEQ ID NO: 32453 - RNA, 19 nt, artificial
  Oligomer
uucugagauacaaaagaca

SEQ ID NO: 32454 - RNA, 19 nt, artificial
  Oligomer
ucauuaacacgcuuaucca

SEQ ID NO: 32455 - RNA, 19 nt, artificial
  Oligomer
auucugagguucauaaucc

SEQ ID NO: 32456 - RNA, 19 nt, artificial
  Oligomer
uucuggguuauucuggaga

SEQ ID NO: 32457 - RNA, 19 nt, artificial
  Oligomer
uggaaguaaggugucuuug

SEQ ID NO: 32458 - RNA, 19 nt, artificial
  Oligomer
uugcuggaacaaauuauuc

SEQ ID NO: 32459 - RNA, 19 nt, artificial
  Oligomer
uauuggaauaaauguucuc

SEQ ID NO: 32460 - RNA, 19 nt, artificial
  Oligomer
aacuuguugcuguugucgc

SEQ ID NO: 32461 - RNA, 19 nt, artificial
  Oligomer
uuagcuuagcuuccugauu

SEQ ID NO: 32462 - RNA, 19 nt, artificial
  Oligomer
ucaauccuucauucucuuc

SEQ ID NO: 32463 - RNA, 19 nt, artificial
  Oligomer
uuuucuuuuugcuguagag

SEQ ID NO: 32464 - RNA, 19 nt, artificial
  Oligomer
uugagaacggacgcacuuu

SEQ ID NO: 32465 - RNA, 19 nt, artificial
  Oligomer
cugaaguucagcaagaguc

SEQ ID NO: 32466 - RNA, 19 nt, artificial
  Oligomer
auuugggcuguugucuggg

SEQ ID NO: 32467 - RNA, 19 nt, artificial
  Oligomer
uccauaaagaaauugggag

SEQ ID NO: 32468 - RNA, 19 nt, artificial
  Oligomer
ucgauauucaccaggaacu

SEQ ID NO: 32469 - RNA, 19 nt, artificial
  Oligomer
ucuacugcaucaaacauug

SEQ ID NO: 32470 - RNA, 19 nt, artificial
  Oligomer
uuucuuuagaggccuuggu

SEQ ID NO: 32471 - RNA, 19 nt, artificial
  Oligomer
uugcacagauccaccacgu

SEQ ID NO: 32472 - RNA, 19 nt, artificial
  Oligomer
uggaauauauugaacuugc

SEQ ID NO: 32473 - RNA, 19 nt, artificial
  Oligomer
ucaugggcagcucaucauc

SEQ ID NO: 32474 - RNA, 19 nt, artificial
  Oligomer
uuauagaggcgaucaagcu

SEQ ID NO: 32475 - RNA, 19 nt, artificial
  Oligomer
ucuagcugccuggucaguu

SEQ ID NO: 32476 - RNA, 19 nt, artificial
  Oligomer
ucuucccuguggaugauug

SEQ ID NO: 32477 - RNA, 19 nt, artificial
  Oligomer
aguuuuacgcaaguuuguc

SEQ ID NO: 32478 - RNA, 19 nt, artificial
  Oligomer
uaauucuuaagaugcuaca

SEQ ID NO: 32479 - RNA, 19 nt, artificial
  Oligomer
uuauucaucuguucaauuu

SEQ ID NO: 32480 - RNA, 19 nt, artificial
  Oligomer
uggacguuguuacaugagg

SEQ ID NO: 32481 - RNA, 19 nt, artificial
  Oligomer
ugaagaacaucaaacauuc

SEQ ID NO: 32482 - RNA, 19 nt, artificial
  Oligomer
aguuuguccaaaauaaggc

SEQ ID NO: 32483 - RNA, 19 nt, artificial
  Oligomer
aaguuuguccuuuuaccag

SEQ ID NO: 32484 - RNA, 19 nt, artificial
  Oligomer
uugguuuaauucuugggua

SEQ ID NO: 32485 - RNA, 19 nt, artificial
  Oligomer
uuugguuuuguaggaacag

SEQ ID NO: 32486 - RNA, 19 nt, artificial
  Oligomer
caucuguucaauuuccucc

SEQ ID NO: 32487 - RNA, 19 nt, artificial
  Oligomer
augaucuugacaaauauua

SEQ ID NO: 32488 - RNA, 19 nt, artificial
  Oligomer
uacagucccagcaaguuac

SEQ ID NO: 32489 - RNA, 19 nt, artificial
  Oligomer
uacaacuguuuuuaaaguc

SEQ ID NO: 32490 - RNA, 19 nt, artificial
  Oligomer
uaucugagugcuacacggg

SEQ ID NO: 32491 - RNA, 19 nt, artificial
  Oligomer
uugggcagugucuguauuu

SEQ ID NO: 32492 - RNA, 19 nt, artificial
  Oligomer
ccuaggacuauuaacaccg

SEQ ID NO: 32493 - RNA, 19 nt, artificial
  Oligomer
uuucugagauacaaaagac

SEQ ID NO: 32494 - RNA, 19 nt, artificial
  Oligomer
uaauucuucauugacuaaa

SEQ ID NO: 32495 - RNA, 19 nt, artificial
  Oligomer
auauauugaacuugcugcc

SEQ ID NO: 32496 - RNA, 19 nt, artificial
  Oligomer
ucuggauuucuacugggcu

SEQ ID NO: 32497 - RNA, 19 nt, artificial
  Oligomer
ugguuuaggagcagcugcu

SEQ ID NO: 32498 - RNA, 19 nt, artificial
  Oligomer
ucacugacaaccaacuaac

SEQ ID NO: 32499 - RNA, 19 nt, artificial
  Oligomer
uggaauaaauguucucugg

SEQ ID NO: 32500 - RNA, 19 nt, artificial
  Oligomer
ucuuaacagagauuaauuc

SEQ ID NO: 32501 - RNA, 19 nt, artificial
  Oligomer
aaauauuacggguaagucu

SEQ ID NO: 32502 - RNA, 19 nt, artificial
  Oligomer
ucugaauuacgcuuauuca

SEQ ID NO: 32503 - RNA, 19 nt, artificial
  Oligomer
aauguaauggaguccaucc

SEQ ID NO: 32504 - RNA, 19 nt, artificial
  Oligomer
ucuagcaguaaagcaaggg

SEQ ID NO: 32505 - RNA, 19 nt, artificial
  Oligomer
uuccucugacuuccaaauc

SEQ ID NO: 32506 - RNA, 19 nt, artificial
  Oligomer
cuuaucauuaaggcgcgcc

SEQ ID NO: 32507 - RNA, 19 nt, artificial
  Oligomer
cuccuuaucauuaaggcgc

SEQ ID NO: 32508 - RNA, 19 nt, artificial
  Oligomer
aucaagcacauguggagcc

SEQ ID NO: 32509 - RNA, 19 nt, artificial
  Oligomer
uuuagagccuuuaguuugu

SEQ ID NO: 32510 - RNA, 19 nt, artificial
  Oligomer
aaaucguugaagaacauca

SEQ ID NO: 32511 - RNA, 19 nt, artificial
  Oligomer
uuuccugaaguucagcaag

SEQ ID NO: 32512 - RNA, 19 nt, artificial
  Oligomer
uuucaucacgcuaaauguc

SEQ ID NO: 32513 - RNA, 19 nt, artificial
  Oligomer
uuucuggaguaacuggaac

SEQ ID NO: 32514 - RNA, 19 nt, artificial
  Oligomer
aagucuugugaaauuuuug

SEQ ID NO: 32515 - RNA, 19 nt, artificial
  Oligomer
auuuacauuuacaccaaac

SEQ ID NO: 32516 - RNA, 19 nt, artificial
  Oligomer
uaauuacugguaccguagc

SEQ ID NO: 32517 - RNA, 19 nt, artificial
  Oligomer
uaacagagauuaauucuuc

SEQ ID NO: 32518 - RNA, 19 nt, artificial
  Oligomer
cuguagagcugccuucuuc

SEQ ID NO: 32519 - RNA, 19 nt, artificial
  Oligomer
auucaucuguucaauuucc

SEQ ID NO: 32520 - RNA, 19 nt, artificial
  Oligomer
ucaugguucuccugaacug

SEQ ID NO: 32521 - RNA, 19 nt, artificial
  Oligomer
uuguuucaaaaacuuuaag

SEQ ID NO: 32522 - RNA, 19 nt, artificial
  Oligomer
ugguuuugguuuaguuccc

SEQ ID NO: 32523 - RNA, 19 nt, artificial
  Oligomer
uccuuucuucgauauucac

SEQ ID NO: 32524 - RNA, 19 nt, artificial
  Oligomer
cuggauuugguucuucugg

SEQ ID NO: 32525 - RNA, 19 nt, artificial
  Oligomer
ucacuguucucuguacugg

SEQ ID NO: 32526 - RNA, 19 nt, artificial
  Oligomer
uacaaaagacaauaaauac

SEQ ID NO: 32527 - RNA, 19 nt, artificial
  Oligomer
uacguggaacauaucccuc

SEQ ID NO: 32528 - RNA, 19 nt, artificial
  Oligomer
uuuacuagacaggauucuu

SEQ ID NO: 32529 - RNA, 19 nt, artificial
  Oligomer
uugcugggcuucaaucugu

SEQ ID NO: 32530 - RNA, 19 nt, artificial
  Oligomer
aauaaauguucucugggug

SEQ ID NO: 32531 - RNA, 19 nt, artificial
  Oligomer
uuucuccugcucagcaacu

SEQ ID NO: 32532 - RNA, 19 nt, artificial
  Oligomer
ucuccugcucagcaacuug

SEQ ID NO: 32533 - RNA, 19 nt, artificial
  Oligomer
auuaauucuucauugacua

SEQ ID NO: 32534 - RNA, 19 nt, artificial
  Oligomer
uauacauggaauauauuga

SEQ ID NO: 32535 - RNA, 19 nt, artificial
  Oligomer
uucccauugcuuagucucu

SEQ ID NO: 32536 - RNA, 19 nt, artificial
  Oligomer
acaacugcugagaacuucc

SEQ ID NO: 32537 - RNA, 19 nt, artificial
  Oligomer
uucugagguucauaauccc

SEQ ID NO: 32538 - RNA, 19 nt, artificial
  Oligomer
uuccuccauuuccucgcac

SEQ ID NO: 32539 - RNA, 19 nt, artificial
  Oligomer
ucauuauccgcaacuggac

SEQ ID NO: 32540 - RNA, 19 nt, artificial
  Oligomer
auuacaacuguuuuuaaag

SEQ ID NO: 32541 - RNA, 19 nt, artificial
  Oligomer
cugggcuucaaucuguugc

SEQ ID NO: 32542 - RNA, 19 nt, artificial
  Oligomer
uuugagguacagaagcaga

SEQ ID NO: 32543 - RNA, 19 nt, artificial
  Oligomer
auagaggcgaucaagcuca

SEQ ID NO: 32544 - RNA, 19 nt, artificial
  Oligomer
uuucuuucguaaggcuucu

SEQ ID NO: 32545 - RNA, 19 nt, artificial
  Oligomer
uaaguuucuccugcucagc

SEQ ID NO: 32546 - RNA, 19 nt, artificial
  Oligomer
uuccuccacaaguuuccca

SEQ ID NO: 32547 - RNA, 19 nt, artificial
  Oligomer
uaaacuuggauccugagau

SEQ ID NO: 32548 - RNA, 19 nt, artificial
  Oligomer
uggagaaagggucuggucu

SEQ ID NO: 32549 - RNA, 19 nt, artificial
  Oligomer
augaccaaggaaccauccg

SEQ ID NO: 32550 - RNA, 19 nt, artificial
  Oligomer
uggaguaacuggaacuucu

SEQ ID NO: 32551 - RNA, 19 nt, artificial
  Oligomer
uucacugacaaccaacuaa

SEQ ID NO: 32552 - RNA, 19 nt, artificial
  Oligomer
uucaaacacucccucuguu

SEQ ID NO: 32553 - RNA, 19 nt, artificial
  Oligomer
cuuagcuuccugauucuca

SEQ ID NO: 32554 - RNA, 19 nt, artificial
  Oligomer
auacuuaucugagugcuac

SEQ ID NO: 32555 - RNA, 19 nt, artificial
  Oligomer
aucuaauuacugguaccgu

SEQ ID NO: 32556 - RNA, 19 nt, artificial
  Oligomer
auucauuaugcccaucuuc

SEQ ID NO: 32557 - RNA, 19 nt, artificial
  Oligomer
aguuuguccuuuuaccagg

SEQ ID NO: 32558 - RNA, 19 nt, artificial
  Oligomer
auuuccaucagaugaaacu

SEQ ID NO: 32559 - RNA, 19 nt, artificial
  Oligomer
uucccauggacggaacaac

SEQ ID NO: 32560 - RNA, 19 nt, artificial
  Oligomer
auguauaauucuuaagaug

SEQ ID NO: 32561 - RNA, 19 nt, artificial
  Oligomer
uucuuaagaugcuacaaaa

SEQ ID NO: 32562 - RNA, 19 nt, artificial
  Oligomer
uuuccuccacaaguuuccc

SEQ ID NO: 32563 - RNA, 19 nt, artificial
  Oligomer
uagccuuccuccauuuccu

SEQ ID NO: 32564 - RNA, 19 nt, artificial
  Oligomer
guaugagucuuggucaacg

SEQ ID NO: 32565 - RNA, 19 nt, artificial
  Oligomer
ucuugcuuagaaccuggag

SEQ ID NO: 32566 - RNA, 19 nt, artificial
  Oligomer
auuuguuucuuagcugcag

SEQ ID NO: 32567 - RNA, 19 nt, artificial
  Oligomer
auacacgguaagaaacauc

SEQ ID NO: 32568 - RNA, 19 nt, artificial
  Oligomer
uuacaccaaacuguaccag

SEQ ID NO: 32569 - RNA, 19 nt, artificial
  Oligomer
ugggucaucaaccucauaa

SEQ ID NO: 32570 - RNA, 19 nt, artificial
  Oligomer
uccuuuuaccaggaggcag

SEQ ID NO: 32571 - RNA, 19 nt, artificial
  Oligomer
uucaggaaccagagagacc

SEQ ID NO: 32572 - RNA, 19 nt, artificial
  Oligomer
uccucugacuuccaaaucg

SEQ ID NO: 32573 - RNA, 19 nt, artificial
  Oligomer
uacaagugugcagugccuu

SEQ ID NO: 32574 - RNA, 19 nt, artificial
  Oligomer
uuagagccuuuaguuugug

SEQ ID NO: 32575 - RNA, 19 nt, artificial
  Oligomer
uaaucguauuacuucuucu

SEQ ID NO: 32576 - RNA, 19 nt, artificial
  Oligomer
ugcuuugagguacagaagc

SEQ ID NO: 32577 - RNA, 19 nt, artificial
  Oligomer
ugauucaggaaccagagag

SEQ ID NO: 32578 - RNA, 19 nt, artificial
  Oligomer
uucuuucguuuucaugguu

SEQ ID NO: 32579 - RNA, 19 nt, artificial
  Oligomer
uuucguaaggcuucuaggu

SEQ ID NO: 32580 - RNA, 19 nt, artificial
  Oligomer
cuaauuacugguaccguag

SEQ ID NO: 32581 - RNA, 19 nt, artificial
  Oligomer
cuguggaugauugucaugc

SEQ ID NO: 32582 - RNA, 19 nt, artificial
  Oligomer
aguuacguggaacauaucc

SEQ ID NO: 32583 - RNA, 19 nt, artificial
  Oligomer
ucuuugcacagauccacca

SEQ ID NO: 32584 - RNA, 19 nt, artificial
  Oligomer
uuucuucgauauucaccag

SEQ ID NO: 32585 - RNA, 19 nt, artificial
  Oligomer
uuuacaccaaacuguacca

SEQ ID NO: 32586 - RNA, 19 nt, artificial
  Oligomer
uucuugcuuagaaccugga

SEQ ID NO: 32587 - RNA, 19 nt, artificial
  Oligomer
ugauccagagcauucccag

SEQ ID NO: 32588 - RNA, 19 nt, artificial
  Oligomer
ugaaacugguagauuuucu

SEQ ID NO: 32589 - RNA, 19 nt, artificial
  Oligomer
uuauuugcaaccugagcau

SEQ ID NO: 32590 - RNA, 19 nt, artificial
  Oligomer
uggugaauucuucaauccu

SEQ ID NO: 32591 - RNA, 19 nt, artificial
  Oligomer
cgcuuauucaaacacuccc

SEQ ID NO: 32592 - RNA, 19 nt, artificial
  Oligomer
uuuguaggaacaggaggug

SEQ ID NO: 32593 - RNA, 19 nt, artificial
  Oligomer
uucugaaggguggaaguaa

SEQ ID NO: 32594 - RNA, 19 nt, artificial
  Oligomer
uccuucauucucuucuaga

SEQ ID NO: 32595 - RNA, 19 nt, artificial
  Oligomer
uaaaugacuccuuuauuca

SEQ ID NO: 32596 - RNA, 19 nt, artificial
  Oligomer
uugucgcugaucuuguugu

SEQ ID NO: 32597 - RNA, 19 nt, artificial
  Oligomer
ggagcuuucuguauauaaa

SEQ ID NO: 32598 - RNA, 19 nt, artificial
  Oligomer
gcaucauacuauaacugaa

SEQ ID NO: 32599 - RNA, 19 nt, artificial
  Oligomer
ugguguuucucauagauaa

SEQ ID NO: 32600 - RNA, 19 nt, artificial
  Oligomer
gcauguuacuacagaggaa

SEQ ID NO: 32601 - RNA, 19 nt, artificial
  Oligomer
cguauuuaaugauagaaua

SEQ ID NO: 32602 - RNA, 19 nt, artificial
  Oligomer
ggacaaucaucaaugcaua

SEQ ID NO: 32603 - RNA, 19 nt, artificial
  Oligomer
gggcuaaaacuuagaaaaa

SEQ ID NO: 32604 - RNA, 19 nt, artificial
  Oligomer
ggacaaguccuauuuucaa

SEQ ID NO: 32605 - RNA, 19 nt, artificial
  Oligomer
gaaagagauuaguacugaa

SEQ ID NO: 32606 - RNA, 19 nt, artificial
  Oligomer
agaaaauaauggaggaaaa

SEQ ID NO: 32607 - RNA, 19 nt, artificial
  Oligomer
caucaauaaggaagaagaa

SEQ ID NO: 32608 - RNA, 19 nt, artificial
  Oligomer
aggaauuucccaaauucaa

SEQ ID NO: 32609 - RNA, 19 nt, artificial
  Oligomer
gaggaaaguuugagaguaa

SEQ ID NO: 32610 - RNA, 19 nt, artificial
  Oligomer
gggacaauuguaucuucaa

SEQ ID NO: 32611 - RNA, 19 nt, artificial
  Oligomer
ugaugugaacugacuuuaa

SEQ ID NO: 32612 - RNA, 19 nt, artificial
  Oligomer
caugaguugugaaauuuaa

SEQ ID NO: 32613 - RNA, 19 nt, artificial
  Oligomer
ccagaauggucaguacaaa

SEQ ID NO: 32614 - RNA, 19 nt, artificial
  Oligomer
aggagaccauguauguaaa

SEQ ID NO: 32615 - RNA, 19 nt, artificial
  Oligomer
guugcuucagguucuuaaa

SEQ ID NO: 32616 - RNA, 19 nt, artificial
  Oligomer
ccaugcugguggaaagaua

SEQ ID NO: 32617 - RNA, 19 nt, artificial
  Oligomer
caaccaaggaggaauugaa

SEQ ID NO: 32618 - RNA, 19 nt, artificial
  Oligomer
aggugaaggugauaaagua

SEQ ID NO: 32619 - RNA, 19 nt, artificial
  Oligomer
ggcuaaaacuuagaaaaaa

SEQ ID NO: 32620 - RNA, 19 nt, artificial
  Oligomer
gugcaaagauuauagcuaa

SEQ ID NO: 32621 - RNA, 19 nt, artificial
  Oligomer
ggacaauuguaucuucaaa

SEQ ID NO: 32622 - RNA, 19 nt, artificial
  Oligomer
caaagauuauagcuaauua

SEQ ID NO: 32623 - RNA, 19 nt, artificial
  Oligomer
ugugaauaaucaugugaaa

SEQ ID NO: 32624 - RNA, 19 nt, artificial
  Oligomer
uaagaagcaucauacuaua

SEQ ID NO: 32625 - RNA, 19 nt, artificial
  Oligomer
guauaaacuagaaguuuaa

SEQ ID NO: 32626 - RNA, 19 nt, artificial
  Oligomer
ggguuuuaauguaauuuau

SEQ ID NO: 32627 - RNA, 19 nt, artificial
  Oligomer
caguuuugaaggaucuaaa

SEQ ID NO: 32628 - RNA, 19 nt, artificial
  Oligomer
gagaaaacaccaucacuaa

SEQ ID NO: 32629 - RNA, 19 nt, artificial
  Oligomer
caacaaaucuuccaagaaa

SEQ ID NO: 32630 - RNA, 19 nt, artificial
  Oligomer
ggcuggaagugaccuuaga

SEQ ID NO: 32631 - RNA, 19 nt, artificial
  Oligomer
ggcauucauuguagauuaa

SEQ ID NO: 32632 - RNA, 19 nt, artificial
  Oligomer
ggaugauuaagauguauau

SEQ ID NO: 32633 - RNA, 19 nt, artificial
  Oligomer
ggaaaguuugagaguaaaa

SEQ ID NO: 32634 - RNA, 19 nt, artificial
  Oligomer
caggguuuacauuacaaga

SEQ ID NO: 32635 - RNA, 19 nt, artificial
  Oligomer
gauagagauuguuuuuaga

SEQ ID NO: 32636 - RNA, 19 nt, artificial
  Oligomer
cuaccaaguaggaaaaaaa

SEQ ID NO: 32637 - RNA, 19 nt, artificial
  Oligomer
gaggcaacugagacucaaa

SEQ ID NO: 32638 - RNA, 19 nt, artificial
  Oligomer
ggucaaacccuuaaaaaua

SEQ ID NO: 32639 - RNA, 19 nt, artificial
  Oligomer
ccggaaucuuaauauucga

SEQ ID NO: 32640 - RNA, 19 nt, artificial
  Oligomer
aagggacaagaauauauaa

SEQ ID NO: 32641 - RNA, 19 nt, artificial
  Oligomer
cagugaagacccuugggaa

SEQ ID NO: 32642 - RNA, 19 nt, artificial
  Oligomer
gguucugguugcagaucua

SEQ ID NO: 32643 - RNA, 19 nt, artificial
  Oligomer
cggcuuuuaucuugaaaau

SEQ ID NO: 32644 - RNA, 19 nt, artificial
  Oligomer
caagguugcaagagcucaa

SEQ ID NO: 32645 - RNA, 19 nt, artificial
  Oligomer
ggauauacucaguuaacaa

SEQ ID NO: 32646 - RNA, 19 nt, artificial
  Oligomer
ccaucuaauuccgcaaaaa

SEQ ID NO: 32647 - RNA, 19 nt, artificial
  Oligomer
cugugaaaggaaaauaaua

SEQ ID NO: 32648 - RNA, 19 nt, artificial
  Oligomer
aagagaagaugacuuuuaa

SEQ ID NO: 32649 - RNA, 19 nt, artificial
  Oligomer
gaagggacaagaauauaua

SEQ ID NO: 32650 - RNA, 19 nt, artificial
  Oligomer
uggucaguacaaaguugaa

SEQ ID NO: 32651 - RNA, 19 nt, artificial
  Oligomer
cgagcaggguuucuuuaua

SEQ ID NO: 32652 - RNA, 19 nt, artificial
  Oligomer
aguaguagauacuucugaa

SEQ ID NO: 32653 - RNA, 19 nt, artificial
  Oligomer
gagccgcacuucauuaaaa

SEQ ID NO: 32654 - RNA, 19 nt, artificial
  Oligomer
uguuaaguguaaaaugcaa

SEQ ID NO: 32655 - RNA, 19 nt, artificial
  Oligomer
cacagguauuggugaccaa

SEQ ID NO: 32656 - RNA, 19 nt, artificial
  Oligomer
ggacugaauuguuuuaaca

SEQ ID NO: 32657 - RNA, 19 nt, artificial
  Oligomer
agaggagaagcuuugcaaa

SEQ ID NO: 32658 - RNA, 19 nt, artificial
  Oligomer
gaguaaaacuguaaaaaau

SEQ ID NO: 32659 - RNA, 19 nt, artificial
  Oligomer
guauuaguauugugaauaa

SEQ ID NO: 32660 - RNA, 19 nt, artificial
  Oligomer
agauauguuaaguguaaaa

SEQ ID NO: 32661 - RNA, 19 nt, artificial
  Oligomer
gguauaaacuagaaguuua

SEQ ID NO: 32662 - RNA, 19 nt, artificial
  Oligomer
cugauuuuguaaaaugaaa

SEQ ID NO: 32663 - RNA, 19 nt, artificial
  Oligomer
ggacaagaauauauaaaca

SEQ ID NO: 32664 - RNA, 19 nt, artificial
  Oligomer
gauuaaaguccuuucagaa

SEQ ID NO: 32665 - RNA, 19 nt, artificial
  Oligomer
ccuggaaauuugggcuaaa

SEQ ID NO: 32666 - RNA, 19 nt, artificial
  Oligomer
gguggaaaacugaaaaauu

SEQ ID NO: 32667 - RNA, 19 nt, artificial
  Oligomer
acaagauucucacaacaaa

SEQ ID NO: 32668 - RNA, 19 nt, artificial
  Oligomer
cucagaucuuccaauuaau

SEQ ID NO: 32669 - RNA, 19 nt, artificial
  Oligomer
gaaaauaauggaggaaaaa

SEQ ID NO: 32670 - RNA, 19 nt, artificial
  Oligomer
gaggagaagcuuugcaaaa

SEQ ID NO: 32671 - RNA, 19 nt, artificial
  Oligomer
ggguguagugaguguauau

SEQ ID NO: 32672 - RNA, 19 nt, artificial
  Oligomer
aguagauacuucugaaaua

SEQ ID NO: 32673 - RNA, 19 nt, artificial
  Oligomer
caaaagauuuggaaagaua

SEQ ID NO: 32674 - RNA, 19 nt, artificial
  Oligomer
gaucauuugcaaagucaaa

SEQ ID NO: 32675 - RNA, 19 nt, artificial
  Oligomer
gcagguuguagauauauca

SEQ ID NO: 32676 - RNA, 19 nt, artificial
  Oligomer
gcugguggaaagauagaga

SEQ ID NO: 32677 - RNA, 19 nt, artificial
  Oligomer
agaguaaaacuguaaaaaa

SEQ ID NO: 32678 - RNA, 19 nt, artificial
  Oligomer
ggugaaggugauaaaguaa

SEQ ID NO: 32679 - RNA, 19 nt, artificial
  Oligomer
ugggcagguuguagauaua

SEQ ID NO: 32680 - RNA, 19 nt, artificial
  Oligomer
caagaugagucaagucaga

SEQ ID NO: 32681 - RNA, 19 nt, artificial
  Oligomer
ggaggaaaaaauucagaua

SEQ ID NO: 32682 - RNA, 19 nt, artificial
  Oligomer
aggaaaguuugagaguaaa

SEQ ID NO: 32683 - RNA, 19 nt, artificial
  Oligomer
ccugcuuuguggaugaaaa

SEQ ID NO: 32684 - RNA, 19 nt, artificial
  Oligomer
ggagccgcacuucauuaaa

SEQ ID NO: 32685 - RNA, 19 nt, artificial
  Oligomer
gaauaaaacguauucaaua

SEQ ID NO: 32686 - RNA, 19 nt, artificial
  Oligomer
gcauaacagaguuauagaa

SEQ ID NO: 32687 - RNA, 19 nt, artificial
  Oligomer
uaccaaguaggaaaaaaaa

SEQ ID NO: 32688 - RNA, 19 nt, artificial
  Oligomer
ccggaucuuuuccaucuaa

SEQ ID NO: 32689 - RNA, 19 nt, artificial
  Oligomer
aguuuugaaggaucuaaaa

SEQ ID NO: 32690 - RNA, 19 nt, artificial
  Oligomer
gaagcaucauacuauaacu

SEQ ID NO: 32691 - RNA, 19 nt, artificial
  Oligomer
gucuuaucuuguuucaaaa

SEQ ID NO: 32692 - RNA, 19 nt, artificial
  Oligomer
ccguuaggaugauuaagau

SEQ ID NO: 32693 - RNA, 19 nt, artificial
  Oligomer
caacggcuuuuaucuugaa

SEQ ID NO: 32694 - RNA, 19 nt, artificial
  Oligomer
aguaggguauaaacuagaa

SEQ ID NO: 32695 - RNA, 19 nt, artificial
  Oligomer
ccauaacuuucacuacaua

SEQ ID NO: 32696 - RNA, 19 nt, artificial
  Oligomer
caaggacucaaggacugaa

SEQ ID NO: 32697 - RNA, 19 nt, artificial
  Oligomer
ggagaaaaguguuaaaauu

SEQ ID NO: 32698 - RNA, 19 nt, artificial
  Oligomer
caaggacauuaagaaaaua

SEQ ID NO: 32699 - RNA, 19 nt, artificial
  Oligomer
cauaguucuuuuuagucaa

SEQ ID NO: 32700 - RNA, 19 nt, artificial
  Oligomer
ggagacucagcaguuggaa

SEQ ID NO: 32701 - RNA, 19 nt, artificial
  Oligomer
ccauuuuaguggauaaaau

SEQ ID NO: 32702 - RNA, 19 nt, artificial
  Oligomer
gugcauacauuauaugcaa

SEQ ID NO: 32703 - RNA, 19 nt, artificial
  Oligomer
cguauucaauaaaauacua

SEQ ID NO: 32704 - RNA, 19 nt, artificial
  Oligomer
aagcguauuuaaugauaga

SEQ ID NO: 32705 - RNA, 19 nt, artificial
  Oligomer
gucuagacuuuaaauuuaa

SEQ ID NO: 32706 - RNA, 19 nt, artificial
  Oligomer
gggagaaaaguguuaaaau

SEQ ID NO: 32707 - RNA, 19 nt, artificial
  Oligomer
gugcgaauuauuuuuuuaa

SEQ ID NO: 32708 - RNA, 19 nt, artificial
  Oligomer
gacuuuuaacaguuuugaa

SEQ ID NO: 32709 - RNA, 19 nt, artificial
  Oligomer
guguagugaguguauauaa

SEQ ID NO: 32710 - RNA, 19 nt, artificial
  Oligomer
ggguuuacauuacaagauu

SEQ ID NO: 32711 - RNA, 19 nt, artificial
  Oligomer
gcuaaaacuuagaaaaaau

SEQ ID NO: 32712 - RNA, 19 nt, artificial
  Oligomer
gcauugucuuaauuuuuga

SEQ ID NO: 32713 - RNA, 19 nt, artificial
  Oligomer
cugguuuuagcauuuacaa

SEQ ID NO: 32714 - RNA, 19 nt, artificial
  Oligomer
cuguccauuuucuuuuaaa

SEQ ID NO: 32715 - RNA, 19 nt, artificial
  Oligomer
agaacagaagggacaagaa

SEQ ID NO: 32716 - RNA, 19 nt, artificial
  Oligomer
ccacuuauuuuacauuuua

SEQ ID NO: 32717 - RNA, 19 nt, artificial
  Oligomer
guacaagaagcuauacgaa

SEQ ID NO: 32718 - RNA, 19 nt, artificial
  Oligomer
gcauuaguuucacaugaua

SEQ ID NO: 32719 - RNA, 19 nt, artificial
  Oligomer
cacuuaguuugguuauaua

SEQ ID NO: 32720 - RNA, 19 nt, artificial
  Oligomer
cugaauuguuuuaacauaa

SEQ ID NO: 32721 - RNA, 19 nt, artificial
  Oligomer
aaaaauugaucauuugcaa

SEQ ID NO: 32722 - RNA, 19 nt, artificial
  Oligomer
cuuuuguugugguggaaaa

SEQ ID NO: 32723 - RNA, 19 nt, artificial
  Oligomer
gcaguuuauucaucuguga

SEQ ID NO: 32724 - RNA, 19 nt, artificial
  Oligomer
gagggcuaacugauuggaa

SEQ ID NO: 32725 - RNA, 19 nt, artificial
  Oligomer
cauggauauacucaguuaa

SEQ ID NO: 32726 - RNA, 19 nt, artificial
  Oligomer
gguacaagaagcuauacga

SEQ ID NO: 32727 - RNA, 19 nt, artificial
  Oligomer
gguaagaacuacugagaaa

SEQ ID NO: 32728 - RNA, 19 nt, artificial
  Oligomer
cugcuuuguggaugaaaaa

SEQ ID NO: 32729 - RNA, 19 nt, artificial
  Oligomer
agugaagaagcuagauuaa

SEQ ID NO: 32730 - RNA, 19 nt, artificial
  Oligomer
aaggcuuaggcauguucaa

SEQ ID NO: 32731 - RNA, 19 nt, artificial
  Oligomer
guuagagaaaugaaauaaa

SEQ ID NO: 32732 - RNA, 19 nt, artificial
  Oligomer
acaugauauacccuuuaaa

SEQ ID NO: 32733 - RNA, 19 nt, artificial
  Oligomer
agauuaaaguccuuucaga

SEQ ID NO: 32734 - RNA, 19 nt, artificial
  Oligomer
aggucaaacccuuaaaaau

SEQ ID NO: 32735 - RNA, 19 nt, artificial
  Oligomer
guagauacuucugaaauaa

SEQ ID NO: 32736 - RNA, 19 nt, artificial
  Oligomer
caaacuaaauuccaguuaa

SEQ ID NO: 32737 - RNA, 19 nt, artificial
  Oligomer
caggacacuucacuuccaa

SEQ ID NO: 32738 - RNA, 19 nt, artificial
  Oligomer
ggaagaagaauuuguagaa

SEQ ID NO: 32739 - RNA, 19 nt, artificial
  Oligomer
cccuguuucuguuuuagua

SEQ ID NO: 32740 - RNA, 19 nt, artificial
  Oligomer
ccaucacuaacuagaagaa

SEQ ID NO: 32741 - RNA, 19 nt, artificial
  Oligomer
auaucaucuuguaucuuaa

SEQ ID NO: 32742 - RNA, 19 nt, artificial
  Oligomer
aaucaucaaugcauauaua

SEQ ID NO: 32743 - RNA, 19 nt, artificial
  Oligomer
ggcuaguaauaguaguaga

SEQ ID NO: 32744 - RNA, 19 nt, artificial
  Oligomer
aaagauuuggaaagauaua

SEQ ID NO: 32745 - RNA, 19 nt, artificial
  Oligomer
cauuguagauuaaagcuua

SEQ ID NO: 32746 - RNA, 19 nt, artificial
  Oligomer
cuguaucauuaauguaaua

SEQ ID NO: 32747 - RNA, 19 nt, artificial
  Oligomer
ccauccuaauacccuuuua

SEQ ID NO: 32748 - RNA, 19 nt, artificial
  Oligomer
gcuuauguagguaaaagua

SEQ ID NO: 32749 - RNA, 19 nt, artificial
  Oligomer
acuccaacuucuaaucaaa

SEQ ID NO: 32750 - RNA, 19 nt, artificial
  Oligomer
aggugaguaaggcauguua

SEQ ID NO: 32751 - RNA, 19 nt, artificial
  Oligomer
ugugguggaaaacugaaaa

SEQ ID NO: 32752 - RNA, 19 nt, artificial
  Oligomer
ggucagauucuacuuugaa

SEQ ID NO: 32753 - RNA, 19 nt, artificial
  Oligomer
cacuccaacuucuaaucaa

SEQ ID NO: 32754 - RNA, 19 nt, artificial
  Oligomer
ccaugaguugugaaauuua

SEQ ID NO: 32755 - RNA, 19 nt, artificial
  Oligomer
gaacguccaggguuuacau

SEQ ID NO: 32756 - RNA, 19 nt, artificial
  Oligomer
caagcuaccuuucuugaaa

SEQ ID NO: 32757 - RNA, 19 nt, artificial
  Oligomer
cauagacuaagaauaagaa

SEQ ID NO: 32758 - RNA, 19 nt, artificial
  Oligomer
cauuuuucuggauuuagua

SEQ ID NO: 32759 - RNA, 19 nt, artificial
  Oligomer
gugaauaaaacguauucaa

SEQ ID NO: 32760 - RNA, 19 nt, artificial
  Oligomer
agucaaaucuacuuguuaa

SEQ ID NO: 32761 - RNA, 19 nt, artificial
  Oligomer
aaccaaggaggaauugaaa

SEQ ID NO: 32762 - RNA, 19 nt, artificial
  Oligomer
agauguauauaggacaaaa

SEQ ID NO: 32763 - RNA, 19 nt, artificial
  Oligomer
acaccaucacuaacuagaa

SEQ ID NO: 32764 - RNA, 19 nt, artificial
  Oligomer
cagggauagcaagggacaa

SEQ ID NO: 32765 - RNA, 19 nt, artificial
  Oligomer
ucagcauaacagaguuaua

SEQ ID NO: 32766 - RNA, 19 nt, artificial
  Oligomer
cuguaaauaugaacuccca

SEQ ID NO: 32767 - RNA, 19 nt, artificial
  Oligomer
caaauuuuuggagacuuaa

SEQ ID NO: 32768 - RNA, 19 nt, artificial
  Oligomer
guuugagaguaaaacugua

SEQ ID NO: 32769 - RNA, 19 nt, artificial
  Oligomer
cggaucuuuuccaucuaau

SEQ ID NO: 32770 - RNA, 19 nt, artificial
  Oligomer
gggccggaaucuuaauauu

SEQ ID NO: 32771 - RNA, 19 nt, artificial
  Oligomer
ugcuguuagagaaaugaaa

SEQ ID NO: 32772 - RNA, 19 nt, artificial
  Oligomer
cauauuaaaugacacuuua

SEQ ID NO: 32773 - RNA, 19 nt, artificial
  Oligomer
ccaggacacuucacuucca

SEQ ID NO: 32774 - RNA, 19 nt, artificial
  Oligomer
aaguauuucugauuuugua

SEQ ID NO: 32775 - RNA, 19 nt, artificial
  Oligomer
caaggagcagcuugcaaga

SEQ ID NO: 32776 - RNA, 19 nt, artificial
  Oligomer
guacaaaguugaaaacuau

SEQ ID NO: 32777 - RNA, 19 nt, artificial
  Oligomer
gacauaguuugaaggugaa

SEQ ID NO: 32778 - RNA, 19 nt, artificial
  Oligomer
gggagccgcacuucauuaa

SEQ ID NO: 32779 - RNA, 19 nt, artificial
  Oligomer
ugaucauuugcaaagucaa

SEQ ID NO: 32780 - RNA, 19 nt, artificial
  Oligomer
cuggaaauuugggcuaaaa

SEQ ID NO: 32781 - RNA, 19 nt, artificial
  Oligomer
gugguggaaaacugaaaaa

SEQ ID NO: 32782 - RNA, 19 nt, artificial
  Oligomer
caaaucuacuuguuaaaaa

SEQ ID NO: 32783 - RNA, 19 nt, artificial
  Oligomer
caauauucauuuaacucau

SEQ ID NO: 32784 - RNA, 19 nt, artificial
  Oligomer
cguacuugugcgaauuauu

SEQ ID NO: 32785 - RNA, 19 nt, artificial
  Oligomer
agaugugcauacauuauau

SEQ ID NO: 32786 - RNA, 19 nt, artificial
  Oligomer
uaauaugcauagaacaaaa

SEQ ID NO: 32787 - RNA, 19 nt, artificial
  Oligomer
gucaguacaaaguugaaaa

SEQ ID NO: 32788 - RNA, 19 nt, artificial
  Oligomer
ugaagaugugcauacauua

SEQ ID NO: 32789 - RNA, 19 nt, artificial
  Oligomer
gguucaguuucaaggacau

SEQ ID NO: 32790 - RNA, 19 nt, artificial
  Oligomer
ggaucuuuuccaucuaauu

SEQ ID NO: 32791 - RNA, 19 nt, artificial
  Oligomer
agaacaaaagauuuggaaa

SEQ ID NO: 32792 - RNA, 19 nt, artificial
  Oligomer
gauugaauuccauuagcau

SEQ ID NO: 32793 - RNA, 19 nt, artificial
  Oligomer
ccauguugagauucucaua

SEQ ID NO: 32794 - RNA, 19 nt, artificial
  Oligomer
gaagaauaguuguuuaaau

SEQ ID NO: 32795 - RNA, 19 nt, artificial
  Oligomer
acuaaaagaucuuuguuaa

SEQ ID NO: 32796 - RNA, 19 nt, artificial
  Oligomer
guaccugcagacaucaaua

SEQ ID NO: 32797 - RNA, 19 nt, artificial
  Oligomer
acugaauuguuuuaacaua

SEQ ID NO: 32798 - RNA, 19 nt, artificial
  Oligomer
cugcagacaucaauaagga

SEQ ID NO: 32799 - RNA, 19 nt, artificial
  Oligomer
ugggcuaaaacuuagaaaa

SEQ ID NO: 32800 - RNA, 19 nt, artificial
  Oligomer
uguucaaacgccugcaaaa

SEQ ID NO: 32801 - RNA, 19 nt, artificial
  Oligomer
aaaucuguauggauagaaa

SEQ ID NO: 32802 - RNA, 19 nt, artificial
  Oligomer
cuuuguggaugaaaaauau

SEQ ID NO: 32803 - RNA, 19 nt, artificial
  Oligomer
cgcacuucauuaaaauucu

SEQ ID NO: 32804 - RNA, 19 nt, artificial
  Oligomer
guuucaaggacauuaagaa

SEQ ID NO: 32805 - RNA, 19 nt, artificial
  Oligomer
agauacuucugaaauaaau

SEQ ID NO: 32806 - RNA, 19 nt, artificial
  Oligomer
ggacaucuagucacuugua

SEQ ID NO: 32807 - RNA, 19 nt, artificial
  Oligomer
gaauaagaagcaucauacu

SEQ ID NO: 32808 - RNA, 19 nt, artificial
  Oligomer
cguuuuuguuccuugugga

SEQ ID NO: 32809 - RNA, 19 nt, artificial
  Oligomer
cacaugauauacccuuuaa

SEQ ID NO: 32810 - RNA, 19 nt, artificial
  Oligomer
cccgaaucauuguuuuauu

SEQ ID NO: 32811 - RNA, 19 nt, artificial
  Oligomer
ucauuacuuucaagcaaaa

SEQ ID NO: 32812 - RNA, 19 nt, artificial
  Oligomer
guaucuucaaaguagacaa

SEQ ID NO: 32813 - RNA, 19 nt, artificial
  Oligomer
ucuagugaaugcucagaaa

SEQ ID NO: 32814 - RNA, 19 nt, artificial
  Oligomer
aacuuucacuacauauuaa

SEQ ID NO: 32815 - RNA, 19 nt, artificial
  Oligomer
uugggaacaacaugcuaaa

SEQ ID NO: 32816 - RNA, 19 nt, artificial
  Oligomer
ggauugaauuccauuagca

SEQ ID NO: 32817 - RNA, 19 nt, artificial
  Oligomer
caggguauuagcuguauua

SEQ ID NO: 32818 - RNA, 19 nt, artificial
  Oligomer
caaucaucaaugcauauau

SEQ ID NO: 32819 - RNA, 19 nt, artificial
  Oligomer
cuuguaucuuaaaguuuca

SEQ ID NO: 32820 - RNA, 19 nt, artificial
  Oligomer
ugcagacaucaauaaggaa

SEQ ID NO: 32821 - RNA, 19 nt, artificial
  Oligomer
auugcuuucugcuguauaa

SEQ ID NO: 32822 - RNA, 19 nt, artificial
  Oligomer
aaauaauggaggaaaaaau

SEQ ID NO: 32823 - RNA, 19 nt, artificial
  Oligomer
ccauuuucuuuuaaaguua

SEQ ID NO: 32824 - RNA, 19 nt, artificial
  Oligomer
uguugugguggaaaacuga

SEQ ID NO: 32825 - RNA, 19 nt, artificial
  Oligomer
ccauuuuucuggauuuagu

SEQ ID NO: 32826 - RNA, 19 nt, artificial
  Oligomer
ggaaagaugucaaagauau

SEQ ID NO: 32827 - RNA, 19 nt, artificial
  Oligomer
caguaggguauaaacuaga

SEQ ID NO: 32828 - RNA, 19 nt, artificial
  Oligomer
cagcuuuaguuuuucuaau

SEQ ID NO: 32829 - RNA, 19 nt, artificial
  Oligomer
ucuuauucuguaucauuaa

SEQ ID NO: 32830 - RNA, 19 nt, artificial
  Oligomer
gauucaaguaguuuugcaa

SEQ ID NO: 32831 - RNA, 19 nt, artificial
  Oligomer
agauuauagcuaauuagua

SEQ ID NO: 32832 - RNA, 19 nt, artificial
  Oligomer
gguuugucuugaccuggaa

SEQ ID NO: 32833 - RNA, 19 nt, artificial
  Oligomer
aaagauauguuaaguguaa

SEQ ID NO: 32834 - RNA, 19 nt, artificial
  Oligomer
guguaccugcagacaucaa

SEQ ID NO: 32835 - RNA, 19 nt, artificial
  Oligomer
cugugaguucugauaggaa

SEQ ID NO: 32836 - RNA, 19 nt, artificial
  Oligomer
gugugaaaaaggaauaaau

SEQ ID NO: 32837 - RNA, 19 nt, artificial
  Oligomer
ugaucuaauuguauuagua

SEQ ID NO: 32838 - RNA, 19 nt, artificial
  Oligomer
guugugguggaaaacugaa

SEQ ID NO: 32839 - RNA, 19 nt, artificial
  Oligomer
ccucuuggaaauuauaaaa

SEQ ID NO: 32840 - RNA, 19 nt, artificial
  Oligomer
caaggguuuuaauguaauu

SEQ ID NO: 32841 - RNA, 19 nt, artificial
  Oligomer
gugcuuuaguugucaugca

SEQ ID NO: 32842 - RNA, 19 nt, artificial
  Oligomer
ugggauguauauauaucau

SEQ ID NO: 32843 - RNA, 19 nt, artificial
  Oligomer
uuuuugaaagcguauuuaa

SEQ ID NO: 32844 - RNA, 19 nt, artificial
  Oligomer
acaucuagucacuuguaaa

SEQ ID NO: 32845 - RNA, 19 nt, artificial
  Oligomer
cagaauuuuuagaaaguau

SEQ ID NO: 32846 - RNA, 19 nt, artificial
  Oligomer
cggaaucuuaauauucgaa

SEQ ID NO: 32847 - RNA, 19 nt, artificial
  Oligomer
agacaucaauaaggaagaa

SEQ ID NO: 32848 - RNA, 19 nt, artificial
  Oligomer
auaauaggacaaucaucaa

SEQ ID NO: 32849 - RNA, 19 nt, artificial
  Oligomer
guggaaagauagagauugu

SEQ ID NO: 32850 - RNA, 19 nt, artificial
  Oligomer
caugcagacuaucuuuuga

SEQ ID NO: 32851 - RNA, 19 nt, artificial
  Oligomer
aggacauuaagaaaauaau

SEQ ID NO: 32852 - RNA, 19 nt, artificial
  Oligomer
cagagaucauuuugccuua

SEQ ID NO: 32853 - RNA, 19 nt, artificial
  Oligomer
aagaaaaugggaagcaaua

SEQ ID NO: 32854 - RNA, 19 nt, artificial
  Oligomer
gaucaaaagcauugucuua

SEQ ID NO: 32855 - RNA, 19 nt, artificial
  Oligomer
caaggagaccauguaugua

SEQ ID NO: 32856 - RNA, 19 nt, artificial
  Oligomer
ucuuaauauucgaagugaa

SEQ ID NO: 32857 - RNA, 19 nt, artificial
  Oligomer
cauuagcauuugcuaccaa

SEQ ID NO: 32858 - RNA, 19 nt, artificial
  Oligomer
guguggaaaacuaagaaaa

SEQ ID NO: 32859 - RNA, 19 nt, artificial
  Oligomer
ugguuuuuuucacuuagaa

SEQ ID NO: 32860 - RNA, 19 nt, artificial
  Oligomer
cuguucgaauuuuuuauaa

SEQ ID NO: 32861 - RNA, 19 nt, artificial
  Oligomer
guauagucuagacuuuaaa

SEQ ID NO: 32862 - RNA, 19 nt, artificial
  Oligomer
gaggaauugaaaacacuga

SEQ ID NO: 32863 - RNA, 19 nt, artificial
  Oligomer
gagucaagucagacuucau

SEQ ID NO: 32864 - RNA, 19 nt, artificial
  Oligomer
aguaaggcauguuacuaca

SEQ ID NO: 32865 - RNA, 19 nt, artificial
  Oligomer
aucugugaaaggaaaauaa

SEQ ID NO: 32866 - RNA, 19 nt, artificial
  Oligomer
gauguaacaaggguuuuaa

SEQ ID NO: 32867 - RNA, 19 nt, artificial
  Oligomer
ccaguucuuucauuuuaca

SEQ ID NO: 32868 - RNA, 19 nt, artificial
  Oligomer
cagacaucaauaaggaaga

SEQ ID NO: 32869 - RNA, 19 nt, artificial
  Oligomer
uguagugaguguauauaau

SEQ ID NO: 32870 - RNA, 19 nt, artificial
  Oligomer
aagaaggcagggcaguuaa

SEQ ID NO: 32871 - RNA, 19 nt, artificial
  Oligomer
caguuuauucaucugugaa

SEQ ID NO: 32872 - RNA, 19 nt, artificial
  Oligomer
aaaaacacuugaauaagaa

SEQ ID NO: 32873 - RNA, 19 nt, artificial
  Oligomer
gacugaucuaauuguauua

SEQ ID NO: 32874 - RNA, 19 nt, artificial
  Oligomer
ggaaaauaauacuuaucuu

SEQ ID NO: 32875 - RNA, 19 nt, artificial
  Oligomer
gugaguaaggcauguuacu

SEQ ID NO: 32876 - RNA, 19 nt, artificial
  Oligomer
gucaaaucuacuuguuaaa

SEQ ID NO: 32877 - RNA, 19 nt, artificial
  Oligomer
cauggaaagaugucaaaga

SEQ ID NO: 32878 - RNA, 19 nt, artificial
  Oligomer
cagcauuaguuucacauga

SEQ ID NO: 32879 - RNA, 19 nt, artificial
  Oligomer
ugguuuuagcauuuacaaa

SEQ ID NO: 32880 - RNA, 19 nt, artificial
  Oligomer
uaaaguuccugcuguaaau

SEQ ID NO: 32881 - RNA, 19 nt, artificial
  Oligomer
ggaggagggcuaacugauu

SEQ ID NO: 32882 - RNA, 19 nt, artificial
  Oligomer
gacugaauuguuuuaacau

SEQ ID NO: 32883 - RNA, 19 nt, artificial
  Oligomer
ugugaaauuuaaugcacaa

SEQ ID NO: 32884 - RNA, 19 nt, artificial
  Oligomer
cuaaauuccaguuaauuaa

SEQ ID NO: 32885 - RNA, 19 nt, artificial
  Oligomer
caaggacugaauuguuuua

SEQ ID NO: 32886 - RNA, 19 nt, artificial
  Oligomer
guaguagauacuucugaaa

SEQ ID NO: 32887 - RNA, 19 nt, artificial
  Oligomer
ugucuuaucuuguuucaaa

SEQ ID NO: 32888 - RNA, 19 nt, artificial
  Oligomer
ucugauuuuguaaaaugaa

SEQ ID NO: 32889 - RNA, 19 nt, artificial
  Oligomer
cugguggaaagauagagau

SEQ ID NO: 32890 - RNA, 19 nt, artificial
  Oligomer
ucagaaagacaguaugcaa

SEQ ID NO: 32891 - RNA, 19 nt, artificial
  Oligomer
ggucaguacaaaguugaaa

SEQ ID NO: 32892 - RNA, 19 nt, artificial
  Oligomer
aguccuauuuucaagagaa

SEQ ID NO: 32893 - RNA, 19 nt, artificial
  Oligomer
caaugugaaauguaaauga

SEQ ID NO: 32894 - RNA, 19 nt, artificial
  Oligomer
agaagaguuuaauagauua

SEQ ID NO: 32895 - RNA, 19 nt, artificial
  Oligomer
guuucuuuauacuggugaa

SEQ ID NO: 32896 - RNA, 19 nt, artificial
  Oligomer
gugcuuuuguuguggugga

SEQ ID NO: 32897 - RNA, 19 nt, artificial
  Oligomer
aguauuuugcugauuuaaa

SEQ ID NO: 32898 - RNA, 19 nt, artificial
  Oligomer
cacuguaccauaacuuuca

SEQ ID NO: 32899 - RNA, 19 nt, artificial
  Oligomer
uguugcuucagguucuuaa

SEQ ID NO: 32900 - RNA, 19 nt, artificial
  Oligomer
gaaucaguaggguauaaac

SEQ ID NO: 32901 - RNA, 19 nt, artificial
  Oligomer
uaggaauuucccaaauuca

SEQ ID NO: 32902 - RNA, 19 nt, artificial
  Oligomer
cuuauuuuucugugaauaa

SEQ ID NO: 32903 - RNA, 19 nt, artificial
  Oligomer
caucuaauuccgcaaaaau

SEQ ID NO: 32904 - RNA, 19 nt, artificial
  Oligomer
caaauguuuauguuuucaa

SEQ ID NO: 32905 - RNA, 19 nt, artificial
  Oligomer
gaagaguuuaauagauuaa

SEQ ID NO: 32906 - RNA, 19 nt, artificial
  Oligomer
uuuugaaagcguauuuaau

SEQ ID NO: 32907 - RNA, 19 nt, artificial
  Oligomer
gaguguauauaaugugauu

SEQ ID NO: 32908 - RNA, 19 nt, artificial
  Oligomer
gagugucugguaagaacua

SEQ ID NO: 32909 - RNA, 19 nt, artificial
  Oligomer
aagacaguaugcaagauga

SEQ ID NO: 32910 - RNA, 19 nt, artificial
  Oligomer
ggaugaaaaauauuucuga

SEQ ID NO: 32911 - RNA, 19 nt, artificial
  Oligomer
aaagauuauucuucucaaa

SEQ ID NO: 32912 - RNA, 19 nt, artificial
  Oligomer
gagcuuucuguauauaaau

SEQ ID NO: 32913 - RNA, 19 nt, artificial
  Oligomer
uggaaagauauacaccaaa

SEQ ID NO: 32914 - RNA, 19 nt, artificial
  Oligomer
gacaucuagucacuuguaa

SEQ ID NO: 32915 - RNA, 19 nt, artificial
  Oligomer
gucaaacccuuaaaaauau

SEQ ID NO: 32916 - RNA, 19 nt, artificial
  Oligomer
ccaaaauccuaugguacaa

SEQ ID NO: 32917 - RNA, 19 nt, artificial
  Oligomer
gacacuuuauaacuaauau

SEQ ID NO: 32918 - RNA, 19 nt, artificial
  Oligomer
aaaaaacacuugaauaaga

SEQ ID NO: 32919 - RNA, 19 nt, artificial
  Oligomer
aaaagauuuggaaagauau

SEQ ID NO: 32920 - RNA, 19 nt, artificial
  Oligomer
gucauuacuuucaagcaaa

SEQ ID NO: 32921 - RNA, 19 nt, artificial
  Oligomer
agaguacuauauuugugaa

SEQ ID NO: 32922 - RNA, 19 nt, artificial
  Oligomer
ggugcaaauaucuguuaga

SEQ ID NO: 32923 - RNA, 19 nt, artificial
  Oligomer
uuggaaagauauacaccaa

SEQ ID NO: 32924 - RNA, 19 nt, artificial
  Oligomer
ugcuuuuguugugguggaa

SEQ ID NO: 32925 - RNA, 19 nt, artificial
  Oligomer
ugaauuucuugauuuuuca

SEQ ID NO: 32926 - RNA, 19 nt, artificial
  Oligomer
aguacaaaguugaaaacua

SEQ ID NO: 32927 - RNA, 19 nt, artificial
  Oligomer
aguugagcuuucuaagaga

SEQ ID NO: 32928 - RNA, 19 nt, artificial
  Oligomer
uuauguagguaaaaguaga

SEQ ID NO: 32929 - RNA, 19 nt, artificial
  Oligomer
uaggucaaacccuuaaaaa

SEQ ID NO: 32930 - RNA, 19 nt, artificial
  Oligomer
aaccauagacuaagaauaa

SEQ ID NO: 32931 - RNA, 19 nt, artificial
  Oligomer
cauaguauacugauuuaau

SEQ ID NO: 32932 - RNA, 19 nt, artificial
  Oligomer
uguggagauuagaguuaau

SEQ ID NO: 32933 - RNA, 19 nt, artificial
  Oligomer
cuaagaauaagaagcauca

SEQ ID NO: 32934 - RNA, 19 nt, artificial
  Oligomer
ugguauccagggugcaaau

SEQ ID NO: 32935 - RNA, 19 nt, artificial
  Oligomer
ggaguuuaccacuuucuua

SEQ ID NO: 32936 - RNA, 19 nt, artificial
  Oligomer
uaucauugcuguuagagaa

SEQ ID NO: 32937 - RNA, 19 nt, artificial
  Oligomer
uggagacucagcaguugga

SEQ ID NO: 32938 - RNA, 19 nt, artificial
  Oligomer
uagucaugcaaagauucaa

SEQ ID NO: 32939 - RNA, 19 nt, artificial
  Oligomer
gugaacugacuuuaaguaa

SEQ ID NO: 32940 - RNA, 19 nt, artificial
  Oligomer
agggacaagaauauauaaa

SEQ ID NO: 32941 - RNA, 19 nt, artificial
  Oligomer
aagaaucaguaggguauaa

SEQ ID NO: 32942 - RNA, 19 nt, artificial
  Oligomer
uagauacuucugaaauaaa

SEQ ID NO: 32943 - RNA, 19 nt, artificial
  Oligomer
ggcuuuuucccacuucaau

SEQ ID NO: 32944 - RNA, 19 nt, artificial
  Oligomer
cuuguauguuuagaguuaa

SEQ ID NO: 32945 - RNA, 19 nt, artificial
  Oligomer
cauguuacuacagaggaaa

SEQ ID NO: 32946 - RNA, 19 nt, artificial
  Oligomer
cagaagggacaagaauaua

SEQ ID NO: 32947 - RNA, 19 nt, artificial
  Oligomer
guuucucauagauaagaua

SEQ ID NO: 32948 - RNA, 19 nt, artificial
  Oligomer
cuuuuaucuugaaaauagu

SEQ ID NO: 32949 - RNA, 19 nt, artificial
  Oligomer
gcuuguaguuauagugaca

SEQ ID NO: 32950 - RNA, 19 nt, artificial
  Oligomer
gcaauuauuuuuaaaccaa

SEQ ID NO: 32951 - RNA, 19 nt, artificial
  Oligomer
ugaugauaccaucuuccaa

SEQ ID NO: 32952 - RNA, 19 nt, artificial
  Oligomer
gagacagaguacuauauuu

SEQ ID NO: 32953 - RNA, 19 nt, artificial
  Oligomer
ccgcaaaaauugaucauuu

SEQ ID NO: 32954 - RNA, 19 nt, artificial
  Oligomer
ucaguuucaaggacauuaa

SEQ ID NO: 32955 - RNA, 19 nt, artificial
  Oligomer
aaagcauugucuuaauuuu

SEQ ID NO: 32956 - RNA, 19 nt, artificial
  Oligomer
aagaagcaucauacuauaa

SEQ ID NO: 32957 - RNA, 19 nt, artificial
  Oligomer
gaagaugugcauacauuau

SEQ ID NO: 32958 - RNA, 19 nt, artificial
  Oligomer
agccgcacuucauuaaaau

SEQ ID NO: 32959 - RNA, 19 nt, artificial
  Oligomer
agcucaaggagaccaugua

SEQ ID NO: 32960 - RNA, 19 nt, artificial
  Oligomer
gaaagauagagauuguuuu

SEQ ID NO: 32961 - RNA, 19 nt, artificial
  Oligomer
aguaguuuugcaauaagua

SEQ ID NO: 32962 - RNA, 19 nt, artificial
  Oligomer
gguguuucucauagauaag

SEQ ID NO: 32963 - RNA, 19 nt, artificial
  Oligomer
uguggaaaacuaagaaaau

SEQ ID NO: 32964 - RNA, 19 nt, artificial
  Oligomer
gaucuuuguuaacucagua

SEQ ID NO: 32965 - RNA, 19 nt, artificial
  Oligomer
agaaaaaauucuuacauga

SEQ ID NO: 32966 - RNA, 19 nt, artificial
  Oligomer
ucuagucacuuguaaacaa

SEQ ID NO: 32967 - RNA, 19 nt, artificial
  Oligomer
aaaagauuauucuucucaa

SEQ ID NO: 32968 - RNA, 19 nt, artificial
  Oligomer
uggucagauucuacuuuga

SEQ ID NO: 32969 - RNA, 19 nt, artificial
  Oligomer
guuccaugcugguggaaag

SEQ ID NO: 32970 - RNA, 19 nt, artificial
  Oligomer
gaaagcguauuuaaugaua

SEQ ID NO: 32971 - RNA, 19 nt, artificial
  Oligomer
ccaaauugcagauuuauca

SEQ ID NO: 32972 - RNA, 19 nt, artificial
  Oligomer
cuaagucacuuuacuaaaa

SEQ ID NO: 32973 - RNA, 19 nt, artificial
  Oligomer
caaagauauguuaagugua

SEQ ID NO: 32974 - RNA, 19 nt, artificial
  Oligomer
gagacucaaaggugaugua

SEQ ID NO: 32975 - RNA, 19 nt, artificial
  Oligomer
aaaugacacuuuauaacua

SEQ ID NO: 32976 - RNA, 19 nt, artificial
  Oligomer
ugaggcaacugagacucaa

SEQ ID NO: 32977 - RNA, 19 nt, artificial
  Oligomer
auaguuugaaggugaaaaa

SEQ ID NO: 32978 - RNA, 19 nt, artificial
  Oligomer
gaggagugucugguaagaa

SEQ ID NO: 32979 - RNA, 19 nt, artificial
  Oligomer
gucuuaaucuaacucuaua

SEQ ID NO: 32980 - RNA, 19 nt, artificial
  Oligomer
guaggaaaaaaaauguaca

SEQ ID NO: 32981 - RNA, 19 nt, artificial
  Oligomer
ugaugaagaugugcauaca

SEQ ID NO: 32982 - RNA, 19 nt, artificial
  Oligomer
caaauucugguauccagaa

SEQ ID NO: 32983 - RNA, 19 nt, artificial
  Oligomer
auuguaucuucaaaguaga

SEQ ID NO: 32984 - RNA, 19 nt, artificial
  Oligomer
gcuaccaaguaggaaaaaa

SEQ ID NO: 32985 - RNA, 19 nt, artificial
  Oligomer
auaggucaaacccuuaaaa

SEQ ID NO: 32986 - RNA, 19 nt, artificial
  Oligomer
accucuuggaaauuauaaa

SEQ ID NO: 32987 - RNA, 19 nt, artificial
  Oligomer
guuugaaggugaaaaacuu

SEQ ID NO: 32988 - RNA, 19 nt, artificial
  Oligomer
uguauagucuagacuuuaa

SEQ ID NO: 32989 - RNA, 19 nt, artificial
  Oligomer
gcuuuuucccacuucaaua

SEQ ID NO: 32990 - RNA, 19 nt, artificial
  Oligomer
auucaucugugaaaggaaa

SEQ ID NO: 32991 - RNA, 19 nt, artificial
  Oligomer
ggcaguuaaccuuuuuggu

SEQ ID NO: 32992 - RNA, 19 nt, artificial
  Oligomer
caguaugcaagaugaguca

SEQ ID NO: 32993 - RNA, 19 nt, artificial
  Oligomer
ccuugggaacaacaugcua

SEQ ID NO: 32994 - RNA, 19 nt, artificial
  Oligomer
ugagaguaaaacuguaaaa

SEQ ID NO: 32995 - RNA, 19 nt, artificial
  Oligomer
gaugugaacugacuuuaag

SEQ ID NO: 32996 - RNA, 19 nt, artificial
  Oligomer
cuauuguagaggugaguaa

SEQ ID NO: 32997 - RNA, 19 nt, artificial
  Oligomer
aagaggagaagcuuugcaa

SEQ ID NO: 32998 - RNA, 19 nt, artificial
  Oligomer
gaauuucccaaauucaaca

SEQ ID NO: 32999 - RNA, 19 nt, artificial
  Oligomer
gguugcaagagcucaagga

SEQ ID NO: 33000 - RNA, 19 nt, artificial
  Oligomer
gucugcugaucaaaagcau

SEQ ID NO: 33001 - RNA, 19 nt, artificial
  Oligomer
acaggugaggcaacugaga

SEQ ID NO: 33002 - RNA, 19 nt, artificial
  Oligomer
gagaguaaaacuguaaaaa

SEQ ID NO: 33003 - RNA, 19 nt, artificial
  Oligomer
uuagcauuuacaaacuaaa

SEQ ID NO: 33004 - RNA, 19 nt, artificial
  Oligomer
gauuaagauguauauagga

SEQ ID NO: 33005 - RNA, 19 nt, artificial
  Oligomer
caaauugcagauuuaucaa

SEQ ID NO: 33006 - RNA, 19 nt, artificial
  Oligomer
uucagauaggcuuaacaaa

SEQ ID NO: 33007 - RNA, 19 nt, artificial
  Oligomer
gcucaaggagaccauguau

SEQ ID NO: 33008 - RNA, 19 nt, artificial
  Oligomer
aagauauguuaaguguaaa

SEQ ID NO: 33009 - RNA, 19 nt, artificial
  Oligomer
ucaaaagcauugucuuaau

SEQ ID NO: 33010 - RNA, 19 nt, artificial
  Oligomer
gcguauuuaaugauagaau

SEQ ID NO: 33011 - RNA, 19 nt, artificial
  Oligomer
guagaagcauguuuguaca

SEQ ID NO: 33012 - RNA, 19 nt, artificial
  Oligomer
agucagguagguaguucaa

SEQ ID NO: 33013 - RNA, 19 nt, artificial
  Oligomer
gguaguuuuuugacaggua

SEQ ID NO: 33014 - RNA, 19 nt, artificial
  Oligomer
guccaggguuuacauuaca

SEQ ID NO: 33015 - RNA, 19 nt, artificial
  Oligomer
uccagaauggucaguacaa

SEQ ID NO: 33016 - RNA, 19 nt, artificial
  Oligomer
gugcaaauaucuguuagaa

SEQ ID NO: 33017 - RNA, 19 nt, artificial
  Oligomer
guaauuugugcaaagauua

SEQ ID NO: 33018 - RNA, 19 nt, artificial
  Oligomer
aguaaggauucauccuuaa

SEQ ID NO: 33019 - RNA, 19 nt, artificial
  Oligomer
gacucaaaggugauguaau

SEQ ID NO: 33020 - RNA, 19 nt, artificial
  Oligomer
gaaauaaauguucucucaa

SEQ ID NO: 33021 - RNA, 19 nt, artificial
  Oligomer
ccaagcuaccuuucuugaa

SEQ ID NO: 33022 - RNA, 19 nt, artificial
  Oligomer
ugcaaagauuauagcuaau

SEQ ID NO: 33023 - RNA, 19 nt, artificial
  Oligomer
agauuuggaaagauauaca

SEQ ID NO: 33024 - RNA, 19 nt, artificial
  Oligomer
uugugguggaaaacugaaa

SEQ ID NO: 33025 - RNA, 19 nt, artificial
  Oligomer
caugcuaaaugguauccag

SEQ ID NO: 33026 - RNA, 19 nt, artificial
  Oligomer
gauuuaauuucuaagugua

SEQ ID NO: 33027 - RNA, 19 nt, artificial
  Oligomer
gaugauaccaucuuccaaa

SEQ ID NO: 33028 - RNA, 19 nt, artificial
  Oligomer
agucuagacuuuaaauuua

SEQ ID NO: 33029 - RNA, 19 nt, artificial
  Oligomer
guucacucuaggauuucaa

SEQ ID NO: 33030 - RNA, 19 nt, artificial
  Oligomer
cagggcaguuaaccuuuuu

SEQ ID NO: 33031 - RNA, 19 nt, artificial
  Oligomer
ccauggauucaaccaagga

SEQ ID NO: 33032 - RNA, 19 nt, artificial
  Oligomer
guuccugcuguaaauauga

SEQ ID NO: 33033 - RNA, 19 nt, artificial
  Oligomer
uccaggguuuacauuacaa

SEQ ID NO: 33034 - RNA, 19 nt, artificial
  Oligomer
cuaaguguaagugaauuaa

SEQ ID NO: 33035 - RNA, 19 nt, artificial
  Oligomer
cuuccaaaauccuauggua

SEQ ID NO: 33036 - RNA, 19 nt, artificial
  Oligomer
ucauuuaaaacauugcaaa

SEQ ID NO: 33037 - RNA, 19 nt, artificial
  Oligomer
gaaagguccaaauguuuau

SEQ ID NO: 33038 - RNA, 19 nt, artificial
  Oligomer
gcagacuaucuuuugagaa

SEQ ID NO: 33039 - RNA, 19 nt, artificial
  Oligomer
agcauaacagaguuauaga

SEQ ID NO: 33040 - RNA, 19 nt, artificial
  Oligomer
gucagcuuauguagguaaa

SEQ ID NO: 33041 - RNA, 19 nt, artificial
  Oligomer
ccauguauguaaaguuccu

SEQ ID NO: 33042 - RNA, 19 nt, artificial
  Oligomer
aauaggucaaacccuuaaa

SEQ ID NO: 33043 - RNA, 19 nt, artificial
  Oligomer
auuucuaaguguaagugaa

SEQ ID NO: 33044 - RNA, 19 nt, artificial
  Oligomer
uaugguacaagaagcuaua

SEQ ID NO: 33045 - RNA, 19 nt, artificial
  Oligomer
ggcuaacaaguuuauuuua

SEQ ID NO: 33046 - RNA, 19 nt, artificial
  Oligomer
gugaguguauauaauguga

SEQ ID NO: 33047 - RNA, 19 nt, artificial
  Oligomer
auauagucauuaacuugaa

SEQ ID NO: 33048 - RNA, 19 nt, artificial
  Oligomer
uguuaacucaguauuuuaa

SEQ ID NO: 33049 - RNA, 19 nt, artificial
  Oligomer
uugcaaagucaaaacuaua

SEQ ID NO: 33050 - RNA, 19 nt, artificial
  Oligomer
uggagcuuucuguauauaa

SEQ ID NO: 33051 - RNA, 19 nt, artificial
  Oligomer
ggcuuuuccuguucuggga

SEQ ID NO: 33052 - RNA, 19 nt, artificial
  Oligomer
cauguuauguuguucuuau

SEQ ID NO: 33053 - RNA, 19 nt, artificial
  Oligomer
uucuggauuuaguaagaaa

SEQ ID NO: 33054 - RNA, 19 nt, artificial
  Oligomer
ggcuuuuaucuugaaaaua

SEQ ID NO: 33055 - RNA, 19 nt, artificial
  Oligomer
gcuuuuguugugguggaaa

SEQ ID NO: 33056 - RNA, 19 nt, artificial
  Oligomer
gaacagaagggacaagaau

SEQ ID NO: 33057 - RNA, 19 nt, artificial
  Oligomer
gcaaauaucuguuagaaca

SEQ ID NO: 33058 - RNA, 19 nt, artificial
  Oligomer
uugguuauauagucauuaa

SEQ ID NO: 33059 - RNA, 19 nt, artificial
  Oligomer
aggaggaauugaaaacacu

SEQ ID NO: 33060 - RNA, 19 nt, artificial
  Oligomer
agcuuauuuuucugugaau

SEQ ID NO: 33061 - RNA, 19 nt, artificial
  Oligomer
agacuucauuacagaaaga

SEQ ID NO: 33062 - RNA, 19 nt, artificial
  Oligomer
gcaauauaaucuuugaauu

SEQ ID NO: 33063 - RNA, 19 nt, artificial
  Oligomer
aauuuagucugcugaucaa

SEQ ID NO: 33064 - RNA, 19 nt, artificial
  Oligomer
uaaggaagaagaauuugua

SEQ ID NO: 33065 - RNA, 19 nt, artificial
  Oligomer
guuaacucaguauuuuaaa

SEQ ID NO: 33066 - RNA, 19 nt, artificial
  Oligomer
uauucaucugugaaaggaa

SEQ ID NO: 33067 - RNA, 19 nt, artificial
  Oligomer
gauuaaaaacuuuugcuaa

SEQ ID NO: 33068 - RNA, 19 nt, artificial
  Oligomer
gauucuacuuugaaucuga

SEQ ID NO: 33069 - RNA, 19 nt, artificial
  Oligomer
aaggagaccauguauguaa

SEQ ID NO: 33070 - RNA, 19 nt, artificial
  Oligomer
agucagacuucauuacaga

SEQ ID NO: 33071 - RNA, 19 nt, artificial
  Oligomer
aaugacacuuuauaacuaa

SEQ ID NO: 33072 - RNA, 19 nt, artificial
  Oligomer
gucagacuucauuacagaa

SEQ ID NO: 33073 - RNA, 19 nt, artificial
  Oligomer
cacguacuugugcgaauua

SEQ ID NO: 33074 - RNA, 19 nt, artificial
  Oligomer
cugacugacugaucuaauu

SEQ ID NO: 33075 - RNA, 19 nt, artificial
  Oligomer
aaaauaauggaggaaaaaa

SEQ ID NO: 33076 - RNA, 19 nt, artificial
  Oligomer
uuaccguuaggaugauuaa

SEQ ID NO: 33077 - RNA, 19 nt, artificial
  Oligomer
auaugaacucccauccuaa

SEQ ID NO: 33078 - RNA, 19 nt, artificial
  Oligomer
aguccuguuucagcaucaa

SEQ ID NO: 33079 - RNA, 19 nt, artificial
  Oligomer
cauccauggauucaaccaa

SEQ ID NO: 33080 - RNA, 19 nt, artificial
  Oligomer
guauguuuagaguuaagca

SEQ ID NO: 33081 - RNA, 19 nt, artificial
  Oligomer
uaaucaucuggauuuuuua

SEQ ID NO: 33082 - RNA, 19 nt, artificial
  Oligomer
ucucagaucuuccaauuaa

SEQ ID NO: 33083 - RNA, 19 nt, artificial
  Oligomer
gguugcagaucuagugaau

SEQ ID NO: 33084 - RNA, 19 nt, artificial
  Oligomer
gcacuucauuaaaauucuu

SEQ ID NO: 33085 - RNA, 19 nt, artificial
  Oligomer
uuaggaugauuaagaugua

SEQ ID NO: 33086 - RNA, 19 nt, artificial
  Oligomer
gaugaagaugugcauacau

SEQ ID NO: 33087 - RNA, 19 nt, artificial
  Oligomer
ggcaauauaaucuuugaau

SEQ ID NO: 33088 - RNA, 19 nt, artificial
  Oligomer
gaaagaguauuguuauguu

SEQ ID NO: 33089 - RNA, 19 nt, artificial
  Oligomer
guaaaguuccugcuguaaa

SEQ ID NO: 33090 - RNA, 19 nt, artificial
  Oligomer
guauguauuacuuuuguaa

SEQ ID NO: 33091 - RNA, 19 nt, artificial
  Oligomer
gcuaauuuuccaaguggua

SEQ ID NO: 33092 - RNA, 19 nt, artificial
  Oligomer
ugaacugacuuuaaguaau

SEQ ID NO: 33093 - RNA, 19 nt, artificial
  Oligomer
ccauagacuaagaauaaga

SEQ ID NO: 33094 - RNA, 19 nt, artificial
  Oligomer
gugaagaagcuagauuaaa

SEQ ID NO: 33095 - RNA, 19 nt, artificial
  Oligomer
acagguagaccaugucuua

SEQ ID NO: 33096 - RNA, 19 nt, artificial
  Oligomer
gcuuauuuuucugugaaua

SEQ ID NO: 33097 - RNA, 19 nt, artificial
  Oligomer
uuuauauacagaaagcucc

SEQ ID NO: 33098 - RNA, 19 nt, artificial
  Oligomer
uucaguuauaguaugaugc

SEQ ID NO: 33099 - RNA, 19 nt, artificial
  Oligomer
uuaucuaugagaaacacca

SEQ ID NO: 33100 - RNA, 19 nt, artificial
  Oligomer
uuccucuguaguaacaugc

SEQ ID NO: 33101 - RNA, 19 nt, artificial
  Oligomer
uauucuaucauuaaauacg

SEQ ID NO: 33102 - RNA, 19 nt, artificial
  Oligomer
uaugcauugaugauugucc

SEQ ID NO: 33103 - RNA, 19 nt, artificial
  Oligomer
uuuuucuaaguuuuagccc

SEQ ID NO: 33104 - RNA, 19 nt, artificial
  Oligomer
uugaaaauaggacuugucc

SEQ ID NO: 33105 - RNA, 19 nt, artificial
  Oligomer
uucaguacuaaucucuuuc

SEQ ID NO: 33106 - RNA, 19 nt, artificial
  Oligomer
uuuuccuccauuauuuucu

SEQ ID NO: 33107 - RNA, 19 nt, artificial
  Oligomer
uucuucuuccuuauugaug

SEQ ID NO: 33108 - RNA, 19 nt, artificial
  Oligomer
uugaauuugggaaauuccu

SEQ ID NO: 33109 - RNA, 19 nt, artificial
  Oligomer
uuacucucaaacuuuccuc

SEQ ID NO: 33110 - RNA, 19 nt, artificial
  Oligomer
uugaagauacaauuguccc

SEQ ID NO: 33111 - RNA, 19 nt, artificial
  Oligomer
uuaaagucaguucacauca

SEQ ID NO: 33112 - RNA, 19 nt, artificial
  Oligomer
uuaaauuucacaacucaug

SEQ ID NO: 33113 - RNA, 19 nt, artificial
  Oligomer
uuuguacugaccauucugg

SEQ ID NO: 33114 - RNA, 19 nt, artificial
  Oligomer
uuuacauacauggucuccu

SEQ ID NO: 33115 - RNA, 19 nt, artificial
  Oligomer
uuuaagaaccugaagcaac

SEQ ID NO: 33116 - RNA, 19 nt, artificial
  Oligomer
uaucuuuccaccagcaugg

SEQ ID NO: 33117 - RNA, 19 nt, artificial
  Oligomer
uucaauuccuccuugguug

SEQ ID NO: 33118 - RNA, 19 nt, artificial
  Oligomer
uacuuuaucaccuucaccu

SEQ ID NO: 33119 - RNA, 19 nt, artificial
  Oligomer
uuuuuucuaaguuuuagcc

SEQ ID NO: 33120 - RNA, 19 nt, artificial
  Oligomer
uuagcuauaaucuuugcac

SEQ ID NO: 33121 - RNA, 19 nt, artificial
  Oligomer
uuugaagauacaauugucc

SEQ ID NO: 33122 - RNA, 19 nt, artificial
  Oligomer
uaauuagcuauaaucuuug

SEQ ID NO: 33123 - RNA, 19 nt, artificial
  Oligomer
uuucacaugauuauucaca

SEQ ID NO: 33124 - RNA, 19 nt, artificial
  Oligomer
uauaguaugaugcuucuua

SEQ ID NO: 33125 - RNA, 19 nt, artificial
  Oligomer
uuaaacuucuaguuuauac

SEQ ID NO: 33126 - RNA, 19 nt, artificial
  Oligomer
auaaauuacauuaaaaccc

SEQ ID NO: 33127 - RNA, 19 nt, artificial
  Oligomer
uuuagauccuucaaaacug

SEQ ID NO: 33128 - RNA, 19 nt, artificial
  Oligomer
uuagugaugguguuuucuc

SEQ ID NO: 33129 - RNA, 19 nt, artificial
  Oligomer
uuucuuggaagauuuguug

SEQ ID NO: 33130 - RNA, 19 nt, artificial
  Oligomer
ucuaaggucacuuccagcc

SEQ ID NO: 33131 - RNA, 19 nt, artificial
  Oligomer
uuaaucuacaaugaaugcc

SEQ ID NO: 33132 - RNA, 19 nt, artificial
  Oligomer
auauacaucuuaaucaucc

SEQ ID NO: 33133 - RNA, 19 nt, artificial
  Oligomer
uuuuacucucaaacuuucc

SEQ ID NO: 33134 - RNA, 19 nt, artificial
  Oligomer
ucuuguaauguaaacccug

SEQ ID NO: 33135 - RNA, 19 nt, artificial
  Oligomer
ucuaaaaacaaucucuauc

SEQ ID NO: 33136 - RNA, 19 nt, artificial
  Oligomer
uuuuuuuccuacuugguag

SEQ ID NO: 33137 - RNA, 19 nt, artificial
  Oligomer
uuugagucucaguugccuc

SEQ ID NO: 33138 - RNA, 19 nt, artificial
  Oligomer
uauuuuuaaggguuugacc

SEQ ID NO: 33139 - RNA, 19 nt, artificial
  Oligomer
ucgaauauuaagauuccgg

SEQ ID NO: 33140 - RNA, 19 nt, artificial
  Oligomer
uuauauauucuugucccuu

SEQ ID NO: 33141 - RNA, 19 nt, artificial
  Oligomer
uucccaagggucuucacug

SEQ ID NO: 33142 - RNA, 19 nt, artificial
  Oligomer
uagaucugcaaccagaacc

SEQ ID NO: 33143 - RNA, 19 nt, artificial
  Oligomer
auuuucaagauaaaagccg

SEQ ID NO: 33144 - RNA, 19 nt, artificial
  Oligomer
uugagcucuugcaaccuug

SEQ ID NO: 33145 - RNA, 19 nt, artificial
  Oligomer
uuguuaacugaguauaucc

SEQ ID NO: 33146 - RNA, 19 nt, artificial
  Oligomer
uuuuugcggaauuagaugg

SEQ ID NO: 33147 - RNA, 19 nt, artificial
  Oligomer
uauuauuuuccuuucacag

SEQ ID NO: 33148 - RNA, 19 nt, artificial
  Oligomer
uuaaaagucaucuucucuu

SEQ ID NO: 33149 - RNA, 19 nt, artificial
  Oligomer
uauauauucuugucccuuc

SEQ ID NO: 33150 - RNA, 19 nt, artificial
  Oligomer
uucaacuuuguacugacca

SEQ ID NO: 33151 - RNA, 19 nt, artificial
  Oligomer
uauaaagaaacccugcucg

SEQ ID NO: 33152 - RNA, 19 nt, artificial
  Oligomer
uucagaaguaucuacuacu

SEQ ID NO: 33153 - RNA, 19 nt, artificial
  Oligomer
uuuuaaugaagugcggcuc

SEQ ID NO: 33154 - RNA, 19 nt, artificial
  Oligomer
uugcauuuuacacuuaaca

SEQ ID NO: 33155 - RNA, 19 nt, artificial
  Oligomer
uuggucaccaauaccugug

SEQ ID NO: 33156 - RNA, 19 nt, artificial
  Oligomer
uguuaaaacaauucagucc

SEQ ID NO: 33157 - RNA, 19 nt, artificial
  Oligomer
uuugcaaagcuucuccucu

SEQ ID NO: 33158 - RNA, 19 nt, artificial
  Oligomer
auuuuuuacaguuuuacuc

SEQ ID NO: 33159 - RNA, 19 nt, artificial
  Oligomer
uuauucacaauacuaauac

SEQ ID NO: 33160 - RNA, 19 nt, artificial
  Oligomer
uuuuacacuuaacauaucu

SEQ ID NO: 33161 - RNA, 19 nt, artificial
  Oligomer
uaaacuucuaguuuauacc

SEQ ID NO: 33162 - RNA, 19 nt, artificial
  Oligomer
uuucauuuuacaaaaucag

SEQ ID NO: 33163 - RNA, 19 nt, artificial
  Oligomer
uguuuauauauucuugucc

SEQ ID NO: 33164 - RNA, 19 nt, artificial
  Oligomer
uucugaaaggacuuuaauc

SEQ ID NO: 33165 - RNA, 19 nt, artificial
  Oligomer
uuuagcccaaauuuccagg

SEQ ID NO: 33166 - RNA, 19 nt, artificial
  Oligomer
aauuuuucaguuuuccacc

SEQ ID NO: 33167 - RNA, 19 nt, artificial
  Oligomer
uuuguugugagaaucuugu

SEQ ID NO: 33168 - RNA, 19 nt, artificial
  Oligomer
auuaauuggaagaucugag

SEQ ID NO: 33169 - RNA, 19 nt, artificial
  Oligomer
uuuuuccuccauuauuuuc

SEQ ID NO: 33170 - RNA, 19 nt, artificial
  Oligomer
uuuugcaaagcuucuccuc

SEQ ID NO: 33171 - RNA, 19 nt, artificial
  Oligomer
auauacacucacuacaccc

SEQ ID NO: 33172 - RNA, 19 nt, artificial
  Oligomer
uauuucagaaguaucuacu

SEQ ID NO: 33173 - RNA, 19 nt, artificial
  Oligomer
uaucuuuccaaaucuuuug

SEQ ID NO: 33174 - RNA, 19 nt, artificial
  Oligomer
uuugacuuugcaaaugauc

SEQ ID NO: 33175 - RNA, 19 nt, artificial
  Oligomer
ugauauaucuacaaccugc

SEQ ID NO: 33176 - RNA, 19 nt, artificial
  Oligomer
ucucuaucuuuccaccagc

SEQ ID NO: 33177 - RNA, 19 nt, artificial
  Oligomer
uuuuuuacaguuuuacucu

SEQ ID NO: 33178 - RNA, 19 nt, artificial
  Oligomer
uuacuuuaucaccuucacc

SEQ ID NO: 33179 - RNA, 19 nt, artificial
  Oligomer
uauaucuacaaccugccca

SEQ ID NO: 33180 - RNA, 19 nt, artificial
  Oligomer
ucugacuugacucaucuug

SEQ ID NO: 33181 - RNA, 19 nt, artificial
  Oligomer
uaucugaauuuuuuccucc

SEQ ID NO: 33182 - RNA, 19 nt, artificial
  Oligomer
uuuacucucaaacuuuccu

SEQ ID NO: 33183 - RNA, 19 nt, artificial
  Oligomer
uuuucauccacaaagcagg

SEQ ID NO: 33184 - RNA, 19 nt, artificial
  Oligomer
uuuaaugaagugcggcucc

SEQ ID NO: 33185 - RNA, 19 nt, artificial
  Oligomer
uauugaauacguuuuauuc

SEQ ID NO: 33186 - RNA, 19 nt, artificial
  Oligomer
uucuauaacucuguuaugc

SEQ ID NO: 33187 - RNA, 19 nt, artificial
  Oligomer
uuuuuuuuccuacuuggua

SEQ ID NO: 33188 - RNA, 19 nt, artificial
  Oligomer
uuagauggaaaagauccgg

SEQ ID NO: 33189 - RNA, 19 nt, artificial
  Oligomer
uuuuagauccuucaaaacu

SEQ ID NO: 33190 - RNA, 19 nt, artificial
  Oligomer
aguuauaguaugaugcuuc

SEQ ID NO: 33191 - RNA, 19 nt, artificial
  Oligomer
uuuugaaacaagauaagac

SEQ ID NO: 33192 - RNA, 19 nt, artificial
  Oligomer
aucuuaaucauccuaacgg

SEQ ID NO: 33193 - RNA, 19 nt, artificial
  Oligomer
uucaagauaaaagccguug

SEQ ID NO: 33194 - RNA, 19 nt, artificial
  Oligomer
uucuaguuuauacccuacu

SEQ ID NO: 33195 - RNA, 19 nt, artificial
  Oligomer
uauguagugaaaguuaugg

SEQ ID NO: 33196 - RNA, 19 nt, artificial
  Oligomer
uucaguccuugaguccuug

SEQ ID NO: 33197 - RNA, 19 nt, artificial
  Oligomer
aauuuuaacacuuuucucc

SEQ ID NO: 33198 - RNA, 19 nt, artificial
  Oligomer
uauuuucuuaauguccuug

SEQ ID NO: 33199 - RNA, 19 nt, artificial
  Oligomer
uugacuaaaaagaacuaug

SEQ ID NO: 33200 - RNA, 19 nt, artificial
  Oligomer
uuccaacugcugagucucc

SEQ ID NO: 33201 - RNA, 19 nt, artificial
  Oligomer
auuuuauccacuaaaaugg

SEQ ID NO: 33202 - RNA, 19 nt, artificial
  Oligomer
uugcauauaauguaugcac

SEQ ID NO: 33203 - RNA, 19 nt, artificial
  Oligomer
uaguauuuuauugaauacg

SEQ ID NO: 33204 - RNA, 19 nt, artificial
  Oligomer
ucuaucauuaaauacgcuu

SEQ ID NO: 33205 - RNA, 19 nt, artificial
  Oligomer
uuaaauuuaaagucuagac

SEQ ID NO: 33206 - RNA, 19 nt, artificial
  Oligomer
auuuuaacacuuuucuccc

SEQ ID NO: 33207 - RNA, 19 nt, artificial
  Oligomer
uuaaaaaaauaauucgcac

SEQ ID NO: 33208 - RNA, 19 nt, artificial
  Oligomer
uucaaaacuguuaaaaguc

SEQ ID NO: 33209 - RNA, 19 nt, artificial
  Oligomer
uuauauacacucacuacac

SEQ ID NO: 33210 - RNA, 19 nt, artificial
  Oligomer
aaucuuguaauguaaaccc

SEQ ID NO: 33211 - RNA, 19 nt, artificial
  Oligomer
auuuuuucuaaguuuuagc

SEQ ID NO: 33212 - RNA, 19 nt, artificial
  Oligomer
ucaaaaauuaagacaaugc

SEQ ID NO: 33213 - RNA, 19 nt, artificial
  Oligomer
uuguaaaugcuaaaaccag

SEQ ID NO: 33214 - RNA, 19 nt, artificial
  Oligomer
uuuaaaagaaaauggacag

SEQ ID NO: 33215 - RNA, 19 nt, artificial
  Oligomer
uucuugucccuucuguucu

SEQ ID NO: 33216 - RNA, 19 nt, artificial
  Oligomer
uaaaauguaaaauaagugg

SEQ ID NO: 33217 - RNA, 19 nt, artificial
  Oligomer
uucguauagcuucuuguac

SEQ ID NO: 33218 - RNA, 19 nt, artificial
  Oligomer
uaucaugugaaacuaaugc

SEQ ID NO: 33219 - RNA, 19 nt, artificial
  Oligomer
uauauaaccaaacuaagug

SEQ ID NO: 33220 - RNA, 19 nt, artificial
  Oligomer
uuauguuaaaacaauucag

SEQ ID NO: 33221 - RNA, 19 nt, artificial
  Oligomer
uugcaaaugaucaauuuuu

SEQ ID NO: 33222 - RNA, 19 nt, artificial
  Oligomer
uuuuccaccacaacaaaag

SEQ ID NO: 33223 - RNA, 19 nt, artificial
  Oligomer
ucacagaugaauaaacugc

SEQ ID NO: 33224 - RNA, 19 nt, artificial
  Oligomer
uuccaaucaguuagcccuc

SEQ ID NO: 33225 - RNA, 19 nt, artificial
  Oligomer
uuaacugaguauauccaug

SEQ ID NO: 33226 - RNA, 19 nt, artificial
  Oligomer
ucguauagcuucuuguacc

SEQ ID NO: 33227 - RNA, 19 nt, artificial
  Oligomer
uuucucaguaguucuuacc

SEQ ID NO: 33228 - RNA, 19 nt, artificial
  Oligomer
uuuuucauccacaaagcag

SEQ ID NO: 33229 - RNA, 19 nt, artificial
  Oligomer
uuaaucuagcuucuucacu

SEQ ID NO: 33230 - RNA, 19 nt, artificial
  Oligomer
uugaacaugccuaagccuu

SEQ ID NO: 33231 - RNA, 19 nt, artificial
  Oligomer
uuuauuucauuucucuaac

SEQ ID NO: 33232 - RNA, 19 nt, artificial
  Oligomer
uuuaaaggguauaucaugu

SEQ ID NO: 33233 - RNA, 19 nt, artificial
  Oligomer
ucugaaaggacuuuaaucu

SEQ ID NO: 33234 - RNA, 19 nt, artificial
  Oligomer
auuuuuaaggguuugaccu

SEQ ID NO: 33235 - RNA, 19 nt, artificial
  Oligomer
uuauuucagaaguaucuac

SEQ ID NO: 33236 - RNA, 19 nt, artificial
  Oligomer
uuaacuggaauuuaguuug

SEQ ID NO: 33237 - RNA, 19 nt, artificial
  Oligomer
uuggaagugaaguguccug

SEQ ID NO: 33238 - RNA, 19 nt, artificial
  Oligomer
uucuacaaauucuucuucc

SEQ ID NO: 33239 - RNA, 19 nt, artificial
  Oligomer
uacuaaaacagaaacaggg

SEQ ID NO: 33240 - RNA, 19 nt, artificial
  Oligomer
uucuucuaguuagugaugg

SEQ ID NO: 33241 - RNA, 19 nt, artificial
  Oligomer
uuaagauacaagaugauau

SEQ ID NO: 33242 - RNA, 19 nt, artificial
  Oligomer
uauauaugcauugaugauu

SEQ ID NO: 33243 - RNA, 19 nt, artificial
  Oligomer
ucuacuacuauuacuagcc

SEQ ID NO: 33244 - RNA, 19 nt, artificial
  Oligomer
uauaucuuuccaaaucuuu

SEQ ID NO: 33245 - RNA, 19 nt, artificial
  Oligomer
uaagcuuuaaucuacaaug

SEQ ID NO: 33246 - RNA, 19 nt, artificial
  Oligomer
uauuacauuaaugauacag

SEQ ID NO: 33247 - RNA, 19 nt, artificial
  Oligomer
uaaaaggguauuaggaugg

SEQ ID NO: 33248 - RNA, 19 nt, artificial
  Oligomer
uacuuuuaccuacauaagc

SEQ ID NO: 33249 - RNA, 19 nt, artificial
  Oligomer
uuugauuagaaguuggagu

SEQ ID NO: 33250 - RNA, 19 nt, artificial
  Oligomer
uaacaugccuuacucaccu

SEQ ID NO: 33251 - RNA, 19 nt, artificial
  Oligomer
uuuucaguuuuccaccaca

SEQ ID NO: 33252 - RNA, 19 nt, artificial
  Oligomer
uucaaaguagaaucugacc

SEQ ID NO: 33253 - RNA, 19 nt, artificial
  Oligomer
uugauuagaaguuggagug

SEQ ID NO: 33254 - RNA, 19 nt, artificial
  Oligomer
uaaauuucacaacucaugg

SEQ ID NO: 33255 - RNA, 19 nt, artificial
  Oligomer
auguaaacccuggacguuc

SEQ ID NO: 33256 - RNA, 19 nt, artificial
  Oligomer
uuucaagaaagguagcuug

SEQ ID NO: 33257 - RNA, 19 nt, artificial
  Oligomer
uucuuauucuuagucuaug

SEQ ID NO: 33258 - RNA, 19 nt, artificial
  Oligomer
uacuaaauccagaaaaaug

SEQ ID NO: 33259 - RNA, 19 nt, artificial
  Oligomer
uugaauacguuuuauucac

SEQ ID NO: 33260 - RNA, 19 nt, artificial
  Oligomer
uuaacaaguagauuugacu

SEQ ID NO: 33261 - RNA, 19 nt, artificial
  Oligomer
uuucaauuccuccuugguu

SEQ ID NO: 33262 - RNA, 19 nt, artificial
  Oligomer
uuuuguccuauauacaucu

SEQ ID NO: 33263 - RNA, 19 nt, artificial
  Oligomer
uucuaguuagugauggugu

SEQ ID NO: 33264 - RNA, 19 nt, artificial
  Oligomer
uugucccuugcuaucccug

SEQ ID NO: 33265 - RNA, 19 nt, artificial
  Oligomer
uauaacucuguuaugcuga

SEQ ID NO: 33266 - RNA, 19 nt, artificial
  Oligomer
ugggaguucauauuuacag

SEQ ID NO: 33267 - RNA, 19 nt, artificial
  Oligomer
uuaagucuccaaaaauuug

SEQ ID NO: 33268 - RNA, 19 nt, artificial
  Oligomer
uacaguuuuacucucaaac

SEQ ID NO: 33269 - RNA, 19 nt, artificial
  Oligomer
auuagauggaaaagauccg

SEQ ID NO: 33270 - RNA, 19 nt, artificial
  Oligomer
aauauuaagauuccggccc

SEQ ID NO: 33271 - RNA, 19 nt, artificial
  Oligomer
uuucauuucucuaacagca

SEQ ID NO: 33272 - RNA, 19 nt, artificial
  Oligomer
uaaagugucauuuaauaug

SEQ ID NO: 33273 - RNA, 19 nt, artificial
  Oligomer
uggaagugaaguguccugg

SEQ ID NO: 33274 - RNA, 19 nt, artificial
  Oligomer
uacaaaaucagaaauacuu

SEQ ID NO: 33275 - RNA, 19 nt, artificial
  Oligomer
ucuugcaagcugcuccuug

SEQ ID NO: 33276 - RNA, 19 nt, artificial
  Oligomer
auaguuuucaacuuuguac

SEQ ID NO: 33277 - RNA, 19 nt, artificial
  Oligomer
uucaccuucaaacuauguc

SEQ ID NO: 33278 - RNA, 19 nt, artificial
  Oligomer
uuaaugaagugcggcuccc

SEQ ID NO: 33279 - RNA, 19 nt, artificial
  Oligomer
uugacuuugcaaaugauca

SEQ ID NO: 33280 - RNA, 19 nt, artificial
  Oligomer
uuuuagcccaaauuuccag

SEQ ID NO: 33281 - RNA, 19 nt, artificial
  Oligomer
uuuuucaguuuuccaccac

SEQ ID NO: 33282 - RNA, 19 nt, artificial
  Oligomer
uuuuuaacaaguagauuug

SEQ ID NO: 33283 - RNA, 19 nt, artificial
  Oligomer
augaguuaaaugaauauug

SEQ ID NO: 33284 - RNA, 19 nt, artificial
  Oligomer
aauaauucgcacaaguacg

SEQ ID NO: 33285 - RNA, 19 nt, artificial
  Oligomer
auauaauguaugcacaucu

SEQ ID NO: 33286 - RNA, 19 nt, artificial
  Oligomer
uuuuguucuaugcauauua

SEQ ID NO: 33287 - RNA, 19 nt, artificial
  Oligomer
uuuucaacuuuguacugac

SEQ ID NO: 33288 - RNA, 19 nt, artificial
  Oligomer
uaauguaugcacaucuuca

SEQ ID NO: 33289 - RNA, 19 nt, artificial
  Oligomer
auguccuugaaacugaacc

SEQ ID NO: 33290 - RNA, 19 nt, artificial
  Oligomer
aauuagauggaaaagaucc

SEQ ID NO: 33291 - RNA, 19 nt, artificial
  Oligomer
uuuccaaaucuuuuguucu

SEQ ID NO: 33292 - RNA, 19 nt, artificial
  Oligomer
augcuaauggaauucaauc

SEQ ID NO: 33293 - RNA, 19 nt, artificial
  Oligomer
uaugagaaucucaacaugg

SEQ ID NO: 33294 - RNA, 19 nt, artificial
  Oligomer
auuuaaacaacuauucuuc

SEQ ID NO: 33295 - RNA, 19 nt, artificial
  Oligomer
uuaacaaagaucuuuuagu

SEQ ID NO: 33296 - RNA, 19 nt, artificial
  Oligomer
uauugaugucugcagguac

SEQ ID NO: 33297 - RNA, 19 nt, artificial
  Oligomer
uauguuaaaacaauucagu

SEQ ID NO: 33298 - RNA, 19 nt, artificial
  Oligomer
uccuuauugaugucugcag

SEQ ID NO: 33299 - RNA, 19 nt, artificial
  Oligomer
uuuucuaaguuuuagccca

SEQ ID NO: 33300 - RNA, 19 nt, artificial
  Oligomer
uuuugcaggcguuugaaca

SEQ ID NO: 33301 - RNA, 19 nt, artificial
  Oligomer
uuucuauccauacagauuu

SEQ ID NO: 33302 - RNA, 19 nt, artificial
  Oligomer
auauuuuucauccacaaag

SEQ ID NO: 33303 - RNA, 19 nt, artificial
  Oligomer
agaauuuuaaugaagugcg

SEQ ID NO: 33304 - RNA, 19 nt, artificial
  Oligomer
uucuuaauguccuugaaac

SEQ ID NO: 33305 - RNA, 19 nt, artificial
  Oligomer
auuuauuucagaaguaucu

SEQ ID NO: 33306 - RNA, 19 nt, artificial
  Oligomer
uacaagugacuagaugucc

SEQ ID NO: 33307 - RNA, 19 nt, artificial
  Oligomer
aguaugaugcuucuuauuc

SEQ ID NO: 33308 - RNA, 19 nt, artificial
  Oligomer
uccacaaggaacaaaaacg

SEQ ID NO: 33309 - RNA, 19 nt, artificial
  Oligomer
uuaaaggguauaucaugug

SEQ ID NO: 33310 - RNA, 19 nt, artificial
  Oligomer
aauaaaacaaugauucggg

SEQ ID NO: 33311 - RNA, 19 nt, artificial
  Oligomer
uuuugcuugaaaguaauga

SEQ ID NO: 33312 - RNA, 19 nt, artificial
  Oligomer
uugucuacuuugaagauac

SEQ ID NO: 33313 - RNA, 19 nt, artificial
  Oligomer
uuucugagcauucacuaga

SEQ ID NO: 33314 - RNA, 19 nt, artificial
  Oligomer
uuaauauguagugaaaguu

SEQ ID NO: 33315 - RNA, 19 nt, artificial
  Oligomer
uuuagcauguuguucccaa

SEQ ID NO: 33316 - RNA, 19 nt, artificial
  Oligomer
ugcuaauggaauucaaucc

SEQ ID NO: 33317 - RNA, 19 nt, artificial
  Oligomer
uaauacagcuaauacccug

SEQ ID NO: 33318 - RNA, 19 nt, artificial
  Oligomer
auauaugcauugaugauug

SEQ ID NO: 33319 - RNA, 19 nt, artificial
  Oligomer
ugaaacuuuaagauacaag

SEQ ID NO: 33320 - RNA, 19 nt, artificial
  Oligomer
uuccuuauugaugucugca

SEQ ID NO: 33321 - RNA, 19 nt, artificial
  Oligomer
uuauacagcagaaagcaau

SEQ ID NO: 33322 - RNA, 19 nt, artificial
  Oligomer
auuuuuuccuccauuauuu

SEQ ID NO: 33323 - RNA, 19 nt, artificial
  Oligomer
uaacuuuaaaagaaaaugg

SEQ ID NO: 33324 - RNA, 19 nt, artificial
  Oligomer
ucaguuuuccaccacaaca

SEQ ID NO: 33325 - RNA, 19 nt, artificial
  Oligomer
acuaaauccagaaaaaugg

SEQ ID NO: 33326 - RNA, 19 nt, artificial
  Oligomer
auaucuuugacaucuuucc

SEQ ID NO: 33327 - RNA, 19 nt, artificial
  Oligomer
ucuaguuuauacccuacug

SEQ ID NO: 33328 - RNA, 19 nt, artificial
  Oligomer
auuagaaaaacuaaagcug

SEQ ID NO: 33329 - RNA, 19 nt, artificial
  Oligomer
uuaaugauacagaauaaga

SEQ ID NO: 33330 - RNA, 19 nt, artificial
  Oligomer
uugcaaaacuacuugaauc

SEQ ID NO: 33331 - RNA, 19 nt, artificial
  Oligomer
uacuaauuagcuauaaucu

SEQ ID NO: 33332 - RNA, 19 nt, artificial
  Oligomer
uuccaggucaagacaaacc

SEQ ID NO: 33333 - RNA, 19 nt, artificial
  Oligomer
uuacacuuaacauaucuuu

SEQ ID NO: 33334 - RNA, 19 nt, artificial
  Oligomer
uugaugucugcagguacac

SEQ ID NO: 33335 - RNA, 19 nt, artificial
  Oligomer
uuccuaucagaacucacag

SEQ ID NO: 33336 - RNA, 19 nt, artificial
  Oligomer
auuuauuccuuuuucacac

SEQ ID NO: 33337 - RNA, 19 nt, artificial
  Oligomer
uacuaauacaauuagauca

SEQ ID NO: 33338 - RNA, 19 nt, artificial
  Oligomer
uucaguuuuccaccacaac

SEQ ID NO: 33339 - RNA, 19 nt, artificial
  Oligomer
uuuuauaauuuccaagagg

SEQ ID NO: 33340 - RNA, 19 nt, artificial
  Oligomer
aauuacauuaaaacccuug

SEQ ID NO: 33341 - RNA, 19 nt, artificial
  Oligomer
ugcaugacaacuaaagcac

SEQ ID NO: 33342 - RNA, 19 nt, artificial
  Oligomer
augauauauauacauccca

SEQ ID NO: 33343 - RNA, 19 nt, artificial
  Oligomer
uuaaauacgcuuucaaaaa

SEQ ID NO: 33344 - RNA, 19 nt, artificial
  Oligomer
uuuacaagugacuagaugu

SEQ ID NO: 33345 - RNA, 19 nt, artificial
  Oligomer
auacuuucuaaaaauucug

SEQ ID NO: 33346 - RNA, 19 nt, artificial
  Oligomer
uucgaauauuaagauuccg

SEQ ID NO: 33347 - RNA, 19 nt, artificial
  Oligomer
uucuuccuuauugaugucu

SEQ ID NO: 33348 - RNA, 19 nt, artificial
  Oligomer
uugaugauuguccuauuau

SEQ ID NO: 33349 - RNA, 19 nt, artificial
  Oligomer
acaaucucuaucuuuccac

SEQ ID NO: 33350 - RNA, 19 nt, artificial
  Oligomer
ucaaaagauagucugcaug

SEQ ID NO: 33351 - RNA, 19 nt, artificial
  Oligomer
auuauuuucuuaauguccu

SEQ ID NO: 33352 - RNA, 19 nt, artificial
  Oligomer
uaaggcaaaaugaucucug

SEQ ID NO: 33353 - RNA, 19 nt, artificial
  Oligomer
uauugcuucccauuuucuu

SEQ ID NO: 33354 - RNA, 19 nt, artificial
  Oligomer
uaagacaaugcuuuugauc

SEQ ID NO: 33355 - RNA, 19 nt, artificial
  Oligomer
uacauacauggucuccuug

SEQ ID NO: 33356 - RNA, 19 nt, artificial
  Oligomer
uucacuucgaauauuaaga

SEQ ID NO: 33357 - RNA, 19 nt, artificial
  Oligomer
uugguagcaaaugcuaaug

SEQ ID NO: 33358 - RNA, 19 nt, artificial
  Oligomer
uuuucuuaguuuuccacac

SEQ ID NO: 33359 - RNA, 19 nt, artificial
  Oligomer
uucuaagugaaaaaaacca

SEQ ID NO: 33360 - RNA, 19 nt, artificial
  Oligomer
uuauaaaaaauucgaacag

SEQ ID NO: 33361 - RNA, 19 nt, artificial
  Oligomer
uuuaaagucuagacuauac

SEQ ID NO: 33362 - RNA, 19 nt, artificial
  Oligomer
ucaguguuuucaauuccuc

SEQ ID NO: 33363 - RNA, 19 nt, artificial
  Oligomer
augaagucugacuugacuc

SEQ ID NO: 33364 - RNA, 19 nt, artificial
  Oligomer
uguaguaacaugccuuacu

SEQ ID NO: 33365 - RNA, 19 nt, artificial
  Oligomer
uuauuuuccuuucacagau

SEQ ID NO: 33366 - RNA, 19 nt, artificial
  Oligomer
uuaaaacccuuguuacauc

SEQ ID NO: 33367 - RNA, 19 nt, artificial
  Oligomer
uguaaaaugaaagaacugg

SEQ ID NO: 33368 - RNA, 19 nt, artificial
  Oligomer
ucuuccuuauugaugucug

SEQ ID NO: 33369 - RNA, 19 nt, artificial
  Oligomer
auuauauacacucacuaca

SEQ ID NO: 33370 - RNA, 19 nt, artificial
  Oligomer
uuaacugcccugccuucuu

SEQ ID NO: 33371 - RNA, 19 nt, artificial
  Oligomer
uucacagaugaauaaacug

SEQ ID NO: 33372 - RNA, 19 nt, artificial
  Oligomer
uucuuauucaaguguuuuu

SEQ ID NO: 33373 - RNA, 19 nt, artificial
  Oligomer
uaauacaauuagaucaguc

SEQ ID NO: 33374 - RNA, 19 nt, artificial
  Oligomer
aagauaaguauuauuuucc

SEQ ID NO: 33375 - RNA, 19 nt, artificial
  Oligomer
aguaacaugccuuacucac

SEQ ID NO: 33376 - RNA, 19 nt, artificial
  Oligomer
uuuaacaaguagauuugac

SEQ ID NO: 33377 - RNA, 19 nt, artificial
  Oligomer
ucuuugacaucuuuccaug

SEQ ID NO: 33378 - RNA, 19 nt, artificial
  Oligomer
ucaugugaaacuaaugcug

SEQ ID NO: 33379 - RNA, 19 nt, artificial
  Oligomer
uuuguaaaugcuaaaacca

SEQ ID NO: 33380 - RNA, 19 nt, artificial
  Oligomer
auuuacagcaggaacuuua

SEQ ID NO: 33381 - RNA, 19 nt, artificial
  Oligomer
aaucaguuagcccuccucc

SEQ ID NO: 33382 - RNA, 19 nt, artificial
  Oligomer
auguuaaaacaauucaguc

SEQ ID NO: 33383 - RNA, 19 nt, artificial
  Oligomer
uugugcauuaaauuucaca

SEQ ID NO: 33384 - RNA, 19 nt, artificial
  Oligomer
uuaauuaacuggaauuuag

SEQ ID NO: 33385 - RNA, 19 nt, artificial
  Oligomer
uaaaacaauucaguccuug

SEQ ID NO: 33386 - RNA, 19 nt, artificial
  Oligomer
uuucagaaguaucuacuac

SEQ ID NO: 33387 - RNA, 19 nt, artificial
  Oligomer
uuugaaacaagauaagaca

SEQ ID NO: 33388 - RNA, 19 nt, artificial
  Oligomer
uucauuuuacaaaaucaga

SEQ ID NO: 33389 - RNA, 19 nt, artificial
  Oligomer
aucucuaucuuuccaccag

SEQ ID NO: 33390 - RNA, 19 nt, artificial
  Oligomer
uugcauacugucuuucuga

SEQ ID NO: 33391 - RNA, 19 nt, artificial
  Oligomer
uuucaacuuuguacugacc

SEQ ID NO: 33392 - RNA, 19 nt, artificial
  Oligomer
uucucuugaaaauaggacu

SEQ ID NO: 33393 - RNA, 19 nt, artificial
  Oligomer
ucauuuacauuucacauug

SEQ ID NO: 33394 - RNA, 19 nt, artificial
  Oligomer
uaaucuauuaaacucuucu

SEQ ID NO: 33395 - RNA, 19 nt, artificial
  Oligomer
uucaccaguauaaagaaac

SEQ ID NO: 33396 - RNA, 19 nt, artificial
  Oligomer
uccaccacaacaaaagcac

SEQ ID NO: 33397 - RNA, 19 nt, artificial
  Oligomer
uuuaaaucagcaaaauacu

SEQ ID NO: 33398 - RNA, 19 nt, artificial
  Oligomer
ugaaaguuaugguacagug

SEQ ID NO: 33399 - RNA, 19 nt, artificial
  Oligomer
uuaagaaccugaagcaaca

SEQ ID NO: 33400 - RNA, 19 nt, artificial
  Oligomer
guuuauacccuacugauuc

SEQ ID NO: 33401 - RNA, 19 nt, artificial
  Oligomer
ugaauuugggaaauuccua

SEQ ID NO: 33402 - RNA, 19 nt, artificial
  Oligomer
uuauucacagaaaaauaag

SEQ ID NO: 33403 - RNA, 19 nt, artificial
  Oligomer
auuuuugcggaauuagaug

SEQ ID NO: 33404 - RNA, 19 nt, artificial
  Oligomer
uugaaaacauaaacauuug

SEQ ID NO: 33405 - RNA, 19 nt, artificial
  Oligomer
uuaaucuauuaaacucuuc

SEQ ID NO: 33406 - RNA, 19 nt, artificial
  Oligomer
auuaaauacgcuuucaaaa

SEQ ID NO: 33407 - RNA, 19 nt, artificial
  Oligomer
aaucacauuauauacacuc

SEQ ID NO: 33408 - RNA, 19 nt, artificial
  Oligomer
uaguucuuaccagacacuc

SEQ ID NO: 33409 - RNA, 19 nt, artificial
  Oligomer
ucaucuugcauacugucuu

SEQ ID NO: 33410 - RNA, 19 nt, artificial
  Oligomer
ucagaaauauuuuucaucc

SEQ ID NO: 33411 - RNA, 19 nt, artificial
  Oligomer
uuugagaagaauaaucuuu

SEQ ID NO: 33412 - RNA, 19 nt, artificial
  Oligomer
auuuauauacagaaagcuc

SEQ ID NO: 33413 - RNA, 19 nt, artificial
  Oligomer
uuugguguauaucuuucca

SEQ ID NO: 33414 - RNA, 19 nt, artificial
  Oligomer
uuacaagugacuagauguc

SEQ ID NO: 33415 - RNA, 19 nt, artificial
  Oligomer
auauuuuuaaggguuugac

SEQ ID NO: 33416 - RNA, 19 nt, artificial
  Oligomer
uuguaccauaggauuuugg

SEQ ID NO: 33417 - RNA, 19 nt, artificial
  Oligomer
auauuaguuauaaaguguc

SEQ ID NO: 33418 - RNA, 19 nt, artificial
  Oligomer
ucuuauucaaguguuuuuu

SEQ ID NO: 33419 - RNA, 19 nt, artificial
  Oligomer
auaucuuuccaaaucuuuu

SEQ ID NO: 33420 - RNA, 19 nt, artificial
  Oligomer
uuugcuugaaaguaaugac

SEQ ID NO: 33421 - RNA, 19 nt, artificial
  Oligomer
uucacaaauauaguacucu

SEQ ID NO: 33422 - RNA, 19 nt, artificial
  Oligomer
ucuaacagauauuugcacc

SEQ ID NO: 33423 - RNA, 19 nt, artificial
  Oligomer
uugguguauaucuuuccaa

SEQ ID NO: 33424 - RNA, 19 nt, artificial
  Oligomer
uuccaccacaacaaaagca

SEQ ID NO: 33425 - RNA, 19 nt, artificial
  Oligomer
ugaaaaaucaagaaauuca

SEQ ID NO: 33426 - RNA, 19 nt, artificial
  Oligomer
uaguuuucaacuuuguacu

SEQ ID NO: 33427 - RNA, 19 nt, artificial
  Oligomer
ucucuuagaaagcucaacu

SEQ ID NO: 33428 - RNA, 19 nt, artificial
  Oligomer
ucuacuuuuaccuacauaa

SEQ ID NO: 33429 - RNA, 19 nt, artificial
  Oligomer
uuuuuaaggguuugaccua

SEQ ID NO: 33430 - RNA, 19 nt, artificial
  Oligomer
uuauucuuagucuaugguu

SEQ ID NO: 33431 - RNA, 19 nt, artificial
  Oligomer
auuaaaucaguauacuaug

SEQ ID NO: 33432 - RNA, 19 nt, artificial
  Oligomer
auuaacucuaaucuccaca

SEQ ID NO: 33433 - RNA, 19 nt, artificial
  Oligomer
ugaugcuucuuauucuuag

SEQ ID NO: 33434 - RNA, 19 nt, artificial
  Oligomer
auuugcacccuggauacca

SEQ ID NO: 33435 - RNA, 19 nt, artificial
  Oligomer
uaagaaagugguaaacucc

SEQ ID NO: 33436 - RNA, 19 nt, artificial
  Oligomer
uucucuaacagcaaugaua

SEQ ID NO: 33437 - RNA, 19 nt, artificial
  Oligomer
uccaacugcugagucucca

SEQ ID NO: 33438 - RNA, 19 nt, artificial
  Oligomer
uugaaucuuugcaugacua

SEQ ID NO: 33439 - RNA, 19 nt, artificial
  Oligomer
uuacuuaaagucaguucac

SEQ ID NO: 33440 - RNA, 19 nt, artificial
  Oligomer
uuuauauauucuugucccu

SEQ ID NO: 33441 - RNA, 19 nt, artificial
  Oligomer
uuauacccuacugauucuu

SEQ ID NO: 33442 - RNA, 19 nt, artificial
  Oligomer
uuuauuucagaaguaucua

SEQ ID NO: 33443 - RNA, 19 nt, artificial
  Oligomer
auugaagugggaaaaagcc

SEQ ID NO: 33444 - RNA, 19 nt, artificial
  Oligomer
uuaacucuaaacauacaag

SEQ ID NO: 33445 - RNA, 19 nt, artificial
  Oligomer
uuuccucuguaguaacaug

SEQ ID NO: 33446 - RNA, 19 nt, artificial
  Oligomer
uauauucuugucccuucug

SEQ ID NO: 33447 - RNA, 19 nt, artificial
  Oligomer
uaucuuaucuaugagaaac

SEQ ID NO: 33448 - RNA, 19 nt, artificial
  Oligomer
acuauuuucaagauaaaag

SEQ ID NO: 33449 - RNA, 19 nt, artificial
  Oligomer
ugucacuauaacuacaagc

SEQ ID NO: 33450 - RNA, 19 nt, artificial
  Oligomer
uugguuuaaaaauaauugc

SEQ ID NO: 33451 - RNA, 19 nt, artificial
  Oligomer
uuggaagaugguaucauca

SEQ ID NO: 33452 - RNA, 19 nt, artificial
  Oligomer
aaauauaguacucugucuc

SEQ ID NO: 33453 - RNA, 19 nt, artificial
  Oligomer
aaaugaucaauuuuugcgg

SEQ ID NO: 33454 - RNA, 19 nt, artificial
  Oligomer
uuaauguccuugaaacuga

SEQ ID NO: 33455 - RNA, 19 nt, artificial
  Oligomer
aaaauuaagacaaugcuuu

SEQ ID NO: 33456 - RNA, 19 nt, artificial
  Oligomer
uuauaguaugaugcuucuu

SEQ ID NO: 33457 - RNA, 19 nt, artificial
  Oligomer
auaauguaugcacaucuuc

SEQ ID NO: 33458 - RNA, 19 nt, artificial
  Oligomer
auuuuaaugaagugcggcu

SEQ ID NO: 33459 - RNA, 19 nt, artificial
  Oligomer
uacauggucuccuugagcu

SEQ ID NO: 33460 - RNA, 19 nt, artificial
  Oligomer
aaaacaaucucuaucuuuc

SEQ ID NO: 33461 - RNA, 19 nt, artificial
  Oligomer
uacuuauugcaaaacuacu

SEQ ID NO: 33462 - RNA, 19 nt, artificial
  Oligomer
cuuaucuaugagaaacacc

SEQ ID NO: 33463 - RNA, 19 nt, artificial
  Oligomer
auuuucuuaguuuuccaca

SEQ ID NO: 33464 - RNA, 19 nt, artificial
  Oligomer
uacugaguuaacaaagauc

SEQ ID NO: 33465 - RNA, 19 nt, artificial
  Oligomer
ucauguaagaauuuuuucu

SEQ ID NO: 33466 - RNA, 19 nt, artificial
  Oligomer
uuguuuacaagugacuaga

SEQ ID NO: 33467 - RNA, 19 nt, artificial
  Oligomer
uugagaagaauaaucuuuu

SEQ ID NO: 33468 - RNA, 19 nt, artificial
  Oligomer
ucaaaguagaaucugacca

SEQ ID NO: 33469 - RNA, 19 nt, artificial
  Oligomer
cuuuccaccagcauggaac

SEQ ID NO: 33470 - RNA, 19 nt, artificial
  Oligomer
uaucauuaaauacgcuuuc

SEQ ID NO: 33471 - RNA, 19 nt, artificial
  Oligomer
ugauaaaucugcaauuugg

SEQ ID NO: 33472 - RNA, 19 nt, artificial
  Oligomer
uuuuaguaaagugacuuag

SEQ ID NO: 33473 - RNA, 19 nt, artificial
  Oligomer
uacacuuaacauaucuuug

SEQ ID NO: 33474 - RNA, 19 nt, artificial
  Oligomer
uacaucaccuuugagucuc

SEQ ID NO: 33475 - RNA, 19 nt, artificial
  Oligomer
uaguuauaaagugucauuu

SEQ ID NO: 33476 - RNA, 19 nt, artificial
  Oligomer
uugagucucaguugccuca

SEQ ID NO: 33477 - RNA, 19 nt, artificial
  Oligomer
uuuuucaccuucaaacuau

SEQ ID NO: 33478 - RNA, 19 nt, artificial
  Oligomer
uucuuaccagacacuccuc

SEQ ID NO: 33479 - RNA, 19 nt, artificial
  Oligomer
uauagaguuagauuaagac

SEQ ID NO: 33480 - RNA, 19 nt, artificial
  Oligomer
uguacauuuuuuuuccuac

SEQ ID NO: 33481 - RNA, 19 nt, artificial
  Oligomer
uguaugcacaucuucauca

SEQ ID NO: 33482 - RNA, 19 nt, artificial
  Oligomer
uucuggauaccagaauuug

SEQ ID NO: 33483 - RNA, 19 nt, artificial
  Oligomer
ucuacuuugaagauacaau

SEQ ID NO: 33484 - RNA, 19 nt, artificial
  Oligomer
uuuuuuccuacuugguagc

SEQ ID NO: 33485 - RNA, 19 nt, artificial
  Oligomer
uuuuaaggguuugaccuau

SEQ ID NO: 33486 - RNA, 19 nt, artificial
  Oligomer
uuuauaauuuccaagaggu

SEQ ID NO: 33487 - RNA, 19 nt, artificial
  Oligomer
aaguuuuucaccuucaaac

SEQ ID NO: 33488 - RNA, 19 nt, artificial
  Oligomer
uuaaagucuagacuauaca

SEQ ID NO: 33489 - RNA, 19 nt, artificial
  Oligomer
uauugaagugggaaaaagc

SEQ ID NO: 33490 - RNA, 19 nt, artificial
  Oligomer
uuuccuuucacagaugaau

SEQ ID NO: 33491 - RNA, 19 nt, artificial
  Oligomer
accaaaaagguuaacugcc

SEQ ID NO: 33492 - RNA, 19 nt, artificial
  Oligomer
ugacucaucuugcauacug

SEQ ID NO: 33493 - RNA, 19 nt, artificial
  Oligomer
uagcauguuguucccaagg

SEQ ID NO: 33494 - RNA, 19 nt, artificial
  Oligomer
uuuuacaguuuuacucuca

SEQ ID NO: 33495 - RNA, 19 nt, artificial
  Oligomer
cuuaaagucaguucacauc

SEQ ID NO: 33496 - RNA, 19 nt, artificial
  Oligomer
uuacucaccucuacaauag

SEQ ID NO: 33497 - RNA, 19 nt, artificial
  Oligomer
uugcaaagcuucuccucuu

SEQ ID NO: 33498 - RNA, 19 nt, artificial
  Oligomer
uguugaauuugggaaauuc

SEQ ID NO: 33499 - RNA, 19 nt, artificial
  Oligomer
uccuugagcucuugcaacc

SEQ ID NO: 33500 - RNA, 19 nt, artificial
  Oligomer
augcuuuugaucagcagac

SEQ ID NO: 33501 - RNA, 19 nt, artificial
  Oligomer
ucucaguugccucaccugu

SEQ ID NO: 33502 - RNA, 19 nt, artificial
  Oligomer
uuuuuacaguuuuacucuc

SEQ ID NO: 33503 - RNA, 19 nt, artificial
  Oligomer
uuuaguuuguaaaugcuaa

SEQ ID NO: 33504 - RNA, 19 nt, artificial
  Oligomer
uccuauauacaucuuaauc

SEQ ID NO: 33505 - RNA, 19 nt, artificial
  Oligomer
uugauaaaucugcaauuug

SEQ ID NO: 33506 - RNA, 19 nt, artificial
  Oligomer
uuuguuaagccuaucugaa

SEQ ID NO: 33507 - RNA, 19 nt, artificial
  Oligomer
auacauggucuccuugagc

SEQ ID NO: 33508 - RNA, 19 nt, artificial
  Oligomer
uuuacacuuaacauaucuu

SEQ ID NO: 33509 - RNA, 19 nt, artificial
  Oligomer
auuaagacaaugcuuuuga

SEQ ID NO: 33510 - RNA, 19 nt, artificial
  Oligomer
auucuaucauuaaauacgc

SEQ ID NO: 33511 - RNA, 19 nt, artificial
  Oligomer
uguacaaacaugcuucuac

SEQ ID NO: 33512 - RNA, 19 nt, artificial
  Oligomer
uugaacuaccuaccugacu

SEQ ID NO: 33513 - RNA, 19 nt, artificial
  Oligomer
uaccugucaaaaaacuacc

SEQ ID NO: 33514 - RNA, 19 nt, artificial
  Oligomer
uguaauguaaacccuggac

SEQ ID NO: 33515 - RNA, 19 nt, artificial
  Oligomer
uuguacugaccauucugga

SEQ ID NO: 33516 - RNA, 19 nt, artificial
  Oligomer
uucuaacagauauuugcac

SEQ ID NO: 33517 - RNA, 19 nt, artificial
  Oligomer
uaaucuuugcacaaauuac

SEQ ID NO: 33518 - RNA, 19 nt, artificial
  Oligomer
uuaaggaugaauccuuacu

SEQ ID NO: 33519 - RNA, 19 nt, artificial
  Oligomer
auuacaucaccuuugaguc

SEQ ID NO: 33520 - RNA, 19 nt, artificial
  Oligomer
uugagagaacauuuauuuc

SEQ ID NO: 33521 - RNA, 19 nt, artificial
  Oligomer
uucaagaaagguagcuugg

SEQ ID NO: 33522 - RNA, 19 nt, artificial
  Oligomer
auuagcuauaaucuuugca

SEQ ID NO: 33523 - RNA, 19 nt, artificial
  Oligomer
uguauaucuuuccaaaucu

SEQ ID NO: 33524 - RNA, 19 nt, artificial
  Oligomer
uuucaguuuuccaccacaa

SEQ ID NO: 33525 - RNA, 19 nt, artificial
  Oligomer
cuggauaccauuuagcaug

SEQ ID NO: 33526 - RNA, 19 nt, artificial
  Oligomer
uacacuuagaaauuaaauc

SEQ ID NO: 33527 - RNA, 19 nt, artificial
  Oligomer
uuuggaagaugguaucauc

SEQ ID NO: 33528 - RNA, 19 nt, artificial
  Oligomer
uaaauuuaaagucuagacu

SEQ ID NO: 33529 - RNA, 19 nt, artificial
  Oligomer
uugaaauccuagagugaac

SEQ ID NO: 33530 - RNA, 19 nt, artificial
  Oligomer
aaaaagguuaacugcccug

SEQ ID NO: 33531 - RNA, 19 nt, artificial
  Oligomer
uccuugguugaauccaugg

SEQ ID NO: 33532 - RNA, 19 nt, artificial
  Oligomer
ucauauuuacagcaggaac

SEQ ID NO: 33533 - RNA, 19 nt, artificial
  Oligomer
uuguaauguaaacccugga

SEQ ID NO: 33534 - RNA, 19 nt, artificial
  Oligomer
uuaauucacuuacacuuag

SEQ ID NO: 33535 - RNA, 19 nt, artificial
  Oligomer
uaccauaggauuuuggaag

SEQ ID NO: 33536 - RNA, 19 nt, artificial
  Oligomer
uuugcaauguuuuaaauga

SEQ ID NO: 33537 - RNA, 19 nt, artificial
  Oligomer
auaaacauuuggaccuuuc

SEQ ID NO: 33538 - RNA, 19 nt, artificial
  Oligomer
uucucaaaagauagucugc

SEQ ID NO: 33539 - RNA, 19 nt, artificial
  Oligomer
ucuauaacucuguuaugcu

SEQ ID NO: 33540 - RNA, 19 nt, artificial
  Oligomer
uuuaccuacauaagcugac

SEQ ID NO: 33541 - RNA, 19 nt, artificial
  Oligomer
aggaacuuuacauacaugg

SEQ ID NO: 33542 - RNA, 19 nt, artificial
  Oligomer
uuuaaggguuugaccuauu

SEQ ID NO: 33543 - RNA, 19 nt, artificial
  Oligomer
uucacuuacacuuagaaau

SEQ ID NO: 33544 - RNA, 19 nt, artificial
  Oligomer
uauagcuucuuguaccaua

SEQ ID NO: 33545 - RNA, 19 nt, artificial
  Oligomer
uaaaauaaacuuguuagcc

SEQ ID NO: 33546 - RNA, 19 nt, artificial
  Oligomer
ucacauuauauacacucac

SEQ ID NO: 33547 - RNA, 19 nt, artificial
  Oligomer
uucaaguuaaugacuauau

SEQ ID NO: 33548 - RNA, 19 nt, artificial
  Oligomer
uuaaaauacugaguuaaca

SEQ ID NO: 33549 - RNA, 19 nt, artificial
  Oligomer
uauaguuuugacuuugcaa

SEQ ID NO: 33550 - RNA, 19 nt, artificial
  Oligomer
uuauauacagaaagcucca

SEQ ID NO: 33551 - RNA, 19 nt, artificial
  Oligomer
ucccagaacaggaaaagcc

SEQ ID NO: 33552 - RNA, 19 nt, artificial
  Oligomer
auaagaacaacauaacaug

SEQ ID NO: 33553 - RNA, 19 nt, artificial
  Oligomer
uuucuuacuaaauccagaa

SEQ ID NO: 33554 - RNA, 19 nt, artificial
  Oligomer
uauuuucaagauaaaagcc

SEQ ID NO: 33555 - RNA, 19 nt, artificial
  Oligomer
uuuccaccacaacaaaagc

SEQ ID NO: 33556 - RNA, 19 nt, artificial
  Oligomer
auucuugucccuucuguuc

SEQ ID NO: 33557 - RNA, 19 nt, artificial
  Oligomer
uguucuaacagauauuugc

SEQ ID NO: 33558 - RNA, 19 nt, artificial
  Oligomer
uuaaugacuauauaaccaa

SEQ ID NO: 33559 - RNA, 19 nt, artificial
  Oligomer
aguguuuucaauuccuccu

SEQ ID NO: 33560 - RNA, 19 nt, artificial
  Oligomer
auucacagaaaaauaagcu

SEQ ID NO: 33561 - RNA, 19 nt, artificial
  Oligomer
ucuuucuguaaugaagucu

SEQ ID NO: 33562 - RNA, 19 nt, artificial
  Oligomer
aauucaaagauuauauugc

SEQ ID NO: 33563 - RNA, 19 nt, artificial
  Oligomer
uugaucagcagacuaaauu

SEQ ID NO: 33564 - RNA, 19 nt, artificial
  Oligomer
uacaaauucuucuuccuua

SEQ ID NO: 33565 - RNA, 19 nt, artificial
  Oligomer
uuuaaaauacugaguuaac

SEQ ID NO: 33566 - RNA, 19 nt, artificial
  Oligomer
uuccuuucacagaugaaua

SEQ ID NO: 33567 - RNA, 19 nt, artificial
  Oligomer
uuagcaaaaguuuuuaauc

SEQ ID NO: 33568 - RNA, 19 nt, artificial
  Oligomer
ucagauucaaaguagaauc

SEQ ID NO: 33569 - RNA, 19 nt, artificial
  Oligomer
uuacauacauggucuccuu

SEQ ID NO: 33570 - RNA, 19 nt, artificial
  Oligomer
ucuguaaugaagucugacu

SEQ ID NO: 33571 - RNA, 19 nt, artificial
  Oligomer
uuaguuauaaagugucauu

SEQ ID NO: 33572 - RNA, 19 nt, artificial
  Oligomer
uucuguaaugaagucugac

SEQ ID NO: 33573 - RNA, 19 nt, artificial
  Oligomer
uaauucgcacaaguacgug

SEQ ID NO: 33574 - RNA, 19 nt, artificial
  Oligomer
aauuagaucagucagucag

SEQ ID NO: 33575 - RNA, 19 nt, artificial
  Oligomer
uuuuuuccuccauuauuuu

SEQ ID NO: 33576 - RNA, 19 nt, artificial
  Oligomer
uuaaucauccuaacgguaa

SEQ ID NO: 33577 - RNA, 19 nt, artificial
  Oligomer
uuaggaugggaguucauau

SEQ ID NO: 33578 - RNA, 19 nt, artificial
  Oligomer
uugaugcugaaacaggacu

SEQ ID NO: 33579 - RNA, 19 nt, artificial
  Oligomer
uugguugaauccauggaug

SEQ ID NO: 33580 - RNA, 19 nt, artificial
  Oligomer
ugcuuaacucuaaacauac

SEQ ID NO: 33581 - RNA, 19 nt, artificial
  Oligomer
uaaaaaauccagaugauua

SEQ ID NO: 33582 - RNA, 19 nt, artificial
  Oligomer
uuaauuggaagaucugaga

SEQ ID NO: 33583 - RNA, 19 nt, artificial
  Oligomer
auucacuagaucugcaacc

SEQ ID NO: 33584 - RNA, 19 nt, artificial
  Oligomer
aagaauuuuaaugaagugc

SEQ ID NO: 33585 - RNA, 19 nt, artificial
  Oligomer
uacaucuuaaucauccuaa

SEQ ID NO: 33586 - RNA, 19 nt, artificial
  Oligomer
auguaugcacaucuucauc

SEQ ID NO: 33587 - RNA, 19 nt, artificial
  Oligomer
auucaaagauuauauugcc

SEQ ID NO: 33588 - RNA, 19 nt, artificial
  Oligomer
aacauaacaauacucuuuc

SEQ ID NO: 33589 - RNA, 19 nt, artificial
  Oligomer
uuuacagcaggaacuuuac

SEQ ID NO: 33590 - RNA, 19 nt, artificial
  Oligomer
uuacaaaaguaauacauac

SEQ ID NO: 33591 - RNA, 19 nt, artificial
  Oligomer
uaccacuuggaaaauuagc

SEQ ID NO: 33592 - RNA, 19 nt, artificial
  Oligomer
auuacuuaaagucaguuca

SEQ ID NO: 33593 - RNA, 19 nt, artificial
  Oligomer
ucuuauucuuagucuaugg

SEQ ID NO: 33594 - RNA, 19 nt, artificial
  Oligomer
uuuaaucuagcuucuucac

(The sequence listing continues in the following parts.)

The invention claimed is:

1. A double-stranded oligonucleotide having the structure:

```
5' iB-GCCAGAAUGUGGAACUCCU 3' (sense strand; SEQ ID
NO: 9015)

3'    CGGUCUUACACCUUGAGGA 5' (antisense strand;
SEQ ID NO: 9516)
``` wherein each of A, C, U, and G is a nucleotide and each consecutive nucleotide is joined to the next nucleotide by a phosphodiester bond;

wherein the sense strand comprises, counting from the 5' terminus, an unmodified ribonucleotide at each of positions 1, 2, 3, 4, 5, 6, 7, 8, 9, 10, 11, 12, 13, 14, 15, 16, 17 and 19, a L-deoxycytidine at position 18, and an inverted deoxyabasic moiety (iB) covalently attached at the 5'terminus; and wherein the antisense strand comprises, counting from the 5' terminus, a 2'-O-Methyl sugar-modified ribonucleotide at each of positions 2, 4, 6, 8, 11, 13, 15, 17 and 19 and an unmodified ribonucleotide at each of positions 1, 3, 5, 7, 9, 10, 12, 14, 16 and 18; or a pharmaceutically acceptable salt of the double-stranded oligonucleotide.

2. A composition comprising the double-stranded oligonucleotide or a pharmaceutically acceptable salt of the double-stranded oligonucleotide according to claim 1; and a pharmaceutically acceptable carrier.

3. The double-stranded oligonucleotide according to claim 1.

4. A pharmaceutically acceptable salt of the double-stranded oligonucleotide according to claim 1.

5. The composition according to claim 2 comprising the double-stranded oligonucleotide.

6. The composition of claim 2 comprising a pharmaceutically acceptable salt of the double-stranded oligonucleotide.

7. A composition comprising the double-stranded oligonucleotide or a pharmaceutically acceptable salt of double-stranded oligonucleotide according to claim 1, in an amount effective to down-regulate expression of a CASP2 gene; and a pharmaceutically acceptable carrier.

8. The composition of claim 7 comprising the double-stranded oligonucleotide.

9. The composition of claim 7 comprising a pharmaceutically acceptable salt of the double-stranded oligonucleotide.

* * * * *